United States Patent
Wu et al.

(10) Patent No.: US 9,029,636 B2
(45) Date of Patent: May 12, 2015

(54) ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS

(75) Inventors: Wei Wu, Chesterfield, MO (US); Jack Tabaska, O'Fallon, MO (US); David Kovalic, Clayton, MO (US); Bo-Xing Qiu, Chesterfield, MO (US); Liang Guo, Saint Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 1262 days.

(21) Appl. No.: 12/864,690

(22) PCT Filed: Feb. 2, 2009

(86) PCT No.: PCT/US2009/000655
§ 371 (c)(1),
(2), (4) Date: Jul. 27, 2010

(87) PCT Pub. No.: WO2009/099580
PCT Pub. Date: Aug. 13, 2009

(65) Prior Publication Data
US 2013/0333061 A1    Dec. 12, 2013

Related U.S. Application Data

(60) Provisional application No. 61/063,633, filed on Feb. 5, 2008.

(51) Int. Cl.
| | |
|---|---|
| *C12N 15/82* | (2006.01) |
| *A01H 5/00* | (2006.01) |
| *C12N 5/10* | (2006.01) |
| *C12N 15/00* | (2006.01) |
| *C07H 21/04* | (2006.01) |
| *C07K 14/415* | (2006.01) |
| *A01H 5/10* | (2006.01) |

(52) U.S. Cl.
CPC .......... *C12N 15/8274* (2013.01); *C07K 14/415* (2013.01); *A01H 5/10* (2013.01); *C12N 15/8273* (2013.01)

(58) Field of Classification Search
None
See application file for complete search history.

(56) References Cited

U.S. PATENT DOCUMENTS

| | | | |
|---|---|---|---|
| 2004/0031072 A1* | 2/2004 | La Rosa et al. | 800/278 |
| 2004/0034888 A1* | 2/2004 | Liu et al. | 800/289 |
| 2006/0179511 A1 | 8/2006 | Chomet et al. | |
| 2007/0294782 A1 | 12/2007 | Abad et al. | |

FOREIGN PATENT DOCUMENTS

WO    WO 99/64600    * 12/1999

OTHER PUBLICATIONS

Komjanc Plant Mol Biol 40 945 1999.*
Shiu Plant Phys 132 530 2003.*
Stein Plant Physiol 101 1103 1993.*
Morillo Curr Opin Plant Biol 9 460 2006.*
Champion Funct Integr Gnmcs 4 163 2004.*
Arabidopsis Genome Nature 408 796 2000.*
Guo Proc Natl Acad Sci 101 9205 2004.*
Kovalchuk_EMBO J_19_17_4431_2000.*
Feschotte_Nat Rvw Genet_3_329_2002.*
Mallory_Trends Plant Sci 13_359_2008.*
Tuskan et al., "The Genome of Black Cottonwood, *Populus trichocarpa* (Torr. & Gray)" Science Sep. 15, 2006, 313:1596-1604.
Genome.jgi-psf.org entry eugene3.00061538 (Sep. 15, 2006) (Retrieved from the Internet on Jan. 2, 2010) <http://www.genome.jgi-psf.org/cgi-in/blastoutput?db=poptr1_1&jobId=1517526&jobToken=1620473425>.

* cited by examiner

*Primary Examiner* — Medina A Ibrahim
*Assistant Examiner* — Russell Boggs
(74) *Attorney, Agent, or Firm* — Lawrence M. Lavin, Jr.; David R. Marsh; Arnold & Porter LLP

(57) ABSTRACT

This disclosure provides purified nucleic acids and polypeptides. Also provided are transgenic plants, seeds, and plant cells containing DNA for expression of the proteins that are useful for imparting enhanced agronomic trait(s) to transgenic crop plants, methods of making such plants and methods of making agricultural commodity including seeds and hybrid seeds from such plants.

23 Claims, No Drawings

ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS

CROSS REFERENCE TO RELATED APPLICATIONS

This patent application claims priority (as a U.S. National Phase Application filed under 35 U.S.C. §371) to International Patent Application No. PCT/US2009/000655 (filed Feb. 2, 2009), which in turn claims priority to U.S. Application No. 61/063,633 (filed Feb. 5, 2008). The entire text of each of these priority patent applications is incorporated by reference into this patent.

FIELD OF THE INVENTION

Disclosed herein are inventions in the field of plant genetics and developmental biology. More specifically, this invention provides novel compositions of soy DNA and peptide molecules. Also disclosed are plants comprising recombinant DNA providing one or more enhanced traits in a transgenic plant, including cells, seed, and pollen derived from such a plant, as well as methods of making and using such plant.

INCORPORATION-BY-REFERENCE OF MATERIALS FILED ON COMPACT DISC

A sequence listing having the file name "38-21(55306)B-0001_SeqListing.txt" which has 370,353,645 bytes (measured in MS-WINDOWS) was created on Jul. 27, 2010 and has 233556 sequences is enclosed herewith in computer readable format and is herein incorporated by reference.

SUMMARY OF THE INVENTION

Certain embodiments of the disclosed invention provide recombinant DNA constructs having polynucleotides characterized by reference to SEQ ID NO:1-116778 and the cognate proteins with amino acid sequences having reference to SEQ ID NO:116779-233556. The recombinant DNA constructs are used in aspects of the various embodiments of the invention to provide enhanced traits when stably integrated into the chromosomes and expressed in the nuclei of transgenic plants cells. In many aspects of these embodiments, the recombinant DNA constructs, when expressed in a plant cell, provide for expression of cognate proteins. In particular aspects of the invention the recombinant DNA constructs for expressing cognate proteins are characterized by cognate amino acid sequence that have at least 95% identity over at least 95% of the length of a reference sequence selected from the group consisting of SEQ ID NOs: 116779-233556 when the amino acid sequence is aligned to the reference sequence. In some aspects of the invention, the recombinant DNA constructs are characterized as being constructed with sense-oriented and/or anti-sense-oriented polynucleotides from the group consisting of SEQ ID NOs: 1-116778 which, when expressed in a plant cell, provide for the suppression of cognate proteins having amino acid sequences that have at least 95% identity over at least 95% of the length of a reference sequence selected from the group consisting of SEQ ID NOs: 116779-233556.

In certain aspects of this invention the recombinant DNA constructs of the invention are stably integrated into the chromosome of a plant cell nucleus.

Certain aspects of this embodiment of the invention provide transgenic plant cells having stably integrated recombinant DNA constructs, transgenic plants and seeds comprising a plurality of such transgenic plant cells and transgenic pollen of such plants. Such transgenic plants can be selected from a population of transgenic plants regenerated from plant cells transformed with recombinant DNA constructs by screening transgenic plants for an enhanced trait as compared to control plants. The enhanced trait provided may include, but is not limited to, enhanced water use efficiency, enhanced cold tolerance, increased yield, enhanced nitrogen use efficiency, altered seed protein composition, altered seed oil composition, or any combinations thereof.

Other embodiments of the invention provide for plant cells, plants, seeds, and pollen that can further comprise DNA expressing a protein that provides tolerance from exposure to an herbicide applied at levels that are lethal to a wild type plant cell.

Embodiments of the invention also provide methods for manufacturing non-natural, transgenic seed that can be used to produce a crop of transgenic plants with an enhanced trait resulting from expression of a stably-integrated recombinant DNA construct. The methods may comprise one or more of the following steps: (a) screening a population of plants for an enhanced trait and a recombinant DNA construct, where individual plants in the population can exhibit the trait at a level less than, essentially the same as or greater than the level that the trait is exhibited in control plants, (b) selecting from the population one or more plants that exhibit the trait at a level greater than the level that said trait is exhibited in control plants, (c) collecting seed from a selected plant, (d) verifying that the recombinant DNA is stably integrated in said selected plants, (e) analyzing tissue of a selected plant to determine the production or suppression of a protein having the function of a protein encoded by nucleotides in at least one sequence selected from SEQ ID NOs:1-116778. In certain embodiments of the invention, the plants in the population further include DNA expressing a protein that provides tolerance to exposure to a herbicide applied at levels that are lethal to wild type plant cells and the selecting is affected by treating the population with the herbicide, e.g. a glyphosate, dicamba, or glufosinate compound. In another embodiment of the invention, the plants are selected by identifying plants with the enhanced trait. The methods can be used for the manufacturing corn, soybean, cotton, canola, alfalfa, wheat, rice, sugarcane or sugar beet seed. In other embodiments of the present invention, the methods can also be used for manufacture transgenic plants including, but are not limited to, millet, barley, peanut, pigeon pea, sorghum, vegetables (including but not limited to Broccoli, Cauliflower, Cabbage, Radish, Chinese cabbage, Melons, Watermelons, Cucumber, Gourds, Pumpkin, Squash, Pepper, Tomato, Eggplant, Onion, Carrot, Garden Bean, Sweet Corn, Pea, Dry Bean, Okra, Spinach, Leek, Lettuce, and Fennel), grape, berries (including blue, black, raspberry, mullberry, boisenberry, etc), cherry and related fruit trees (including but not limited to plum, peach, apricot, kiwi, pomegranate, mango, fig), fruit trees (including but not limited to orange, lemon, lime, blood orange, grapefruit, and the like), and nut trees (including but not limited to coconut, walnut (English and black), pecan, almond, hazelnut, brazil nut, hickory nut, acorn, and the like) and sunflower, other oilseed producing plants or any combinations thereof.

Other embodiments of the invention provide a methods for producing hybrid corn seed by acquiring hybrid corn seed from a herbicide tolerant corn plant which also has stably-integrated, recombinant DNA construct having a promoter that is (a) functional in plant cells and (b) is operably linked to DNA that encodes or suppresses a protein having the function of a protein encoded by nucleotides in at least one sequence selected from the group consisting of SEQ ID NOs:1-116778. The methods of these embodiments may further include producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; selecting corn plants which are homozygous and hemizygous for said recombinant DNA by treating with an herbicide; collecting seed from herbicide-treated-surviving corn plants and planting said seed to produce further progeny corn plants; repeating the selecting and collecting steps at least once to produce an inbred corn line; and crossing the inbred corn line with a second corn line to produce hybrid seed.

Other embodiments of the invention provide methods for selecting a plant comprising plant cells of the invention by using an immunoreactive antibody to detect the presence or absence of protein expressed or suppressed by recombinant DNA in seed or plant tissue. Another embodiment of the invention provides anti-counterfeit milled seed having, as an indication of origin, plant cells of this invention.

Still other embodiments of this invention provide for transgenic plants with enhanced water use efficiency or enhanced nitrogen use efficiency. For example, this invention provides methods of growing a corn, cotton, soybean, or canola crop without irrigation water by planting seed having plant cells of the invention which are selected for enhanced water use efficiency. Alternatively embodiments of these methods include applying reduced irrigation water, e.g. providing up to 300 millimeters of ground water during the production of a corn crop. This invention also provides methods of growing a corn, cotton, soybean or canola crop without added nitrogen fertilizer by planting seed having plant cells of the invention which are selected for enhanced nitrogen use efficiency.

Other embodiments of the invention provide mixtures comprising plants cells and an antibody to a protein produced in the cells where the protein has an amino acid sequence that has at least 95% identity over at least 95% of the length of a reference sequence selected from the group consisting of SEQ ID NO: 116779-233556 when the sequence is aligned to the reference sequence.

ILLUSTRATIVE EMBODIMENTS OF THE INVENTION

While the making and using of various embodiments of the present invention are discussed in detail below, it should be appreciated that the present invention provides many applicable inventive concepts that can be embodied in a wide variety of specific contexts. The specific embodiments discussed herein are merely illustrative of specific ways to make and use the invention and do not delimit the scope of the invention.

To facilitate the understanding of this invention, a number of terms are defined below. Terms defined herein have meanings as commonly understood by a person of ordinary skill in the areas relevant to the present invention. Terms such as "a", "an" and "the" are not intended to refer to only a singular entity, but include the general class of which a specific example may be used for illustration. The terminology herein is used to describe specific embodiments of the invention, but their usage does not delimit the invention, except as outlined in the claims.

In the attached sequence listing:

SEQ ID NO:1-116778 are nucleotide sequences of the coding strand of DNA for "genes" used in the recombinant DNA imparting an enhanced trait in plant cells, e.g. each comprises a coding sequence for a protein;

SEQ ID NO: 116779-233556 are amino acid sequences of the cognate protein of the "genes" with nucleotide coding sequences provided by SEQ ID NO: 1-116778;

As used herein, a "plant cell" means a plant cell that is transformed with stably-integrated, non-natural, recombinant DNA, e.g. by *Agrobacterium*-mediated transformation or by bombardment using microparticles coated with recombinant DNA or other means. A plant cell of this invention can be an originally-transformed plant cell that exists as a microorganism or as a progeny plant cell that is duplicated by regeneration into differentiated tissue, e.g. into a transgenic plant with stably-integrated, non-natural recombinant DNA, or seed or pollen derived from a progeny transgenic plant.

As used herein, a "transgenic plant" means a plant whose genome has been altered by the stable integration of recombinant DNA. A transgenic plant includes a plant regenerated from an originally-transformed plant cell and progeny transgenic plants from later generations or crosses of a transformed plant.

A "consensus amino acid sequence" means an artificial, amino acid sequence indicating conserved amino acids in the sequence of homologous proteins as determined by statistical analysis of an optimal alignment, e.g. CLUSTALW, of amino acid sequence of homolog proteins. The consensus sequences listed in the sequence listing were created by identifying the most frequent amino acid at each position in a set of aligned protein sequences. When there was 100% identity in an alignment the amino acid is indicated by a capital letter. When the occurrence of an amino acid is at least about 70% in an alignment, the amino acid is indicated by a lower case letter. When there is no amino acid occurrence of at least about 70%, e.g. due to diversity or gaps, the amino acid is indicated by an "x". When used to defined embodiments of the invention, a consensus amino acid sequence will be aligned with a query protein amino acid sequence in an optimal alignment, e.g. CLUSTALW. An embodiment of the invention will have identity to the conserved amino acids indicated in the consensus amino acid sequence.

As used herein, "control plant" means a plant that does not contain the recombinant DNA that expressed a protein which imparts an enhanced trait. A control plant is to identify and select a transgenic plant that has an enhance trait. A suitable control plant can be a non-transgenic plant of the parental line used to generate a transgenic plant, e.g., devoid of recombinant DNA. A suitable control plant can in some cases be a progeny of a hemizygous transgenic plant line that is does not contain the recombinant DNA, known as a negative segregant.

As used herein, an "enhanced trait" means a characteristic of a transgenic plant that includes, but is not limited to, an enhance agronomic trait characterized by enhanced plant morphology, physiology, growth and development, yield, nutritional enhancement, disease or pest resistance, or environmental or chemical tolerance. In more specific aspects of this invention enhanced trait is selected from group of enhanced traits consisting of enhanced water use efficiency, enhanced cold tolerance, increased yield, enhanced nitrogen use efficiency, enhanced seed protein and enhanced seed oil. In an important aspect of the invention the enhanced trait is enhanced yield including increased yield under non-stress conditions and increased yield under environmental stress conditions. Stress conditions can include, for example, drought, shade, fungal disease, viral disease, bacterial disease, insect infestation, nematode infestation, cold temperature exposure, heat exposure, osmotic stress, reduced nitrogen nutrient availability, reduced phosphorus nutrient availability and high plant density. "Yield" can be affected by many properties including without limitation, plant height, pod number, pod position on the plant, number of internodes, incidence of pod shatter, grain size, efficiency of nodulation and nitrogen fixation, efficiency of nutrient assimilation, resistance to biotic and abiotic stress, carbon assimilation, plant architecture, resistance to lodging, percent seed germination, seedling vigor, and juvenile traits. Yield can also be affected by efficiency of germination (including germination in stressed conditions), growth rate (including growth rate in stressed conditions), ear number, seed number per ear, seed size, composition of seed (starch, oil, protein) and characteristics of seed fill.

Increased yield of a transgenic plant of the present invention can be measured in a number of ways, including test weight, seed number per plant, seed weight, seed number per unit area (e.g., seeds, or weight of seeds, per acre), bushels per acre, tonnes per acre, tons per acre, kilo per hectare. For example, maize yield can be measured as production of shelled corn kernels per unit of production area in bushels per acre or metric tons per hectare, often reported on a moisture adjusted basis at about 15.5 percent moisture. Increased yield can result from improved utilization of key biochemical compounds such as nitrogen, phosphorous and carbohydrate, or from improved responses to environmental stresses, such as cold, heat, drought, salt, and attack by pests or pathogens. Recombinant DNA used in this invention can also be used to provide plants having improved growth and development, and ultimately increased yield, as the result of modified expression of plant growth regulators or modification of cell cycle or photosynthesis pathways. Also of interest is the generation of transgenic plants that demonstrate enhanced yield with respect to a seed component that can correspond to an increase in overall plant yield. Such properties include enhancements in seed oil, seed molecules such as tocopherol, protein and starch, or oil, particular oil components as can be manifest by alterations in the ratios of seed components.

Seed according to the present invention may be planted, grown and harvested to produce a crop or terminal crop. As used herein, a "crop" is a plant or plant product that is grown and harvested, such plant or plant product including but not limited to plants or plant parts such as leaf, root, shoot, fruit, seed, grain, or the like. A "terminal crop" is a crop grown for uses other than for use as planting seed to produce subsequent generations of plants. In some crop plants, such as grain produced from hybrid corn, the crop is not very suitable for planting because it does not breed true and the crop can then be conveniently referred to as "hybrid grain." In other crop plants, where the crop does breed true, such as soybean, whether a crop is planting seed or a terminal crop will depend on the uses and marketing channels of the crop. If used or marketed for planting, it will be a crop of planting seed; if used or marketed for other purposes it will be a terminal crop.

As used herein, "exogenous promoter region" refers to a sequence, capable of promoting mRNA transcription, that does not naturally occur in the plant at the same site and/or linked to the nucleic acids. The promoter can be from a different plant species or it can be from the same plant species, but naturally found in a different location in a non-genetically modified plant. Moreover, the promoter region can be found in the same genetic locus as is present a native plant, but linked to different sequence(s), than are native.

As used herein, "promoter" means regulatory DNA for initializing transcription. A "plant promoter" is a promoter capable of initiating transcription in plant cells whether or not its origin is a plant cell, e.g. is it well known that *Agrobacterium* promoters are functional in plant cells. Thus, plant promoters include promoter DNA obtained from plants, plant viruses and bacteria such as *Agrobacterium* and *Bradyrhizobium* bacteria. Examples of promoters under developmental control include promoters that preferentially initiate transcription in certain tissues, such as leaves, roots, or seeds. Such promoters are referred to as "tissue preferred". Promoters that initiate transcription only in certain tissues are referred to as "tissue specific". A "cell type" specific promoter primarily drives expression in certain cell types in one or more organs, for example, vascular cells in roots or leaves. An "inducible" or "repressible" promoter is a promoter which is under environmental control. Examples of environmental conditions that can effect transcription by inducible promoters include anaerobic conditions, or certain chemicals, or the presence of light. Tissue specific, tissue preferred, cell-type specific, and inducible promoters constitute the class of "non-constitutive" promoters. A "constitutive" promoter is a promoter which is active under most conditions.

As used herein, "expressed" means produced, e.g. a protein is expressed in a plant cell when its cognate DNA is transcribed to mRNA that is translated to the protein.

As used herein, an "expression cassette of a DNA construct" is capable of integrating in a plant genome, expressing a functional polypeptide and providing a transgenic plant expressing polypeptides of the invention.

As used herein, "suppressed" means decreased, e.g. a protein is suppressed in a plant cell when there is a decrease in the amount and/or activity of the protein in the plant cell. The presence or activity of the protein can be decreased by any amount up to and including a total loss of protein expression and/or activity.

As used herein, a "functional fragment" refers to a portion of a polypeptide provided herein which retains full or partial molecular, physiological or biochemical function of the full length polypeptide. A functional fragment often contains the domain(s), such as Pfam domain, identified in the polypeptide provided in the sequence listing.

As used herein, a "homolog" means a protein in a group of proteins that perform the same biological function, e.g. proteins that belong to the same Pfam protein family and that provide a common enhanced trait in transgenic plants of this invention. Homologs are expressed by homologous genes. With reference to homologous genes, homologs include orthologs, e.g., genes expressed in different species that evolved from a common ancestral genes by speciation and encode proteins retain the same function, but do not include paralogs, e.g., genes that are related by duplication but have evolved to encode proteins with different functions. Homologous genes include naturally occurring alleles and artificially-created variants. Degeneracy of the genetic code provides the possibility to substitute at least one base of the protein encoding sequence of a gene with a different base without causing the amino acid sequence of the polypeptide produced from the gene to be changed. When optimally aligned, homolog proteins have typically at least about 60% identity, in some instances at least about 70%, for example about 80% and even at least about 90% identity over the full length of a protein identified as being associated with imparting an enhanced trait when expressed in plant cells. In one aspect of the invention homolog proteins have an amino acid sequence that has at least 90% identity to a consensus amino acid sequence of proteins and homologs disclosed herein.

Homologs are identified by comparison of amino acid sequence, e.g. manually or by use of a computer-based tool using known homology-based search algorithms such as those commonly known and referred to as BLAST, FASTA, and Smith-Waterman. A local sequence alignment program, e.g. BLAST, can be used to search a database of sequences to find similar sequences, and the summary Expectation value (E-value) used to measure the sequence base similarity. Because a protein hit with the best E-value for a particular organism may not necessarily be an ortholog, e.g., have the same function, or be the only ortholog, a reciprocal query is used to filter hit sequences with significant E-values for ortholog identification. The reciprocal query entails search of the significant hits against a database of amino acid sequences from the base organism that are similar to the sequence of the query protein. A hit can be identified as an ortholog, when the reciprocal query's best hit is the query protein itself or a protein encoded by a duplicated gene after speciation. A further aspect of the homologs encoded by DNA useful in the transgenic plants of the invention are those proteins that differ from a disclosed protein as the result of deletion or insertion of one or more amino acids in a native sequence.

Other functional homolog proteins differ in one or more amino acids from those of a trait-improving protein disclosed herein as the result of one or more of the well-known conservative amino acid substitutions, e.g., valine is a conservative substitute for alanine and threonine is a conservative substitute for serine. Conservative substitutions for an amino acid within the native sequence can be selected from other members of a class to which the naturally occurring amino acid belongs. Representative amino acids within these various classes include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, tyrosine, asparagine, and glutamine; and (4) neutral nonpolar (hydrophobic) amino acids such as alanine, leucine, isoleucine, valine, proline, phenylalanine, tryptophan, and methionine. Conserved substitutes for an amino acid within a native amino acid sequence can be selected from other members of the group to which the naturally occurring amino acid belongs. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Naturally conservative amino acids substitution groups are: valine-leucine, valine-isoleucine, phenylalanine-tyrosine, lysine-arginine, alanine-valine, aspartic acid-glutamic acid, and asparagine-glutamine. A further aspect of the invention includes proteins that differ in one or more amino acids from those of a described protein sequence as the result of deletion or insertion of one or more amino acids in a native sequence.

Genes that are homologous to each other can be grouped into families and included in multiple sequence alignments. Then a consensus sequence for each group can be derived. This analysis enables the derivation of conserved and class-(family) specific residues or motifs that are functionally important. These conserved residues and motifs can be further validated with 3D protein structure if available. The consensus sequence can be used to define the full scope of the invention, e.g., to identify proteins with a homolog relationship. Thus, the present invention contemplates that protein homologs include proteins with an amino acid sequence that has at least 90% identity to such a consensus amino acid sequence sequences.

As used herein, "operably linked" refers to the association of two or more nucleic acid elements in a recombinant DNA construct, e.g. as when a promoter is operably linked with DNA that is transcribed to RNA whether for expressing or suppressing a protein. Recombinant DNA constructs can be designed to express a protein which can be an endogenous protein, an exogenous homologue of an endogenous protein or an exogenous protein with no native homologue. Alternatively, recombinant DNA constructs can be designed to suppress the level of an endogenous protein, e.g. by suppression of the native gene. Such gene suppression can be effectively employed through a native RNA interference (RNAi) mechanism in which recombinant DNA comprises both sense and anti-sense oriented DNA matched to the gene targeted for suppression where the recombinant DNA is transcribed into RNA that can form a double-strand to initiate an RNAi mechanism. Gene suppression can also be effected by recombinant DNA that comprises anti-sense oriented DNA matched to the gene targeted for suppression. Gene suppression can also be effected by recombinant DNA that comprises DNA that is transcribed to a microRNA matched to the gene targeted for suppression. In the examples illustrating the invention recombinant DNA for effecting gene suppression that imparts is identified by the term "antisense". It will be understood by a person of ordinary skill in the art that any of the ways of effecting gene suppression are contemplated and enabled by a showing of one approach to gene suppression.

As used herein, "percent identity" means the extent to which two optimally aligned DNA or protein segments are invariant throughout a window of alignment of components, for example nucleotide sequence or amino acid sequence. An "identity fraction" for aligned segments of a test sequence and a reference sequence is the number of identical components that are shared by sequences of the two aligned segments divided by the total number of sequence components in the reference segment over a window of alignment which is the smaller of the full test sequence or the full reference sequence. "Percent identity" ("% identity") is the identity fraction times 100. Such optimal alignment is understood to be deemed as local alignment of DNA sequences. For protein alignment, a local alignment of protein sequences should allow introduction of gaps to achieve optimal alignment. Percent identity is calculated over the aligned length not including the gaps introduced by the alignment per se.

As used herein, a "plant by-product" includes any product that is made from a plant or plant product, for example, by dehulling, crushing, milling, extraction, hydrogenation, and other processes. A plant by-products in accordance with the invention, therefore, will include such as, for example, dehulled soybeans, crushed corn, soybean meal, soy milk, paper made from corn stalks, and a wide range of other useful products of processing based on plant vitamins, minerals, lipids, proteins and carbohydrates and their constituents that can be characterized as being produced from crops or terminal crops in accordance with the invention.

As used herein, a "plant cell" means a plant cell that is transformed with stably-integrated, recombinant DNA, e.g. by *Agrobacterium*-mediated transformation or by bombardment using microparticles coated with recombinant DNA or other means. A plant cell of this invention can be an originally-transformed plant cell that exists as a microorganism or as a progeny plant cell that is regenerated into differentiated tissue, e.g. into a transgenic plant with stably-integrated, non-natural recombinant DNA, or seed or pollen derived from a progeny transgenic plant.

As used herein, the term "polypeptide" or "polypeptide molecule" means a chain of amino acids. Polypeptide is also commonly referred as "protein".

As used herein, "polyadenylated ribonucleotides" refers to the series of adenosines at the 3' end of a polyribonucleotide commonly referred to as a "poly-A tail".

As used herein, "recombinant DNA" means DNA which has been a genetically engineered and constructed outside of a cell including DNA containing naturally occurring DNA or cDNA or synthetic DNA.

As used herein, the term "structural nucleic acid molecule" refers to a molecule having sequence that encodes a protein, functional peptide fragment, or any other molecule that has biological activity (including, but not limited to, mRNA and bioactive RNA molecules, including antisense RNA).

As used herein, the term "substantially purified nucleic acid" or polypeptide means nucleic acid or protein separated from substantially all other molecules normally associated with it in its native state. A substantially purified nucleic acid can be greater than about 60% free from the other molecules (exclusive of solvent) present in the natural mixture. The term "substantially purified" is not intended to encompass molecules present in their native state.

"Pfam" database is a large collection of multiple sequence alignments and hidden Markov models covering many common protein families, e.g. Pfam version 19.0 (December 2005) contains alignments and models for 8183 protein families and is based on the Swissprot 47.0 and SP-TrEMBL 30.0 protein sequence databases. See S. R. Eddy, "Profile Hidden Markov Models", *Bioinformatics* 14:755-763, 1998. The Pfam database is currently maintained and updated by the Pfam Consortium. The alignments represent some evolutionary conserved structure that has implications for the protein's function. Profile hidden Markov models (profile HMMs) built from the protein family alignments are useful for automatically recognizing that a new protein belongs to an existing protein family even if the homology by alignment appears to be low.

Recombinant DNA Constructs

Recombinant DNA constructs are assembled using methods well known to persons of ordinary skill in the art and typically comprise a promoter operably linked to DNA, the expression of which provides the enhanced agronomic trait. Other construct components can include additional regulatory elements, such as 5' leaders and introns for enhancing transcription, 3' untranslated regions (such as polyadenylation signals and sites), DNA for transit or signal peptides.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens* and the CaMV35S promoters from the cauliflower mosaic virus as disclosed in U.S. Pat. Nos. 5,164,316 and 5,322,938. Useful promoters derived from plant genes are found in U.S. Pat. No. 5,641,876 which discloses a rice actin promoter, U.S. Pat. No. 7,151,204 which discloses a maize chloroplast aldolase promoter and a maize aldolase (FDA) promoter, and US Patent Application Publication 2003/0131377 A1 which discloses a maize nicotianamine synthase promoter. These and numerous other promoters that function in plant cells are known to those skilled in the art and available for use in recombinant polynucleotides of the present invention to provide for expression of desired genes in transgenic plant cells.

Furthermore, the promoters can be altered to contain multiple "enhancer sequences" to assist in elevating gene expression. Such enhancers are known in the art. By including an enhancer sequence with such constructs, the expression of the selected protein can be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene. See also US Patent Application Publication 2002/0192813A1 which discloses 5', 3' and intron elements useful in the design of effective plant expression vectors.

In other aspects of the invention, sufficient expression in plant seed tissues is desired to affect improvements in seed composition. Exemplary promoters for use for seed composition modification include promoters from seed genes such as napin as disclosed in U.S. Pat. No. 5,420,034, maize L3 oleosin as disclosed in U.S. Pat. No. 6,433,252), zein Z27 as disclosed by Russell et al. (1997) *Transgenic Res.* 6(2):157-166), globulin 1 as disclosed by Belanger et at (1991) *Genetics* 129:863-872), glutelin 1 as disclosed by Russell (1997) supra), and peroxiredoxin antioxidant (Per1) as disclosed by Stacy et al. (1996) *Plant Mol Biol.* 31(6):1205-1216.

Recombinant DNA constructs in this invention will generally include a 3' element that typically contains a polyadenylation signal and site. Well-known 3' elements include those from *Agrobacterium tumefaciens* genes such as nos 3', tml 3', tmr 3', tms 3, ocs 3', tr7 3', for example disclosed in U.S. Pat. No. 6,090,627; 3' elements from plant genes such as wheat (*Triticum aesevitum*) heat shock protein 17 (Hsp17 3), a wheat ubiquitin gene, a wheat fructose-1,6-biphosphatase gene, a rice glutelin gene, a rice lactate dehydrogenase gene and a rice beta-tubulin gene, all of which are disclosed in US Patent Application Publication Number 2002/0192813 A1; and the pea (*Pisum sativum*) ribulose biphosphate carboxylase gene (rbs 3'), and 3' elements from the genes within the host plant.

Constructs and vectors can also include a transit peptide for targeting of a gene to a plant organelle, particularly to a chloroplast, leucoplast or other plastid organelle. For descriptions of the use of chloroplast transit peptides see U.S. Pat. No. 5,188,642 and U.S. Pat. No. 5,728,925. For description of the transit peptide region of an Arabidopsis EPSPS gene useful in the present invention, see Klee, H. J. et al (*MGG* (1987) 210:437-442).

Recombinant DNA constructs for gene suppression can be designed for any of a number the well-known methods for suppressing transcription of a gene, the accumulation of the mRNA corresponding to that gene or preventing translation of the transcript into protein. Posttranscriptional gene suppression can be practically effected by transcription of RNA that forms double-stranded RNA (dsRNA) having homology to mRNA produced from a gene targeted for suppression.

Gene suppression can also be achieved by insertion mutations created by transposable elements can also prevent gene function. For example, in many dicot plants, transformation with the T-DNA of *Agrobacterium* can be readily achieved and large numbers of transformants can be rapidly obtained. Also, some species have lines with active transposable elements that can efficiently be used for the generation of large numbers of insertion mutations, while some other species lack such options. Mutant plants produced by *Agrobacterium* or transposon mutagenesis and having altered expression of a polypeptide of interest can be identified using the polynucleotides of the present invention. For example, a large population of mutated plants can be screened with polynucleotides encoding the polypeptide of interest to detect mutated plants having an insertion in the gene encoding the polypeptide of interest.

Transgenic plants comprising or derived from plant cells of this invention transformed with recombinant DNA can be further enhanced with stacked traits, e.g. a crop plant having an enhanced trait resulting from expression of DNA disclosed herein in combination with herbicide and/or pest resistance traits. For example, genes of the current invention can be stacked with other traits of agronomic interest, such as a trait providing herbicide resistance, or insect resistance, such as using a gene from *Bacillus thuringensis* to provide resistance against lepidopteran, coliopteran, homopteran, hemiopteran, and other insects. Herbicides for which transgenic plant tolerance has been demonstrated and the method of the present invention can be applied include, but are not limited to, glyphosate, dicamba, glufosinate, sulfonylurea, bromoxynil and norflurazon herbicides. Polynucleotide molecules encoding proteins involved in herbicide tolerance are well-known in the art and include, but are not limited to, a polynucleotide molecule encoding 5-enolpyruvylshikimate-3-phosphate synthase (EPSPS) disclosed in U.S. Pat. Nos. 5,094,945; 5,627,061; 5,633,435 and 6,040,497 for imparting glyphosate tolerance; polynucleotide molecules encoding a glyphosate oxidoreductase (GOX) disclosed in U.S. Pat. No. 5,463,175 and a glyphosate-N-acetyl transferase (GAT) disclosed in U.S. Patent Application Publication Number 2003/0083480 A1 also for imparting glyphosate tolerance; dicamba monooxygenase disclosed in U.S. Patent Application Publication Number 2003/0135879 A1 for imparting dicamba tolerance; a polynucleotide molecule encoding bromoxynil nitrilase (Bxn) disclosed in U.S. Pat. No. 4,810,648 for imparting bromoxynil tolerance; a polynucleotide molecule encoding phytoene desaturase (crtI) described in Misawa et al, (1993) *Plant J.* 4:833-840 and in Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:2188-2193 for imparting tolerance to sulfonylurea herbicides; polynucleotide molecules known as bar genes disclosed in DeBlock, et al. (1987) *EMBO J.* 6:2513-2519 for imparting glufosinate and bialaphos tolerance; polynucleotide molecules disclosed in U.S. Patent Application Publication Number 2003/010609 A1 for imparting N-amino methyl phosphonic acid tolerance; polynucleotide molecules disclosed in U.S. Pat. No. 6,107,549 for imparting pyridine herbicide resistance; molecules and methods for imparting tolerance to multiple herbicides such as glyphosate, atrazine, ALS inhibitors, isoxoflutole and glufosinate herbicides are disclosed in U.S. Pat. No. 6,376,754 and U.S. Patent Application Publication Number 2002/0112260. Molecules and methods for imparting insect/nematode/virus resistance are disclosed in U.S. Pat. Nos. 5,250,515; 5,880,275; 6,506,599; 5,986,175 and U.S. Patent Application Publication Number 2003/0150017 A1.

Embodiments of the invention provide molecules of that include "fragments" of the disclosed recombinant DNA molecules; including oligonucleotides of at least 15, at least 16 or 17, at least 18 or 19, and at least 20, 21, 22, 23, 24, 25, 26, 27, 28, 29, 30 or more, consecutive nucleotides of any of the sequences provided. Such oligonucleotides are fragments of the larger molecules having a sequence selected from the group consisting of SEQ ID NO: 1 through SEQ ID NO: 116778, and find use, for example as probes and primers for detection of the polynucleotides of the present invention.

Aspects of the various embodiments of the invention also provide for nucleic acid fragments of SEQ ID NO: 1 through SEQ ID NO: 116778 that are at least about 50, 100, 150, 200, 400, 500 or more nucleotides in length. Some aspects of these embodiments provide for nucleic acid molecules that encode functional fragments of any of the polypeptide sequences provided in SEQ ID NO: 116779 to SEQ ID NO: 233556.

Other embodiments of the present invention provide for one or more polypeptides having at least about 10 contiguous peptide residues of one or more of the peptide sequences provided in SEQ ID NO: 116779 to SEQ ID NO: 233556. In other aspects of these embodiment, the polypeptide(s) comprises at least 15, 20, 25, 30, 35, 50, 75, 100 or more contiguous peptide residues from one or more of the sequences provided in SEQ ID NO: 116779 to SEQ ID NO: 233556. In particularly aspects, these embodiments the poly peptide includes a functional fragment of one or more of the polypeptides provided in the Sequence Listing.

Other aspects of the various embodiments of the invention includes, transgenic plants, transgenic plant seeds, transgenic crops, plant products and byproducts having any of the nucleic acid or protein fragments described above. The invention also provides for various methods that use such fragments.

Embodiments of the present invention also contemplate that the trait-improving recombinant DNA provided herein can be used in combination with other recombinant DNA to create plants with multiple desired traits or a further enhanced trait. The combinations generated can include multiple copies of any one or more of the recombinant DNA constructs. These stacked combinations can be created by any method, including but not limited to cross breeding of transgenic plants, or multiple genetic transformation.

Plant Cell Transformation Methods

Numerous methods for transforming chromosomes in a plant cell nucleus with recombinant DNA are known in the art and are used in methods of preparing a transgenic plant cell nucleus cell, and plant. Two effective methods for such transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn); U.S. Pat. No. 6,153,812 (wheat) and U.S. Pat. No. 6,365,807 (rice) and *Agrobacterium*-mediated transformation is described in U.S. Pat. No. 5,159,135 (cotton); U.S. Pat. No. 5,824,877 (soybean); U.S. Pat. No. 5,463,174 (canola); U.S. Pat. No. 5,591,616 (corn); U.S. Pat. No. 5,846,797 (cotton); U.S. Pat. No. 6,384,301 (soybean), U.S. Pat. No. 7,026,528 (wheat) and U.S. Pat. No. 6,329,571 (rice), US Patent Application Publication 2004/0087030 A1 (cotton), and US Patent Application Publication 2001/0042257 A1 (sugar beet), all of which are incorporated herein by reference for enabling the production of transgenic plants. Transformation of plant material is practiced in tissue culture on a nutrient media, e.g., a mixture of nutrients that will allow cells to grow in vitro. Recipient cell targets include, but are not limited to, meristem cells, hypocotyls, calli, immature embryos and gametic cells such as microspores, pollen, sperm and egg cells. Callus can be initiated from tissue sources including, but not limited to, immature embryos, hypocotyls, seedling apical meristems, microspores and the like. Cells containing a transgenic nucleus are grown into transgenic plants.

In addition to direct transformation of a plant material with a recombinant DNA, a transgenic plant cell nucleus can be prepared by crossing a first plant having cells with a transgenic nucleus with recombinant DNA with a second plant lacking the transgenic nucleus. For example, recombinant DNA can be introduced into a nucleus from a first plant line that is amenable to transformation to transgenic nucleus in cells that are grown into a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

In certain embodiments of the invention the recombinant DNA insertion is "targeted" in order to achieve site-specific integration, for example to replace an existing gene in the genome, to use an existing promoter in the plant genome, or to insert a recombinant polynucleotide at a predetermined site known to be active for gene expression. Several site specific recombination systems exist which are known to function implants include cre-lox as disclosed in U.S. Pat. No. 4,959,317 and FLP-FRT as disclosed in U.S. Pat. No. 5,527,695, both incorporated herein by reference.

Transformation methods of this invention can be practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant can be regenerated is useful as a recipient cell. Callus can be initiated from tissue sources including, but not limited to, immature embryos, seedling apical meristems, microspores and the like. Cells capable of proliferating as callus are also recipient cells for genetic transformation. Practical transformation methods and materials for making transgenic plants of this invention, for example, various media and recipient target cells, transformation of immature embryo cells and subsequent regeneration of fertile transgenic plants are disclosed in U.S. Pat. Nos. 6,194,636 and 6,232,526, which are incorporated herein by reference.

The seeds of transgenic plants can be harvested from fertile transgenic plants and be used to grow progeny generations of transformed plants of this invention including hybrid plants line for selection of plants having an enhanced trait. In addition to direct transformation of a plant with a recombinant DNA, transgenic plants can be prepared by crossing a first plant having a recombinant DNA with a second plant lacking the DNA. For example, recombinant DNA can be introduced into first plant line that is amenable to transformation to produce a transgenic plant which can be crossed with a second plant line to introgress the recombinant DNA into the second plant line. A transgenic plant with recombinant DNA providing an enhanced trait, e.g. enhanced yield, can be crossed with transgenic plant line having other recombinant DNA that confers another trait, for example herbicide resistance or pest resistance, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

Descriptions of commonly used breeding terms such as "crossing", "hybrids" and methods for crossing and producing hybrid that are used to describe present invention can be found in one of several reference books (Allard, "Principles of Plant Breeding," John Wiley & Sons, N.Y., U. of CA, Davis, Calif., 50-98, 1960; Simmonds, "Principles of crop improvement," Longman, Inc., N.Y., 369-399, 1979; Sneep and Hendriksen, "Plant breeding perspectives," Wageningen (ed), *Center for Agricultural Publishing and Documentation*, 1979; Fehr, In: Soybeans: Improvement, Production and Uses, 2nd Edition, Monograph., 16:249, 1987; Fehr, "Principles of variety development," *Theory and Technique*, (Vol. 1) and *Crop Species Soybean* (Vol. 2), Iowa State Univ., Macmillan Pub. Co., N.Y., 360-376, 1987).

In some embodiments of the invention, during transformation, DNA is introduced into only a small percentage of target plant cells in any one transformation. Marker genes are used to provide an efficient system for identification of those cells that are stably transformed by receiving and integrating a transgenic DNA construct into their genomes. Marker genes provide selective markers which confer resistance to a selective agent, such as an antibiotic or herbicide. Any of the herbicides to which plants of this invention can be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells can be tested further to confirm stable integration of the exogenous DNA. Commonly used selective marker genes include those conferring resistance to antibiotics such as kanamycin and paromomycin (nptII), hygromycin B (aph IV) and gentamycin (aac3 and aacC4) or resistance to herbicides such as glufosinate (bar or pat) and glyphosate (aroA or EPSPS). Examples of such selectable are illustrated in U.S. Pat. Nos. 5,550,318;

5,633,435; 5,780,708 and 6,118,047, all of which are incorporated herein by reference. Selectable markers which provide an ability to visually identify transformants can also be employed, for example, a gene expressing a colored or fluorescent protein such as a luciferase or green fluorescent protein (GFP) or a gene expressing a beta glucuronidase or uidA gene (GUS) for which various chromogenic substrates are known.

Plant cells that survive exposure to the selective agent, or plant cells that have been scored positive in a screening assay, can be cultured in regeneration media and allowed to mature into plants. Developing plantlets regenerated from transformed plant cells can be transferred to plant growth mix, and hardened off, for example, in an environmentally controlled chamber at about 85% relative humidity, 600 ppm $CO_2$, and 25-250 microeinsteins $m^{-2}s^{-1}$ of light, prior to transfer to a greenhouse or growth chamber for maturation. Plants are regenerated from about 6 weeks to 10 months after a transformant is identified, depending on the initial tissue. Plants can be pollinated using conventional plant breeding methods known to those of skill in the art and seed produced. The regenerated transformed plant or its progeny seed or plants can be tested for expression of the recombinant DNA and selected for the presence of enhanced agronomic trait.

Progeny can be recovered from transformed plants and tested for expression of the exogenous recombinant polynucleotide. Useful assays include, for example, "molecular biological" assays, such as Southern and Northern blotting and PCR; "biochemical" assays, such as detecting the presence of RNA, e.g., double stranded RNA, or a protein product, e.g., by immunological means (ELISAs and Western blots) or by enzymatic function; plant part assays, such as leaf or root assays; and also, by analyzing the phenotype of the whole regenerated plant.

Transgenic Plants and Seeds

Transgenic plants derived from the plant cells of this invention are grown to generate transgenic plants having an enhanced trait as compared to a control plant and produce transgenic seed and haploid pollen of this invention. Such plants with enhanced traits are identified by selection of transformed plants or progeny seed for the enhanced trait. For efficiency a selection method is designed to evaluate multiple transgenic plants (events) including the recombinant DNA, for example multiple plants from 2 to 20 or more transgenic events. Transgenic plants grown from transgenic seed provided herein demonstrate improved agronomic traits that contribute to increased yield or other trait that provides increased plant value, including, for example, improved seed quality. Of particular interest are plants having enhanced water use efficiency, enhanced cold tolerance, increased yield, enhanced nitrogen use efficiency, enhanced seed protein and enhanced seed oil. Transgenic plants of the present invention include, but are not limited to, corn, soybean, cotton, canola, alfalfa, wheat, rice, sugarcane, sugar beet seed, millet, barley, peanut, pigeon pea, sorghum, vegetables (including but not limited to Broccoli, Cauliflower, Cabbage, Radish, Chinese cabbage, Melons, Watermelons, Cucumber, Gourds, Pumpkin, Squash, Pepper, Tomato, Eggplant, Onion, Carrot, Garden Bean, Sweet Corn, Pea, Dry Bean, Okra, Spinach, Leek, Lettuce, and Fennel), grape, berries (including blue, black, raspberry, mullberry, boysenberry . . . etc), cherry and related fruit trees (including but not limited to plum, peach, apricot, kiwi, pomegranate, mango, fig), fruit trees (including but not limited to orange, lemon, lime, blood orange, grapefruit, and the like), nut trees (including but not limited to coconut, walnut (English and black), pecan, almond, hazelnut, brazil nut, hickory nut, acorn, and the like), sunflower, other oilseed producing plants or any combinations thereof.

Selection Methods for Transgenic Plants with Enhanced Agronomic Trait

Within a population of transgenic plants each regenerated from a plant cell having a nucleus with recombinant DNA many plants that survive to fertile transgenic plants that produce seeds and progeny plants may not exhibit an enhanced agronomic trait. Selection from such population is necessary to identify one or more transgenic plant cells having a transgenic nucleus that can provide plants with the enhanced trait. Transgenic plants having enhanced traits are selected from populations of plants regenerated or derived from plant cells transformed as described herein by evaluating the plants in a variety of assays to detect an enhanced trait. These assays also can take many forms including, but not limited to, direct screening for the trait in a greenhouse or field trial or by screening for a surrogate trait. Such analyses can be directed to detecting changes in the chemical composition, biomass, physiological properties, morphology of the plant. Changes in chemical compositions such as nutritional composition of grain can be detected by analysis of the seed composition and content of protein, free amino acids, oil, free fatty acids, starch or tocopherols. Changes in biomass characteristics can be made on greenhouse or field grown plants and can include plant height, stem diameter, root and shoot dry weights; and, for corn plants, ear length and diameter. Changes in physiological properties can be identified by evaluating responses to stress conditions, for example assays using imposed stress conditions such as water deficit, nitrogen deficiency, cold growing conditions, pathogen or insect attack or light deficiency, or increased plant density. Changes in morphology can be measured by visual observation of tendency of a transformed plant with an enhanced agronomic trait to also appear to be a normal plant as compared to changes toward bushy, taller, thicker, narrower leaves, striped leaves, knotted trait, chlorosis, albino, anthocyanin production, or altered tassels, ears or roots. Other selection properties include days to pollen shed, days to silking, leaf extension rate, chlorophyll content, leaf temperature, stand, seedling vigor, internode length, plant height, leaf number, leaf area, tillering, brace roots, stay green, stalk lodging, root lodging, plant health, barreness/prolificacy, green snap, and pest resistance. In addition, phenotypic characteristics of harvested grain can be evaluated, including number of kernels per row on the ear, number of rows of kernels on the ear, kernel abortion, kernel weight, kernel size, kernel density and physical grain quality.

Assays for screening for a desired trait are readily designed by those practicing in the art. The following illustrates screening assays for corn traits using hybrid corn plants. The assays can be readily adapted for screening other plants such as canola, cotton and soybean either as hybrids or inbreds.

In certain embodiments of the invention transgenic corn plants having nitrogen use efficiency can be identified by screening in fields with three levels of nitrogen (N) fertilizer being applied, e.g. low level (0 N), medium level (80 lb/ac) and high level (180 lb/ac). Plants with enhanced nitrogen use efficiency provide higher yield as compared to control plants.

In other embodiments, transgenic corn plants having enhanced yield can be identified by screening using progeny of the transgenic plants over multiple locations with plants grown under optimal production management practices and maximum weed and pest control. A useful target for improved yield is a 5% to 10% increase in yield as compared to yield produced by plants grown from seed for a control plant. Selection methods can be applied in multiple and diverse geographic locations, for example up to 16 or more locations, over one or more planting seasons, for example at least two planting seasons, to statistically distinguish yield improvement from natural environmental effects.

In other embodiments, transgenic corn plants having enhanced water use efficiency can be identified by screening plants in an assay where water is withheld for a period to induce stress followed by watering to revive the plants. For example, a useful selection process imposes 3 drought/rewater cycles on plants over a total period of 15 days after an initial stress free growth period of 11 days. Each cycle consists of 5 days, with no water being applied for the first four days and a water quenching on the 5th day of the cycle. The primary phenotypes analyzed by the selection method are the changes in plant growth rate as determined by height and biomass during a vegetative drought treatment.

In other embodiments, transgenic corn plants having enhanced cold tolerance can be identified by screening plants in a cold germination assay and/or a cold tolerance field trial. In a cold germination assay trays of transgenic and control seeds are placed in a growth chamber at 9.7° C. for 24 days (no light). For example, seeds having higher germination rates as compared to the control can be identified as having enhanced cold tolerance. In a cold tolerance field trial plants with enhanced cold tolerance can be identified from field planting at an earlier date than conventional Spring planting for the field location. For example, seeds are planted into the ground around two weeks before local farmers begin to plant corn so that a significant cold stress is exerted onto the crop, named as cold treatment. Seeds can be planted under local optimal planting conditions such that the crop has little or no exposure to cold condition, named as normal treatment. At each location, seeds may be can be planted under both cold and normal conditions preferably with multiple repetitions per treatment.

In other embodiments, transgenic corn plants having seeds with increased protein and/or oil levels can be identified by analyzing progeny seed for protein and/or oil. Near-infrared transmittance spectrometry is a non-destructive, high-throughput method that is useful to determine the composition of a bulk seed sample for properties listed in table 1.

TABLE 1

| Typical sample(s): | Whole grain corn and soybean seeds |
|---|---|
| Typical analytical range: | Corn - moisture 5-15%, oil 5-20%, protein 5-30%, starch 50-75%, and density 1.0-1.3%. Soybean - moisture 5-15%, oil 15-25%, and protein 35-50%. |

Although the plant cells and methods of this invention can be applied to any plant cell, plant, seed or pollen, e.g. any fruit, vegetable, grass, tree or ornamental plant, the various aspects of the invention are preferably applied to corn, soybean, cotton, canola, alfalfa, wheat, rice, sugarcane, and sugar beet plants. In many cases the invention is applied to corn plants that are inherently resistant to disease from the Mal de Rio Cuarto virus or the *Puccina sorghi* fungus or both.

Homolog Identification

In certain embodiment, the present invention also includes identification of homologs of proteins encoded by the DNA identified in the sequence listing which is used to provide transgenic seed and plants having enhanced agronomic traits. From the sequence of the homologs, homologous DNA sequence are identified for preparing additional transgenic seeds and plants of this invention with enhanced agronomic traits.

An "All Protein Database" are constructed of known protein sequences using a proprietary sequence database and the National Center for Biotechnology Information (NCBI) non-redundant amino acid database (nr.aa). For each organism from which a polynucleotide sequence provided herein can be obtained, an "Organism Protein Database" are constructed of known protein sequences of the organism; it is a subset of the All Protein Database based on the NCBI taxonomy ID for the Organism.

The All Protein Database are queried using amino acid sequences provided herein as SEQ ID NO: 116779 through SEQ ID NO: 233556 using NCBI "blastp" program with E-value cutoff of $1e^{-8}$. Up to 1000 top hits are kept, and separated by organism names. For each organism other than that of the query sequence, a list is kept for hits from the query organism itself with a more significant E-value than the best hit of the organism. The list contain likely duplicated genes of the polynucleotides provided herein, and is referred to as the Core List. Another list is kept for all the hits from each organism, sorted by E-value, and referred to as the Hit List.

The Organism Protein Database are queried using polypeptide sequences provided herein as SEQ ID NO: 116779 through SEQ ID NO: 233556 using NCBI "blastp" program with E-value cutoff of $1e^{-4}$. Up to 1000 top hits are kept. A BLAST searchable database is constructed based on these hits, and are referred to as "SubDB". SubDB are queried with each sequence in the Hit List using NCBI "blastp" program with E-value cutoff of $1e^{-8}$. The hit with the best E-value are compared with the Core List from the corresponding organism. The hit is deemed a likely ortholog if it belongs to the Core List, otherwise it is deemed not a likely ortholog and there is no further search of sequences in the Hit List for the same organism. Homologs from a large number of distinct organisms are identified and reported.

Recombinant DNA constructs can be prepared using the DNA encoding each of the identified homologs and the constructs can be used to prepare multiple events of transgenic corn, soybean, canola, cotton and other transgenic plants mentioned. Plants can be regenerated from the transformed plant cells and used to produce progeny plants and seed that are screened for enhanced water use efficiency, enhanced cold tolerance, increased yield, enhanced nitrogen use efficiency, enhanced seed protein and enhanced seed oil. From each group of multiple events of transgenic plants with a specific recombinant DNA for a homolog the event that produces the greatest enhancement in yield, water use efficiency, nitrogen use efficiency, enhanced cold tolerance, enhanced seed protein and enhanced seed oil is identified and progeny seed can be selected for commercial development.

Pfam Module Annotation

The amino acid sequence of the expressed proteins shown to be associated with an enhanced trait are analyzed for Pfam protein family against the current Pfam collection of multiple sequence alignments and hidden Markov models using the HMMER software in the appended computer listing. The Pfam domain modules and individual protein domain for the proteins shown in the sequence listing. The Hidden Markov model databases for the identified patent families are known to a skilled artisan allowing identification of other homologous proteins and their cognate encoding DNA to enable the full breadth of the invention for a person of ordinary skill in the art. Certain proteins are identified by a single Pfam domain and others by multiple Pfam domains.

In one aspect, the present invention includes recombinant DNA constructs having a polynucleotide encoding a protein that has an amino acid sequence having at least 95% identity over at least 95% of the length of a reference sequence selected from the group consisting of SEQ ID NO: 116779-233556 when said amino acid sequence is aligned with said reference sequence.

In another aspect, the present invention includes a mixture having plant cells, and an antibody to a protein produced in said cells wherein said protein has an amino acid sequence that has at least 95% identity over at least 95% of the length of a reference sequence selected from the group consisting of SEQ ID NO: 116779-233556 when said amino acid sequence is aligned to said reference sequence.

Yet another aspect of the present invention includes recombinant DNA constructs having a promoter that is functional in a plant cell and that is operably linked to a polynucleotide that: (a) encodes a protein having an amino acid sequence having at least 95% identity over at least 95% of the length of a reference sequence selected from the group consisting of SEQ ID NO: 116779-233556, when said amino acid sequence is aligned to said reference sequence; or is transcribed into an RNA molecule that suppresses the level of an endogenous protein that has an amino acid sequence that is at least 95% identical over at least 95% of the length of a reference sequence of SEQ ID NO: 116779-233556, when said amino acid sequence is aligned to said reference sequence; and wherein said construct is stably integrated into a chromosome in a plant cell nucleus. In some aspect, this invention includes a transgenic plant cell having the recombinant DNA construct wherein said DNA construct provides for an enhanced trait as compared to control plants; and wherein said enhanced trait is enhanced water use efficiency, enhanced cold tolerance, increased yield, enhanced nitrogen use efficiency, enhanced seed protein or enhanced seed oil. The DNA construct further can express a protein that provides tolerance from exposure to an herbicide (e.g., a glyphosate, dicamba, or glufosinate compound) having an agent applied at levels that are lethal to a wild type of said plant cell nucleus.

In some aspects, this invention provides transgenic plants (e.g., corn, soybean, cotton, canola, alfalfa, wheat, rice, sugarcane, or sugar beet plant), that is homozygous for said recombinant DNA and have a plurality of plant cells.

Yet in another aspect, this invention includes transgenic pollen grains having a haploid derivative of a plant cell nucleus having a chromosome comprising the recombinant DNA construct.

In one aspect, this inventions provides a method for manufacturing non-natural, transgenic seed (e.g., corn, soybean, cotton, canola, alfalfa, wheat, rice, sugarcane, or sugar beet seed) that can be used to produce a crop of transgenic plants with an enhanced trait resulting from expression of a stably-integrated, recombinant DNA construct, said method includes (a) screening a population of plants for said enhanced trait and said recombinant DNA, wherein individual plants in said population exhibit said trait at a level less than, essentially the same as or greater than the level that said trait is exhibited in control plants which do not contain said recombinant DNA, wherein said enhanced trait is selected from the group of enhanced traits consisting of enhanced water use efficiency, enhanced cold tolerance, increased yield, enhanced nitrogen use efficiency, enhanced seed protein and enhanced seed oil; (b) selecting from said population one or more plants that exhibit said trait at a level greater than the level that said trait is exhibited in control plants, and (c) collecting seed from selected plant from step b.

Yet in another aspect, the method of this invention further includes: (a) verifying that said recombinant DNA is stably integrated in said selected plants, and (b) analyzing tissue of said selected plant to determine the expression or suppression of a protein having the function of a protein having an amino acid sequence selected from the group consisting of one of SEQ ID NOs: 116779-233556.

In one aspect, this invention provides a method of producing hybrid corn seed including: (a) acquiring hybrid corn seed from an herbicide tolerant corn plant which also has a stably-integrated, recombinant DNA construct; (b) producing corn plants from said hybrid corn seed, wherein a fraction of the plants produced from said hybrid corn seed is homozygous for said recombinant DNA, a fraction of the plants produced from said hybrid corn seed is hemizygous for said recombinant DNA, and a fraction of the plants produced from said hybrid corn seed has none of said recombinant DNA; (c) selecting corn plants which are homozygous and hemizygous for said recombinant DNA by treating with an herbicide; (d) collecting seed from herbicide-treated-surviving corn plants and planting said seed to produce further progeny corn plants; (e) repeating steps (c) and (d) at least once to produce an inbred corn line; and (f) crossing said inbred corn line with a second corn line to produce hybrid seed.

In some aspect, this invention provides substantially purified nucleic acid molecule having a nucleic acid sequence wherein said nucleic acid sequence exhibits 95% or greater identity to a nucleic acid sequence selected from the group consisting of SEQ ID NO: 1 through SEQ ID NO: 116778 and sequences complementary to SEQ ID NO: 1 through SEQ ID NO: 116778.

It is contemplated that any embodiment discussed in this specification can be implemented with respect to any method, kit, reagent, or composition of the invention, and vice versa. Furthermore, compositions of the invention can be used to achieve methods of the invention.

It will be understood that particular embodiments described herein are shown by way of illustration and not as limitations of the invention. The principal features of this invention can be employed in various embodiments without departing from the scope of the invention. Those skilled in the art will recognize, or be able to ascertain using no more than routine experimentation, numerous equivalents to the specific procedures described herein. Such equivalents are considered to be within the scope of this invention and are covered by the claims.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

The use of the word "a" or "an" when used in conjunction with the term "comprising" in the claims and/or the specification may mean "one," but it is also consistent with the meaning of "one or more," "at least one," and "one or more than one." The use of the term "or" in the claims is used to mean "and/or" unless explicitly indicated to refer to alternatives only or the alternatives are mutually exclusive, although the disclosure supports a definition that refers to only alternatives and "and/or." Throughout this application, the term "about" is used to indicate that a value includes the inherent variation of error for the device, the method being employed to determine the value, or the variation that exists among the study subjects.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps.

The term "or combinations thereof" as used herein refers to all permutations and combinations of the listed items preceding the term. For example, "A, B, C, or combinations thereof" is intended to include at least one of: A, B, C, AB, AC, BC, or ABC, and if order is important in a particular context, also BA, CA, CB, CBA, BCA, ACB, BAC, or CAB. Continuing with this example, expressly included are combinations that contain repeats of one or more item or term, such as BB, AAA, MB, BBC, AAABCCCC, CBBAAA, CABABB, and so forth. The skilled artisan will understand that typically there is no limit on the number of items or terms in any combination, unless otherwise apparent from the context.

All of the compositions and/or methods disclosed and claimed herein can be made and executed without undue experimentation in light of the present disclosure. While the compositions and methods of this invention have been described in terms of preferred embodiments, it will be apparent to those of skill in the art that variations may be applied to the compositions and/or methods and in the steps or in the sequence of steps of the method described herein without departing from the concept, spirit and scope of the invention. All such similar substitutes and modifications apparent to those skilled in the art are deemed to be within the spirit, scope and concept of the invention as defined by the appended claims.

SEQUENCE LISTING (233556 sequences)

SEQ ID NO: 1 - DNA, 246 bp, Glycine max
  Peptide Sequence Number=SeqID_116779
atggagcaatataagggggctccattgggtgagcttagcccacatgtttttgccgttgctgatgcatcttatagagcaatgatgaatgaaggtaaaagtcaatctatcttggtcagcggtgaaagtggtgctggaaaaactgaaacaacaaaattgattatgcagtatcttacctttgttggtggacgtgccgctggtgatgaaagaacagtggaacagcaagttcttgaagtaaactattcttga

SEQ ID NO: 2 - DNA, 273 bp, Glycine max
  Peptide Sequence Number=SeqID_116780
atggacatactcataccgcttccattaaggtggagttactaccttattttgtctgtgaatgggcaccatatgtggtcattggatgatctcactctcaaggcaatgggtctccaacttcttctccatgtggatccaagcaatggaaacttggatgtgttgattggagagaaaggcttcttggtctgcactggtgatggactaaatggttgtggagtaggagttgaagttgcctcactatcagacgagttagagtcgtcagcggatggatcttaa

SEQ ID NO: 3 - DNA, 318 bp, Glycine max
  Peptide Sequence Number=SeqID_116781
atgagtctgcgccacggctccaaggtttggcttgaggaccgcgattcggcttggctcgccgccgaagtgctcgattccgacggtaaccgcctcttgctcgtcaccgattccggcaagaaggtttatgcttcgccggagaagctgcttccgagggatgcggatgaagaggagcatggaggattcgaagatatgacgaggctggcgtacttgaacgagccaggagtgttgttcaatcttcggagaagatatgctctcaatgatatctatttgctagatattgaattgcggttgactagcagtttaggctttgactgttag

SEQ ID NO: 4 - DNA, 369 bp, Glycine max
  Peptide Sequence Number=SeqID_116782
atggtaggccccctggtggtgtggatttccttgacgaagttgagccctttaacaagctcagtgtcgtctacgcgcttggcatcattgatgatgaagagaatgttatcaacagtgaggggatcgaggatcatggagtattggcttaagaccactaagggaggtgctggtggatttcacgagggtgtcatggtcgaagagctcgacgggaacaaccatggtgttgaggatgtcgacaaccttcacgacgaccttccaaagggaaatgaagatgacaatggggtggatatcctgggagaggaggaaacggtcgcattgctcgaggagtgcaccgacaatggcaaccatagtggcttcatgataggtttataa

SEQ ID NO: 5 - DNA, 420 bp, Glycine max
  Peptide Sequence Number=SeqID_116783
atggacaagtattgtccagtgtcgagagataaccttgacaggtgtgagaattgcaagtctttcaagcttgttaaacaagcttggacaagtgttgtccagactacttatgtcaagttgttcggggtggacatgcttttagttttgcaggcaaggagtgtgcaacacatgcatagtactcttgcatacatgtcactcgtggagtgggtgaaaaagaggctaagtcatgaagtgctaaaacgcagcttcaatgcgcttagtgcgacaaaagaatctggaagggcatcatcatcaaagtcgcacgctaagcgtgagatcagtgtgctaagcgcaacaattgtcttcagccaggctcagcgcatgactggcgctaagcgcgagggtggcactaagctcaatgtcgcgaattcagagtctatttaa

SEQ ID NO: 6 - DNA, 138 bp, Glycine max
  Peptide Sequence Number=SeqID_116784
atggcttcttctggatggtgtagattcttggtatacccttttaagatcttcatgtatcactcaaccgggatcaaggactttggtacatatgacattgaagaaaaagcacaaccgagttatggcaagcctgaatgttag

SEQ ID NO: 7 - DNA, 168 bp, Glycine max
  Peptide Sequence Number=SeqID_116785
atggctcgcaccaagaaaactaggcaaatgacgtctgaggcggcaaaggaaattgttgacaagattgagcaggcctcacagggttcctttatcgcccatggatgtcaggatgtactgattgctgctattgggcaaccagaacaccctgggcgtgtgcatgctgcttga

SEQ ID NO: 8 - DNA, 384 bp, Glycine max
  Peptide Sequence Number=SeqID_116786
atgactagttctctgtgcttttgggctgcccatttagctggtccaaaatgggggccattttcttcatggtgttgtgcttggcttgagaccatatggcttatagttgggataaggactcagagaatttttacatggcaactcatgcttttcatggttggaaaaggcatatgcgggatcacacacgttgcaaagtataatcctactctcaactggcacaataaaggtggagggtacttcgctccaaaatggctattcttatgtatgtatattggcctcactgttatatgggcaacactaaacacatttgcattggaagtgattgctttgatcgatatagtttcaatatggtggcaggtagtattacttccttgtatacacttttaa

SEQ ID NO: 9 - DNA, 537 bp, Glycine max
  Peptide Sequence Number=SeqID_116787
atggcttcagggccaatagttggagatgatggagccaaagagaagcagaggtacaccgagagtaaggtttacactaggaaagcgtttaaaggtctgaagaacaaaggaaacacaagtatggattcagcagagaagaggctcaatgagcttggttacaagcaagaactgagaagagaaatgactatgtttaagactctggcaatatcattttccacaatgacccttttcactggaattacacctctctatggttctagtcttcaatatgcaggccctgcaactcttgtctgggggtggatagtgcctcttcaagattgtaaagatgttgtatcgccattacttcaaggggaaactaagaagaatgaaaaggtacctcaaattaatgagactgccaaggaatgtattaagaagttgaatgttgagtttcaaacaaaaatgtcaaatgacttacagacaccagtgattctaactggtgctctccaagaggccttgaaatttgtgaacgcttctttgaagatgttgaagaaaagagcatag

SEQ ID NO: 10 - DNA, 398 bp, Glycine max
  Peptide Sequence Number=SeqID_116788
gaaggaacgtgttggatgggatcttgattgcaaatgaggtggtggaggaggcaaagaaaggtaggaaagatagtatggtattcaaggtgtactttgagaaagcgtgttatttagtgtctaggaattttctctactacatggttggaaggttgcagtttttccagaggtggattaggcgattcaaggttgtttgggtacttgatgatgaggacatgaccaagagcaagggcaaggatccacttgaaggacttggagggcctatgacaagggctagagcaaggaaagccaaggaagctgttcaacaagtgttgtccatactatttgaatacaagttcaagtttcaaggagaaaagtccaaggttgtgagttgtatcatggcccaaatggaggaggactaa

SEQ ID NO: 11 - DNA, 627 bp, Glycine max
  Peptide Sequence Number=SeqID_116789
atgacacgttcgaccggggatgtgaaaagagcgacgcaagaattttttgttgtgcactggctctctatgtgtggctggtttcacacccttttctccaagaaggtaggcccgtctatccgctacaaggtcaccgctcgaaggaagaatcaggattctatcttcatgcgaaggatgtccaaatgttcccttgatggaacaaggggttgtattaattataatcccgtcctcgccataagacagcttggctaccccatgagaggagtgccatcagacgaaagcatcacgcctttcatcgcacggggtttcggtgaccacaacgcgagggacagagagcttaggggaagcagtaatgggatcatcggcggctatcataagtggctgaaaggattggattggctcccaaatctaaagactgtgagagaggatgaggttaaagcttcggaagaaagtgatgaggtacaagccctaaaggcagagcttgaaagagcccgggtagtcgaagagaagttcaagtccatagccatcaaagaatcatcacgggtcaaaggcatgatctccgaagaggtgaaaggaatcatcacgggtcaaaggcatgatcttgaaggacgagctaaaggtttgccttag

SEQ ID NO: 12 - DNA, 279 bp, Glycine max
  Peptide Sequence Number=SeqID_116790
atggttcgcacgaagaaaactggccagatgacatctgaggcagcaaaggaaattgttgagaagattgagcaggcgtcacagggttcttttgtcccccatggacgtcaggatgtcctgactgttgccattgggcgaccagaacaccctagtcgtgtgcgtgctgctggagccggtgtgaccatcaagaaatactttgaatcggctccacacacctcccgcatttcttcctctatggctccaaaagaactagagcagctgactcatcaaatcagggactaa

SEQ ID NO: 13 - DNA, 753 bp, Glycine max
  Peptide Sequence Number=SeqID_116791
atggcgaggattcctgacaagattaagtctattgatgggtcaaaagagacacttaagcttgctgtcagaatcacggatcttttgttcgttgggactcccaacaagtctgagcaagtggaaatggtttttgttgattctgagggtgatcaaattcatgctgtttgtaaatcggaccacctcaagtcttggaaagctgatttgaaagagaattccacttatgttatgcataatttcaaagttgtcaagaatgatggtcaatttagagtgtgcgaacatgagtacaagttattttttattggagtgacggttgttagagaagctgatttgcatgaactgccttttaaggaatttagatttgttgaatttgcaaatgtcgttgctggcaatttcgtggctggcctgttggttgatattattggggtcgttgatcaggtggtctttcggcgtgtttcatcaaaaaataccagggttgtttttagaatgaaggatttgagtggtgaaattttatcttgcacactttgggagaattactgtatgcaattcctatcctatttgaatgagcgtgggaatgatgggtcgatggttattatattggcacatgccaaaataaaagatgcgcagggtaagtgtgatattctatttactgatttgggtactcatctgataagttttggcgttgctatttttggcatttacaggaagttatccagcttcagtgagcaattccttcaaggtgtcaaaactattgattaa

SEQ ID NO: 14 - DNA, 552 bp, Glycine max
  Peptide Sequence Number=SeqID_116792
atggggtggttggagtaccaaggaaatgtttggaagcaaaagcaagagtcttggcaggtagcgattgacgcttttctcgcctttcatgaccgcaaggaaagctcagttgtcgctatcttagccgatctatatgacaccttcgaccgaagatgtgaaaagaacagtgcaaggatcatttgttgtactccggccctctatgtatggttggtttcgcaccttttccgccaagaggtgagacatgcttgcccgctagaaggccatcgctcatgcacagagaaaaaaaaggcaagttgggaccgactcttagcaagcaaagaaagagcgtctgtcaactggttcccccaatggaaagaaggaagaaccgggattcttatttcgtgcagaggatttccaaattttctcttgatggggacaaggggttgcattaattacaatcccatcctcgccataagacaacttggctaccctatgagaggggcaccattagaggaaggcctcacacctattattgcacgaggtttcaatagcaccaacgcgggggcgcttcagaag

SEQ ID NO: 15 - DNA, 276 bp, Glycine max
  Peptide Sequence Number=SeqID_116793
atgacaaatgcaggaatgatatgtccattgcaatgccatgaagagatgcatgacgcaatcaaggaatatgccagaggactatcagcgacagcacatcaccaaaaaaaaggaaaactttacatgaggcttcactgtcaccaagcgagtcggagacccagcatgaccacagatcaacctccacttcttatggctcacataggcccgggtgtagggcctaacatctcaatatgtgtacgaggtgtaggtgtcatgtgtgtgcagaaaaagtatttctag

SEQ ID NO: 16 - DNA, 381 bp, Glycine max
  Peptide Sequence Number=SeqID_116794
atggacgacatgctcttgtgtgtctacgccacaaggccccatgtccaaagagccaaacaccatctaaggcagaactttaagatggttgacccatcgcaagattaccgagtagacaaagcgacactcaactcccactatagccaagaaggtgaaacaatggatgagagcttctcaagcttttgtggttctagaataatcaattaccaaatgtgtaaccagctcgcctgggcgagcaagtttcttcagaatgaagttatcagcttgcttgggcgagctcagctcgcctgggagagttcagctcgcctaagtgagctaccttcaacccaaatgcttcattttgctataaataggcgtgggaaggctgaagtaaagggtccttga

SEQ ID NO: 17 - DNA, 141 bp, Glycine max
  Peptide Sequence Number=SeqID_116795
atggatactgatgtcaccgacgagaaaaaagaaataccaaatgataaggggaaatcaaaagatgttttccagcgaaaaggatttgaaaaaccaatgtcctcgagattaaaaaagacggaatctcaagatcctatagaatag

SEQ ID NO: 18 - DNA, 1617 bp, Glycine max
  Peptide Sequence Number=SeqID_116796
atggatggctcctccgccaaaccccctcaaatctcggaaatgttccagaaattcgccctcgctttcaagaccaaaacctttgaattcttctccgaggaagaaaacaacaacgcttcccccctcttcgacgacatcgacggtttctccctccttgactccaccgaagaaatcatccccgatcagaaagtcgtcgtcatcaaacccgaccccgatccctccaacaattcctccccaccgccgctgctgccacagccacaatcccctccgccaccgccgccgccacagatcatccctccgcctccgcccccggaatcccgcgagcccgaaacgccaccgccgccgctaacctctgctcagatcagagaaatgacacacgccctggtctcctcggtcttcgccgccgtctccgccttcgaagcctcctacttccaactccagagcgcgcacgtgccgttcgtggaggagcacgtgacgagcgcggacaaggttttagtttcccacctccagaggctctcggagctgaagagattctacagcaactccgagccatgcggttttcccttagggttgcgcttggaggccgaagtggaagagaatcagagcaaattgagaaccctcggcaccgtctcgaaccgcttgcagtgggagctggagcagaagcacgacgaggtggtagccctcagagccaaactcgacgagattcacaggggtaacgttaatttgtccaagaagctctgtgctcgcgctttgaacccctcttctgatgttttgttaaccgttaaggtgtttgattcgttgttgctcgacgcttctagagcgacgcataggttcaccaagattttgattgggttgatgaggaaggcagggtgggatttgggtttagctgccaatgcggttcatcccaatgttgattatgccaagaaagggcacaaccagtacgcgctcttgtcctacgtttgtttggggatgtttcatggttttgattcgttgaattttggaatggaggaaccggtggtgttgaatggacacggttcggatttggaggatagggatggttgcttgaagcaactgcttgagcatgtgtctagcaatcccatggatttgctggggattcacccgggttgcaagttttcacggttctgcgagcacaagtatgagaggctcatccatccctcgattgagtcgtccattttcgtcaatttggaggagaaggaggcagtgttgaactcatggcgctcgttgagtatgttctatgagacctttgttggaatggcgagtgctgtttggacactacataagttgtcctacgcgttcaatcctgcagttgagatctttcaagtggaaagaggtgtggagttttctatgatatacatggaagatgtgacaaagaggttgacctggccgaacaaggggagggccaaggtgggattctctgtgcttcctggttttaaaattgggagggtagttattcaatcgcaggtttatataaggttcctcttgaagtcgtgggcactgagttcggatgcgagtactatatgcaggaggtacatgaatcctgttgatggttctggtgttgtgagattttgccagaacttatttaaagatgcctgggcttga

SEQ ID NO: 19 - DNA, 327 bp, Glycine max
  Peptide Sequence Number=SeqID_116797
atggtgtctgatttatgtgggaagccttcaaattctcaaggggtaatcggtttggatgttttagtaagtagtagaaggcctacaatgtttccagtgatttctttgcaagccaactttaacatgttattgggaagggaatggatccatggagtaggagcagttccatcagcagttcatcaaaagattttcttttggaatgaagatggaaaactcaaaatggtggaagcagatcaatcatcgtatggaatttatgctgcttttgcaagtaaaggtgaccaagcaatgcaagaactgctccattcaaagtcgaagattcattctctatga

SEQ ID NO: 20 - DNA, 213 bp, Glycine max
  Peptide Sequence Number=SeqID_116798
atggctattgtggccatcaaaattagagaagtggctactacgacagtggaaaagaaagaaaagatggatgataatgccatcaaagaaaaagggaaagagatggatgcttatgccatcgaaatagatattgatgccatcgaagtaaagaaagaaaagatggatattgatgccatcaaagaaaaagggaaagagatggatattgatgccatctaa

SEQ ID NO: 21 - DNA, 546 bp, Glycine max
  Peptide Sequence Number=SeqID_116799
atgtctattttttatgatgacatagggagtccaagagaagcatctccaaagagtgaggaggtggtgaataataaacctcaagaagaaccctcattacaacaacatcatcttcccaaggaatgcaaagcaccaaaggatctttctatagacaatatcatcagagacatagaaagaggattataccagatggatgtcaaaagtgttttcctaaatagatacattgaaaaggaagtttatgtttcccaacctcctgattttgaggatcgtaaaaatgcaaatcataaaattgaccatggaacatttctctatcaaacaaagtattgcaaagaacttctcaagaagtttaagatggacaaaagcaaggaggatgaaactcctatggctactaattgctaccttagtgcagatgaaaatggaaagtcaattggtcaaacaaagtatagagactcacaactagttgatatcttcaccaaacctttagctagagataggttctaccatcttcataacaatcttgacattttaagggagtctaatctcacttga

SEQ ID NO: 22 - DNA, 336 bp, Glycine max
  Peptide Sequence Number=SeqID_116800
tgctcagtggaaaaactccctaacaatgaagtgtttagccctccattagcaaggagggcacaatacaagcgagcatgtctcgttgagcaagagatagtgactgggcgcttagcgaacttggacgcgctaagcgcgaggagcgacaaaggcttcgctgggcggcatatgatagctggtcataaagataagccagcgcagctaccccctaagggtacttgtggctatgatctagatcacaaaggtaatggtgatggtcatctcttcaactggaaagtggaaggaggacatctgattgtgccatctgttggaatagataggaatttagaagagggttga

SEQ ID NO: 23 - DNA, 339 bp, Glycine max
  Peptide Sequence Number=SeqID_116801
atgtttgcacattcgattaaaggctgccgtcccttgggacgggcgtgtggggtgctaataccttccccgtgcgtaaatacaactcccgaacctttcaacttaaaagttcgtagatcgcgtcttttccggtttttccgacgttttcctcaaataaacgttggtggcgactccgcgcgtattcctttcgtggaacacgcatcccgcgagtctcgcgtcgccctccctccgaagggtaggttgcgacagcgcgtttacccactcagcttgttgttcctgaatgataaagggcgcaaaattcgtctatgcgcgtttaccacccaacttgctatcatgctttga

SEQ ID NO: 24 - DNA, 934 bp, Glycine max
  misc_feature (626)..(626): n is a, c, g, or t
  Peptide Sequence Number=SeqID_116802
atggccaagtttgatccagaaatagtccttgagttttatgccaatgcttggccaacagaggagggcgtgcgtgacatgagatcctgggttagggggtcagtggatcccgttcgatgccgacgctatcagccagctcctgggatatccgatggtattggaagagggccaggaatgcgagtatggccagaggagaaaccggggaggcgagtgcgaatcatgcgcaccaacatgaccaccctgacccagatatggatgacgttgctcctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccaatcgttcggagtccccgttgcacctaccaaggtgattcggccgcccatcacccgggcttttatcgagaagtactgtacccagagacaggctcagggtgatgctccacaggcagcaggcgcgcccccaccacctcatcaggctgnccaggctggggcatttgacatggagcagtatttacagcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaaaagcccacgaggatgaggagatggctgatttgcttgacttcttgggagggagtggagacac

SEQ ID NO: 25 - DNA, 909 bp, Glycine max
  Peptide Sequence Number=SeqID_116803
atgaggtcctgggtgagggttcagtggatcccgtttgatgcagatgctatcagccagttcctgggataccctttagtgctggaagagggccaggagtgcgagtatggccagaggaggaaccggtccgatgggttcgatgaggaggccatcgcccacttgctatgtataccggggcaggattttgcccggactgctgccgggagacgggtgaggatcatgcgcaccaacatgaccaccctgactcagatgtggatgactttgctgctcagcaacatccagcccagcgatcataattccgacctccccctgccaaagtgtcagctggtgtacgccatcctgacacggatgagcattcacgtggcgcagttaatcgctgatgccatctatctatttgcaggtatggcgcctaccaggcaccctctggacccggataagtccaatagggccctgggatttcccgccttgatcacaggactctgccagtcgttcggagtccccgtcgcacctagcaaggtgattcggccgtccatcacccgagcttttattgagaagtattacacacagagacaggcccagggggatgctccgcaggccgcagacgcgccgccacctcatcaggttgatccagccggatcgtttgatacggagcagtatttgcggcatttggttcgccagcaggcggccaatcaccgggctcatcctgcagagccagggtttacttcttttccgtgccctactccggaccagttcagggcagaggtcgcatggcctggagattggcctgaggcccgggcaagagaggcacctgcagaggaaccagcagaggctcccgacgaggcagatgaggctcgcgaggacgaggagatggccgatttacttgatttcttaggagggagcggagccacatga

SEQ ID NO: 26 - DNA, 630 bp, Glycine max
  Peptide Sequence Number=SeqID_116804
atgaagcaccgctctaccgaacttgccctggccctgatgctcagcctgccgctggccgtgaccgccgttgcggctgacgcaccgcaggccgccgccgcgaagccgacggccgtagccaacgtgaagccggtcgctgccgacgcgcagcgcgtgatcccgctgcagggggcctggaacgtgcgaaccttcgccggcctgcagggccgccatggcccgattccggccgatgcgttcgtgcgcaccgccgacctcggccgcctcaccgatgccgaccgtgatgccctggccgctgcaggcgtgaagctggacatcgacctgcgcaccgccgatgaggaagcgcagtcgccggacctgctggccagggatgatcgcttcgactaccagcgcatctcgctgatgggcaccgagaagatggacctgcagaagatgatgagcagcttccccgattcgctcggcgaagcctatgtgcagtggctgggccacagccagccgcagttcaagcaggtgttccagcgcatcgccgcgcagcaggatggcgccgtgctgttccattgcacggccggcaaggaccgcaccggcatcatcgccggcctgctgctggacctggcgggcgttcccaaggccgagatc

SEQ ID NO: 27 - DNA, 432 bp, Glycine max
  Peptide Sequence Number=SeqID_116805
atgacattgtgtagcaaaacgtggctacgctaccacttacctcggttgatctctgtcttggatttggcgcggcccgagtcattaaaagactacgcatcttttaaggcacaaagcgaggatcagaacaacgaacccccaatcccacgttcattaagagattgcgacgagaaaattacagaggacaggaatgatgcaagctccattggagcttgtaggcctaggatcttcttcatcaatggattcttttgcttcttggaaaatgaatggcaacggaatggagaaaggaagagagagaggagacgccacttcaaggagaagatgagtctagaagaagctcaccaccataggaggccatggataagagcttggaggaagaaggagatgaatgaggggagagggagagaagagcacaaaattttgtgctctaaatga

SEQ ID NO: 28 - DNA, 186 bp, Glycine max
  Peptide Sequence Number=SeqID_116806
atgtcaagtgtctcaaaatatgataaaaaggatgcccgagaatgtggtgccatggagtttgggatgaggatgcgaagactagagctttgggtggaatgggatgaggatgcgaagactagagctttgggtggaatggttggtgatgtatgtgatataggaagagaagtaccatctacaatgagttga

SEQ ID NO: 29 - DNA, 849 bp, Glycine max
  Peptide Sequence Number=SeqID_116807
atggcactgactccgggagcgttcaggctctggtgggaggtgttcctgagcttcaggggcaacgacacacgcaacaccatcatgaagggtctctatgagtcttaccgaggcgcatggggttcacatgttacgggacgacgtgggattggagcatggggaagagataaagcgggggatgatgactacgcttcttctcgttggtgtctcgatgaactcaccaagatttgccagatcaggaggcttgtcttgcctgttttctaccgggtggacttgagtcatgtccgacaccagaagggtcccttcgaagcagattttgcatctcatgaactaagctgtgggaaaaatgaggtttccaagtggagggaagctttcaagaaagttggtggagtttcaggctttgacctaattggctacattgatgggacaaatccgtacccagcctccaaccatcatgacttccaatactggaagcaccaggatcaacttatcctttattccatcgtctcatacgttgatcaaaatgtgatcacattgcttgggaaagccatcatcaatgctttattggacaataaagaccttatcattcacaccctaaatgggctaggtgctgagtacaaggaggtttctacaactcttcgtactcgtgaaaaatcgtttgactttgaagagcttcatgatcttctctctaactttgagagttatctcaagagggatgacatcaacaatgatacctcatttgttgccactgctcatgcaacacacaagggtaagcaaccttaccatgaaaagtcctacaatccaaatcatggatcaacctccaaccgatccacctctctcaacttctcatag

SEQ ID NO: 30 - DNA, 780 bp, Glycine max
  Peptide Sequence Number=SeqID_116808
atgcagagccgccatgctctctccttcgcctgcttcgcttgccaccacgacaagcgctaccattccatcgacgagatccgcaacggcttccagatcttctctgataatcttaaactcatcagatccaccaacaggaggtctctcacctacatgctcggcgtcaatcattttgctgactggacttgggaggagttcaccagacacaagcttggcgctcctcagaactgctctgccacgctcaaaggcaaccacaggctcactgatgttgttcttcctgacgagaaagactggagaaaagaagcacaactggtgcattggaggcagcttacgcgcaggcctttagggaagaatatcagtctttctgagcagcagctagtggattgtgtcggtgctttcaataactttggctgtaatgatggcttgccatccaaagcctttgaatacattaaatacaatggtggccttgacacagaggaagcatatccctacaccggaaaagatggtgtctacaaatttgcagctaaaaacgttgctattcaagtcattgactctatcaatatcactttgggtgctgaggatgaattgaaacaagcggttgcttttgttcggccagttagtgtggcatttgaggtatcgaaggactttcaattctacaataatggagtttacactaataccatttgtggtagcatgcccatgggtggtcctggtggaaggcctggttttggtcgtggttccggtggttatggtgcaccaactagttcaaactttccttcttaa

SEQ ID NO: 31 - DNA, 450 bp, Glycine max
  Peptide Sequence Number=SeqID_116809
atggtggtcatcctgcccaaggaacacctagttgtctggttttgttcattgcataacaggccagacaactaccttaagggaattattaacagtgctttaaaaggtcttgatgatgctccacagcctaaatcaaaggctcctgctaggtggattgtcgtcaagtgtaatagacaaaaaggaagtactgagtgcggctactatgtcatgcactggatgtccaccatcattttaggaacttttaggaataactgggaagcggaactactctgtaaaaggtacgatggctacaatcatcatcccgttgcggcgagtgagttccacgcgacgacgagcgactcagactcttcctctgttatcgatctgaaccataatgaaggtgaggttaaggggaacggttctagaatctttgatctggaccttaaccatcctcctccacatgagatcgcttga

SEQ ID NO: 32 - DNA, 297 bp, Glycine max
  Peptide Sequence Number=SeqID_116810
atggaagatgtaagacctctatggcaacatatcaatgagacggaaatctttgctcatccgattgtgagggagtatgttcctccatctcccaatagtgagattaccttttccgcatattcgacatacgatctagctacccatactgggttccttttgcccatatgtctaattgattggacatccattttggaggactacactggtggtgtcagtgatgaggtgaaggatccttataaggatgtgagcgacccgagggagacatcagagatccaggaagatccatctaaagattcttag

SEQ ID NO: 33 - DNA, 297 bp, Glycine max
  Peptide Sequence Number=SeqID_116811
atgtcaaatgaagaattgaagttgcaggatccacgatgtcggatacaatgtcctgacatcctgcccgaaaatactggagttgctgcacaatgcataagtcaagataaaatgtcaaatgaagcattgaagctgcaggatccacgatgtcggatacgatattttcaggaagaagatagatctcatccagcacaagtagttgcagcccagaaacgcacactgctatttaaacatgaaggctgcacgagttttgtaccaagtccgggattgaagagttatcttgtgagttttgggacttga

SEQ ID NO: 34 - DNA, 327 bp, Glycine max
  Peptide Sequence Number=SeqID_116812
atggttttcaggacaaactgtcatgttctcaagcctaaaattcttgagctaaaaggtgtaattgttggtgttgttctttcaatcaaccataacattgacatacctaatatgaatcgagattatatgcctggagtgatggatgttaaagcaaatgtcctcaaacagggcaaaactctcttagtacagtgggatgatgattatgatggaggccaagaatcattggacaaattaaagacctacaatctgtctcagaaaaattggccaactttttcagcaatttatgaaagtggcagtcctatctatgccactgatgatgaagatgagtga

SEQ ID NO: 35 - DNA, 756 bp, Glycine max
  Peptide Sequence Number=SeqID_116813
atgggaaagcgagggcactcaggtgggatatgggtgttttcttttagaaggaatgttaagtggacttgttttgtgatttatgcctcttctactccaactgctagggttgccttctgggatcatttatctgtgttaagtgtcagcattatagggccttggagtcttttgggacaatttaatgagataatttccccttccaaagttgtgggtggctcttttcatgcttcaaaggccatccttatgattaatatgatgacctcttatggcttgctttacatggagactatgggaggtagctttacatggaggaaggacactcaaaatggaggacatattcgtcaaaagcttgatagggttttggttaatcctaaatggcatatctcatttcctcaagctttggtggaaactctccctcttcataattttgatcataaccccatgttattaagctactttaaatctcattccaagaagttgagatcctttcaatttcaaggaacttggatgtcccatccagattactcaccactagttcgaaacacttggcaagatgcaaaggggtctatcccttataaactgggtcgtattcagatgaaatccaaggagtttaatgagaaggtgtttcggaatatttttcgtaacaagaagaagcttgaatcccatattaaaggtgttcaccaacagcttgagtggaggcaggatcattctcttattatgttggaaaagatcttcaaagtcaatataataatatcctag

SEQ ID NO: 36 - DNA, 354 bp, Glycine max
  Peptide Sequence Number=SeqID_116814
atggtggcagatacttttaattcaggttcgattaacccttctttagatgatactctaattgtcactatccctaaagtggacaatccatcttctatgaaggatttcaaacccatcagtctttgcaatgtagctttcaagattgtctacaaagttctagttaacatgattatgcctttcttggacaccattatcagacctttcgagagtagttttattcccaaaacaggcactatggataatgttgttattactcaagagatagctcatcacatgcataagaagaaagaatctagccttattaattcaagagaaagttcaagcgaacctatgggaacctataaaaatttcaagtaa

SEQ ID NO: 37 - DNA, 324 bp, Glycine max
  Peptide Sequence Number=SeqID_116815
atgctcccccaggccgcaggcgcgcccccaccaccttcatcaggctggccaggctggggcatttggcatggagcagtattttcggcatttggttcgccagcaggcggccaaccaccgagcacatcatgcagagcccagggcttcgcttctttttcatgccctactccagaccagttcagggcagaggttgcatggcccggagattggcccgaggcccaagcaggtgaggcacccccagaagctcccggcgacggagaagaggcccacgaggatgaggagatggccgatttgcttgacttcttgggagggagtggagatacgtga

SEQ ID NO: 38 - DNA, 186 bp, Glycine max
  Peptide Sequence Number=SeqID_116816
tcctttcgctaagcgcaagcctcgcgctaagcgtatctttggtcatgtgctaagccgagagcctctaagaaccgagcttgaagaggaagccgtcctaagagcttgtgatgagtttgtgagtgattgtgaggttctagaggaagcttcccagtcatggagagctaaatcctctgttggttcttcctt

SEQ ID NO: 39 - DNA, 1560 bp, Glycine max
  Peptide Sequence Number=SeqID_116817
atcgagctggtgacgcgctgctgcgcgatttctacggccaggaagtggtgcggtactcggccaccaagcccgcgaccaggatctacgagaccaacgtggtggaggccacgagctatcacagcgtcaaacgcctcactgccgctgggaagcctggcgatctggctgtgcaagtcgataccccgtacgtgtccatcgtccctacctccacggctgaaaccccggtcagtgacgttctggccggcatgggcaccatcagccaggtcccgtccggccctgccggcagcctcggccagaacttcaatgcgagctttgctgctggcgtgccggtcagccgatacctcggtactgggttggtggtgggcgcaataagggttgtcgcaggcagtgtcgaacttaccgacgacggtactggcgggctcgcttccgccgtggcgacgccctggagcggtacggtcgactatcagggtggggtcgttgccttgacgcatgcgagtggcgtcggcagtaccagtatcagcatcaccgcgtccccggcgggttccatccccatgcagggcttcaccgacgagattgaggtgacgcagaacaaccagggcatggtctggctgttccaactgactccgttgccggccccaggaacggtggtggtcggctaccgcgccctggggcgctggatcagattgaccgacaacggccgcggccgtctgattggcaagccgggccaaggcactgggacgatcaactaccagaccggctccgttgtggtgaccgctggcgcgctgccggatctgaagagcagcatcatctccaactggggcactcccatcatcgcggaggcccgggttggtgatgctgccatcctgccgccggcgctccgctttgtgctgggcgagggctcggcggtaccggagacggtgcaactgacgctgcgtgtcggcggctccaatgttgtggtcacagataacgggaacggcggcttgctgattggcgggcaggttcgtggacagatcagctactcgaccggtgagatttcgctccggccgctgagtctgcctgatgcggacagtcagctctcgatcgcctacgactgggggcagccgctacacgcagcgccgcagcctgttccggacgcggccgggatcgtctcgttcaccctgccgcagggaccggtgaggcagggcacagtgcttctcgactggcttgtgagtgtgcggcgcgatcgcgatgacctgtcgtcggcccctcaggcgatgcgggttatcgccaaggatgatggcgcaggcaacctggtgggcgtttcggttggggatacggccttcagcacagtgctgggcgccgtgaactacagcacgggcgcggtctcgctgcaggcggggaagttcatggtccgtcaggtttcctatcccgtgtacgagatccgctctgggcgtctgaaggtggttggctacgagcgcctagacgtgctagcgcagctctccgccggcagtatcgtttcagccggttggatgctcgccggcgaggccgcccagtctgcgcaaggaggccatgccgctgcctgcg

SEQ ID NO: 40 - DNA, 432 bp, Glycine max
  Peptide Sequence Number=SeqID_116818
gagcagtcgttcggcgtggttaccgctggcggtccacgattaaacgttcttcgaatcgaggaggagttgagtgctgtgcatctccgcctggcgaataccgtgatcgagtgcctgccgtggcaggagtgcgtgcggcgctacgatcgcccggggacgctcttctatctggatccgccgtactgggagacggagggttatggcgttgagttcccgtttgctgagtacgaggcgatggccgagctgatgcgcacctcggccggccgcttcgtggtctcgatcaacgaccatcctgagatccgcgaggtcttcgctggcttcgacctggtgccgctgcagctcgactacaccattggcggcgggcaggggagagggaagaagttcggagagttgatcatcaagagctgggacgacagccaggccaccctgctgtag

SEQ ID NO: 41 - DNA, 303 bp, Glycine max
  Peptide Sequence Number=SeqID_116819
atggctatgcgtgaagagctgaatcaacataagagaaatgaagcgtgggacttagttcctaaaccagcctctcacaagtcaatcggaaccaagtgggtgtttcgaaacaaacttgacgaatcagacatcataactaatccaaaggaacctcatttgacagttgttaaaaggatcattaagtaccttaatggcataaccaatgttggtttgtggtatcccaaagggtgcaaagtagataggaaaagcacaagtggtacatgtcatatgttactagaagttgttgtggtcaaagtctttggatga

SEQ ID NO: 42 - DNA, 201 bp, Glycine max
  Peptide Sequence Number=SeqID_116820
atgaccattaggaggaaacaccgagtccgactgaaaatagaagaaaatcactcagagtgtataaacctcacacagggcgaggatgcacattctcaccctaggtcaaggtttatggtgagttgggattttggctcaaggcttgtagaatggctagacatgatatatgtcagggtgttggtttggccagcagttcagggataa

SEQ ID NO: 43 - DNA, 321 bp, Glycine max
  Peptide Sequence Number=SeqID_116821
atgaccatttgtatttctcgagagcttccattgttcatcttcgagcgtctcgttatatcatgggcctcacacatacaccggagtcaaaagtcatggctgcttgaattttcaaacaacttccatgttgatgaggacatgaccaagagcaagggcaaggatccacttgaaggacttggaggacctatgacaagggctagagcaaggaaagccaaggaagctcttcaacaagtgctgtccatactgtttgaatacaagcccaagtttcaaggagaaaagtccaaggttgtgagttgtatcatggcccaaatggaggaggactaa

SEQ ID NO: 44 - DNA, 204 bp, Glycine max
  Peptide Sequence Number=SeqID_116822
atgtcttcagtcatttatgttttcaaaagaggggatgagaaggaggttcaaaggtccaaaggtccaaaattgagagaaagaagagaaaagaagaaggaagaagagaaaaagaagctaaatcgccgcagaattgcgactgcgaacaatttctacattgttcttcgttcgttcttcgttcttcgtccggttaatgcttgtctttaa

SEQ ID NO: 45 - DNA, 828 bp, Glycine max
  Peptide Sequence Number=SeqID_116823
atgaaggccatgaaagagcaaatgaccacaatgatggaggccatgatgagcatgaagaagataatggaggtcaatgtggttgtagttgcctctacgagcgtcgttgctgaggtcagggaggcaaagagttgggaagtatggggcccccattttgtgcaagttcagaacaagcatgccttcccgccatatggcttgcctcccaatcatacaccacccaatgttgcacacgctcttgatgagaatgttgacaactctgcacccatacccgttgagagccaacaaccccaatttgatcatgcacatgtctctcaacccatgggggagacacacgaagtaccccaccacaatctagttgacttcgagccttacctcagatatgccactgaggggcaagcagttggtggtgtacccctgccaaacactttggaggaccctcaatttcacccacaaccacaacccttgcattttgcggaaaggctgagggccattgaagaaggtggagattatgctttcgttgacacggtagagttgtgcctggtgcctaacatcgtcatccctccaaggttcaaggtgccggattttgataagtacaagggaactacttgccccaagaatcacctgaaggtgtactgtaggaaaatgggagcatatgcgaaagatgaaaaattattgatgcatttcttccaggaaagtcttactgggacagttgtcacctggtatactaacttggaaccttcccgagttcattcttggaaggacctaatggttgccttcgttaggcaatatcagtacaattctgatatggttccggatagaatgcagctatag

SEQ ID NO: 46 - DNA, 936 bp, Glycine max
  Peptide Sequence Number=SeqID_116824
atgttggtggcaactccacgtgttattttcacgagaaggcgcacttttgagtttcgcctcaccctcctgtcgaaggttttaactggaaatgacttgactgaaattacacatattactcaacttcatgacaatgttttcaaaatcaaggacttaggagatttgagattttttcttgggtttgaagtagccagaagcaaaagaggtatcaacatctgccaaaggaaatacactattgatattttacatgatacatgcatgataggatccaaacctatttctactcccatagattattgtactagacttcatcaaaagtctgaaactcctctttctgatactgatgcttctgattatagaaggctagttggaagactcatttatttgacaaactcaaggcctagtatcacctttgttttgcagaacctaagttctggtgtgttctttggcactccacggctaaaggccttcagtgactcagactgggctcgatgcttggatactagatgttccattactggttttgttgtttactttggttcttctttgatttccatgaaatcaaagaaacaagttattgtttctcgaagttcttctgaaactgagtacagagcaatggccagtgtcacttgtgagcttcaatggctcacttacttacttgaagattttggtattcaattcaatagacctgctttattgtactgtgataatcgttcaacattacatattgcagcaaatactgtctttcatgaaagaaccaaacatattgagatcgactgtcacattgttagagagaagattcaatttggattgctcaagctattacctatagcttctgctaatcaattggcagacatttacaccaaagctctcccacctggggcattcgaatttcttaattacaaccagggaatatcaaacatacattctccagcttga

SEQ ID NO: 47 - DNA, 246 bp, Glycine max
  Peptide Sequence Number=SeqID_116825
atggctacattcagatggaagaaatgtttaggttcaggaacgaggttagacaagctggacaaaaacatgtctagcggcaaggaagcaccaagaccaaatcacacaaatgtgaacagcacgacattttgtccaggaacatgccgtgactggcctgattgtgatcgtggctgcaagttcagaggctatcagataggcatgcacttgcgtccgacctcaaaattacttccgcagttgctccaaatatga

SEQ ID NO: 48 - DNA, 471 bp, Glycine max
  Peptide Sequence Number=SeqID_116826
atgggggagggatattgtacgcagtcttacccttgcagatgcaaagaggctgtttccggattcgaacccatgaccaacaagtcaccaagacacaactttaccgctgcaccagggttcgccctcacagaatataaagtggtatgctggaattgggtattgactattcacgtgaactccaacaagtggaatgggagatcatctaactccaaccaaaggggaagaggtcccctcgggcagcgaaatgcagacataagcagattcccgatcaagacatgtaaagatggacccacgtaccatgctcacaagagagcatctgctcggatattcaatgttgttacaaagtacctagaatcctcacttatcccaaacaggcggtctctgtgtagatttaaaatgttgaacaactattttgaggtttcaactagacttgggggtgggggtgccttgatttatgctatttccaatctataa

SEQ ID NO: 49 - DNA, 252 bp, Glycine max
  Peptide Sequence Number=SeqID_116827
atggctatgttttactgtagccccatggtgggcgccaaatgtacttaccaagattccgagctggcacacgtcagggtagacgtggctaaggacaaaggggtggaccctgcaaaacaaagaactctgacgctcaaggaacctagtactaatagtgtggagagggagctacgagtccttgttgataggggcttttacggtgacataacaatccttgcaaataatcaacagcttgtagataaaagtagcttatag

SEQ ID NO: 50 - DNA, 477 bp, Glycine max
  Peptide Sequence Number=SeqID_116828
atgaagaaggagagaggcgatggaaatgggtattttgacggcagggactacaaagattccaaagcaagtgcacagatactaatgtgtgcccctctctcaacgggaattggaacctcaactagtaagtggacaaaggcgaaacctgtagtggcacacgagttcgagggaggccccagcgatgccgtcgaggagggcaccgcggtgggagtcggcggcggccttgggcggctggtccccctagaggcggacgacatagacttcgaggacaatgatgacgaggttggggagggagccgatgtggtggctagggcgggagggccactcgacgtcgatgtcatcgggctggagaaggacgaagtcagagcgagagtgggtgaggaacccgacggggcaattatcgatgccggtggggcactgcatcatcttgtacgccgcgaaactcatggtggaagaaacagtgtttctgtgtgtccctga

SEQ ID NO: 51 - DNA, 672 bp, Glycine max
  Peptide Sequence Number=SeqID_116829
atgaagcgcttcatgctcccaagaaaccctctcatggacgcagtagagcttccttcttcgccaagcccaaccccaactaccagctctaccaaaccccgtccctcttctcgcaaacacaaaccctccaaagagaacgacactccctctttcattactccctcccctgccaaattgaagagccccttgcccccgagacccccttcttccaaccctctcaagcgcaagctcaccgctgtcgatgccgtaaccaacaattccctccctgcaccctccgattccggcatcaaggttattgtcaagatgaggtcgctgtcttcggacaaggacgaaggagatcccacaattcacaaggttttagtgtgtgacaattttagtagtgttgttgttaatacggaaatggttgagtactatgatatttccagttgctatattctgaggccttggtcaatggcaatatgggagatcatgcaaagttgctttaatttcgaaaacaatgtgctggagtttttcgatccagaagtaaagaaaatgaaaatcaagacctgctacttcccattgtttgtatctcctgaaattctgcaaaaggagaaggaccacgttgaggattttgctcctgaggtgaaagtttgtgaatctgttgggccatgtaatgttgactattcaataagttag

SEQ ID NO: 52 - DNA, 312 bp, Glycine max
  Peptide Sequence Number=SeqID_116830
atgattcctggtcaagcccctgttcctgagaaactggttcccaaaagacaacagggagtgaagatttctgaaaaccctagccttgcaacaagtcctagggaagtagacccggagatggataagaagatccacagtattgtgagtagcattctgaaaaaagcttctgtccctgatgctgatgaagatgttccaacatcctccaccccaaatgattatgtccctgatgcaccactggacaacatttcattccactccattggcaatgttgaaaggtggaaatttgtgttagacaagtggcctcagatatcttaa

SEQ ID NO: 53 - DNA, 303 bp, Glycine max
  Peptide Sequence Number=SeqID_116831
atggtagacataaccctaaccaaggttcatcaacctccatttctccgagaatacgactcgaacgcaacgtgtgcttgtcatggagaagccccggggcgttgcattgagcattgtagggctctgaagcgtaaggtgcaaggtctaattgatgcaggctggctgaaatttgaggagaatcacgtgattttcaactttcaccggaagtgggtgcaagccattggtcagtttgctcaagcgacctatgctcctgagcttgggacttccaagaccgttggtgggggtgttcaaaaaacatttgattga

SEQ ID NO: 54 - DNA, 375 bp, Glycine max
  Peptide Sequence Number=SeqID_116832
atgcaatcacagcgactcgcactgcctcctgagcctgaggttggtccttcagctacttgtgccaacactaaagagagttgtgttgatccctcagggaatgatccagacacaggtgacttagacaaatacaggttgtacatcgaagaaaatcctccttgcctggttgccctaggaagagtttatgagggatccataatcgttcacaacattcctttgttgcatgatcaagtcaaggttggtgttgaggaggttagagatgcatatgcttccattcccgtacccactgaagaggttaagttagtggggcaggcacttaacactttttttgctttgccgacacatcttgtcaagggtttatcagaacaggaaaaataa

SEQ ID NO: 55 - DNA, 1558 bp, Glycine max
  Peptide Sequence Number=SeqID_116833
atcacccgcgtctggatggatcgaccgtcgtgctggtcttcgccgaagaagcggccgacaccggcctggaaaccaccgcgcagtggcgcgccgatccgggtcggctcccggccatccagccaccagctcagccagtgctgctccgccgcattccaggcgcggatgcccatgccgcgcagcggtgctgcaggcacgtccatcacgttgtcacccacgttgccgaatcctcccaggaccggccagttgtgcagggtgccgttgaacgcgtcccacgcatcgctgcctgccagccgagtgcgcaggcgacgatggcgcgcgttccaatggcccaccaggaaatcaaagtcgcccggtgcatccggcagcttcggaagcggagaagggatcgcagcagtgcggcggaaccagttgcgccagttcacttcccagtgcgcaccggcatcgtcggagaacgcctgctcccaccacggctcctcgccgtggatgtcatgccagcggaaccacacgtcgatggggcgtccgtcgatccggtcggtgccgcggaagctgcctgcatcgccctcgaaaacgccacgcacgggggcttcgatacgggcagggttgcggccatcgatccaccagatcgaccacatggaagacaccggatcgaatgcacgcacgcccaggcccctgtaagggcccgaaggcagcgccatgacgttgtcatcgatggtgccgagtccgcccagggtgagccagaccgcactggaaccggtgaaggactcccaacgggtatcgccgaccaggcgctccttcaggcgctggtgccggacctgccagttgccctgcaaccatttccaatctttgctgtggctgggcagggcccacccggagggcaggacggtggacgctgccgcggcggccaaagtggccaggaactgccgtcgatccatgtgctgatccgctaccgaaggtgcctccatcgttgcgggcacgaggggggattgaccacgcagatatcggggctcaggctaagccacacttatggtgacccaacgccagcttccgtcgcttgccgccatccgtgccttcgaggcggcggcgcggctgggcagcttcgcgcgtgccgccgaggagctcgataccagtgcggcatcggtgagctaccacgtgcggcggctggaggcccagaccggcacctgcctgttcctgcgccacgctcagcacgtggaactgacggtggcgggtgccagcgtcgcccaggaggccacccgggcattcgatgcactgcgcgccagcttcatgcgcgccgcagacatggatgcggcgcgactgcgcctgtctgtactgcccacgctgggcaccagttggttgacgccgcggctgggcaccttccgcgcccgccaccggcagctcgtgctggaactggacctgtcggcagcgccgcaggatctggccgccggtcacttcgatgccgccatccgcaatggccagggtggatggccaggtcttcaggcaactcctttgtttcccagcgtgttcacaccgttgtgtgcgccggcgctgctgccagcggccc

SEQ ID NO: 56 - DNA, 323 bp, Glycine max
  Peptide Sequence Number=SeqID_116834
gtatctccgcgtatcatgggtgcagaatgaccaaacttggtctctgcttgccaacggacacgactgtgtctgaatggcaaaggggtgcggataaccataaggtatctccgcgtatcatgggtatctccgcgtatcatgggtgcagaatgaccaaacttggtctctgcttgtcatcggactcgactgtgtctgaatggcaaaagggtgcggataaccgtaagaatgaccaaacttggtctctgcttgtcatctgctctggacgacaaaagggtgcggataaccgtaagggtgcggataaccgtaagggtgcggataaccgtaag

SEQ ID NO: 57 - DNA, 183 bp, Glycine max
  Peptide Sequence Number=SeqID_116835
atggcattagcgtgtgacttttgtaaggagacaacccatggggtattttgggttagaataggtagcgaaatacctttggcaatttacactttgggtatgatggcaaaatacttggatgtattagaaataccaggaggtgtacatgtgcaatttttggtaccccaaaatgctttgagtatgcat

SEQ ID NO: 58 - DNA, 279 bp, Glycine max
  Peptide Sequence Number=SeqID_116836
atgattgatgctgccagtggtggagctcttggtgatatgacccctgttgaagctaggaatttgattgagaagatggcttccaactcccaacaatttagtgcaagaaatgatgctattgttcttagaggagtccatgaggtggccacggattcatccttatctactcaaaataaaaagcttgaaggaaaacttgatgccttggtcaacccagtaacccagcttgccatgaatcagaaatctacacctgttgcaagagtctgtgcaatctggagtcaatga

SEQ ID NO: 59 - DNA, 1384 bp, Glycine max
  Peptide Sequence Number=SeqID_116837
tctcagcgtggccatctcaatgccgatcggcattcctctgggcatcatctcggggctggctggacgcaaaattgatgcgctgatcatgtggctgatggatattattttcgccttccccggcatcgtactggcgattctgattgtcagcgtgctcggcgaggggctgacaaacatgctgatcgccatttcgttgttctcgatcccggtgtatgcacgtctgagtcgcaacctgacgctgggactgaaaaatatggagtatatcgaagcggcgcatatgcttggcgtgcgatacccgcgcattatcacgcactatattctgcgcaacgccattggcccgctgattgtacagtcgacgctgacggctggtgcggtggtgctttctgccgccagtctgtcgtttctcgggctcggcgtgcagccgccgatgccggagtggggcaccatgatgagcgatggccgcaactttctcgggctaaatatttacgtctccctatttcccggactggcgattttgattaccgtgctcggttttaatttgctgggcgacggcctgcgcgatgatcggctaaccctgctcgaccagcaaaaaatcccggcgacggactggcaggcattttgcgccagagtcagcgagatgatcgccgggcagcataaccatttcagcagccaggcggctgttgccatctccacggcgggcattgtggcaccgcaaaccggcgaaatgtttgccagcaacatcccggcttttcaccggcgtaatctggcgcgggaactgggtgaggtgctgcagcggccagtgatcgcgcacaacgatgccgactgctttgccctggccgaggcgctggccggcagcggcaaagggcacaaagtggtgtttggcgcgattctcggttccggcgtgggcggtggtctggtggcggacggccgcattatcaccggacaaaacggcctgaccggcgaatggggccacgggccgattaccctcacggaagtgacgctggcgcatcgtcgcgtgcgcgtgccgcgccaggcgtgcccgtgcggccagacagggtgtctggacacctacggcggcgcgcgcggactggaaacgctgcatcaggtgctgcacgctgaaagcgccagcagcgtggaaatcattgcccgctggcagcaggcagaagcgcgggcgcagcagacgatagaagcctggctgcaactggtgagtgagccgctcgcctacaccattaacattaccggcgcgtcgcgggtggcggtaggcggcggactggcttcggtcaccccgctgattgctgcgcttaatgatgcggtgcagcgctgtgtgttgcgcagcacagcgcatgcgctggtggtgccgggcgagtttgcccaccagggcggcatg

SEQ ID NO: 60 - DNA, 471 bp, Glycine max
  Peptide Sequence Number=SeqID_116838
atggctcaagcctctgaggaggacttgattttgatgtggcttttccttatcggtcgtcagatcgactgggctcacttggttaggtatcaaatacaaaaggcattacgggccaatgcacctcttctgtatcctcaattggtcaccctttttctccgtcattttcaaattcctcttgatgatgaaccttttgttcaagtcaagcgatcttttgccattggtgctggtgcatggctgaagaaggacatgcaacctctgcaagacgagtgtactccctctcttcctcctcaacgagatgattccttagcccttatgaatgaagttctttcggaattacggggcctccgcacctatgttggcgaacgctttgattccttggatggtcgctttgaaggaatggatactcacatcacccagcttgaagaggatgtgagttatcttcgtcggtgcttcgaccttccaccaccttcctag

SEQ ID NO: 61 - DNA, 562 bp, Glycine max
  Peptide Sequence Number=SeqID_116839
atgtataatatcggtatgcgtagtttaagaaagtactgctatattgcgtttgtcagtgctgcacttttgccttggaatgcaaccgcagttaaccacgaggcgttaactgcgcgtttgttcgtccaaaacaagagcaccagcccggttgaacgcatgctggtgcaaaccctgcaatctatcaaagaggggcgtttgcaacaggcattggactatgtcgaccaactgctggccatttccccaaactttgcgcttgcccacctgattcatggcgatttactctccgccaaagccaggatattaaacaatttcggtgacgctaatgtcgccgacaccacccgcatccaggacttcaaggaagaggcggaaatccgtatccgcaactactttgaccgcaaccgcggcttgacccagcccaacatgctggttgaactgtcagaaaagcaaagccacgtcctgtttgttgacactgcccgctcccgtctttacgtttatgaaaaaggcgaaggggacgtattgaagtataccgctgactactatgtcaccattggtaaaaatgggattg

SEQ ID NO: 62 - DNA, 717 bp, Glycine max
  Peptide Sequence Number=SeqID_116840
atggctaagtttgaccctgaggtagtcctggagttttatgctaatgcttggccgacagaggagggagtgcgagatatgcgttcatgggtgaggggtcagtggattccttttgacgtagatgccctcagccagttcctgggtgacccgctagtgttggaggaaggccaggagtgcgagttcagtcagaggaggaacaaggccgacgggttcaacgaggaggccattgcccaactattatgcacactggggcaggatttcgcccggaccgctgcagggaggcgggtgcggatcatgcacaccagcatgaccaccttgacccagatatggatgagattgctgctcagcaatgtcttgcctagtgatcataactccgatctccctctgctgaagtgtcagttggtgtatgccatcctgacacggatgagcgtccacgtggctccgttgattgctgacgccatctatttgtttgaaggtatgccacccaccaggcaccctctagacccggataagtctaacagggccctggggtttccagcattgatcacgggcctctgccagtcattcgggtattgcacgcctaggcaagcgcagggtgatgctcctcaggccgcagatgcaccgccaccacctcatcaggccgatcccgctgggtcactaggcatggagcgttatctacaacccttggttagccagcaggcggccaaccatcgggggtag

SEQ ID NO: 63 - DNA, 507 bp, Glycine max
  Peptide Sequence Number=SeqID_116841
atggctccttctttagttcgattatatgaacaaatgcccgaacctaaatatgttattgctatgggagcatgtacaattacaggggggatgtttagtaccgattcttatagtactgttcggggcgtggataaactaatcccagtggatgtctatttgccgggctgtccacctaaaccggaggctattatagatgctataacaaaacttccaccaggaggactattagctagtgtatatcaccttacgagactagagtatggtatagatcaacccgaagaggtctgcataaaaatatttgtcgcaagaaaaaatcccagaattccttccattttctgggtttggaaaagtgcggattttcaagaaaaggaatcttatgatatgttgggaatctcttatgataatcatccgcgtctgagacgtattttaatgcccgaaagttggataggatggcctttgcgtaaagattatatcgccccaaatttttatgaaatacaagatgctcactaa

SEQ ID NO: 64 - DNA, 888 bp, Glycine max
  Peptide Sequence Number=SeqID_116842
atgcggatggatatggcctttgctgctggtgtgggctctcaagcgggaaacatgtatttcgagcgcttactacctgacgcggatgcgatgaaaacatattttgcgtattcgaccacacaaaaccatactttctttagttttgctttaggcaataacgatgctttaggttgggctacaaacggtggtgtagaagatggaccaacatcaacattgacctctacagcgctttttacgactttattgggcaactatgtaacgacattaaccgcaggaggtcaaaaaggggtactggcaacaattcccgatgtaacggcaacaccttattttacaactgttacacgggcagctttattggcagcggtgaatgcaacaaacccgccaactccggtaactaatatttatatcgccactaaatcgggtccccgtgcggctacggatcaagattattttgtacttcctttctcctctatgggattattaggaaaaccaaatgaagcgcaaattccttatggcttacatccattgaaccctgtggaagacaaatatgtattggatgtgagcgaaacagcaacagtcgtgcaacgcatcaatgaatataatgcagctatcaaggctgccgcagattcaaaaggcctggctttagctgacgtacatggattcctgaacaatgtaaaaggtggtgtccgtatcaatggattagccgttagtgcaaaatacattactggaaatgcattctcgctggatggaatacaccttacaccaattggaaatgcattgatggccaatatctttatcagtgccatcaattctaaatatggttcaaaaattccacaagttgacgtagcgaaatatcgcggtgttaaactgcctgataccgtcacaaaataa

SEQ ID NO: 65 - DNA, 441 bp, Glycine max
  Peptide Sequence Number=SeqID_116843
atggcggaaccatcgaagaagcgaaagggcacttcgagccggagtcaacagtgtggggggtcacaagaaacaccaattccttcctccattcccttggggatcattgttttcatcagaggaacagcgtatacgtccctattctatgatttaacccaattgccaagcgaaggtgtaccatttgaaggtgcactgattgatgattggaagtttgatttttctgtgcatgatgcccgccggttggtttgcaccaatcaagcggatatgaacggaaggcttcttgccgattcattggcttttgaaagccgcatcctccattacctaattgttcgcattttgcttccaagatcttcaaaccttgctcaggtttctgaagaagatctcattgttatgtgggcctttcataaaggtctacaaatttattgggcacatcttgttagataa

SEQ ID NO: 66 - DNA, 309 bp, Glycine max
  Peptide Sequence Number=SeqID_116844
atgatagttaaccaacaagtgaaggtagctaaggatcaagtacaaataaaactcaaatgggatgagggaaagaatagaaaaagaaaagaagaacaacctttaatggttaagaaggaatgtaaggaggtaagtgtctcctccaagaggttaactaagatggaaagtcattttgcaataaagaaaaactttaaagaaacttcccttcttaaacaaccttcacatcttctcctttgtaaaagaacacttgttagcactgccaaacctcttgagcttgaggctattcctcaagtaaaggaccattttgcctaa

SEQ ID NO: 67 - DNA, 333 bp, Glycine max
  Peptide Sequence Number=SeqID_116845
accacgtcttttccggtttttccgacgttttcctccaataaacgttggtggcgactccgcgcatttttctttcttggaagacgcatccgtgagtctcgcgtcgccttcccgccgaaggccatgtcactcggtttggaactcccttgtgactcagtgtggacacgcttaggctctttcttgacgaatggtaccacattggatttaagagttgaggagagggttgatgcaatcctccctaggaagggaccagtcactagagccatgagcaagaggctccaagaggattgggctagagctgttgaagaaggccctagggttctcatgaacctcagg

SEQ ID NO: 68 - DNA, 1171 bp, Glycine max
  Peptide Sequence Number=SeqID_116846
ctccttcttccatggcttattccctagtggatggcacctcctctcacctcttctcctttgtcttccgctgcatctccatgatggaaaatcaccattaaaggacctcattgaagctcaaagatccagcctccatagaagccccacaagcaagcttccatcacacgtcctcgccttcatagggctacatgccctaaccttcagaggactacgcgtcctcaccttcagagggctacacgccctcgccttcacaggactgcatgtcctcgccttcgtagggatacacgccctcacctttagaggactacacgtcctcaccttcatagggctgcccgccctcgccttcagaggactacacgtcctcgtcttcagagggccacacgcccttgccttaagagaactacacgtcctccacttcagattgttgcgtgccctcaccttcacagggctgcatgcccttaccttcgaagggatacatgcccccaccttcagagggctacactccatcaattatagaggactacacgtcctcggcttcagaggactacatgtcctcaccttcagaggtctacacgtccatggctttagaggactacacattctcaccatcagaggactacacatcctcgcctccagaggactacacgtcctcacctttagaggactacacgtcctcaccttcagaaggccacacgccctcgccttcgtagggctacacgctctcaccttaagaggactacacgtcgtcgccttcataggggtgcacgccctctccttcaaagaactacacgtcctcctctttagaggactagtaggactacaggtcctcaccttcagagcactactcgtcctcgcttttagaggactacacgtcctcaccttcagaggactacacatcctcgcctttagagggccacacgccttcgccttcagaggactgcaagtcctccccttcagagggccacacgccctcgcctttgtagggcttcaagccgtcacctttagaggacaacacgttttcgcattcattaggctgcatgccctctccttcagaggactacacgtcctccccataagaggaccacgtgtcctcaccttcagaggactacacgtccttggcttcagaggactacacgtcctcaccttcagaggactgcacgccctcgccctctga

SEQ ID NO: 69 - DNA, 1080 bp, Glycine max
  Peptide Sequence Number=SeqID_116847
atggcaattccattcaagacaaaagatgtcaacgaggaagtaacctctagagacattaaaagcctaatggaacaggcaaattataccaacaaatacttacaagctttaggagaaaccattaaaactaaggtagttcctaaacaaaaatcaattgaggaagcttcgctgagtgtccccattgaaaaacctttattcaaacctttcaaagttagtgataaggctaaacgaaaaattagggaacttagaaaaactaaatccttaattgaaggcgtaggtgacaatcatagcgaattactaaacaagattagtagtttgcttaaggtcattccagatactccccaagcttcggaaaatacttccaaaatggtaacaagaagtacctccaaattaattaatgttattaatgaagatagtgaccaaaacttagataacacaactgagataggatcagtgtcagaaaagaatataaatccattaaactccaaacactggaaaaccccctccaaattatattatcaacgtccaactgcccctgaccttctattagaagaaagaggtgaaaacaattttaaaatttttagtgcaaataacatctatgaatggaacatagatgcacaaacggagtataacatcatgaatacactccaacatatgaccatggtagccacggcttaccaaacctcccatgaatgttcggaagaaaccattatagatatcttagtggcaggattttccggacaactaaaaggatggtgggataattatctcactaatgaagagaaatcaaaaatttacagcgcagttaagacggatctcaatggaaaagtcattactaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagagaagatagtcaacaacctttttggaaagaaaaattcctagccgtcttcccagatccttag

SEQ ID NO: 70 - DNA, 162 bp, Glycine max
  Peptide Sequence Number=SeqID_116848
atgaggctcagcccaacagtggcgctaagcgcacatcaggcgctaagcaagcaaccaaatgcaggcgctaagcgtggcgttaagcacgaaggagcagaaaccgttacgcgcgctaagcctggctacgtgcccagagcgcgatccaacagaagcacaggctaa

SEQ ID NO: 71 - DNA, 330 bp, Glycine max
  Peptide Sequence Number=SeqID_116849
atgacagcacacacagcaaaatcaataagcagcaagctagaagttagtgtcttgcaaagcgaggcttatgtgcgtagcgagaatcatgcgctaagcgaggcactcagcctgcttagcgagttgggagaatctgaaggagaatttgagaagtatctcatgctcagtgcatcatcagctcccttagcgaggcgtttgtctcttcccacgctatgcgcgcccagctcgctcagtggattttcactaactcgcaataagtgcgaaaatggcgctcagcgagccttcgaggacagaaagccctttttaaggttgaagttggaaaaaccaaaatga

SEQ ID NO: 72 - DNA, 303 bp, Glycine max
  Peptide Sequence Number=SeqID_116850
atgttgcagagcatccaccgtggcttatgcctagtgatgcaaagtatgcatgactcggctcagcatcgaccttttatcagcatggatgagttcatggcacaggtggcctggccaggagtccagccttctcctttggggggaggtgaggcttctgcagcccaggagcctcagccagagccagaggtcgcacgagaggccactccagagacgactccacaggtttcacatgctacttcatttgttgtggaggtctctgagggtgaaaaaggtgctgaggacaccaactatgcagcaaatttatag

SEQ ID NO: 73 - DNA, 1593 bp, Glycine max
  Peptide Sequence Number=SeqID_116851
atggtcatttttctatgtttgaccatggtcatttttctctggagcctgcttctagttatgcatataatcacaagcaagatgtacggatatctaagggaggtgtttgatattttaaaaagtgtggcatgtatggaaaatactgaggaagagcaagatgcagattttgtgaatgcagaaaatgaaagtgtacctaattgtcccttattatgcacacaaggtttgaatgagtttgttaatgctattggagacactgatgttgatgaagatgaggatgaatttgaggaaaaaccatcagtatatattagtggtgatgaagtggataggttctcatttggagaccttgaagcgacatatttattttactattggtatgctagaattaatgggttttctctaaggaagagcaaagttgttaaaaattgtaagggtgagaaaacacaacaaacatttctttgttctaggcaaggtgttagggaagacaaaggacgatgggaagtgaaggagttttctgatgagcacaaccataagcttttgccaccagagtgcagcaagaacaagttcttgtgtccgtttgtgattttctctggtgttaacaaccacaatcaaacagtaatctttgccactgctcttgtttctgatgaaactgagcaaaaatatgtgttgttgttagagcaatttgtggatgcaatgaaagggaaggcaccggtgtctgtaacaacagatggggacttagcaatgaagaatgctataaagagtgcttttccttatgtgcatcataggctatgtgtgtggcatctaatttgtaatgctaattctaatgtgcatatccttggtttcatgaagtcctttaagaaatgcatgctaggtgattttgaggttggtaaatttgaaaatttgtgggatgaaatggtgaatgagtttggattgcatgaaagtaggtggatagcagacatgcacaacaaaagacatatgtgggcaacttcatacataaagggtagttttttcgcaggaataagtacaacatcacgtgaaggatttcacagtcaccttgggaaatttgtgagctctaaaataggtttgtttgagtttgttgaacaattccaaagatggtcaaagagtgcaagaaaatgtatccgggaaaggtttaaagatggatcaatgaactgggactcaagtttagtagcacgtcatgtgcaattgcattttatttttagagaagttgctagtttgtcataccgtgataatgatgattataatcacattgttaatttgcttattgaagaacttgcaaagctacggttgacacaaggtgggaatgatgattcagaggcagttgacaatgatgcagtgaatgtattggttgaagatcctacagttgttagaacaaaaggatgtggtccaaatctggagtctttgtctagaagatcaaagcggaatatcaaatgtcgcaattgtggtgatcatggccacaacaagcgttcatgtgtttctgctagcaagaatacacaaggagatggaaccttgaattggggtatccatgttattacctgcaaaggttgtcgaaaggacatcattgacagtagctgcaaatga

SEQ ID NO: 74 - DNA, 1035 bp, Glycine max
  Peptide Sequence Number=SeqID_116852
atgactgatctaggcaagttgtcatacttcctaggtatcgagtttgagcaaagcaacaagggaattctgatgcatcagagaaagtatattttggaaattctagaaaggtttaatatgcttcagtgtaatcctgttgatacaccagtggaagcaaatttgaagcttggaagttgtgagcaggagacaaaggttgacaacactatgtttaggcagctggttggatgtttgaggttcttatgccatagcaggcctgaaatatcttttggtgtaggacttgttagcaggtatatgaagtctcctaggcaatctcatttagttgcagccaagagaattctcatatacctgaagggaacacttaatcatggagttttatttccaactcacttgccaaatcaaaaggaggatggtattctacatctagtagcatactctgactctgattggtgtggagatcaagtggatagacgcagtacaatgggttatgtgttcttccttggtgaagcaccattctcatggtcttccaagaagcaagatgttgtggctttatcaacctgcgaggctgagtatatagcagcctgcagtgctgcttgtcaaggcttgtggattcagactttgattcaggacttggagttgaagactgaaggtgctattaagataatggtggacaacaagtctgctattaaccttgctaaaaatccagtttctcatggtagatcgaagcatatagaaactaagtatcatttcttaggagatcaagtcagtaaagagaagataaagctgcaacattgtggtactaatttgcaagttgctgatatattgactaaacctttgaagattgaaaggttcaagtcattaagagataagatgaatgtagagatgtggacattgtcatgtatttgtttattaaatgcagcgataatacaccgctatgactggatgatgatggagcatgtttttgtaactgatctcataggagtgatgaatgagcgccaagttcgcatgagtgtggcaatggctctctatgggagagcataa

SEQ ID NO: 75 - DNA, 2217 bp, Glycine max
  Peptide Sequence Number=SeqID_116853
atgggatcaaccaatggtaacttccctgcaaaccttcccattcttgagggcaaaaactggaacaagtggagtgtccagatgaaggtgatattcgcatatcaagaagtccaagaagtggttgatgaaggttatcctgcacttgtagaagatgcaacagaagcacaaagggctgtgcatcgggaaaacaagaagaaagataataaggctttgtttttcattcatcaatgcatagataatgcacactttgagaaaattgcttcagcaaagacctcacatgaagcctggaagattcttgagaagtgtaatgagggtgccgatcagttgaagaaagtgcgattacaaactctgagacgccaatatgagctgatgcagatgaatgtgactgaaaagattcttcgcactctgattcctaagtttgatcatgttgttgtggcgatagaggaatcaaagaatcttgcaactctaaaagtagaagaattgcagggttcattagaagcatatgaacaacgtatgctggaaaggcaaagtgacagatctcaggaccaggctcttcaagctcaaacttggaagaaaggtggtctttctggtaaaaaaggcaatcgaggcagaggaagatccagagagtatagaagcaatcatggaagttttggaaaacaatctcagaacaatgaggaaaatgatcaatctgaatcttcttcaagaagaggaggatcacaaaattggcaaggaggtaagaagaaagttgatcgaagatttcttaggtgctttaattgtaacaagttggggcacttctcaagtgagtgcaaggcacctgctgattcaagaggaaaattcagtaatgaagccaatcttgtgagtgaaaagcttgatcaagacgaagaaccagtcactcttatgatgatgacaaaagaaaggagtagcaattcaggaatttggtacattgattcaggatgtaccaatcacatgactggccacaaagaatggctagtcaatcttgatcttagcaaaaagagcagagttcgatttgctgatgatagacacattacagcagaaggaattggtgatgtctatgtcaaaaagaaagatgggaaggatgttgtgattacagaggtgctctatgttcctgggttaaagagcaatcttatcagcatgggatggctcttggttatggcatctcagatttggtcaccgaaacttcaagagtttgagtcttctgaattcaaaaggaatggtgtcaggaatgactccaataaagcttccctcaaagatgtgtgtggtccaattgatactgtctcattgggtggaaacaaatactttgtatccttcattgatgaaattagtagaaaattatgggtgtatttgcttaaggccaagagtgaatttttctctgtgttcaaagtgtttaaatcaatggctgaaaaacaatctggaaaatacatcaaggtgttgagaactgatggaggtgatgagttctgttcacatgaaatggaaaatttttgcacagaaaatggaatattgcatgaaattgtagctccatatacaccacaacacaatgggatagctgaaaggaggaataggactatactcaatatggtgagaagcatgttgaaaggcaagaacatgtctcatacattttggggagaagctattatgacagcagcttatgtactgaatttgtgtcctacaaagaagcttggatcaaaagtaccagaagaaatctggactggaaagaagccttctgttaagcatcttaaagtttttggctgtttatgccataaacacattcctgatcagaaaagaaagaagctggattataagagtgagtcaatggttttcataggatatagctctactggtgcatacaagctgtcaggatcaaaagtggctgagatagatctggatctagatcagactgcatctgatttagataatggagaagaacttggagaggaactcaatttaccacttgcaccatctgtggaatcaaatgcacctcagaatgaaaggccaagaagacatgctgaagtgcctgcaagattacatgactatgaattgttccaggattttgaaattgggaatgatggtgagctaatccacatgacattacttgctgatgttagtccagttagttttgatgaagctatagttaatgaaacttggaggaaagctatgaaagaggagctggtttccattgagaaaaatgaaacttgggaattg

SEQ ID NO: 76 - DNA, 357 bp, Glycine max
  Peptide Sequence Number=SeqID_116854
atgagtacaggagcagatgaaggccgatataaaggccataaaggagcagatgacaacaatgatgaaagcaatgatgagtatgaggaagttgatggagtagttctgcacccgtactcattgagaatcaacaacctcaatctgatcatacccatgcccatgtctctcaacgcatggcagaaacacatgaagctccccaagaccacactatggccggtttcagggtttatccaggatataccattgaaaggcatgcattttctggtgtcctcgtgtcgaatgctccgtggggcctcagtattgaccaccaccttaacccttacattttgcgatgggaggagggtctcctgctacaattga

SEQ ID NO: 77 - DNA, 771 bp, Glycine max
  Peptide Sequence Number=SeqID_116855
atgaaatctactaaacctagtcaagtttgtaagttacaaagatctctttatgggttgaaacatgctagtcgtcaatggtatggtcaattatctacttttcttgtggcttatggcttcaaacagtctactactgactattctctctttactttgaaaagaaaaaattcattcactgcattattggtctacattgatgatatttttctgagtgggaatgatctctctgttatttctcatattacaaaattactggatgcatatgacacttttaagatcaaagagcttggtaatttgaagtattttcttggatttgaagttgctcgtggaacctctagtattaacatttgtcaaagaaatttttctatttatcttggttcatcacttatatcatggaaatctaagaagcaagccacagtctcgagaagttcttctgaagtcgaatatcgtgcccttgctactgtaacttatgaaattcaatggctcacacatttgcttcatgactttggtattattcataagcctgctttggtgttctatgacaataaaccggctctccacattgtaactaatcctgtcttccatgaaagaaccaagcatattgagattgatcgtcacttggttcatgacaggttgctttcgggtttgatcaaactcttgcctattgattcaacacaacaacttgttgatgtttacacaaaagctttagctcctggtgcttttcattttatctgttccaagttgggtatgaatgacattcattccctagcttga

SEQ ID NO: 78 - DNA, 513 bp, Glycine max
  Peptide Sequence Number=SeqID_116856
atggggcgaaaggggagggagagggagcgtctgatgagggagacagggagggacttagaggtttcacgcttgatgaggtttttgagggagattaagggtttgaggtttctctcgcgctctatggcgtggtcgaggccacgatcgcggattggtttgacggtgccgtcaaagatggttcggagggtgaggatgcgcgatgctctggacctgggtattgacaaatccatattcatcaagcctagaacatttcaccttatagtactgatgcttaagctatggaacaaagatcaaattaagacagcctctgaggtcttgcagagtatctcctcaaaagttatggaagccttggatgatcaacctctctctataagattaaaaggactggaatgcatgaaagattcattggcaaaagctcgtgttctgtactccaagagactggcactacacaccattgtgatgaacacaaggcataggaaaagttgctactccatcccctctgatttttgcagctga

SEQ ID NO: 79 - DNA, 288 bp, Glycine max
  Peptide Sequence Number=SeqID_116857
atgtcgggatttacacgcaattctcctcaaatttcagccagcccgcatcaattagaccttgcaccttacgcttcagagccctaccatgctcaatggaacgccccggggcttctccatgacaagcacacgttgcgtttgagtcgtattctcggagaaatggaggttaatgaaccttggctagggttatggctaccattgaattatcaagtagatatgggagcaagaaagaatgcaatgagcaatgcaaccaatgaaaagcatggatgtatgcgaatgatgtacagttga

SEQ ID NO: 80 - DNA, 1266 bp, Glycine max
  Peptide Sequence Number=SeqID_116858
atgttagccgacctatatgacaccttcgaccgaagatgtgagaagagcagtacgaggatttgttgtactccagctctttatgtatgtttggtttcgcacctttttctccaagaggtgaggcatgcttgcccgctagaaggtcgtcgttcatgcacagagaaaggaggtgcaaattgggaccaactcttagcaaacaaagaaggagcgtctatcaactggttccctcgatggaaggaaggaagaaccggagttcttatttcatgcggaggatttccaaatgttcccttgatggggacgaggggttgcatcagctacaatcccgttcttgctataagacaacttggctaccctatgagaggggcaccactagaggatgagctcacgcctatcatttcacgaggcttcaataagaccaacgtggagacacttcagaaggtccgcaaggcatgggagatgttgcaaaagaaggacaaagaactcaggggcagtaacaatgggcccattggtggctaccgtaagtggttgagagcccacgtccaaggtttggattggctcccaagttttagaaccgctaaaaaggaggaagttgaggcaccggaggaagatgaagaggtgcaggcccttaggacagaactcgagcaagctccaacagtcaaagaaaggttcaaatcagcagctctgaagatccgaaaggagaatgccgaactaagagatataaatacagctaccaccaaagccttggaacaagagaccaagagggctcgtagggaagagcacggccggaacaagttccaaggggctctgtggggcagcaacagcgagcttaagctccagagagaggaaagggaccaatcacgagtggacagtttgatcttgaaagatgagttgaaggtttgctcaaggtacaaaagaaacctgtctcagcggttatgcgagacaaagaccaacacgttagccatcatcagcaaataccaagaagaactaaatctagccacggcccacgagcataaagtggcggacgagtatgcccaagtgtacgcggaaaaggaggctagaggaagggtgatcgatgcgttacatcaagaggcaacaatatggatggaccgatttgtttttaccttgaacgggagtcaagagcttccccaattgctagccaaggccaaagcaatggcagacacctactctgcccccgaggagatccacgaatttctcaactattgtcagcatatgatagacttaatggcccatataattagaaaccgctag

SEQ ID NO: 81 - DNA, 582 bp, Glycine max
  Peptide Sequence Number=SeqID_116859
atgtcctctccatatcccataattgagcctttgttgggtcaatctaggttttcagttgttgcaaagcttgaacaacttaaaatcgatgatgctttagtgattgttttggttaaaaggtggagacctgagtcacacacgtttcatcttcttgttggtgaatgcacaatcaccttgggagatgtttctctacaactaggtttacacgttgatgatagactagttattagcccaacatattatgattgggaagaaatgtttgcggtggtaatatacaactcgaggcatgttagctctaagatgtttgcatacatggaaaacataatcattacatcctcatcattgtgcaacatgcatgccgtgtacttgccacaatcaccaacaaataatatagagctttgtccgttatgtcagaaaaggagtggtcaaagttgcactaatcacaatcaacgacccataacgcattcacgtaaacaagtggcagcggaatggagaagaagaagagttgagaggagacgccacttcaaggagaagatgagtcaagaagaagctcaccaccataggaagccatggataagagcttga

SEQ ID NO: 82 - DNA, 384 bp, Glycine max
  Peptide Sequence Number=SeqID_116860
atgacaatagttgtggttggagtgccaaccttgatagcacacatcaaaagcattgaaggatacaccaccacgtaccgcaaagaatggttgacaaaaaaggttattgaagacatttacgacaattgggaaagatcgtaccacgatctaccaagattgttgcaagttatgcatcaatttcatcttggtatggtgatggagaaggaaacactgtcaatgccaccacaaagaggtcaaccagtagaaggtttcctcatgttccatcatcttttttggtgtttcagattgtgtatcaatgggtttcaatattgcaagcccatagttcaagtcaatggaacatggttgcatggtgagtataaagggacccttcttgtggctgttgcataa

SEQ ID NO: 83 - DNA, 543 bp, Glycine max
  Peptide Sequence Number=SeqID_116861
atgattggaggcttacctagtctggctttcctttggagctggttgtttgccttttttttggctacatggctgaggcctgaggctatggttggagcatttcaatcacagtatttagaattactactggattctggaatgggaacaagttttgacttttactacgagtatccttcaagatcagtaatgggaattggattgttgaaacctctttggaactacatgaactgctttctcctctttttcttcatttcaaggactaaaaaattggtcttgtatgctacattctttggtgtatggagaagatatggtttgacagtagaggattttaatcttgcacaccgtattgttcagcccatttttaggacaaccatgtactatatggattccttgaatctgacagttgttgatcatatacatttggccaagtctaagctttacattttctttccaataaaaacatggaggaaaagttatttgttgctagcagatctaatggaaagccatacaaagctatcagagaagtataattgcatccgcatttga

SEQ ID NO: 84 - DNA, 468 bp, Glycine max
  Peptide Sequence Number=SeqID_116862
atggacatgatgagatgcatgctaaaggccaagcaaatgcctaaagaattttgggcagaagtagttgtcgttgctgcttatattttaaatgggtgtctaacaaagagtgttcgtgataagacaccagaagaagcttggagtggaaggagaccatcaattagacaccttagagtttttgggtacataacatatgcatatgttttagaccaactcaagaagaaattggacgacaaaggcatgtgggattggtcgacaagatcccagaagaagctagtggtgacttttgacaactatgaagaaaatgaaaaacaactagatctaacccccgatgaaccaaaatcatctaggaggccacagaggaaacctcaattgctagttagattacatgcttgtatcatgtttaatgataatgatccttccaacaaggagattatcaattttctttttttacaaattgtgagccgttaa

SEQ ID NO: 85 - DNA, 336 bp, Glycine max
  Peptide Sequence Number=SeqID_116863
atgaacatgaattacaacattgtatggtccggtcccaaactagatgggaagctagatttttattattggaaaactttgatggctacacatttgagagctcacaatatttggaactttgttgagacgggattagcggaagaagcgagtgatactgctagaaggagagatcagttggtgtatcacagattcaacaaggagttgattgactattccattttcagcattatcataaatgccaaaactgcgaaaggagtgaagacttgggtgtatttcatgaagcagaagtcagaagcctgtgaggccttcaagatgttcaaggcgtttctagagaaatag

SEQ ID NO: 86 - DNA, 375 bp, Glycine max
  Peptide Sequence Number=SeqID_116864
atggatagaagcatgattgatgtagccagtagaggtgctttaactgctattgctgcaagacaattgatttctaacatggcagccaattatcaacaatttggtactagaatggatgcaacatccaaggctgttgcaaatgaagtttctgtttctatgagaatcaaccaaggctatatggtatctggacctgatcatccaacagatacatgccccactctccaagaaatggaacatgttgttgatgtttacaccatgcaatctggacaaccattcaaacatcaacaacaacaatataatccttactccaacatttataatcttgattggagatatcatccagacttaaggtatggtgctggacaacaacaacaatga

SEQ ID NO: 87 - DNA, 183 bp, Glycine max
  Peptide Sequence Number=SeqID_116865
atggaagagagactaggttttgcctttgagatagctctcgagcgaaatggtatatcgaatagtcactttgctttgataaaaatgggtgctggcgaaggtgttgtagctggtggtgggaatattggacatttggaagttattgtcaactatctaatgatgatggcaactaagatggtgttatag

SEQ ID NO: 88 - DNA, 738 bp, Glycine max
  Peptide Sequence Number=SeqID_116866
atggttcatgaaccttctaatgatactgagaggtttttcaacaagtatgttgaggctaggtattatgccaatcttaagaaagaaatctatactgagagaagaatagagctcaaagaggatgagtttctggaggagcaacaatggctcaataaggagaggagcacaaaaaaggagcaagaagaaatggttgatgagatggtagagttattgtgtcttcctaatagacatttcaatgttggggtgaaaactaaaaggctacacaaagtaggcatgactagcttagctcagtttcagactgctttcatgttggataacattgttcctaactcccacgagttagatatgcctatgaaaagagatcagttcctttatcctatccttaaggacctttatattgacattggccaaatcctctctcatgagatgttcacaatggccaagaagagagctactcaccttgcttcctcctacccatttccatctcaggaggaagtgttggttgccattggttggcctactcttctaggggaccagtcttcagaaggccaaaagggtgatgagacagtcaatggaattggagctagagctggagatgtagctaaagttgctaccactattgctattaatgatgaaggtgtgcctcaagggaacaacaacagaaatgatgttgcgaaggacactattaagggtgttaccactgaagataaaatggaagaggaatttgcaattgaagaatga

SEQ ID NO: 89 - DNA, 471 bp, Glycine max
  Peptide Sequence Number=SeqID_116867
atgaagtatggaacttttgttgtgagtgtcccaaattgcccagaccatataagtgatggcaacaatcctcacatcattcaactgtggggaacatcttcaggaggcaaaagagagcatatgcagtatggaacttctgtcaagattagtgtgaagcttatgttccagccaagtccaaattgtttagggaaaggagcaataaagaaacaagcgatcaaagggatacaaggcctccaaatcatttttgcccagggaatagcattattggcaaagtacaggaaatcaaaagcttgcctaaagctcaaagtcctagaatctgaaggcttccaaactgggaaatcccttgttggaacaaaaggaatggccgtattttgtatatcagttgccaaaataggcgccttttggacaaaccaagaagcccaagatcattggtcatcatgcttcaagtatgtgcaagaatggatgctcggttaa

SEQ ID NO: 90 - DNA, 387 bp, Glycine max
  Peptide Sequence Number=SeqID_116868
atgagcgtgctctatttcgatgctcgcacgggaccttctatttattcttctttggttattgtttcattgtgcatgattctgaaggattctgaaggagttgcattgttgtttctagctctttgtgtcaaatgcgaaagtttccgtaaggaggctaaagtcaaatccttttgggatggtgaaaaattcgatgaagcaaaaaatgcaggagctgatttggtgggtggagaggatctgatagaacagataaaagcaggattcatggagtttgataaactaattgcttctccagatatgatgcctaaggttgctagcctagggaagattctgggaccaagaggactgatgccaaacccaaaagctggcactgtaacacccaatattccccag

SEQ ID NO: 91 - DNA, 186 bp, Glycine max
  Peptide Sequence Number=SeqID_116869
atgtgtctaacacaaatcttagacagtgtgttatggagccctatgagtcagagattaggagttgcaatggtgggggttgaatctcacacagggtatttgaaatttatatccgtcttctaccaagccacaatggttgatgccacagtttatgaatttgtggaatttgaaattagccagattggatga

SEQ ID NO: 92 - DNA, 549 bp, Glycine max
  Peptide Sequence Number=SeqID_116870
atgtcctctagggggaaggagaccatacctcttctcaggattctatcgataaaagcccacgtgcaaggtttagattggctcccgagtttgagaaccgctaaaagggaggaagttgaggcaccggaggaagacgaagaggccttggaacaagagaccaagagggttcgtagggaagagcacggcagggacaagttccgaggggctctgtggggcagcaacagcgagcttaagcgccggagagaggaaagagaccaatcacgagtacatagcatggtcttcaaagaggagttagctacttgctcaagatccaagaagagtttggcccaacacttagaagccacggagcaaagcatgctagctataatagggcagtacaaagaagagttaaaccagtctttgacccatgagcaaaagctagtagaggacttcgcacaagcatacgccgagaaggaagcaagagggagggtgattgatgcattgcatcaagaagcgaccatgtcgatggataggttcgccttgaccttaaatggaagtcaagacctcccgtga

SEQ ID NO: 93 - DNA, 379 bp, Glycine max
  Peptide Sequence Number=SeqID_116871
atgcagagtgactcgtatcgggcaaccggttgttacaaccttctttgtgctggctttattcaaacgaatagcagaatagccattggagctgccatttctcctgtctcttcttatgatggcaaccaatatgacatcacaatcctcatttggaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 94 - DNA, 180 bp, Glycine max
  Peptide Sequence Number=SeqID_116872
atggcattaggggtcatggcaactcgcccaggcgagctgttgcttcaacctaaactatttgggggcccgggcaagccagaggctagcctgggcgagccagggttcagaaaaaggcctaaaataaccctttttccctccctttttggtattttccatattctttaccgaaacgtcgaatga

SEQ ID NO: 95 - DNA, 582 bp, Glycine max
  Peptide Sequence Number=SeqID_116873
atggcttcctatggtgtggcatctccattcttctttctccttccccattccactgcaatcagacctcaagaagcaaaggaatccattgataaagaagatccaaggcctacaagctccacatggagctacatcattatttacaaggcaatagtcattaatcacataaaacaaggtaaaaaaggactcataagaaaaaacagtctaacaaaactaatgaattttaggagctacacaaagtcaatttttgaggtcatggatgtgaaggatctcacaatagctcatgtcaaaagccatttgcagaaccaattagagcccccctctgaccaagcaaagaagcacatgcacagatggtcaaaaacatttgagtcaatgagagataattgggacctggaagcaagtaatggtctgaaaacacctcagctcctaactaaaagcatcccatcgatgatgcaaatgagcagaaagttctcgttgtacgctccggcaatggcattgagcaccctaagatcgccaacggtgaacaatgacagtgacggtggtgagtgtgatggtggtggcggcggtgacggtgatgatagctga

SEQ ID NO: 96 - DNA, 1503 bp, Glycine max
  Peptide Sequence Number=SeqID_116874
atggtattgctattttgtgctccatatgacagaatgactgttatgcttcaagagaaaaatgctatagttgaacatattgccaagagatataattttactgaggaaattttaagtgcaacatccttttcacggcagttagcggagcaaatggttctggccaaggcttatgtgattattgccaaagagcacaataatcttcaccttgcctgggagcttagctcaaagattagaagttgtcagcttttgctttcaaaagctgccatgactggggagcgtctgaccatggaggaagctgagccaattattaaaagcttgtcttctctaattttcaaggcacaagatgtccattatgacattgcaaccactatagcaacaatgaaatcacatattcaagcacttgaagagcgtgcaaatacagcaacagttcaaagtactgtgtttgctcaaatatcagctgaagcactacccaagagtcttcattgctttaatgtgaaacttatggctgattggctgaagatgccatccctgcaaaaacgagaacatgagagtagaatctccccccggctcacagataacaatctatatcatttctgcattttttcagataatgtactggctacatctgtagttattaactcaacagtcatgaatgctgaccatccaaaacagttagtctttcacattgttactgatggtatcaattatggagcaatgcaagcatggttcttcagtagtgactttaaaggggctaccttagaggtgcagaatattgaggaattttattggttgaatgaatcttattctccaattgtcaaacagctacacattccagaatcacgatccttttattttggaccttatcaaggtgcaaatgttgagccaaaattgcaaaaccccaagtttttgtctttactaaatcatcttcggttttacattcctgagatttatccactacttgagaaggttgttttcctagatgatgatgttgttgttcagaaggacctaaccccacttttctcactggatttgcatggaaatgtgaatggagctgttgaaacttgtctagaagcctttcataggtactacaagtatctcaacttctcaaattcaattataagctcaaagtttgatccacaagcatgtggatgggcacttggtatgaatgtgtttgacttgttttcatggaggaaagcaaatgtgactgcaaggtatcattattggcaggagcagaatgctgatgagacactctggaagctcggtactcttccacctgctcttttaagcttttatggtttgacagaaccacttgacagaagatggcatgttttaggattgggttatgacctaaacattgacaaccgcctcattgaaagtgccgcagttattcactttaatgggaacatgaaaccatggctgaagttagctataggcaggtacaagccattatggcacaagtacataaaccaaagtcacccccatctacaagattgtgctgcaggttaa

SEQ ID NO: 97 - DNA, 210 bp, Glycine max
  Peptide Sequence Number=SeqID_116875
atggatagctccaaatcactctataaattgatcaaattcgatggagcaacttgcaaggaaggagttccaaaaagaaagggtaaggtcagggataagagtggtcaggggagtattgcttctgaagttcagtatgaacacaacaggtgttatgaaagtccaatagcagttgcttctaagggtgtgaaacttagaaaggctatagaggtttag

SEQ ID NO: 98 - DNA, 333 bp, Glycine max
  Peptide Sequence Number=SeqID_116876
atggccaaaatacatcatcaagcatggccaacaaaaacatatcatccaatgaaacatattccccacacttatttccaaaacaattccaaagctccaaaattccttaagggaaaggggaacataggctcaaaggggctatcaagggaattaattcaaggtaggctcatttggctagaggcttataagaacaaaatgcctaaatcatctcccaacatgcatgtgaagcaagaagtatcaacaagagtcaagccaaggctattatgcaagcaatcaatggggaaaaacacaccgaataaaatagatgatgatggctcaaattctcaccaagggtaa

SEQ ID NO: 99 - DNA, 858 bp, Glycine max
  Peptide Sequence Number=SeqID_116877
atggaaccgattgcatccctttcccagtattatgacctgcccctaaggtgcttcacatttgaggacttccagctagtgccgactgtgaaagagtttgaagaaatcctgggatgcccactgggaggatggaagccatatcttttctctaggttctatccttccacgacaagagttgccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcatcgccattttggccatgtatgacacgttcgactggggatgcccgtctatccgctacaaggtcaccgctcgtgccatcgaaaaaggaaaggcgaattgggaccaactcttggctagcatggaggggcgtctgttaattggttccctcgctagaaggaaggaagaatcaggattctatcttcatgcgaaggatgtcccatcagaggagtgccatcagatgaaagcatcacgcctttcatcgcacggggtttcagtgaccacaatgcgagggtactccaaggagttcgcaaggcatgagatgcggcgtgaagaaaggacagagagcttaggggaagcagtacaagccctaaaggcagagcttgaaagagcccgggtagtcgaagagaagttcaagtccatagccatcaaactgaagccttggaacgaagaggtgaaaggaatcatcacgggtcaaaggcatgatcttgaaggacgagctaacggcttgccttag

SEQ ID NO: 100 - DNA, 375 bp, Glycine max
  Peptide Sequence Number=SeqID_116878
atgcggaaaatacccaagggaaggggcaaaagggtcatttcaagcgtgagggaggctgaggaaggggttgggcattcgtcattgagaggttctagagagaaatcagagagaagaagaaagaagaaagaagagaaaaacgaggccaaggcgctaccgaattgtgactgtaatcaacttctacatcgttcttcgttcgtcatctgtgcatcttcatctccttcttctatcatcagtaatctcttttcttcttgtaaaacctttctttttgggttttctaacatttttcctcgaataaacattggtggcgactcccgcgtgttctcctttttggaagatgccattttcatctcgcctcgctctcccgccgaagggtag

SEQ ID NO: 101 - DNA, 423 bp, Glycine max
  Peptide Sequence Number=SeqID_116879
atggttagaacgagaggtttaggtcatcatttaggcatagttataggaagagtcctggggatagaaaataatcgtgattctaatgaagctccccagcagcgaaggcccacagcatccgcacgtaggcaatgggaagttatcgttgttgctgaggatgttcatcacatgggaatcattgtttggaatggagaggaatgtcttgaattaaagttttcatcccatggaaggaaggttcaaaaattcaggagacctgctgctaagattgaaggcaaatgtgatgtcggacactggactgtagtagctcgagcttatctgttgcatttgctaggttgcattctttttgctaacaagagtgcaacacatgtgcatatggtggtcttggacgcctttcgagacctcagtcaaagtggaagctacgcatag

SEQ ID NO: 102 - DNA, 234 bp, Glycine max
  Peptide Sequence Number=SeqID_116880
atgaggctagcacaaccccaggatccagtcagacatccatctatcgttcaagatgacacatatgtcaaaccatatatgcctcagtacacggtggcggcaatagctatggaggaagcacttgcgcatgcaccttctgatgtggagcaacctagacatgcagtggaggctttccaagtaatagctaaaaggttggagcggttgctcaacctaaggatagtgactgtaggcacataa

SEQ ID NO: 103 - DNA, 279 bp, Glycine max
  Peptide Sequence Number=SeqID_116881
atggataaaatcccgagaagagatatggtttccttcctcccagaaggcatcccaggatctcttcaaactcttccactgtgggtgttaattggaagtccccaaaggagaagcacctcaaaggccggtcgtaatattgggcgagggaggcaatggcctccgtggagacctctgccatggttaggtcccagatcttaccataagctttgcgaaaggcttgtcgctggagctgacccatcaactatcctaactctttcagactggcgactcctaggctcttga

SEQ ID NO: 104 - DNA, 426 bp, Glycine max
  Peptide Sequence Number=SeqID_116882
atggagggattagtggacctagtagcaattgatgccttccttgcttatcaccataaaagtaggcccacctgtccactgcaaggtcaccgcttatgcaccgagaaaggaaaggcaaactgggagcaactattggctagtgtggtaggggcatccattaattggttcacccattggaaggaaggaagaactagggttttgtccttatgccaaggatttccaaatgttcccttgatgggtgtcgcaacctaccctttcggcgggagggcgacacggggctcactggtgcgtcttccaagaaaggaaaatgcgcagagtcgccaccaacgtttattcgaggaaaacgtcagaaaaatcagaaaggtgtggtctacgaactttaagtttgaaaggttcgggagttgtttttacgcacggggaaggtattag

SEQ ID NO: 105 - DNA, 186 bp, Glycine max
  Peptide Sequence Number=SeqID_116883
atgaagaacgatgaagaacggcgaagaatcttcacgaaatcgctcacggaaacgtctcggaagcgttatggaagcaccttagcttggatgagaaaagagggaggtggttgccgcccagctcgcccaggcgagcgttgcttccaccagaaggcaccgccttctgttggaaccctcttgaaggcctaa

SEQ ID NO: 106 - DNA, 255 bp, Glycine max
  Peptide Sequence Number=SeqID_116884
atggtcgtccgcacctttcgtcaaccaggggcaaacgagctcattgacgcacagagacttacgtcgtcttctgcaccttttgtcatccagggacagcgagtcgggtggcaggcagagataccttatggtcgtccgcacctttcatccaccgaggcgaacgagttcgacggtttttactctcgtcgtccggagacattcaagcccgacgacgcacgagattcttctctgaggggcggggacgatcaagttcgatag

SEQ ID NO: 107 - DNA, 135 bp, Glycine max
  Peptide Sequence Number=SeqID_116885
atgtggagaccagttaaggtcatgctgtcttgcgctccaaccatgtgggatcgacacaggcttaaaggagcactcaaaccgggtgacacccaaggtctacacttcgaagagttcgtcagggcttctccctcctaa

SEQ ID NO: 108 - DNA, 168 bp, Glycine max
  Peptide Sequence Number=SeqID_116886
atggacgcttggggggctgctattcctgctgtttccatgagcaatggggttcttgagatactaggctgcctcccagtagcgcttctcgattgttcagagttggacgcaggacaacgatctattgatcatgggcctagcatccattcgtgcccgtccccaagtacctga

SEQ ID NO: 109 - DNA, 216 bp, Glycine max
  Peptide Sequence Number=SeqID_116887
atggggaatgcaaatagcaattttgaaatttggccttccagagtatttttgaagctggattgcttcttctggaggaagcaacccagcttgcctgggcgagctgggctgaagggggttgttctaagggtcccagatccccctggtgatgtatttcagctgttttgggtgaaaaaaattgtttccgtgaagaaaatccaagccgaggtgcttccgtaa

SEQ ID NO: 110 - DNA, 111 bp, Glycine max
  Peptide Sequence Number=SeqID_116888
atggagtggccaacatgtatggatgagtatgagaagctcgtaattcgcatgagtaaccccagatgtattgggcaccgattcaaccttctattttgcatacctagggtttaa

SEQ ID NO: 111 - DNA, 336 bp, Glycine max
  Peptide Sequence Number=SeqID_116889
atggtgacgaatgacaatatggatgatattctatttttaatggaggagaaattatatcgcaaacgccccaaacaaagacatggtccaaccagtagcaaagacgacaccagtagcaacagtgacagtgagaaggatctcaccatctacaagaaggattatgaggactattttggtagtgaaaaggcaacaatgcaaacatatgtagtagtcaaatcacctttgcattttgaagctagctttacgccattagttccaaaacaaaccatgaccactgcaaaatcgcaagaacaaccaactacccctaaacccaccaacgatgaacaacaacttgcttag

SEQ ID NO: 112 - DNA, 366 bp, Glycine max
  Peptide Sequence Number=SeqID_116890
atgttcaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgttagtgggtcattactaaaatctgctgtaaagcttctatataagctgaaccattttatcaataaagacaagttgagttttattcagaaaattagagtttatctcttttatcttagtgagagtgattctcctaaattcttgagtgattcaagaacaccctggctgtatcaaaggactttcacaacctttgtgtgttgccctcgctggaaagagtga

SEQ ID NO: 113 - DNA, 441 bp, Glycine max
  Peptide Sequence Number=SeqID_116891
gaaaactactacactaatagtctatgtttatgacatcatcctcactggagatgatgcagtggaattggctaggctaaaaaagaacttggcagcagaatttgagatcaaggacttgggatccttgaggtactttcttggcatggaggttgctcgctcaaaaaggggaattgttgtttcccaagagacgtatattctagacctcttggaagaaatgggaatgagtgattacttatgtgcttacttacatgcaatgtcactcatcaatccatcatttgcttactacacccctgtcgcaacctacccttcggcgggagggcgacgcgtgactcgcgggatgcgtgttccacgaaaggaatacgcgcggagtcgccaacaacgtttatttgaggaagacgtcggaaaaaccggaaaagacgcgatctacgaacttttaagtgaaag

SEQ ID NO: 114 - DNA, 658 bp, Glycine max
  Peptide Sequence Number=SeqID_116892
atgaccggccctctccatgagtcgatctcttgctttctcataagggtacccttggggcagcacgccctcaccttcagaggaccaaacatcctcatctttagaggactacacgtcctcaccttcatagtgctacacgcccttgccttaagagggctgcacgcccttgccttcagaggactacacgtcctcaccgtcagagtactatatgtcctcaccttcagaggactacacgtcctcaccttaagagggctgcacaccctcgccttcagagggctacacgccctcagaggactacacgtcctcgccttcagaggacttcacatcctcaccttcagagggctatacgccttcgccttcgtaggactaggcgtcctcaaattcagaggactgcacgtcctcgccatcagaggactgcacgtcctcgcctttaaagggctatatgccctcgccttcataggactacacgtccccaccttaagagggctgcacgccctagcctttagagggctacacgccctcaccgtcagaggactacacgtcctcgccttcagaggacttcatgtcctcaccttcagagggctacacgccttcgccttcgtaggactaggcatcctcaaattcagaggactgcacgtcctcgcctttaaaggggctatat

SEQ ID NO: 115 - DNA, 592 bp, Glycine max
  Peptide Sequence Number=SeqID_116893
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 116 - DNA, 450 bp, Glycine max
  Peptide Sequence Number=SeqID_116894
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaggactttgaaaagagagtcaaagagtgcttga

SEQ ID NO: 117 - DNA, 385 bp, Glycine max
  Peptide Sequence Number=SeqID_116895
atgaaggcaaagatattagagaatgttttaatcatgtctagattattgcgatccttttcccgtatttcttttcgctcgaattcctccacttcatcttcttcaagaaacaccaatctcttaaatgatcaagataaccagacccaagaggtcgccccaaaacacaatctcttcgatgaggaagtccgattcgaagatattaatcaaaacatggatgactggaacattccagaaatccctcaggatcaactatacgttcctgagacaattaaagacaaacacaactttgattacataatcaaaacagtagaaaacaatattcctctaggacaagatataggggaagaatttcatctactttcaaagaattcaatttatgaacatagcc

SEQ ID NO: 118 - DNA, 612 bp, Glycine max
  Peptide Sequence Number=SeqID_116896
atgttgtccttcagccagatgcagccccagattcaatcgcagatgcaatcacaaggactcgcactgcctcttgagcctgaggttggtccttcaactgctcgtgtcagtacaaaggagagttgtgttgatccctcagggaacgatccaaacatgggtgacttagaggggttgtacgtcgaagaaaatccttcctgcctagttgccctaggaagactttatgaggggtcgacaaccgttcacaacatccctttgtgccatgatcaagtcaaggttggtgttaaggaaattagagatgcagatactctcattcatgtacccactgaagagtttcagttagtggggcagacacttaacacctttgttgcttcgccaacacatcttgtcaagcatttatcagaacaagtgaaaaagaggctaagtcatgaagtgctaaaacgcgcatccaccgataagcgcagcttcagtgcacttagcgcgacagaagaatctggcagagcatcaatatcaagaccgcacgctaagtgcgagatcagtgcgctaagcgcaggagttgtcttcagccaggctcagcgcacgactggcgctaagctcaaatccacttatgcgtgctaa

SEQ ID NO: 119 - DNA, 834 bp, Glycine max
  Peptide Sequence Number=SeqID_116897
atgaagcatcaaggcaagcttagagtgtttcttccaaatatgataatacttgtaaccatccttctccattcaacaacatggattagtgcacaggaagttgaggatgaaagtgagtttgattacataaaagggagtgagaagggtccctcacactggggggaactgaagaaggaatgggaaacatgtaagagtggcaaaatgcaatctccaattgatttgtcaagccacagagtgagagtggtgccaaagttaggggagcttaagaagtactatacgcctcagaatgccactatcaagaacagaggccatgatattgagctgaaatgggaagatgcaggatcaataaacatcaacggcaccgagttttttcttcatcaatgccattggcattcaccttcagaacataccatcaatggcaggaggtatgacttggagctccacatggttcatgaaagcaaaaacataaaaggaaaaaccaaatttgctgttgttggacttttctataagattggtcggcccgatcctgttctgaaaaagttgtcaaaattcataaaaaccatggtgtatggagaagaaaagaacattggggtgtttgatccctcaaaaattaagttgggtggcaagaaatactacagatacatgggttccctcactgtccctccttgcacagaaggtgtcatttggactattaataaaaagataagaactgtgtcgagggctcaagtcaagttacttagagaggctgtccacgatcatgcagagaagaatgccagacctatacaacccataaatagacgagggatacaactctatgcccaaaagcggaaggaataa

SEQ ID NO: 120 - DNA, 174 bp, Glycine max
  Peptide Sequence Number=SeqID_116898
atgaaagtctgcgagaatgtcagaggatttatgtgggcgagtggaatgacaagaatagcacctgagattaaggagagtagaaaggttcagagaaagtgtagagaagaaggaattaacagaaggatcagagaagcaaacaggaagagtgttcaccttcaacataacctagaatga

SEQ ID NO: 121 - DNA, 853 bp, Glycine max
  Peptide Sequence Number=SeqID_116899
caggggactacacgtcctcaccttcaaaggactacacgtccttgccttcaaagggctacacaccctgaccttcagagggctacacgttcacgccttcagaggtctacacgccctcaccttgagatcactacacgtcctcgccttcaggggactacacatcctcgccttcaaagggctccaagccctcaccttcaaagggctaaacgtcctcgcctttagagggctacacgccctcgcatacagaggactacacgtcctcaccttcagaggactacacgacctcgccttcagaggactacacgtcctcgcctttagagggctacacgccctcaccttgagaggactacacgccctcaaattcagagaactacacgtcctcgcctttaggggattacacgtcctcgcctttagaggactacatgtcctcacctttagagggctacaaaccctcacttttagaggacaacaagtcgttgccttcaggctactacacgtcctcgccttcaggggactacacgtcctcccctctaggggactacaggtcctgaccttcagaggactacacgtcctcgcctttagagggctacacgccctcacctttagaggactacacgtcctcgcctttaggggactatacgtcctcaccttcaaaggactacacgtcctcaccttcagaggactacaggtcctcacctttagagggctacatgccctcacctttagaggactacacgtcctcgccttcaggggactacacgtcctcgcctttaggggactacacgtcctcaccttcagaggactacacgtcctcgccttcaaagggctacacaccctgaccttcagagggctacac

SEQ ID NO: 122 - DNA, 129 bp, Glycine max
  Peptide Sequence Number=SeqID_116900
atgtatcgtgggccccgtggctcgttcggtgtagaaggtcgatcgaaagtcggcccgtgcgatcataccagcactaatgcatcggatcccatcagaactccgcagttaagcgtgcttgggcgagagtag

SEQ ID NO: 123 - DNA, 899 bp, Glycine max
  Peptide Sequence Number=SeqID_116901
atgacaaccatacagaccgcggcgcagatcgccgcggaaaccgcggcgttgaagcagcagaccaccgaactcaaccggaattgcacggcgctgaaggcgcgcggcagcgaactcgcgaagaccgcgacggcaggcgccaagaacaccgccgtcaccaagttgggaacggctgaaaaggccaaggcgacgcaggcgctggatcgcaacgcccgcgctatccggtcggaagccgtcgagcagacgctggcggacatgcgcaagaccggcgcgctgctgggcgtggactcggaagtcggacgaatgcgggtggaaaccgagatcggcagattctcgggcgagagcgatgacgacaaggtcagcctgttggctggcgcgtcgcggttggacaagttgcgcgcgcagatgaagatgagcgcgtatatccagagcctggcgaatcccgacgcggccgccaacgaagaaaagcgtcagaagcaggaggcgctcgatcaggcattgaacgacggcacgctgagccagcacaagtacgacaaggaaagacgcggtctcggtctggtgaagcgggacggcgatttcatgctggacgtgaacgacaagctgctcgaatcggcgcgcaacggcgcaagcaagatccaggacatcctgggcacgaaggtgtacgactttgttgcggacaagttcgacaagctgggcctgtcgttcctgaacaacgtggcaaagatggtgacctcggcggcgtccgccaaattgatggaaaccctgctgggcaatagcttcatggagggcaagggcggcgtggggggatggatcgggaaagccggatcgttcctctcagacctcttcagcggcggcggggggatttccgttggcagcagcttcgtctccggcggaacggcgct

SEQ ID NO: 124 - DNA, 744 bp, Glycine max
  Peptide Sequence Number=SeqID_116902
gtgagggcggttagccctacgaaggtgaggacatgcagtcctctgatggcgagggcgtgtagccctctgaaggtgaggacgtgtggtcctctaaaggtgagcgcgtgtagccctacgaaggcgagggcgagtagccctctcaaggcgaggacgtgtagtcctctggaggtgagggcgtgcagccctctgatggtgaggacatgtagtcctctcaaggcgaggacgtgtagtcctttggaggtgagggcgtgcagccctctgatggtgaggacatgtagtcctctcaaggcgaggacgtttagtcccctcaaggtgaggacgtgcagtcctctgaaggcgaggatgtgtagtcctctaaaggtgagggcatgtagccctacgaaggcgagggcgggtagccctctcaaggcgaggacatgtagtcctctggaggtgagggcgtgcagccctctgatggtgaggacatgtagtcctctcaaggcgaggacgtgtagtcctctcaaggcgaggacgtgtagtcctctaaaggtgagggcgtgtagccctacgaaggtgaggacatgcagtcctctgatggcgagggcgtgtaaccctctgaaggtgaggacatgcagtcctctgatggcgagggcgtgtagccctctgaaggtgaggacacgcagtcctctgatggcgagggcgtgtagccttctgaaggtgaggacatgcagtcctctgaaagtgaggacacacagtcctcttaag

SEQ ID NO: 125 - DNA, 118 bp, Glycine max
  Peptide Sequence Number=SeqID_116903
atgaatcacggtactgatcggaaaggattccagccgacgtcggccaggaaagatgaccgatcgaggtttagaaaagaagcatcaccggatgacgccgatcggacatttccttatagac

SEQ ID NO: 126 - DNA, 685 bp, Glycine max
  Peptide Sequence Number=SeqID_116904
aggagaaaatttgcgtaaagggacttggctccaagaggaagatgaacaattgactagctttgtggcccgtcttggggaaagaaggtgggattcccttgccaaagtagctggccttaagagaagtggtaaaagctgtaggttaagatggatgaactatcttcgtccaaatctcaagcatggtcattttagtgttgaagaagagcagcttattgttcagcttcagcaggaattgggtaacaagtgggcaaagattgctcggaaacttccaggaagaactgacaatgaaatcaagaattactggaaaactcatttaagaaaaagagctcaagctcaacaaggagattttaagtacaaattagaaatagcaacacaagaagtcaaccagaaaagtattgacatggattccaagaattgcaaacatggaaacgtttggtgtcaagatagtgagtgggagacaaaggatagtagctccacagacactttatccttatcagattgggaattaagaagctcaccctatgaaactaggatattggattggatagcagaattgcaaaatggatatggtgagaacgaactagaacaagattgtaatagcacaggaacgtgcaactattatcctcaagaatttgatgagggatgtgactcatgggattattcaggttccttatgggatatgaactaa

SEQ ID NO: 127 - DNA, 1434 bp, Glycine max
  Peptide Sequence Number=SeqID_116905
atgctccaaacaacctgcattatactcttctctgttgtggccatatttttgcctcatggaacagcaatgctcaacctcactctcccaggacaacacccagaccctgaagccgttgctcgagaagttcataggaaagtgaatgcttcaatggcaagaagggaaatgctgggagtgtcagagaaagaggtggcatcatgtctaacagggaatcccatagatgattgttggaaatgtgacccagattgggccaacaacaggcagaggctagcagattgtgcaatagggttcgggcagaacgcaaagggaggaaaaggtggccaattttacatagtcactgattcctcagatgaggaccctgtgaacccaaaacctggaacacttagatatgcagtgatacagaacgagccactgtggatagtgttccccagtaacatgatgattaagctgtctcaagaactcatttttaatagctacaagaccattgatgggcgtggagctgacgtgcacattgtgggtggaggctgcattactcttcagtatattagcaatgtcattattcacaacattcacatccaccattgccatccctctggcaacgctaacgtgcggtcgagcccggaacattatgggtaccgcacggagtcggacggcgacgggatctccatcttcggctcgcgtgacatttggatcgaccactgcaccctctcccggtgcaaggacggcctgatcgatgcagtgatgggttccagcgctatcacgatctccaacaaccacttctcccaccacaatgacgtgatgctcctgggccacagcgaccactacctcccagactccggcatgcaggtgaccattggcttcaaccacttcggggagggcctcgtccagcgcatgccgcgttgccgacgaggttacatccacgtggtgaacaatgacttcacacgatgggagatgtacgccatcggcggcagtgcgggacccaccattaacagccagggaaaccgctacaccgcgccggaggatccgtacgcgaagcaggttacgaagaggctggatgccggagaaggggagtggagcgggtggaattggcggtccgaaggggatgttttgttgaatggcgcgttcttcgttgcttcgggagcagttgctgaacctaactatcagaacgcctacagcacccaacctaagaacgtggatcgcatttcgcttctcactatgtccgccggtgttctcggcgttgctagggacaataatctgggaatgtggatcagaggacccaacgatggcactgtatatttttcagattctggcccagaatacacagacgaaatgtcccggagtacaatgccgttgctaccttcacgtattttgattcttgtatctgcactcttatgcttcttaggtcatacaacaaccttaacaacactacccaattag

SEQ ID NO: 128 - DNA, 816 bp, Glycine max
  Peptide Sequence Number=SeqID_116906
atgaagcatcatcgaattgaagtcgctaattgggtagtgttgttaaggttgttgtatgacctaagaagcataagagtgcagatacaagaatcaaaatacgtgaaggtagcaacggcatttgccatcgttgggtcctctgatccacattcccagattattgtccctagcaacgccgagaacaccggcggacatagtgagaagcgaaatgcgatccacgttcttaggttgggtgctgtaggcgttctgatagttaggttcagcaactgctcccgaagcaacgaagaacgcgccattcaacaaaacatccccttcggaccgccaattccacccgctccactccccttctccggcatccagcctcttcgtaacctgcttcgcgtacggatcctccggcgcggtgtagcggtttccctggctgttaatggtgggtcccgcactgccgccgatggcgtacatctcccatcgtgtgaagtcattgttcaccacgtggatgtaacctcgtcggcaacgcggcatgcgctggacgaggccctccccgaagtggttgaagccaatggtcacctgcatgccggagtctgggaggtagtggtcgctgtggcccaggagcatcacgtcattgtggtgggagaagtggttgttggagatcgtgatagcgctggaacccatcactgcatcgatcaggccgtccttgcaccgggagagggtgcagtggtcgatccaaatgtcacgcgagccgaagatggagatcccgtcgccgtccgactccgtgcggtacccataatgttccgggctcgaccgcacgttagcgttgcctga

SEQ ID NO: 129 - DNA, 2607 bp, Glycine max
  Peptide Sequence Number=SeqID_116907
atgtttaacaggccaagaggtgctcgtgcttttaatgtattgaattggaaacatcaaggtgaatcatctgtgacaacaggtttacttcaggatgttccaccagagattgaattgtcggattatagaaggatcccaagtccaggtagtgagagcccttcagaccttcttaatggtgagagcctaaatgtagagcccattgctgatttggatttcttcttcgaaaggctttactgctactactgtgagaaagggctctggtgcatcatcataaagtggatagttgaacttctgagtcttggtttcaccatatgtttttcgggttttttcttactatatgttgactggaatgggctccgaaatgcaaagtgtgggatggatgcagttgaatctggaaggaagccttgtgatcttgctaaagaagctcttcatgaacaccctttaaccccatttacacttggcaaagctattattgttggatacttgggaatattttctatctattggatattttgcttcttgagattctttgttcaactaaaggatactttggatattcgacagttttactacaatgatctctgtgttactgataatgaaattcaaaccatgccctgggctacaattcttgaaaaggttgttcttgtgcaaagctcacgacaactctgtgtggtaaaggatctttctgctcatgacatggtaatgaggttgatgcggaaggagaactacttgattggaatgctcaacaagggtgtgctttctttcccaatttctctgtgggtcccaggtgccggaccttcagtgaaagctggtactaatcgcacacgatatcgtctaatacttcccaagacccttgagtggactttgaactggtgcatactgcaaagcatgtttgatcgaaacttctgtgttagaagagactttgtgtcaaatccaaagacattaaagaaaaggcttatggtagttgggattgtaatgcttttactttctccatttcttgtcatatttatgctggtatatctctttctggggcacgctgaacaattttataatcacccaagcacagcatcatctcgaagatggtcaaatttgtcacgatgggtctttagggaattcaatgaggtggatcatctgttcaggcatcggattaatagcagtgtattacatgctactaactatatcaagcaatttccttcgcctatcatatctatcattgcaaaattcatctcatttgtatcgggtggctttgctgcaattctgatcatcattgcttttctagaggagtctctgctggagggtcatatatttggtcggaacttgttctggtatgctgctgtttttggaactataactgctattagacgggcttcaattacagatgagcttctagtcatagaccccgaaggagcaatgtcaatggtagttgagcatacacattatatgcccaagagatggcggggaaaagaaagtactgaaatggtccggattgagtttgaaaccttattccagtatagtgggatgatgttacttgaggagatggcctcgattttccttactccatacttacttctgttggttgtcccaaagcgggttgatgatatcttgcagtttattgcagattttactgtagatgttgaaggtgttggtcatgtttgcagttttagtgtcttcaattttcaagagcatggaaacagtaattatggctctccatttaatgcacctcacagccagagaagttcccaggggaagttggagaaatcatttttgagctttcagagtagttacccttcatgggaaccaaatgctcaagggaagcagtttctgcaaaatctgagaacattcagagaccaaaacttagcaggacacgtaagccgacatgaatttccccctcttagactgtggagaggcagtccaaacatgggaagcaatggagacagaaacaggtttgcatccagggaaatgccatttagtacttttgcaactggcaatcatttgggttcattgtggctaattgaatcaagaaatcaaaacaatcatccctatcttcttgattggtactacacttcccaacctcatgatgcaacaactcaaagacatattcaagctgatgatccatttgaagtaacggagcatcaatccccagattggatgccctccatcttggtacaaaatgagcaacatgggcatgaagaatacataaatgagtattgcgatgaacgtgtcacttcccatcttggcgcttccacatcagctcccatcttcagggaaagcctaattcaggatcaacattccattgatatgcccctcactaccaggagtcattggtgggctagaagtcactcccagagtggacatggtcagacaagcttttttgagccaccagatttcaatcaccaaccagtatacaattaccatgaaaagttttctgatagagggtcagaggatcatgatcaggaacaacacttgcactggggagattatcaccaagtagtatctagtacagcacatgtagatgatttagatgcaggaaaattcaatcttctatttgatgatgtttatagcagtactccacaaaattccactgtaaatcctagcactgcaaccttttaa

SEQ ID NO: 130 - DNA, 813 bp, Glycine max
  Peptide Sequence Number=SeqID_116908
atgcagtatggttttcaaatactccctctcccgtgggtcctcagagtcaaacaaatcgagcaacttgagaacaaaggagtggtcgatgtaccgtttcgcgattttcgtatcggtgtcggaggaaaccacgtatctgaggagaagctcgtagacgagctgaaggtggggccaagaagggtccaaggaaggttcctcctcttcgggatcggtgggttcttggcctgtgttttcgtgcgacgccggcgggaggcaccgaaaaatgttgacggagatcattctgatcatctcttcttggcagttctcgcttatcttgccggagccggattggatgaagtccacgaggtccatgagcgcctggcgcttgatttctttctccctaacgttcttcagcgtgtcggagaagtcgaggatgtagcagcacacgtggagcttccggaggaagaggttctgccgttccgcgacgggcgcgtcgcggaacggaggcaccggctcgacggagccgccggaggagagcgtgaggggggtcaaggagacgaaattcacgacgacattggcggagggcgccgccggagcgctgaagttggcggcggcgtacggctgcggagccggatcactggcgtcggacttggagggcttcttgtgcccgcctttcatgattttcttgaacatcctgtcgcggaaaacgaatcgtttcgtgaggcgcgtgtggaagaggttttcatcgaggaacaagaagaaaaaaaaagtggcccggagactgtgagagctatggatccgagtgaggaatcatcggagtcaatgccggaaaattga

SEQ ID NO: 131 - DNA, 1506 bp, Glycine max
  Peptide Sequence Number=SeqID_116909
atggaaaccctcgtccagaaatcctctccaatcccctcgaggcagcgaaaaatcatggaaaaatcgcagcttgacgaagctttcgagtccgcagaaaccaccgaggaaatgctcaaagtcttcagcaacatggaaggggttttcgacgagagagaacttggtttggcttctttaaaaattggccttaaacttgaccatgaaggtgaggaccctgagaaagctctttcctttgctaacagagctttgaaagctttggaaaaagataacaacaacaacaacttcccttcttctttgcctgttgccatgtgtttgcagctgttggggtctgttagttttagcttgaaaaggtttagtgatagtttagggtaccttaatagggctaatagggtgttgggtaggttgcaggatgagggtggtgttagtgttgatgatgttaggcctgtgctgcatgctgtgcagcttgagttgtccaatgttaagaacgccgtggggagaagggaggaggctcttgagaatcttaggaagtgtttggagatcaaggagatgacttttgaggaggatagtggggagttgggtaaggggaaccgcgacttggccgaggcttacgttgcggttttgaacttcaaggaggcgctgccgtattgcttgaaggcgttggagattcatatgaagcggttggggatgaactcagtggaggttgcgcatgacaggaagcttcttgggattgtgtatagcgggttggaggagcatgagaaggcgctggagcagaatgttttggcgcagaggattttgaagaactggaatcttaatgcggatttgttgcgtgctgagattgatgctgcaaatatgatgattgctctagggaggtatgacgaggctgttggtactttgaagggtgttgtgcagcagacagagaaggatagtgagactcaggcgcttgtgcttgtgtcgatggcgaaagcattgtgtaatcaggagaagtttgtggactgcaaaagatgtttggaggtttctcttgggattcttgacaaaagggaacggatttgcccagtagaagttgctgaggcgtactcggagatatcaatgcagtatgaaaccatgaatgagtttgaaactgcgatttcgttgctgaagaggacactagctttgcttgagaagcagccacaagagcagcactcggaaggaagtgtttctgcaagaataggttggttactgttgttgactggtaaggtgcagcaggctattccttatttggaaagtgctgctgaaagattgaaagatagctttggtcccaagcattttggagtgggttatatctacaacaatttgggggcagcatatttggagttggatagaccccagtcagcagctcaaatgtttgcagtagctaaggatatcatggatacatctcttggtccacatcatgcagatacaattgaagcatgtcaaaacctttcaaaggcttatggcgagatgggaaggtatggatggtttttgttggtttga

SEQ ID NO: 132 - DNA, 1014 bp, Glycine max
  Peptide Sequence Number=SeqID_116910
atggcactgaacaagaaccactcctacaacaacaagcttggtaatgaagctctcccacccatcaaaacccaggctggaacactccaacacccaccacaacctgcttcatcagactatgcttttcccatatttgtcattgttgtgctcagcatcttggccactgttctgttgctcctcagctacttcacttttctaaccaaatactgctcaaactggcgccaagttaacccaatgagatggatttccatccttcgagctcggcacgaagaggaccccttcatagcattctctcctgccatgtggaaccgagggcttgatgagtctatcatcagagaaatcccaacttttcagttcataaaaggagaagaaggtgaggaccaaagtgtatatggttgtgtggtttgtttgactgagttcaaggaacaggatgtgctaaaagttcttcccaattgcaaccatgcttttcatttggactgcattgacatttggcttcagaccaattccaattgcccactttgcagatcaagcatttcaggcaacacacactgtccattggaccacatcatagcaccaagttcttctcctcaggattctcagttgctctccaacatgggtagtgatgaagattttgtggttattgaacttgggggagaatctggagcagtgataccaccggtgcaacaagagaggaatgactcaaggggaagcttggcacatagaaaccacactacaaggaagtgccaccatgtttccatcatgggagatgagtgtattgatatcaggaagaaagatgaccagtttctgattcagcctattagaagatctttctcaatggattcagcacatgatagacaaacttacttggatgctcaagtcattatacaacaaaatagacttcagaatgaggctagtgctagtgaggattgtaatagcagatgtcgaagagcattcttcccgttttgctatggaaagggatccaaaaatgcagttcttcctttggagaatgatgtttaa

SEQ ID NO: 133 - DNA, 264 bp, Glycine max
  Peptide Sequence Number=SeqID_116911
atggaatgcacaagcatgtttctgtccctaatttttctctgctgtctctgtggggactatgtccttgccattgaatttcaacagcaagttgttgatgcttgggaaagccatggagctagtgcagaagatgaacttagagaaggccaacgacttcttgaccaattaaagaaaaaggcccgtgacgcctctgcaaatgagcttcatatgaaggctttgccaaatgaacttcctatgaaggctttgcccttaccacataaatcctga

SEQ ID NO: 134 - DNA, 1527 bp, Glycine max
  Peptide Sequence Number=SeqID_116912
atggctgtttctggagcaacctacatgtttggtttgtactcaaacgaggtcaaaacctctctggggtatgaccagtcaacgctcaacttgataagcttcttcaaggaccttggtgccaaccttggaattttctcaggcttgatcaatgagataagccctccatgggtgatactagccatgggagccaccatgaacttcattggctacttcatgatatggctctctgtcacttcacgcattgccaaaccccaagtgtggcaaatgtgtctgtatttttacattggtgccaattctcagtcttttgccaacactggtgctttggttaactgtgtcaagagcttcccaagaagtcgtggaagtgtcattggtcttcttaagggttatgtgggtctaagtggtgctattttcactcagttttaccatgccttctatggtgatgactctaaggctcttattttcctcattgggtggcttcctgctgctatttccttcgttttccttccaacggttagggtgttgagtataaccccacaacccaaagagatcaaggttttctaccagcttctttatatctcacttggggttgcagggtttctcatggtgttgattattatacaaaacaagttgagtttcacaagggtggagtacataggggatggcatggtggttcttttattacttcttctcccacttggtgttgtgtttagtgaagaattcaaactttggaagaaccaaaaccaaaaccaaacattcactaatcatgcaggtgctgcttcagttgttgaattgccacagccagaagaagcacatgcagtagcaccaactcattcagaaaggaaaaacaacaactcgtgcttgaagaacgttttcaagcctccaaaaaggggtgaggactacaccatcttccaagccctcttcagcattgacatgctgattctgttcattgcaacagtttttggtgttggtggaacattgacagcacttgacaatttaggacagattgggaactcattggggtaccccagaaagagcctcacaacttttgtgtcccttgtgagcatatggaactatttgggacgagcatcttctggctttgcctctgagtacttattgaccaaatacaagttccctcgtcccttgttgctcactctagtcatgcttctctcttgtgttggccacattcttattgcttttgtggcaagccctgttggctcttacattctcaatgtgaaagtgactggttatttgtatgataaagaggctttgaagcagttgggggtgaagggactcataaggcaaaaggggaaggacctaacttgcgttggagtgcaatgctataggatggcttttctcattatcactgcttcaactttggttggatgtgttgtttcttttattcttgtgttgaggactagaaatttttacaaaggtgacatttatgagaagttcagagttcttgaactagacacaggagagagtcttccaacttttggcagcactagtggcaccaccactaccacaaaccgc

SEQ ID NO: 135 - DNA, 267 bp, Glycine max
  Peptide Sequence Number=SeqID_116913
atgtgcatgctgcaagccctcttaaaccctagcacgttgggtttcaatttgaaaccacaaccaaccaacgaagcttttgtcaattcagcgagacgaatagcttcttccaccttggattcctatctgggacgtcaccatgaacatccagcgactctacctgtgtacttctccgtcatcgtgagccctccacctttctcgcgattctggtctctcgtgactctatttgtgtgtgtctctgtcaccattccaatcgttccaaatggttga

SEQ ID NO: 136 - DNA, 204 bp, Glycine max
  Peptide Sequence Number=SeqID_116914
atgaccgtgataataatgataacaattatattggtgaaggtgttggtggtgtggttggggcaaaatggtggtggtgggggctatagtggtgatggaatggtgacagtgaagatgaaggtgatgatagcaatgattgtaacaacagtgacaatgatgtttggtggcgatggtgatgatggaatggttgtgatggtggaatgctag

SEQ ID NO: 137 - DNA, 663 bp, Glycine max
  Peptide Sequence Number=SeqID_116915
atgactccccctttcttccagaacccagcttcagattggaacatgttgcagcaggagccttcagaaattttgttcgattcaatgtcaagcaataatgctgttcttgaccctatccaagattctctttcctttgatatggttgacttctccacaacaccaacagaaggataccataacgaggcaaagaaattggtggtgaaatctgaactgcagaataataaggaaaggtcttacattggtgtgaggaaaaggccttggggaaaattcgcagcagagatcagagacacaacgaggaacggtgcgagggtttggcttggaacctttgacagtgctgaggctgctgcattagcttatgaccaagctgcatttaccatgagaggtgataatgctgtgctcaattttccggtgaagacggtgaaagagtctttgcaagagattcaatatagctgcagcaatggttcttctcctgcacttgcactcaaggagaggcactgtatccaaagaaagttgtcattaaagggtagaaagtgtaaagcgaaagagacatcatcatcagaggatccaacaccaagtgtgttggtgttcgaggacttgggagctgactatcttgagcaacttctaagcatatctgatcaaagtgcaagacctagctacttcagctaa

SEQ ID NO: 138 - DNA, 642 bp, Glycine max
  Peptide Sequence Number=SeqID_116916
atgcctactaattcccctttgtttcatcagaatccagattggaacatgttgcaggagccttcagaaattttgttcgattcattctcaagcaatcctgttcgagacaccgtccacgatttactttccttcgacatggttgacttctccacgccaccaacagaaggaaatcacaacaagacaaagcaattggtggtgaagtctgaagtgcagaataaggaaaggtcatacataggtgtgaggaaaaggccttggggaaaatttgcagcagagatcagagacacaacgaggaatggcactagggtttggcttggaacctttgagagtgcagaggctgctgcattggcttatgatcaagctgcattttccatgagaggccacgatgctgtgctcaattttccggtcaaaagggtcaaagagtctttgctagagattcaatatggttgcagcaaagggtgttcaccagctcttgctatcaaggagaggcactacatcagacgaaaattgtcatcaaaagctagaaagtgtagagagaataaacaggaatcagaggcaccaacaccaagtgtggttgtgttagaggacttgggagttgaatatctagagcaacttctaagcatatcggatcaaagtgtaagcttataa

SEQ ID NO: 139 - DNA, 219 bp, Glycine max
  Peptide Sequence Number=SeqID_116917
atgaggaaagaactcactggtgtcaaagacaacaacgaacacataaatatgaataaaaatggcgagatgaaaaatgaacgcaatgccacaaagctacagcaaatggtgaggattgagttgagtttggtgggaggagaagctgctagtataagggaagatctgtgggtggaagaagagggtgagaggaaagctgtgggtgagcaaaatggaggaggttga

SEQ ID NO: 140 - DNA, 318 bp, Glycine max
  Peptide Sequence Number=SeqID_116918
atggtatcaaaacaccccaacaacgggtttccacagaacctccgtggctcaaaacaccccaacgtcatcaacaagcttttcctctaccgcgacgacgtcaacgccaccgtctgcaatggcttcgttgccgccgcagatacaaacaacacctttaacaacatatctttcatgcgtgctgcactggaagtgaatgagccaaggttctggtttaagcatgagaatgcggtgatgaaggttggggacaaggtgaatcttgaggtgggtgatgggacgagcaagggttatggaaacaacccaatcaggtctcacccactttga

SEQ ID NO: 141 - DNA, 651 bp, Glycine max
  Peptide Sequence Number=SeqID_116919
atgcctagtatgtcttcccctttcttccagaacccggattggaacatgtcgcaggacccttacgaaattttgttcgattcgttgccaagaaatgatgttcttgaccctcttcacgattctctttccttcgatatggttgataatttctccatggcaccaaaaggaaaccatagcaaggcaaagcaagtggtggtgaaatctgaagtgcagaataaggaaaggtcgtacacaggtgtaaggaaaaggccttggggaaaatatgcagcagagatcagagacacgacgaggaatggcactagggtttggcttggaacctttgacactgcagaggctgctgctttggcttatgaccaagctgcattttccatgagaggccataatgctgtgctcaattttccgatcaaaagggtcaaagattctttgcaagagatccaatatagctgttgcaatggttcttctcctgcacttgcactcaaggagaggcactgcatccaaagaaagttctcatcaaaagctaaaaagtgtaaagggaaagggacatcagaggatccaacacaaagtgtggtggtgttagaggacttgggagttgactatcttgagcaacttctaagcgtttctgatcaaagtgaaagccctagctattggccctag

SEQ ID NO: 142 - DNA, 1125 bp, Glycine max
  Peptide Sequence Number=SeqID_116920
agaatccccaaggttaagtatgctgtgaagaagataatccttaggacattgaagcttctcttttggggcatacttttgcaaggtggatactctcatgcccctgatgatctatcatatggagttgacatgagatttatccgatggtgtggcattctccagagaatagcccttgtatactgtgttgtagctctaatagagacatacaccaccaagcttagaccctctaccttgaagccaggacacctgtccattttcactgcctatcgatggcaatggttggggggctttgtggcatttgtcatttacatggtcacaatcttcagcctctacgttccagattggagtttcgtggattataacagcgacaaacctaagagatacacggtggaatgtgggatgcgaggacacctaggtcctgcatgtaacgctgttggatatgttgatagacaagtttggggcgttaatcatctttattcccaacctgtttggacacgcttgaaggcatgcacactcagttctccagctgaaggccctcttcgtaaaaatgctccagcttggtgtcgcgctccctttgaacctgaaggctttttgagttccgtattagctatcctctctggcaccattggcatccactatgggcatgtcttgattcacttcaagggtcactttgaaaggctcaagcaatggctctcaatggggtttgtgttattgaccctaggcctcatccttcattttacagatgctatcccgattaacaagcaactctacagcttcagctatgtttgtttcacagctggggcagctggaattgtcttctctgtgttctacctactgatcgatgtttgggggcttcgtactccattcttattcttggaatggataggaatgaatgcaatgctagtgtttgttatggcagcacagggcatcttcgcagcatttgtaaatggatggtattacaaagacccagataactcactagtatactggattcagaatcatgtgtttaccaatgtttggcactcagagaggttgggaactctgttatatgtcatctttgcagaaatcaccttctggggtgttgttgctggcatcttgcacaaattaggaatatactggaaactataa

SEQ ID NO: 143 - DNA, 375 bp, Glycine max
  Peptide Sequence Number=SeqID_116921
atgcaacaggcccttccgatcgtgacaacagaaattcaaaagaaagacatcagaaggcttcgacggctgcaggtcagatcgataataagagattccagaggcagaggagaaagaagggcacgcctcaatgagcctcttcttcaacaaactccacctcgtcctctgtttcccaaccacccagaaaactatgtagcaccatttcccatccgtcgacacatcttcatttatgttgaggccgaagaacagtatgatgcgacacaaatcgcaacccagaccggttttgtcggggcaattgacagtgaggagagttgggtcgccatctttttctggcgggcttatgatcactacgtcgtcgtacagtatacccatcaataa

SEQ ID NO: 144 - DNA, 246 bp, Glycine max
  Peptide Sequence Number=SeqID_116922
ggggttgctcgcccaggcgagctaacctgcactttttttttaaagttgattgattttaggagacgactgtacacgggaatgactcgcgtgaggggaccaaagcttttgatgctccgccagccactccgtaaggacgacgacctattggtagtgaccctagcctctttttgtgtccgtccccaagtatctgaaagtaggaaacaacgaggtgtggcaaatctcgaccgcgtcgttgtcttaccttga

SEQ ID NO: 145 - DNA, 714 bp, Glycine max
  Peptide Sequence Number=SeqID_116923
atgggtgcgctccgacagatcgtcgttgccatccgccatctggcgtgccgcatcgctaagtgcatgggcactttcgcccacctcgcgcacgatctccgccagccgcacatccatgcgcagcagcgcctgcatcagttcacccatctcatcgcgcgttaccgtaccgatacggtgattgagctcgccgccggcaatggcatccgccagttcgcgcgcctgggcgatggaacggttaatcgagcggatcagcagccagccggagaccagcgccagactcagacccaacagcaggatggcgatcaggctattgcgtgccagcaggtagtcgcggttgccctgttgccaggccgtctgcgcatgctgccgcatcagcgtatccagctggtcaatgtcctgttgcagcaactggctaccgctgcgcaggcgggtttcaatgaccaccagtgcggcggacgggttaccgcctttcagcagctcaccggcttcatgcagcgcaccctgccagccgtcgagatgggtcaggaagcgctggctcagcggtttggtctgcgcatcaaacgccagctgctgccaggtatggcgatcggcgttgatttgctgaccgtactgcgcaatgcgcgccaggcgtttttccacttcactgctgtcggtccagtagcgcagcgcatcgaacagggtagcggattgctcctgcaccatgcggtacaggcgtga

SEQ ID NO: 146 - DNA, 427 bp, Glycine max
  Peptide Sequence Number=SeqID_116924
tcaaagactgcggaagggaaagctgcaatctcttcatttcatcagttccctgacgagtccttgagtgaaacgttggagagaccacaaaccaagcaactgttagatgcttcagcagggggaaaaataaagttgaagacctctgaagaggcaactgagctaattgagaatatgtcagccaacgattatgccattctgcgtgacagagttcatcaacccacaaagaaaagcttgttagaactatcatcacatgatgctttattggcacagaataagttgctttctaggaaacttgagattttaacagaaacacttggttgtagcatatgtggtgaggctcatgaaacagaccaatgtattcccattgaagaaaaaactcaagaagttcactatatgggaaatcaacagagacaaggatatactcaaggag

SEQ ID NO: 147 - DNA, 1812 bp, Glycine max
  Peptide Sequence Number=SeqID_116925
atgtgtcataggctcatatacctttatcaactgagcagtctcaagaggacaatcgaaaatttgtttacttgtagagtatacatcatttatgcaaaagaattgttcaaagaggcccaatcgtctgtcttcaataggacattttgtgttgtcaatctggttatgggtcaatgcagtaatagagaaaaaccacattggaactatacgcatagtgtttccaaccagcttcaattgcaaaggtcaagagcagacaaggtagaagataagctaaaagaagagcaagaaacacaacggatttctttcaaatcagaagtgaagaaggcggatggaaatgatgggattagcaaatactgttctgatgatgaagattcctcagatagtaagtggaagttggagctggcttggcttacaaaggcacttgaaccagctctgcaattttgtaggtgggctttgccaacaggaaatgaaattggaaacaaacccccaccaagcattcgatcccttacggaaataattgcctgcatccaacgaagtaagattggaatccaggattggagcttgagtgaccttacaattggcttgtatctgatctatcttcgtcaagcttctactcatccatttgaagatatcaaaggcattccgatattgtcagaatccattgttcaagatctcatttatcatattgagttggctaaaggtgcttatagggataacccttgtagtatttcaaggaacagcatgctacgagaaagtaatgtcaaaaagtttgttaaaaactccagtgtaatgaggcctgcatactatataggggttgatacccgtaaaaagcttgtaattttgggcattcgaggcacacatactttttatgatcttatcactgatattctttcctcaagtgatggtgaagtcacctatgaaggctattcaacccactttggcactgctgaatctgcacgttggtttctccgtcatgagattgaaatcataagaaaatgcttggagaaacatgagggatttaagttaagacttgtgggtcattctctgggaggggctatagcttctttattggcaataatgatccatagaaaatcatcaaaggagctgggttttagtcctgacattgtatctgctgttggatatggaactccaccatgtgtatctagagaacttgctgaaagctgctctggctatgtatcaacagttgtgatgcaggatgatattatacctagattgagtgtagcttccctagcaaggctccgaaatgaaattgttcaaactgattggatgagtgtaattgagaaagaagactggaaaagcatcacagatttggttacaaatgcaaaggaggttgtgtcttcagtgcaagatgttgctcgcaaacttgctgattatacaaatttcaggggaaacaaaagtttagctgttggtactactgataaggagttgccagttgctaccgaagcacctctgccctccgaagctgcaaaggagacttctggtgtcacgaaagttgcgggaactaaaactgcagtgatcgaggagttatttatacctgggactgtttactatcttaagaggaacttgggatcccaaattgatgctggaaaggattttttcaccctttacaagagggagcctggtgagcatttccagaaggtaatcttttcggggaattttatcacagaccacagatgtgatagccattattatgctttgagagatgtccttaaaggtgtgccatggtgtgggaaggaagggggtgccttacagttcttcagtctgtgcggaggtgttagcaatagcacagtagattag

SEQ ID NO: 148 - DNA, 243 bp, Glycine max
  Peptide Sequence Number=SeqID_116926
atggcgttcgcttctttcctcggcagagtcctcttcgcttctgtcttcatactctctgcttaccaacagctgcggatttgcgtgtctgatttcatttccttgtcaagggatattattttaaagctggaacatgaaattattcattgtgggtttggagcagttgatgggttggttgctttgcttgtgcttactttccatgttaacttagagactaaggttaataatcaagttcttccaatttaa

SEQ ID NO: 149 - DNA, 387 bp, Glycine max
  Peptide Sequence Number=SeqID_116927
atgagccaattaggacatggtattaatggatataagtatttacctttatccttgaggtttattggtgctggatcataccaaatttggggttctcaacagctgaaatttttaattgctggggctattgctctgaagggtcttggaggggttcttttcatatttggcagctcttttggagctttgcttctgctcctgcaccagctgattgctactccaatccattatgatttttacaattatgatagtgaggacaaagaatttactcaactgttcatcaaatttacacagaatatggctcttttcggggctgtattgtttttcattggcatgaaaaactccatccctaaaagggtacccaagaaggctccaaagacaaaaacatattag

SEQ ID NO: 150 - DNA, 888 bp, Glycine max
  Peptide Sequence Number=SeqID_116928
atggaagtggtgggttttgacaaagagggtgcaggctatgacagagccaaggaagtgaaggagtttgaagataccaaagcaggagtgaaaggactcgtagattttggtattctcaagcttcccagattcctcatccatccaccagaatctcttccatcatcaccaacatcttccaacaacacaacttcaaccttgcaggttcctgtgatagatttcgcaggatatgatgatgatgatgatgaaagttgttgtcgcaggttaaagatagtgagagagattcgcgaggcatcagaaaagtgggggttctttcagatggtgaatcatggtgttccagttagtgtcatggatgagatgctaagggtcataagagagttccatgagcaatcaaaggaggtgaagaaagagtggtattctcgtgaccctaaggtgagagtaaggtatttctgcaatggagatctccttgtggcaaaagtagcaaactggagggacaccataatgtttcattttcaagagggtcctctcggccctgaggcatatccactagtatgcagggaagccgtgattcaatacatggagcacatgttcaaactgagggagatattgtcccaattactttcagaggcattggggctcaagagggactatcttaaaaacagagaatgcatgaaaggtgaaacagtggtgtgccactattacccaccttgtccagagccagatttgacacttggtgccactaagcattcagacccatcatgcctaacaattcttcttcaagataccatgggtggtctccaagttttccatgaaaatcaatgggttcacattaagcccatgcctggagcattagtggccaacattggtgacttcatgcagtgtgttgccaaatag

SEQ ID NO: 151 - DNA, 2244 bp, Glycine max
  Peptide Sequence Number=SeqID_116929
atgtgtttgcacgtatcaaagcaattcaattccatgtcactgtctaaccactactgtgagttgctcaaacattgccgcgacacaaagaagattcactgccacataatcaaggcctttcgaaaccccgaaatcttcctgctaaacaacttagtcagtgcctatgccaagtttgacagaatcacttatgcccgcagggtgttcgaccaaatgcctcaaaggaatctctactcttggaacacccttctttcctcctattccaaacttgcttgtcttcctgagatggaacgtgtgtttcatgcaatgccaacccgagatatggtatcatggaattcccttatttctgcctatgctggtcgtggtttccttcttcagtcggtaaaggcttataatttgatgttgtacaatgggccattcaatctgaatcggattgcgttatccactatgcttatacttgcttccaaacagggttgtgttcatttgggtctgcaggttcatgggcatgtggtgaaatttggtttccagtcatatgtttttgttgggagtcctttggtggatatgtactctaaaactgggctggtattttgtgcaaggcaggcttttgatgagatgcctgagaagaatgtggttatgtataatacattgattgcagggcttatgcgatgcagtaggattgaagattcaaggcaattgttttatgatatgcaggaaaaggattctatttcctggacagcgatgattgcaggatttactcagaatggtttggaccgagaagcaattgatttattcagagagatgagattagaaaatctagagatggatcagtacacatttggaagcgtgttaactgcttgtggtggtgttatggctttgcaagaaggcaagcaagttcatgcttatataattaggacagattatcaggataatatatttgttggtagcgctcttgttgacatgtattgtaagtgtaagagtataaaatcagcagaaacagtttttaggaagatgaattgcaagaatgttgtatcttggactgcgatgttagtgggttatggacagaatggttacagtgaagaagctgttaaaatcttttgtgatatgcaaaacaatgggattgagcctgatgatttcacccttgggagtgtaattagctcatgtgcaaaccttgcaagcctagaagagggggctcagtttcattgtagagctctggtttctggcttaatttcttttattactgtttccaatgctctagttacattatatggtaagtgtggaagcattgaagactcccataggctttttagtgaaatgagctacgtggatgaagtctcatggactgcacttgtttctggatatgcacagtttggtaaagccaatgaaacattaaggttgtttgaaagcatgttagctcatggtttcaaacccgacaaggttacttttatcggggttctttcagcttgcagtagagccggactagtacagaaaggaaatcagatatttgaatcaatgattaaggaacataggattataccaattgaagatcattacacatgcatgattgatctcttcagtcgagctgggaggttagaagaggcaaggaaatttataaataagatgcctttcagccctgatgcaattggttgggcatccttattaagttcatgtaggttccatcgaaacatggaaattggcaagtgggcagctgagtctcttttaaaattagaaccacataacactgctagttacatcttactttcgagcatctatgctgctaaaggaaaatgggaagaagttgccaatttaagaaaagggatgagagataagggcctgagaaaggaaccaggatgtagctggatcaaatataagaaccaagtgcacattttctctgctgatgatcagtcaaacccattttcagatcagatatattctgaacttgaaaaattgaactataaaatggtacaagagggatatgtgcctgacatgaattctgttttgcatgatgttgacgattcagagaaaataaagatgcttaatcaccatagtgaaaagcttgcaattgcttttgggttgatatttattcctcctggtttgcccatacgagtagttaaaaatttaagggtttgtggggattgccacaatgcaactaagtatatatctaagatcacccagagggagattcttgtaagagatgctgcccgattccatttgtttaaagatggaaggtgttcgtgtggagacttttggtga

SEQ ID NO: 152 - DNA, 994 bp, Glycine max
  Peptide Sequence Number=SeqID_116930
atggctgccacttttttcatagaagatagaatgagaaaattgactaagaaaagaaggaacaactgtagagagttagaagaattcttgttgcaaattgtaatggaaacaggaagatgccaatctgttcctccttccctagtccctacccaggaaatcagctttgacgatttatcacttgaagaaaagaaacggtttcacatagcaattgcttatggggaactgagcaagatgatcaaaccatgggatccatggtggtcaaagccttctgcaagaaacatctgtctcagtaaggaaggaactcagcttgttcaacctattccagatcaggaattgctagatgatgatattggaagtgatgaattcagcaaagttcctcttggacctgaaactccacttcctcctctaagcaggcttagttccaaggagccatcaccccttttaacagttcacctagtcgatattctgtatagctattgcttcactcttcgtctctacaatggagattggaggtcagatgccttagggtcagtcatggttgtattgagtgtgtcctcggtgttgggtcaaggtgcacagccggagacagtactagaagccctttctcattgcttggagcaggtatgctgtccagcttacagacacattggaggattgcaatttggtttgggtgtcattgatgatgtgatcagtctgcttggtttgggaactcctgcattggtttgtgcccttcgtgatatgcattggtgcattcaagaaggcgaaaaggaggccaaatcagaaaggccaagaaagtcccagagaggtgggactagaagtgccattaagctggctgaaaggaagatatatttcatcatgtgttgggttcatgagcagccagaggaagtctggtcttccttagcagccattgtaagagcagaaaagacatcagccatggaatttcaacagatcaatagatctgaagatttgaacaataagacagaggccaaaggcaaaa

SEQ ID NO: 153 - DNA, 150 bp, Glycine max
  Peptide Sequence Number=SeqID_116931
atggcttgccggtatatagattctcaggcggaacaagcgtgtcatattaggaagttgctgagcagtactaatcacagagaggtgacaacagtagtaacttcatccatccatccaagacttcctgttgatgaatgcaaaagacttccttag

SEQ ID NO: 154 - DNA, 1113 bp, Glycine max
  Peptide Sequence Number=SeqID_116932
atgtctaacaatgaatgtgcatttggggtggtgtatgtgaaattcaagcctcaccttctcatggttctagttcagctggttctttcgtttctctacttcctagtagaggcttcattaaacaaagggatgaaccctcatgtctttgttacctatcggcatgctgttgggggcatagttgtgcttccttttgcttacattcgtgaaagaaaaacatggccaaagttgactttgacgatgttcgtggagctattttttctttccctcttcgggatcagtcttactctgaacatgttttttgaaagcttgaagtataccactccttcctttgttgcatccatgattaatacaatctcaccccttacttttataattgcagttggactcaggctagaggttgttgatgttaagaagcctcgtgggatggctagagtttttggaactgtattatctttgattggtgccttgataatgactttgtataaagggcatacgatacaaagcttacggggtgcacccttcaatgtcagaggcaaattggttcataataactggattaaaggatcgattttgtctgttgcaagttgcatatcatggtctttatggtacatactacaggcaatcatagtgaagaaatatccagcacaactgtcactaacagcatggataaattgcatgggtgcagcccagtctgctgcctttactgtactcgtgcaacgcaagcccacagcatggttcattacatccactgttgaactctgttgcattttttatgcaggagttatatgtggtggttttgttatattcggtcaattctggaccgcagaacaaaaagggccagtctttgtgagcatgtttaatccccttggaacaattttggtggcaattctagcatactttgtttttggggaacaacttcacactggcagtttattgggagtggtcattgttatcatcggcctatacttgctattatggggaaaagaaagtgacggagattacaagtcacaacaatcttttccaactcatgttgagcagaaggaatataggacgcagataaagacttcagctgaggaagaggtaccacagaggagcgtatcacatgccacaaattaa

SEQ ID NO: 155 - DNA, 219 bp, Glycine max
  Peptide Sequence Number=SeqID_116933
atggacccagttttgtcagacccacagagaccccttgtaggagaacaaaatctgatggttgagaagacaaagaaaaaactggaggaagccgctcagtccgaaagcactgagggcgtcattgatccttcatctcccatcaaacgacacgtgaagtggaagatggcctgcaccaagaaaactggtcaaatgtgttggatcgagtggcctcagaataattaa

SEQ ID NO: 156 - DNA, 897 bp, Glycine max
  Peptide Sequence Number=SeqID_116934
accgccacaaaatacgtgttaaagctcgacggctggatccagaaaaacaaagggctggcggaaaccatcggcattgttgccggtggcgcgctggctcttattggtgtcatcggcggcattggtctcgttgcgtggccggttgtcatggggattaacgccatcattgccgccgctggcgtgatgggtaccgccttgactgttgccggtagtgccattgtgaccgcgctcggtgcaatcacctggccgattgtggccgtcggcgcggcgattgtggccggggcgctacttatccgtaaatattgggagcccatcagtgcatttttctcaggagtgatagagggcattatgagtgcctttgcgccggtcggggaaatgttcgctccgctggcacccatttttgacggtctcggagagaaactgcgcggcgtctggcaatggtttaaagacctgattgcaccggtcaaagctactcaggagacgctcgatagttgtaaaaatgctggcgttattttcggtcaggcgctggcctcagcgctgatggcaccgctaaacgttttcaacaagctacgcagcggtgtcgactggcttctcgaaaagctcggtatcatcaacaaagaatcggacagcctcgaccagaccgccgccaaaaccaacgccgccacgcaggggaattcctacataccggcgaccagtacctatggcggatatcaggcttatcagcccgttaccgcaccggcgggacgctcttacatcgaccagagcaaaagcgaatacaacattacgctaccgggcggtgtcgcgccggggcatcaactcgaccgccagctacgcgacacgctcgaacaaattgagcgcgaaaaacgtgcgcgtcagcgtgccagcatgagccacgactaa

SEQ ID NO: 157 - DNA, 676 bp, Glycine max
  Peptide Sequence Number=SeqID_116935
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagg

SEQ ID NO: 158 - DNA, 591 bp, Glycine max
  Peptide Sequence Number=SeqID_116936
gaaatcactgccaaacaagtccagcattggccaaagaaagggaagctttctgcagggaagctgagtgtgaagtatgcaattctgcataggattggcgctgcaaactgggtacccaccaatcacacttccactattgccacagaatcttttgctgtcaaattacccattgccttccctactgtattgtgtggcattatgttgagtcaacatcccaatatgttaaactacactgactctgtgatgaagagagaatctcctctatccctgcattacaaattgtttgaggggacacatgtcccagacattgtctcgacatcagggaaagctgcttcaggtgctgtgtccaaggatgccttgattgctgaactcaaggacacatgcaaggtgctggaagcaaccatcaaagccaccacagagaagaagatggagctagaacggctgatcaaaaggctctcagaaagtggcattgatgatggtgaagcagctgaggaagaagaagaagcagccgaggacgaagaagaagctgctgaggaagaggaagatgcagcagaggatactgaatcagatgatgattctgaagccacctcatga

SEQ ID NO: 159 - DNA, 405 bp, Glycine max
  Peptide Sequence Number=SeqID_116937
atgattatgaggagccaagacatttatagtagtcaagatgaggctactacttcaccttcctatagtgaaagtgaagaagcaaaaggggaagaatctagtgaagaaatctacccccaagaagaaggacaacctttaatggttaaggaagagtgtacggaggtaagtgtctcccccaagaggttagctaagaaggaaactcattttgcaataaagacaaacattaaagaaacttcccttcttagacaacctctacatcttctcttttataaaaagacacttgttagcactgcaacacctcttgggtttgaggttattcctcaagtaaaggagttgttggatgagggtttggttcgtaagagcttaaatccttgtgctttgttggtacccaaaatagggactcattag

SEQ ID NO: 160 - DNA, 322 bp, Glycine max
  Peptide Sequence Number=SeqID_116938
caaagatccacaagggatgtaccctcccttgttcactttgaacaacctagtggatgtaccctccgctagaactaatccacaagagatgtaccctctcttgttctttgtcacaacaacccaagtagatgtaccctctacttgtacaacaaaggatgtaccttccaatgtgttaagacaaagttctcaggcgggagaagggagacacaaaagaattcaggcggttagtccttcgttatttgggaaaagggagaatagagacacaaaaagaattcaggtggttagtccttggcgaattctttttggcaaagggagaatggaatga

SEQ ID NO: 161 - DNA, 252 bp, Glycine max
  Peptide Sequence Number=SeqID_116939
atgatgatttggaaagaacgtgcaaaattagtcatggccacagccaggacgacattcctaaatgaaaaactctacacggttccgaaatttcaacaaacactattgacaacaacgaaggatcccacggtcatgtggctccgcatgccaccggactcttgggtcacggtaacaaaaagtggggtggtcgacaaaagcagggcttttgctcctacgtatcctcaattttgtgacgaggaactcagacctacgtag

SEQ ID NO: 162 - DNA, 288 bp, Glycine max
  Peptide Sequence Number=SeqID_116940
atggttgaaactagccatatagacactaaaagaggtgtgaaagataaggctcccaacacacttccaatgaaaggcctttttgttacaaaacttgaaagcaatgaagcccatgggctcgaaatctaccctaaggctcatgagaaccctagggccttcccttggatctctagcccaatctacttggagtcttctacccaatgcccttacggagtaggattgcatcacgtactatcaaggacttcagaatcagaccagttcccactgttgaatgaccctaacaaagcatga

SEQ ID NO: 163 - DNA, 436 bp, Glycine max
  Peptide Sequence Number=SeqID_116941
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactg

SEQ ID NO: 164 - DNA, 456 bp, Glycine max
  Peptide Sequence Number=SeqID_116942
atggaaagtggatggcatatttattccaaagaccttccggaagatacaggaatccctacggaatataaagtttccggtaaaaacattgaactgatcggaaagttccaagaggttggaaagaagcatgaagaattttctgaggcttttggaggaactattgttttttattccaattctgctggctttaaacaaaaattcaaacttaaagatcctgcaaaaccagctgatgttacatcagagatcacttatcaaacatgtgatgatcgggtttgcttagctcccaatactttagaattcaatcaaaaagtgactccgaaaggagcaaccgaagaagtagctcttgaaacaaatacagaaacttccaaagattccgcagttacagttgtagcagactctgctaaacatgaagttactgttactgaatcctctcatttagatcctaagaagttaaaatag

SEQ ID NO: 165 - DNA, 486 bp, Glycine max
  Peptide Sequence Number=SeqID_116943
ggccctcagtttcgcccacaaccactacccttgcattttgcggtgggaagagtccctcctactatggtggaaagggagaaattggatcatataaaggaaaggctcagggtcattgaaggaggtggagatcatgcttttgctgacattgcagagttatacctagtgcctgatatcatcattcctctgaaattcaaggtgtccgatttcgataagttcaaggggactacttgccccaagaatcacctgaaattgtactgtcggaagatgggggcgtacgcaaaagatgaaaaactgctaatgcatttcttccaagagagccttactagggcagccgtcacctggatcgaagtgggtctgaaaagaggcaaatttgattatcctgctttgataaatgagaagccaggggaaaatagagaggatgagaaggaggaaggaacccatgttgtgactgccattcctacatggccaaatttcccaccagcttaa

SEQ ID NO: 166 - DNA, 1212 bp, Glycine max
  Peptide Sequence Number=SeqID_116944
atggacggccgagatcgtgtggtcgctgagcgcggggacacgacgcttggagagttgcgcatcgatctggcgccggtgacggccaagacattgacggcgcgcctgcgcgacatgcagctgaaggggatgatcacccggcacgagcgcgatacctcgccgccttcgatcgaatacgcactcaccgccctgggggcgcaactgttgccggcgatccacgccatcgcacgcgttggcaatgcactgaagtttgaagaaccggagcgttgctgttcagctcgacgcgctgcggatagcctccggcagcggtgcgctcttgccggtatgcgtatccatccacaccaccaccacgttgccgtcggagtacagcttcgagtcgtcctgctggtcgacgatgcgatggccgatggtcacgctgctgttgcccaggcgctcgacgaacagctcgaccaggatgtcgttgggccacacgatcggcagccggtagttgacgttggtcgcggccaccaccggtgcgatgcggtcggtcatcgacacgccttcaacgcccagcatccagcgcacgcgcgcttcctccagataggaaatgtacttggcgttgttgacgtggcccatgctgtccatgtcacgccagcgcacgctgatcgggatgcgggccaggatcttgtgttcgctgctcatcaggcgtccttcttcttcttgctggcagtagcggtcttgctggacttgccggtgctcttggaagccaccgccttctttgccggcttctccggcttcaccttgcgcggcgggcgggcgtcgggcttgttggccacggcggcgggctgctccgggcgtgcgttggtggagggcagcatgcgcgccaggaactggccggtatacgactgcgggcaggccgccacgtcttccggcgtgccggtcaccaggatcgtgccaccgcggtggccgccttccgggccaagatcgacgatccagtcggcggtcttgatcacatcgaggttgtgctcgatcaccaccaccgtgttgccttcgtcgcgcagcttgtgcagcacgcccagcagcgcttcgatgtcgtggaagtgcaggccggtagtcggctcgtccaggatgtacagggtgcggccggtatcgcggcgcgacagttccttggacagcttcacgcgctgcgcttcaccgtcggacagcgtggtcgcgctctggcccagcttgatgtag

SEQ ID NO: 167 - DNA, 912 bp, Glycine max
  Peptide Sequence Number=SeqID_116945
atgaagcaagtgatcatagtcgcgctggcgggtgcggtgctggcggcacccgcgacaggcgcgcaacagcttgacgccagtcataacgaaacgccgatcactatggcggccaatccgcaggcgatcgcgaagatccccgcaggatttcattttgttcaccccggctatttaaccgtcgccacctcagccaataattcaccgccaattggcctctgggcgtccgataataaaacgctgatcggcagcgacccggacattgcgcgcctgctggccgacagcctcggtctgaaactcaggctggtgccggcggcgtgggaggactggccgctggggatcacggcagggcgctatgatgtggcgatgtttaatatcgcggtgaccgaggagcgcaagcagaagtttgatttcgccacctatcgcgcggataaccacgccttcgcggtgaaagcggacagtaaaatcagcgcaattcgtcgccgggaagacgtggccggcaaacggattatcgtgggctccggcaccaatcaggagcgaatcttactgagctgggatgagaagaatcgggcgcagggcctggccccggtgcagccgatttatctcaacgatgatgcctccgccacgctggcgctgctctctggccgggccgatgcgtcattcggcccgcaggccatggcggcgtggaaagtggcttcgcgcgggcaaaccaaaattgtcgggcacggaccgtttcgcgcctgggtggcggtcaccacgaagaagggcaatggcctggacgtcgcgctgcagcaggcgatcaacggcgctattgctggcggccagtaccaccaggtgctggcaagatggggtgaagagggcgaggcagtggagatttcgcaggttaatccgcctgggattgtttatcaggagaattag

SEQ ID NO: 168 - DNA, 963 bp, Glycine max
  Peptide Sequence Number=SeqID_116946
gaagccgtttttaccgttttcaattgtgcagtgccggtgacggcactgctgtcgaccgtgtttacctatggcggcaattattccgccaccgatcttatcaagcgcgaactcgcgtccgccatcgagcgccagcagctggagctctattatcagccgcaggtcgatggcgacaaaaatctcatcggttttgaagcgctgctgcgctggaagcacccggagaaaggctttatctcgccggaggtgtttatcccggtagccgaaaaaagcgggctgatcattgatattggcaagtgggtgctggagcgcatgctgcagcaaatcgtcgagtgggatcgtgtgctgcggctgcctccgctggtgttttccatcaatatcagcccgctgcagttgatgcaccgcgacttcacccatgacacgctgctgacgctgtcgcattacaaaatccgtcccgagcggctgaagtttgaaattaccgagaccacctttatttacgatcagcagcgcattggggatgtcatcaaccacttcagccagttagggatcaaatgggcgatcgacgatttcggcgtcggctactcttcgcttaagtcgctgagtgatttcgctattgatgatattaagattgataaatccctgatcatgcacatttttgaaaacgaatcggcggcgattgtggtgcaaaagaccattgagctgtcgcgcgcgatggggctgaacgtgctggcagaagggattgagagcgaggagtatttcgagcacctgcgcaataagggctgccatttattccagggctaccatttttgcccgcccgctgcccgccgccgaagcattgcagtggataaaaaaagcagggtaaaccgggcgagccttcattttttaagccagtgcgcagcaatgcgcactctacgaaagcccgagcgagctgtagggtcgccatttatggtgaccacaccgcacgcctga

SEQ ID NO: 169 - DNA, 273 bp, Glycine max
  Peptide Sequence Number=SeqID_116947
atgataattgttggtcagaacattggtaactttctgggccaatatttgatctatgatgacaagcaaaattctagccgatggatgtcctacaagaggataagagtcgtgatcgacattaacaaacctctgaaatgcaccaagaagattaggaaggaaggtggagacgcaactatagtcaagttcaagtatgagaggttgcatgcgttctgtcatttctgtgggtttctagggcacaacgaagactattgtaggaagttaagttattcaaggtag

SEQ ID NO: 170 - DNA, 1062 bp, Glycine max
  Peptide Sequence Number=SeqID_116948
atggtgaagcttgtcattcagagatatactagggaagctggtgtgcgaaacttagagagaaatctagctgccttggctcgagctgctgcagtaatagttttagagcaagaacaagtagttccattaaacaaagggatgcagggacttgctacaccacttgtggaaaacagacttgctgatgggactgaagttgaaatggaagtgataccaatgggtgtcaatagtcgggacatctcaagcacgtttaggattgcctctccattggttgttgacgaaactatgcttgaaaaagtgcttgggcccccaagatttgatggcagagaagctgcagaacgtgtggctacccctggggtctctgttgggctagtttggactgcttttggtggagaagttcagtttgtggaggctacagctatggttgggaagggtgaactgcatctcactggacaacttggtgatgtaataaaagaatcagctcagattgcactgacatggttgcaaatgagtggcatgggtggtgaagctaacattgccgtgtttgttgagaccagtcaaagggttaatgcatggttagcccacatgggtgctggggttatagaatgtggtgggatgttaggatccaattgcaaggtaagggcaagggctactgatcttaggcttgctgctacagaaggatttaatattttggagggccgtgatgtacacatacattttcctgcgggtgctgtacctaaagatgggccctcagcaggtgtgactttggtcacagcactggtatcacttttcagtcagcaaagggtgagatcagacacggctatgaccggagagatgacattgaggggtcttgttctacctgttggtggtgtcaaggataagatattagctgcacatcgttatggtattaagagagttattctgcctgaaaggaacttgaaggacttggttgaagtaccatcgtcagtgctatccaatttggaggtcctgcttgctaaacgagtggaagatgtgttagagcatgctttcgatggtgggtgcccttggaggcagcactcaaagttatag

SEQ ID NO: 171 - DNA, 249 bp, Glycine max
  Peptide Sequence Number=SeqID_116949
atgggttctgagaacaaagaagccccaggtggagaacttaacaattcgtctccttcgccctcttcttctcatgcttggaaaagtcgaatcgttattccaacccttctcgcaggagttgctggtgctggagctgggttgatttcaaagcatcgaagaactcttggtcttgctactgtgtgttctaactatgctgtgaatttcaccattgtcaccgggtgctattgtgtgctgcgtgttttgaatccatga

SEQ ID NO: 172 - DNA, 802 bp, Glycine max
  Peptide Sequence Number=SeqID_116950
atggaggcctccaaaattgacccaattttggagtatgatttctgtgttgccttcctctccaataagtggcacacaccaccctccaacctcaaagatttcgtggtcacatcaattcagcaaaccaaatccaacgcaaccaacatggtttcaatcatttcaaacttcttgaagaacaaaagttttgatccatacgtaaaggattgcctacgaacttgctttgacctttactcggatagcgtttcggccttagataatgctgtggttgctttcaagaacaaggattttgacacggctagtaccaaagtgagtgtttccttggattccccagttgcatgtcaagcttcttttttgcgcttgatctctttcttctttctcatcgcactccctcttggaagaagctctaccaccttgaatgtaccaaaggacataatcaaccaaacatgccaaaaatgtgccaaccaatccatcatcttgagctacaagctatgctccacttctcttccgacggttccggtgagtcactccgcaaatctcgaagggttggcgttggttgcaatggagctagcactagagaatgtcactagcactttggcaatcatagagaagctattagatagcacaagtttggataattctgctttggggtgcttagcagattgcttggaactgtactctgatgcagcatggacaatactgaattccgtaggtgttttcttgtctgggaattatgatgtaactaggatttggatgagttcagttatggaagcagcatcaacatgccaacaaggttttactgagagag

SEQ ID NO: 173 - DNA, 192 bp, Glycine max
  Peptide Sequence Number=SeqID_116951
atggcgccagtgtcggctctcgcaaagtacaagctggtgttcttgggcgatcaatccgttgggaaaaccagcatcatcactcgcttcatgtacgacaaattcgacaacacttatcagcttcaggggaggaaatggcatattggagagaaacagaaaacagattcagattccagtgttgcacgtgtcttataa

SEQ ID NO: 174 - DNA, 523 bp, Glycine max
  Peptide Sequence Number=SeqID_116952
ggatacagctggccaggaaagatttagaagtcttattccaagctacattagggactcatctgttgctgtcattgtttatgatgttgcaagaactggaacttctcaagaagtagctttctctaacagtcctaaacactttgatggacagtttctgattgttcagcattcttgtgatataggccgtcagactttcctaaacacatcaaagtggattgaagaggtgcgcagtgaaagaggcagcgatgttattgttgttcttgttgggaacaaaactgatcttgtggataaaaggcaagtctctacagaggaaggggaagcaaagtcccgagagctaaacgttatgtttattgaagctagtgcaaaagctggctttaatataaaggccctctttcgaaaaattgctgctgcattacccggaatggaaacattatctacaacaaaacaggaagatatggttgacgtgaacctgaggtcttctggtagccatgattcccaacctcagtcgggtggatgttcttgctga

SEQ ID NO: 175 - DNA, 756 bp, Glycine max
  Peptide Sequence Number=SeqID_116953
atggctctctctcttttgtatccccttcttcttgccacctttcttttcatgcaaactctggcagatacttcatttgttcaatctcgtgcagcattttacccaaactctcaagaaaatggcacagatgttggtgcatgtgaatttggttcctttggtgctacggttaatggtggcgacgtatcagctgcatctaatctttatcgaaatggtgttggctgtggtgcctgttaccaagtaagatgtagcaatagtgctttatgctcagacaacggtgtgactgtggttataactgactcaggctcaggtcataacactgatttcattcttagccaacgagcctttggtagaatggctctcaacactgacgctgctgcatctctattagctcttggcgtacttgatattcaatatagacgtgtctcatgcagctacccaaacaaaaacattacagttaagatacatgagagcagcaacaaccctcactatttggcttttgtcatatggtttcaacaaggaagtagagacataactgctgttcagctttgtgagactcaaaactttgtgtgcaagttactggaccggagtcatggagcagtttggaccactacagctccaccaagtggacctttgactttgaggatgttgtttagccctgaagaagagggagaagaaacatgggtggttcctgttaataacataccacaagactggaaggctggacaaacatacgacttaggggtacaagtggaccaatag

SEQ ID NO: 176 - DNA, 135 bp, Glycine max
  Peptide Sequence Number=SeqID_116954
atgggagaaagacaactcgcatggttgttgggagaagattctgtgttgagggaaaggagacagcagtgtgcccagaggctggagttatataggtcagcaagggatgagattgaagcagtttgttggtcgggataa

SEQ ID NO: 177 - DNA, 402 bp, Glycine max
  Peptide Sequence Number=SeqID_116955
atggccggctcaaccaattcttccgcagcaactactaacaacaacactcaaaatgggacaacaacaacccaatccaacccagtggtttttcaactcactttcagctatcaacaactatcatgcttggcatcggcaagcaagttcccttctatctggcatgaagctgttcggttatgtggatggatccactccctcccaatagccagagatcacccaggatgccacaaaggatctcaatctgtcacaaaatatttgttctttgtcaagagaatagttgatgaattatctgttattgatcatgtgcagaatacagagacatcgttgcatcaatacacacaagagaccgtcccttctcctttgaagaattactcagtcatttggttgcccacgaggaatttttaa

SEQ ID NO: 178 - DNA, 1716 bp, Glycine max
  Peptide Sequence Number=SeqID_116956
atggacaccttgatcgcactcgtcaaccgaattcagcgcgcctgcacggtcctcggcgaccacggcgccgataccgccgccttgcctactctgtgggaagcccttccctccgtcgccgtcgttggcggccagagttctggaaagtcttcagtgctggagagcattgtcggccgcgactttcttcccaggggatcagggattgtgacgcggaggcctttggtgctgcagctgcacaaagtagaacagcgacaacaggagtatgccgaatttctgcacttgcctgggaagcgatttactgatttctctatggttcgaaaggaaattgaagatgaaactaataaactgactgggaaatcaaaacagatatctccggttgctattcatctcagcatctattccccgaatgttgtcaatctaacactgatagatctgcctggtttgacaaaggttgctgtagagggacagccagaaagtattgttcaagacattgaaaacatgattcactcatatgtcgacaagcccaattgcttaattttggccattacttcagcaaatcaagatatagcaacatcagatgccatcaaggtttccagacaagttgaccctgcaggggaaagaacgttcggtgtgttgacaaagcttgatttgatggacaaaggaacaaatgctctcgatgtccttgagggaagatcttatcaacttaaaaacccttgggttggagttgtaaaccgttctcaggcagatattaataggaatgtggatatgattgctgctcggcagcaggagcattcatttttcactaccagtcctgattactcacacttggtcagccaaatgggctcggaatatctagcaaggattctctcaaagcatttagagtctgtgataagaactcggcttccaggaattgcatctttaattaatagaaacattgatgagcttgaagcagagttggcacaccttggtagaccagttgctgttgatgctggggcacagctgtacactattctagaattatgccgtgattttgaacgagtatttaaggagcatttagatggagggaggccaggtggagatcgaatttacgtggtttttgattatcagcttcctgctgcattgagaaagcttccactggaccgtcatttgtcgttgcaaaatgtgaaaaaagttatttcagaggcagatgggtatcaacctcatctaatcgctccagagcaaggttaccgacgccttctggagagctcacttcattatttcaaaggtcctgcacaagcttctgtggatgctgttcacttcgtattgaagcaactcgtgagaaagtcaattgcagaaacgcaggaattgaagcgctttccaactcttcaagctgaaatagcagaagcagctaatgaggcgttagagagattccgtgaagacggtaagaagacaacgttacggctggtggaaatggaatcttcctatatcactgtcgatttcttccggaagctccctcaggaagttgacaagggaaagaatccagcttcctccttgttagttgatcggtatgccgaggaacacttccagaggatcggttcaaatgtttcatcttatgttgggatggtgtcacaaacattgaggaataccattccaaaggctgtggttcattgtcaagtgagggaggctaagcgatctttattagaccgtttttatgcacaactgggcaaaaaggaggtataa

SEQ ID NO: 179 - DNA, 612 bp, Glycine max
  Peptide Sequence Number=SeqID_116957
atgacattcgttggtgtggtatcaatggggttggtgtggaggttagttcacttagttgggctggttgtagcggagttgttgagtgagaggggtggagaaattggaggagtgaatggtgaagtgaggtcagggagtgaaggtaccgttgtgccttttgaaggggaagagaacggaaattctgtttcaaagaacactacatgcctagaaatggagggtgaccaagacgagcatgccaaaggagtggaggggatcgaatggtggatagtgttgttgcttgagtgggtgatgagtgttttgttgtgggttgaagggtgtacaggtcatcactactttgactgtgcatcaatgtcgcttgcgttgtacgatccttcatacaaaaagaaaagaggcagaggtggaggtgggaagtttagtagaagcagcacgagtatcgggcaaacctgtgccattacttgttgttacttcatctgggccatcataatgagagtaaaggttgatgttacgaagatcacttgtcacatggtggcttgcacctgtgtcaagcacccaattagtggagggtgtagcggtggaagctgcaaagttggcagtaggacgttgagacaactgtag

SEQ ID NO: 180 - DNA, 414 bp, Glycine max
  Peptide Sequence Number=SeqID_116958
atggcaaatactcttggtaatatagaaatacaagaaattgagtccattaatgtcatgtccatggatacaccactttcatttggggaggttatgccgagagatgcttcaaatgatgctgaagaattgaatatccaaccttgtcttgggttggagtttgagtctcttgaaaagacttggctcaaggaaatgggtgggaaaaaacctgtttctatcataactgatcaagatttagcaattggagctgttataaaaaaagtgtttctagaaacaagacatcgtctttgcttgtggcacattaggaaggagtttcctgaaaagttagctcatgtataccataaaagatctactttcaagcgtgagcttaaaagatgcatccgagagtcaccttgtattgatatttttgaagaagaatga

SEQ ID NO: 181 - DNA, 363 bp, Glycine max
  Peptide Sequence Number=SeqID_116959
atggaaatcaacaaatgcaaactaggtgcaagaagagaaaatagagttagctttctagtgttaaaaagggaagatagaatgaggtataggaattacaaaaggaaacacatacaagaggtgttaggcgtttatggtgccaacggaaagtgctcgacgccggtgttatgcttgtgtcaaaacatgggcttggtcagcatgtctagccattccaactggcgagatcaccacgtcacactccaggtaagtaagcttatcgccatcttcaatggcaacacccatcctctcgtcattgcagatggcggaacagccatttcgccattgccacttgcgggatccattgaaaaaatagatcccctacgttaa

SEQ ID NO: 182 - DNA, 597 bp, Glycine max
  Peptide Sequence Number=SeqID_116960
atgggtgaccaagaggagatacaggaacagatgaaagttgacatgtcggctttgaaaaagcaaatggcttccatgatggatgccatgttaggaatgagacaacttatggagaataacatggccaccgctaccgctgttagttcggctgccgaagcagacccaactctcccagctaccgcgcaccatcctctcccaaatgtaataagacgagatagaagcacactagggcacatcagcaacccctatttgggatacaaccgagtggcttacccttatggattaccacctaattacatgccaccagtcatgcgtgctgacgcgggtcatgtcccttcccccatccttgaaagggagcctcctcgacagtcggacaaggttcacgaggatcgtatagagtatgcccaaggagacatcgatttctaccccccagtccccgtcgagggggccgacacccaacacactgccttagcccaacctcacgggagaaccttgaaacctcccagcacagccaatattcttgtccacagaaggaccgcccccggcagtggaagaacaaaggaaactcgatctcatcgaagagagattgagagctattga

SEQ ID NO: 183 - DNA, 287 bp, Glycine max
  Peptide Sequence Number=SeqID_116961
gggataacgtttctatagggcataacgccattgtgcacggatgtacggttcaggataacgttctgatcggaatgggagcaattgtgatggatgactgccttgtggaagaaaattcaataattggtgctggatcggttgttactcagggaacgcatattaaatccggagaagtatggggtggcgtaccggccaggaaaataaaagatatttcctcccagttgcttgaaggagaggttaacaggattgccgataattatgtaaagtattcctcatggtataaggactaa

SEQ ID NO: 184 - DNA, 399 bp, Glycine max
  Peptide Sequence Number=SeqID_116962
atggctttggcttcttgtggcacaaaaaatatgacagataatttacctaaagatatttcagaaagacccgctgatgaaaacagcaagaaatatgatgaagttcaattggaaaaagcaaaagcagtagtagaatcagaaattgccaaggaaaaatgcagtaatcctgaagactggaaaatagcaccgatgggagcaaaagcttgtggtggtcctaaattttacattgcttatcctaaggcttcagaagagcagattttacctttaatagaaggctacaataaaaaagaagcagagtttaataccaaatatggtattacttcggattgttctgtaattgcagaacccaagggcataaaatgcaagaatggaaaagctgagctcatatttgaaggacaataa

SEQ ID NO: 185 - DNA, 225 bp, Glycine max
  Peptide Sequence Number=SeqID_116963
atgggttcaattttgtcagagccgcagagacccttcgtgggaggatgtgcgaaaaaaggcacagacaccgtgattgatcctccttctcccatcaaacgacacgtcaaatggaagatgacccgcacaaagaaaactggccagatgatatctgaggcaacaaaaatttgttggaggagcaggcgtcatagggttccttggtcgcccatggacgtcaggatgtactga

SEQ ID NO: 186 - DNA, 144 bp, Glycine max
  Peptide Sequence Number=SeqID_116964
atggctactgagacttctgcatctgatcatgcttctactactgatgagtatgtgtgtgagtgtgactgtgtgctcaattctatgcaagttttttttatgtttctttcttggagtcaagcttacctatctttacccagtggataa

SEQ ID NO: 187 - DNA, 2076 bp, Glycine max
  Peptide Sequence Number=SeqID_116965
atgcctttatatgagttataccggctggccagagagaagcttggtaaagaaactaccagcacacgtgctcctgatcaatgttcctcgccagagaatgatttttttgagctggtttgggagaacggtcagatttcgagccagggtcagtccagtagagttagaaggagcccctcttgcaagagtttgccatctcactgcttaccatctcacagtcccaaggctagggataaagatgtaggatatggtagctacacaaggttggggaaatttggggatttagactctggattaaatgaaattccaatgtcggtgccatccagtgaagtggatttctgtcaagatgaagatgtgttaccttggttggattatccatcaatagatggttctttgcaacaagagtatggttctgatttccttcccgcctcaaacagttttactctattggataaaaaaagtaatggcaatatggcgtttagggattctcagaaaacttctgaagaacaagggaatgttttcaagggttcttcagctggacaggttgagactgccagacctaaagctagtagcaccagtcagttattccccccatcattgcatcagtgtcaaacatcttttgtttcgtctagatccagagcatcagatataactgaaaataacaatacgagtaatgcaaaccaggatgcgtcttatggcaaaattactcatattctatcttcctcaagtgatttttctaacgcaaaggtgcagaagtgtgatccacctatgaatagcaatggttccagttccaccataatgaatttctcccattttgcaaggcctgctgctatggtaagagctaatcttcatagcattggcctgaagtctggtttgtcttcatcaagatcagacagtatggaaatgaagaataaaggtgctgctgcaactagcagcaatcctcctgaatcaattcttgttgattcaagtgttgaatgtttaaaggaaccgatcatacaatgccagcaggttgtggagcaatccaaggctgatgtgaactctttgctgccaaaatctgttgaacagaatgctgtgccttctaagcagtcagagcctgctggtaaagagagtgccgctaagattgatctaattcccaatcaagttcctggtgacaatggcactaaaggacagacagctgctgaaaaaagtaaggagccagcagtagcctcttcctctgtttgctctggcaatggtacagaccaaggttcagaagagccaaatcaaaatttgaagcgaaaaagaaaagacactgacgactctgagtgccatagtgaagatgttgaggaagaatcagctggtgctaaaaagacagctggtgggcgaggaggtgcaggttccaagagaagccgtgcagctgaagtgcataatctatctgaaaggaagcgaagagataggatcaatgagaagatgcgtgcattacaagaactcataccaaattgcaataaggtggataaagcttcaatgctggatgaggcaattgagtatcttaaaacacttcagctccaagttcaaattatgtcaatgggagctggtttatatatgcctccaatgatgttacctgcaggaatgcagcacatgcatgcaccacatatggctccattttcacctatgggtgttggcatgcatatgggatatggtatgggttatgggatgggaatgcctgacatgaatggtggatcttcaagattccctatgattcaggtgccccaaatgcaaggaactcatatccctgttgcacatatgtctggatctacagcttttcatgggatggccagagcaaatcctccagggtttgggcttcctggacaaggacatcccatgccaatgccgcgagctcctatgtttcctttttcaggaggacaaatgccaaatgttgacccacaagttaagcaaagcactggtggccgtgactcaactagtcagatgcctacccagtgtgaagcagcagctgttggatttgagcaatctacgttggctcataataacggtcatgcaaccaaggctaatgacaatggatctgttaatcctggacctggcagataa

SEQ ID NO: 188 - DNA, 210 bp, Glycine max
  Peptide Sequence Number=SeqID_116966
atggacgcagaaagcggcgaaagaattgcagagaagcaatgcggaagaaagaagtgtctagcagtgacacaaaagagacagacaggaacagaaaagagtgagaaattcaggggtttctactttctaagttctaaccatggtttagtcaaaagttgtcgtggtttaagtttttcagacccttccagaatcaaacgctcaccctcctcttaa

SEQ ID NO: 189 - DNA, 2339 bp, Glycine max
  Peptide Sequence Number=SeqID_116967
ttgaagacagtgtaaaggaggagaaggaagtggttcctgactcacacactatcagtgacattgaaccagttcatcaggcaccatccacagaacaagctgtggagaaaacactatcacaggagctagaaaaggaacctgtggaaacagatgaagagaaacaagtacaaccgaaggcagaagacgttccagaagcatcggcttcagccgttgaaaaaccaagcaacacagatgagactagtcctctgacagaatcagaaggagaggtggtgaaagaggctcaagttttggaaacaagtgcccaagtggaagagcagcctgagactgaggctgcaccagtgcaggaaaaaccagaaaaagagcaaccgagcacggttgttgcggtatctgagccggtggctacagaagtagaggaaaaaacagaagaaccagaaaaagaattgcaagaagctgagaaaccaagcatagttgcagttcctgagcctgtggttacattagttgaggaaaaaacagaagaaccagaaaaagaatcgcaagaggctgagaaaccgaccacagttgcggttcctgagcctgtggctacacaagtggaggaaataacagaagaatcaagtgcagttggggttcctgaaccatcagctgaaaagaaatcgagtgataccatagaggaaaaagcaacaggaccctcagaagatgtggtggaagagaccaagaacagtgaaacagggcctttggaaacagtggaagcagaacatgtggttcctgaagttgatgaaagccagacagaaccagaaaagcaatcattggaacaaaaggaagaagaggagaaacaagacacatctgcagttcctgaatcctcagaagaaagtggtgatgccatagaggtaaaaacaagagaactagaatttgaggcagaggtattgaaagagactaacaactctcaaacagagaaagcagaacctgtggaagctaaagttgatgaaaaccagagtcaaacagagaaagcagagcccgtggccgccaaagttgatgagaaccaaagtgtaatagagaaaacagagcttgtggctgctaaagttgatgaaaaccaaagtgaaccagaaaaacaagaggaagaagagcagcctaagacagttgttcctgaaattgaagctgaaagtgaagagcaactagaaaatatagtggaggcttaccctcccaaagactcagtgattgaggaggtaaaagacacagacaatggcaactcagagcccaaagcagttcctgaaaaaacagagaaaccagtacttctgtcaactgaagtggaggaaaagccaagagagcaactacaagtagatgaggaagtagcagaagctggtaaggaagtggagactaagcaagaaattgtgcttgagactgccaagagtgaagaaacttcggctggcacggtcacagaagagaaaactgataaagacgaggaaactagcctcactgaaaatgctgagcaagttttatcaaatgtggaacctcaacaaaatcctggggaaacttctccagaagttgtgcttgagacttccaagagtgaagaaacttcagctgacacggtcacagaagaggaaactacagaaaaggttgttgaagaggttgatgacaagaaagaatcaagcatcactgacgtgattgaagcagtattaaacgaagcggctgacatcaagaaaactccagaacaagcctccattgatgaggaagccaaaactgagctaaaagaagaaagagagatttctgttcctgctgctgtggaggaaaaggttgctgttgctgcaattgatgatgttgacaagaaggaacctgaagcacctaatgtttcccctgaatcctcacaagaagaagagtttgaaagcaaaagggttgaggaacagaatgaggcaaaggcagctacaactgaaacagtagagagtgtgaaagttgataatgatagctcaatagttgatgacaagaaggaagagaaaactgactcaaaggtggaagaaatctctagagctattaatgaacctgttagagaaacattggcatctaaatttgaagaggaaactgttgaacctggagcggataaggtagagaaagaacaaactgtggagcctgagaaaactgaggaggttcaagccaccaaggaaagtgatgcaacaaaaacatccaaggaccttccaaaagaaactccagcaaaaccagctcaaaagcaatcaaataacatcatatcaaaggttaagcagtcactagtgaaagcaaagaaagctatcactgggaaatctccatcctccaaaaacctttcctcggatgctaagggcgatattaaagtcaaataa

SEQ ID NO: 190 - DNA, 294 bp, Glycine max
  Peptide Sequence Number=SeqID_116968
atgcgtatgaacatagacagagagaagattgttgtgaacacacaagctggttttcgagaccacgatcaagctaaggatcttctagaagctggcctcaccaatccttcctcacacgtagtcgttgagtcaccttgtcctcaaggtggtagttttggcatagatccttccagctctcccatgaagtatcatcaggagaaagtccactccattgaaccagcacctcccagggatcttctcaataagctcttcgataatccaggatggctaagggatacacaagtggttggtcattga

SEQ ID NO: 191 - DNA, 384 bp, Glycine max
  Peptide Sequence Number=SeqID_116969
atgggtactccccccgtcaacgagaacagtgacgcggtggtcggagatgagtcccgtcaatcgcaatgcttctggggccaaatggcccgaaagggagttcaggctaatttgggcctgatattgggatgggctatcgggcgggtcaggagccggggttcgtcttcttccgcgacaagcctcgctcccggcgcgaggtcaactcttcaggtgtcaggcgcactggtggtggttgggaacggggaggtgacggcaaaagtggtggtaacatggagggacgcactggaaaaggggaaagtggtggaggacgtggccgagaaggcgaatgatagtccaagagcttctcctcctggagacgagccaagccggtggcctgaaccagcgtga

SEQ ID NO: 192 - DNA, 1686 bp, Glycine max
  Peptide Sequence Number=SeqID_116970
atggggtggaaccggtcgcttcgaagattgccgccattcaacaatggcctcctccacgttccaccaaggcaattagaagcttcctcgggctcgtcggattttacaggaaattcatttgaggcagtcaccaccctcgagtccttccaatggtctcctcaagctcaaacagcttttgaaaacctcaaacaagccctatcaactacccctgtcttagcatttccagacttcactatgcctttcaccatcgagaccgatgcctcaggagtagggatgggtgcagtcttatcccagaaaggacacctcatcgccttctttagcaattcgttcacctccaagctcttgggtgccttagcctatgttcgcggattatgtgccatcaccaccgccgtgaaaaagtggaggcagtacctgcttggccatcattttgtcatcatcaccgaccatagaagccttaaagagttgttgactcgggtaatccaaacacctgagcaacatatgtatttgaccagattattgggttacgactatgaaattcaataccgctccggtagtcacaaccaagcggttgatgccctgtctcgcctaccagaatctgagtcattcctgtccatgatcctatcagttccatccttgatttttctggaggaacttcgtcaccagttggaagacaacccagagtatcgaactctgcgtcattcccttcgagaaaatccccagcaacacccgaattcaccctcttttaggatttggtgcttcactctggtcgaatttggttaccaagggatatcccaattgcttctatattgcttgctgaataccataccacttcgacagggggccacgccgaagtcactaaaaccctggcacgcatatcagaaaacttttattggacaggttactaagtatgaagctcagaagatggcggggttgttatgtcccttgtcggtgccttgccgtccgtgggaggacttgtcattagacttcatcgtcgagcttccgccatatcaaggcaacattaccattctggtggctgttgatcatttttccaagggaattcacttgggcatccttccaactgcacatatggcacacatgcctgcttccttattcgtcaacatcgtagtcaaactccatgggattcctaggagcttggtctccgatagagaccccctgttcattagtcgcttttggcaggaactctttcatgcgagtggaaccttgctgcacatgagctcttcatatcacccacaaagtgatggcttatggggcaagcttctaccgtgggtcgagtggtctcataatacatcttggaatgctggcactggagcaactccgtacgaagtcaccttcggtcggaaaccctttaattttccggagtacattgcaggatcttctaacattacggcgatagaagaaatgctgactgatcgggatgacaccttccaagccattagaaacaagctcctaaaggcacaagaaaatatgaaaaagcaggctgatggaaaacggagagagatgcaatatgagattggtgattgggtccttctaaaactgcgaccccgccggcatacgacagttaagggattgaaggtgttaaccggaaaattagcccagcgatactatgagcccttccaagtcacagagcgtttgggcctagtggcctataagctgcaatttccagaatga

SEQ ID NO: 193 - DNA, 183 bp, Glycine max
  Peptide Sequence Number=SeqID_116971
atgaagaacgatgtagaagtcgattacggtcgtaattcgcctccctcacacctatttatagcaaaagatgacattaagggtcatggcagctcgcccaagcgagttggagctcgcccaggcaagttattgcttcaacctgaagtaaccttgctcgcccaggggagctggttacttcacccctaa

SEQ ID NO: 194 - DNA, 378 bp, Glycine max
  Peptide Sequence Number=SeqID_116972
atgacaccttatcctcccaccagggagcttgccaagtctcaccccatagtggctgaaggcactcaaatcatgaaaatagaggaagggtctccaattcaagctttgaccatctgccaagcaagcctagacgatgaatttgatataaatccgctcaacaacacttttgacaagcgtaaaacacatcgtcgtgctaagaacaattccaaccgagaggaattgcgttcagcgcgaaatgttgcgctcaacacaagaggaattgtactcagcgccaaatgttgtgctcaacacaaatcccaacccgagaggaattgcgctcagtgcgaaaagttacgcttagctccaaaagtggattccatcttagcaagacgagctcactaa

SEQ ID NO: 195 - DNA, 261 bp, Glycine max
  Peptide Sequence Number=SeqID_116973
gggggtgatgagtttgtcaagcccccgagcatggacaagtattgttcggtgtcgagagtggtatcctcgatcgatgtgagaattgcaggtttattaagcttgtcaaggcctcgagcctggacaagtgatgtttgggctgcttctgttaggttgtctggggtggacatgcttttggttttgcaggcgaggtctgacatgtgtgtgtggcgcacacacaatactcttgcgtacatgtcactcgtggagtgggcacgtacttga

SEQ ID NO: 196 - DNA, 381 bp, Glycine max
  Peptide Sequence Number=SeqID_116974
atggcacaaaatttcaaaggccctcaccatggcccaactgtttgggtggagttggaaagaggtcatgttcaagttctcaagaagagcacattggaaagtgttcaaggggagaacgagacccctgacctcaaacagacaccactacataaaaaagaagggtggactgctcgacactgccctcaagaaaaggaagttgtcactcccgcaagcctggacgactatcttgcaggagtcctcaggatttgccagcttcacctgggaaacgccctaacctccccaccacttctccttgctcccccagaagcagaagaggggatgatcacagtgactgggataggctccctagctggggaagcagggaaaggctacgtcagcctgtga

SEQ ID NO: 197 - DNA, 1440 bp, Glycine max
  Peptide Sequence Number=SeqID_116975
atgtcttcgtttatgtttgacttcgtcatcgacatgggtggcagtgattatgggggttcgattcaacaacccctcatgaaccaggaggtcatttccattggtggttcctcctcggatgatacttgccatgttgcctccgactacgaattctcttcctcaaagaggttgaggcctttccctgcttccccagctagggagcctatcccagtcactgtgatcatcccctcttctgcttctgggggagcaaggagaagtggtggggaggttagggcgtttccctgcatgcgatgtagccatagcggtgggtcaccatcatcctcacttgtcattgttggctatgagtgggtgaagctggcaaatcctgaggactcctgcaagatagtcgtccaggcttgcgggagtgacaacttccttttcttgagggcagtcaggggtctcgttctccccttgaacactttccaatgtgctcttcttgagaacttgaacatgacctctttccaactccacccaaacagttgggccatggaccgtttcttcaaggtcttggctactgatgtcacggctaatgatttgccactaatgtttaatagggacggggagccccgcttctcgttctattggcagtctgatcccatcaggttcaagttgtttgatgaggatttgttgacccttgtggagaagatcgaacctactagtgggactgtgccaccgtctgctgctgctactgctcctactactaaagaagaggatcaacctattgttgaggttggccttattattggtgctgctaagattgcttccagtgccccttcctctattttgactaagaggaagcgagatgatggtccttcggctccgtcaaccatcgaggcttctactcctactgctattgttactgttactcctgctcctcctcctcctgctatgccttccatcgtccctacacccttgttgagtgctggtgtggcgaccaccagtgctcctgtgatgctgcctccttcttctactccaccatttccaccctctattgtgttggcgggtgcaagttacaaggcaaagcaaaagacctcgggtggcagtgcccttgccaagttactgcttaccatgttggatggttatgaattgttcgaacactgcaaggttttgcaggaagagaaaaaagacttggctggcaaggtggagggcattgcggggaagatgaacgagcttgctaaggagtttgagttgtgggcggctatggagagggaggccgacaaggatgttgaagaggagcttctgatgtacaagaaggaggtcagattctttgtcaaggaccttgacttgggtctttttcacccattcaaggatggtgttctgcttgacgaggaagatattgctactgaggaggaggctggcgaggagcagggtgctgaggagcaaggcaatgatgccaccatttag

SEQ ID NO: 198 - DNA, 513 bp, Glycine max
  Peptide Sequence Number=SeqID_116976
cgctcttgcgccgaagatgaacggggctaagcgatctgccgaagctggggggtgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 199 - DNA, 375 bp, Glycine max
  Peptide Sequence Number=SeqID_116977
atgggccctccagcgaaggtgttgtggtatcttcccatcattccaaggtttaaacatttatttgctaatgaggacgacgcaaaagatcttacctggcatgcaaatgggagaaaatatgatggaatggtccgtcatccagctaattgctcccaatggaagaagattgatagtttgtatccggatttcggcaaagaggcaagaaatcttagacttggactagccagtgatggaatgaatccatatagcaatttaagcactcaacacagttcatggccagatctactagcccagcccaatacgcgcgttgagcgcgcgtcatgcgctaagcccatgatccaacagaagcgcgcgctaagcatgcaacacgcgcgctaa

SEQ ID NO: 200 - DNA, 382 bp, Glycine max
  Peptide Sequence Number=SeqID_116978
atgacacctattgtgaaaggtgatagattcaatttgaatcaatgtcctaaaaataagcttcaaagggaacaaatgagaaacattccatatgcttccattgtaggaagccttatgtatgcgcagacagctgcaaagaaagtgttaagatatcttcaaggaaccaaagattacaagcttatatatcaaagatctgacaatttagaagttgttggctactcaaactcggattttgttggttgcgttgactctcgcaggtcgatatctggatacatattcataatggctaatggagcaatatcttggagaagtgaaaaacaatcattagttgctacttctaccatggaggctgagtttatttcattattggaagcggcaacacagg

SEQ ID NO: 201 - DNA, 291 bp, Glycine max
  Peptide Sequence Number=SeqID_116979
atggacaaattgcttttcttaggaacacatattcgttaccacaaaaaggataatgatatcccttcaacacaacataggtcatcgaaaggatctcgaagacccaccaacgcacgaaagccgggatctttcagaaaatggattcctattcgaagggtgcataaccgcatggataagctcacactaacccgtcaatttgggatccaattcggttccttaggaggtatcgggaaggaattttggaatgtaataatatcgattcatacagatacagaagaaagggttctctattga

SEQ ID NO: 202 - DNA, 324 bp, Glycine max
  Peptide Sequence Number=SeqID_116980
atggttcataacatccctttgttgcatggccaagagaaggttggtgttaaggaggttaaagatgcagaggctcccattcatgtacccactgacgaggcagctgtgtctccagcaacgcctccagataggctgcatcctgaggtcaatgatcccctaaatctgatgatattgaccatcccacagcttttcttgaggcctctccaggttatgtgggatgctaccgtgtccggggtgtttaatcaagactttccattgtacatcaagcatgaagatctctccgaaattgcacacgatggtcaatgtctaagcatatctgttttatag

SEQ ID NO: 203 - DNA, 393 bp, Glycine max
  Peptide Sequence Number=SeqID_116981
atggatcgagttacatcgctgctttgtctactgccaaacacatttaggactgctgatgtccctgtttacttccagtttcaccttgacaaagatgtcatggaccatgaggtgcaaaagcagatgaaggccgacatggaggccatgaaagagaaaatggccacaatgatggaggccatgatgaccatgaagaagataatggaagccaatgcggttatagttgccactaccagtgctgttgctaaagtgaacccgatggccccatctggcctcaaccaaatgaatcaaccaaccttagctatggtaggcaaagatttgggaagtacgggcagcccctattatgtgcaaattcaaaacaagcacgctttcccgctatatggttggcctcccaactag

SEQ ID NO: 204 - DNA, 324 bp, Glycine max
  Peptide Sequence Number=SeqID_116982
atggacgaagatcaatgggcgtatgagtatgcgatgtcacaagaagttcatatggattatgattatgataatgaagaagaatgtggtgtgactgaaccacatgtcgattgttcaaatgcttttaatacgtctcaggtatttggtactcgagatgatgttttgcagtgggctcgaacagttgcccatgaaaatggatttgttgcagtgattatgaggtctgacacagataccggtagcagaggaagaagttcatttgtcttaattgggtgtgaaaggaatggcttcgtgggaaaccagtgcatggaggggaaggttggatggtga

SEQ ID NO: 205 - DNA, 99 bp, Glycine max
  Peptide Sequence Number=SeqID_116983
gctgggaagcatgacaacaagttggggatgcaagtagctccattgagttatcttgctccgtatgagaccaaagaattaagtcaagaacacccaacttag

SEQ ID NO: 206 - DNA, 207 bp, Glycine max
  Peptide Sequence Number=SeqID_116984
atgccaatgtttaagcctccttgtaagagggatggtgtcgaaggacaaattctagatctagacacgatggcaaaagatggggttttgggtggtggtgttgattctggggttggtgaaaaactggatcttgcaaaaatgattgaagagttagacttgggtgaagtttcctctgtgttcatttgctcagtttcccttgagccaatataa

SEQ ID NO: 207 - DNA, 267 bp, Glycine max
  Peptide Sequence Number=SeqID_116985
atggaagcagagactttgaatgcaaatcaccctcccggttttcttcaccggtcgctccccgctgttgtgcctatccttttgatttcaataggatatgttgaccctggaaagtgggtggcaattgctgaaggaggtgcacgatttgggttcgatctgatggccttcatgcttatctttaattttgcagccatcttctgtcagtacatatcagcaaaaattggtgttatcacaggaaaggatcttgctcagtacaattgtataatttga

SEQ ID NO: 208 - DNA, 3375 bp, Glycine max
  Peptide Sequence Number=SeqID_116986
atggctaagtggggaggtcatgatcaatcctttcctcagactcagctaagtcagtggcatcagggatcaactaccatttctaaggatgctttatgtcataaccattttttggccatcatgtgtgtcttcagtggcctttatttggtaaataatgtgctgatgaatgctgcagcaaatgagttctacagtatgggtcttgttttgactacttttcaggatgcattatcaccaatggaacaggtgttgcgtagtccaatagccatgcttgcttttttactcattctgtttttttcaaatcaaaccacagcattaacttggagttttggtggagaagtagttgtgcaaagtttcttaaaattggatattccgggttggcttcattatgctacaattagagtaattgctgttctgcctgccctttattgtgtttggagttcaggagctgaagggatgtatcaactacttatattcactcagattgttgtagctctgcaacttccatcttctgtgatccccctttttcggatcgcctcatctagatcaataatgggggtacacaagatccctcaatttgtggaatttttggcattgatcatattcattgggatgcttggcttgaatattgtctttgttgtagaaatgatatttggcagtagtgattgggtgggcaatttgagatggaatgtggggactggtgtgtctctctcttatttggttcttctttgcactgcgtttgcatcattctgtctgatgctttggttagctgccacacctttaaagtctgctagtgttcaattggatgatcagcaatggaactgggacatgccacaggccgtaccaaaatcacggattgataacgaggaaacagatttaaaagaaacaagatatcaaggagatgcatcagttcaggggaaggaaccatcaccagctctagcaaggaccctggaatattcagatgtaccagttgcaagttttcatcttgatctacctgaaactatcatggagcctgatgttcctgtgactactgtaagggagactcatccatttacatcatttccttgctccccaacatctgttaaggaatcagcttccacttcagaatcggaggcagtaccagctgtaagtaatgagacttctgatattatattgggacattccaaaactttgaaaacagaaactactgcccctgttgagaaaactgtagaaattgagggagattcaaatgccgaaagggatgatgatgatggagattcatgggaaactgaagaaatacaaaaagtggtctcactagccccatcttcagcatcagatggcccagcatcattcaggagccttagtgggaaaagtgatgatggagggaatagcattggtagtctttcgagattagcaggtttagggcgcggtgcaagacgtcaactagctgctattcttgatgaattctggggacaactttatggtttccatggtcaatttacccaggaagctaaggccaagaaacttgatgttttactgggaatagattcaagactcactggttctttgcaaagaatggatccatgtggaaaggaatattctgaatatttaatatctgtaggaagtagagctccagatactttaatgaactctgctccatatgaatctcccaggcagaataggatccaaagtaatttagatgcttcctatgggcctcaaaggagttcttcctcactgcgggcaaatcctgtccagtttatggatgaatatgttcagacctccagccgcaatctcctcgatgctggtgaaaggcgctattccagtgtgcgcaatttacctacgtctgcagcctgggattatcagccagctactatacatggttatcaggtttcatcgtatattaatcaggttggtaaagacacaaattctgataacttaaatggtctgagggaatccccttccatgggtaatacgaaccactacaggaattctatgggtaatacgaactacaggaattctattgcatttgctttgggtaaaaagttgcaaaatggttcaggtttaagccaacccccagggttccagaacattgctgtctctaagaatagccaattgccatctgagaggtcctattatgattctcgcccttccggacctgtggatagtacagtcagttcagtcaatgctaaaaagtaccacagcttgccagatatttcaggatatgccattcctcacagggatgtttacatgtctgataagagtgctccatgggatggttctgttggtggatatagatcttctgcaagtaggactcattatgaaccgtcattatattcaaactctggatcaaggacaggagctcctttagcctttgatgtactctctccatcaaaagcctacagtgatgaactttcttctcagttgagttctggttttggcactggatccctctggtccagacagccttttgagcagtttggggtggatgataaaattcataatgctgcaacagaagatgttggaaataggcctagtgcaactactcaagaaactacttcagtggtggatatagatggcaaacttcttcaatcttttagacaatgtattttgaaactcttaaaattggaagggtctgattggttgtttaaacagaatgatggggctgatgaagatctgattgatcgtgttgctgcaagggagaaatttgtttatgaaattgaaaccacagagatgaaccgcaatcatatgggagaaactcgatatctttcttctgatgggaagtcttgttcttcaatgaagaataatgaggctaattggtctagtttttccgtaacctcaatccctaactgtggagatggatgtgtatggagagcagacataataataagctttggggtgtggtgtatcaaacgtgttcttgacctctcattaatggagagccggccagagctgtgggggaagtacacttatgtactcaatcgcctccaggatacagccttgcctttcctactattcaaggatactctcggcatcattgatctggctttctccaagcctcgtagtcccatgaccccatgcttttgccttcaagttcccatgacttaccagcagaagtcaggctcacctccttccaatgggatgctgccccctgcatcaaaaccaggccgtggaaaatgcacaactgcgtcagtggtgtttgagatggtcaaggatgtggagatagcaatctctagccggaaaggtcgcacaggaactgctgctggtgatgtagctttcccaaagggaaaggagaatttggcatctgttctcaaacggtataagcgtagattatccaataaaccagttggcactactcaagaagggattcgcaagattcccacatcagcaccatacaacttgtag

SEQ ID NO: 209 - DNA, 213 bp, Glycine max
  Peptide Sequence Number=SeqID_116987
atgtcggagctaagagaaatacccttcgcaccggagaaaaaggaatcacatgaagacagtacaagtggagacttcaatcacttctccgtctctctaacgtttgggaactctatcagagcagttggaggaaaaaccgaaggaattttaggaaacgctagagatgccgctgtcactgtcggaagacacatgagtccgcttagaggtaagggatga

SEQ ID NO: 210 - DNA, 450 bp, Glycine max
  Peptide Sequence Number=SeqID_116988
atggaacttcaacgacttaatcaaaatgaagaaaccgacaaaaagaaaagaaatatagcacttaaagcctcttcatcaatgcaagaagaaaatgaagaagaagaatcagaagatgaagaagacttctcactctttgtgaagaagtttcaaaagtttgtcaagaagagaagaatcgagaggcgtcagaacttcaacaatggaagaagatctcaagaagactctcaaattcttagatgctacaaatgcaaccaacttggtcacctcaaagcaaattgtacctcaaataaggaatggcctgagaagagtgataagaaaaggtatgaagaaagaaggaccaaaaaggcttacattgcatgggatgacaatgactcatccgatggttcagaaaaggagatcaaccttctaaccaaggattatgagagcaatgagaacatttctcaagaagattaa

SEQ ID NO: 211 - DNA, 468 bp, Glycine max
  Peptide Sequence Number=SeqID_116989
atggctgaattggagaggcataacttccataagcacctcaacaatttagctgatagtagcattgacctagcattggtgaaggagttctacgacaacctctacagtcctgaggggccttcaccaaaacaagtcagaatacggggccacttgataaggattgatgcagacaacctcaatgccattttagaaacacttgtggtgcttgctgagggtgaatctctacccgattactcaagatactgcaggatgcctactgacatcagggaaattaaggtttctcggtgcatacctggccgagggtttattttaaatgctgaaggtcaccttgggaagatcctcagaaaagatctaatcactcttgcccaggtttggagtgttctctcatactccaacctggctttgacttcccacaccttggatttggctgtggatagagcgaggttaatatttggcttagtactcagctag

SEQ ID NO: 212 - DNA, 909 bp, Glycine max
  misc_feature (874)..(874): n is a, c, g, or t
  Peptide Sequence Number=SeqID_116990
cctgacgccggtcaaacaggctgatctgatcctgattaacgcggctgacctcaacctttacccgaacggaaatgcattcggaacggtggtgcatgcagctgaacgtagcaacatcgataccgtgatgatcggcgggcgcatcgtcaagcagaacggcaaagtgctggccagacatctttgcggaaaaattcctgccgctgatccaggcaaactgacagggaataacagcatgagcgcggtttattacgtaatagcttttgcagcgggcctgggtattacccttcagacgacactgaacagtcagcttgcaaaagggctcggcggggatccggtcaccgccgcgttgttttcctttacggccggggcgttcggccttggaatttactcgctgctgcgtggagggttattcacctcccttgctgccattccttcgcagcctgtgtggagtctggcgggcggactgattggtgcctgtgcgttattcagctacgttgtactcgctcccaaaatcggtttttcagccctgctcggtctggcgattgtcggacagttactctcatcacaggtgatcgacaattttggcctgctcggcgcgataaggcggccagtctcgttgctgaagctgggaggaatgctggtcatgctgattggactcgccatcatgctttttggcgacaaactttctgcactggctgctgatgtcagaaatttgctgggagagtgcccaatctggtgtgagaggacacgcaggatttactggactgacattgaaggcagcgagctgcttgcccttgaagaagataccagtgttgtgatgcgctggtccctgcctgagcgcctcggatcgtttgcacttactgaaaattctgacgtnttactgatggggctggcgtccagattcgcccttct

SEQ ID NO: 213 - DNA, 321 bp, Glycine max
  Peptide Sequence Number=SeqID_116991
atgcatgctttgttagggtcattcaatagtggaaactggcctaattctgatgaccttgataggacagggctaagttgttgtactatcatgaggaatcgaggagaatttgtgggatattttgctaaggcgaacatactaatggagtatgtgttctctaatgctgctgtatcaagtagtttcacagagtatttgagctttgcatttggagaaagtgatcaaaatgtgtggagagtgaaagtgcatggattgctaaaggactttaacatattggatttcccagctgtgtcttactttcttgtcactctcttgcatgtgtcatag

SEQ ID NO: 214 - DNA, 642 bp, Glycine max
  Peptide Sequence Number=SeqID_116992
atgtccccaatcgtccggatccaccgaccagtcggtgacgatagaatccagatcccccggtttcgcccggcggctgccggtgatggggatcgtctcttcgcgccagaactgcggcgcggtggttttaaactcggcggcctctacgcagggcgtaaactggatataggtggcgccgagttcacgggtaagaaaacgatatacctcgcgcgggaaacgggcattcacccggttaacgactgccagcgcgttgaacggcacgccgtggcgcttcagtgccgcgatcccttccataaccttatcgaaggtcggcttgccgctgcgcgtcacgcggaagcgatcgtggatctcgcgcgggccatcgatcgataccccgaccaggaagttatgcgccttcaagaaggcggcccacttatcattaatcagcacgccattggtctgcagatcgttctcaatgcgctggtgcttcggctgatatttcttttgcagctcaacgaccttttcgaaaaactccagtcccatcagggttggctcgccgccctgccaggagaaaataatctcttcgccatcctggctttggatgtactgacgaataaaattctccagtacctcgtcgctcattcctttgtcgtgcggctgatgtaa

SEQ ID NO: 215 - DNA, 150 bp, Glycine max
  Peptide Sequence Number=SeqID_116993
atggggcttccatcccagttatgcatcaccgcgccgttttgcggcaaggcgctggcgattgagaaaaacggcgacgtctactcctgcgatcactacgtctacccggaatataagcttggcaatattaaggcgcataagctggcgcatatg

SEQ ID NO: 216 - DNA, 432 bp, Glycine max
  Peptide Sequence Number=SeqID_116994
atggtcgtcattttgcctaaggaaaatcttgtcgtctggttttgttcgttgcataataggttagacaactacctgaaaggaataattaacaagtcagtgttgtttttcaatacatttgcattagcattacttaacaacatcaatattttaatgttccttgtattcaacagtgctttgaaaggacttgatgatactccacaacctaaatccaaggctggtgctaggtggattgttgttaagtgtaatagacaaaaagggagcattgagtgtggctattacgtcatgcactggatgtccactataatcttaggaagtttcaggaataattggaaaatgtattttaatgatattagaccattggaagtagagagattgaaggcgcttcgcatccagtggacacaatattatctcaaaattagaaatcaaacttag

SEQ ID NO: 217 - DNA, 205 bp, Glycine max
  Peptide Sequence Number=SeqID_116995
tacaccagaacgcacacaacactgcatacctcgtatgccgtatgtcatcaacgatcaccacaacaccgaacaccagaacgcaccttcaccttcatgcaacctaatggttcaccgaaccaaaccgatcgcaaggaaggaagcactacgcaccgaagagagaaaagaaggagacaatgcgcaaatggaagcattgtgccatttttaa

SEQ ID NO: 218 - DNA, 170 bp, Glycine max
  Peptide Sequence Number=SeqID_116996
aggaaacactgggtacaacaaagataggagaaaatcactcaaagtgtatcaatctcacacagggcaaggattgacattctcaccctgggtcaaggtttatgataagttgggattttggctcaaggcttgtagaacggctggtcatgatacatgtcagggtttggccagcg

SEQ ID NO: 219 - DNA, 384 bp, Glycine max
  Peptide Sequence Number=SeqID_116997
atgtcgcggaacttcacggattgcgtaacgatgggtgtcaagtacctcgaagtggtcaagcaagggtcgcaccccaacaaacagatgatccccggacgaaattatggaagtaaagataagacactaatttcgttcgagcggaacaccattcggccggtcaatctccccgccagcggtacctgcaaaaatcttgaaaatgatcagcaccgaacgaccaacatcatcctgatactgccgaatttgttcctctcggttgacataaggcacagaatgaccataatttgtctctgcgtgccatcggacacgatcgtatctggatggcaaaaggtgcagaatgaccataatttgtctccgcatgtcttcgagctcgccgcctctggatga

SEQ ID NO: 220 - DNA, 666 bp, Glycine max
  Peptide Sequence Number=SeqID_116998
atgatgtttgcctttacttctactggaattaagctagataaaacaagtaataattcaagaggacctcctacaatcagaatacagggccaaccatgccatagaataggcagtctattaccaatgcctaggaaaaaacccaaatttgcacagctatatatctttgacacagaaaatgaagtgcaatatagaattaatgccatgagtcaatattctagaattcagagtcatattgtttcagctttaagtcacatgctcaatcaacacaattctcatgctaaaatttttagaatggccagggatagattggcatgtgatcaagccaataatatcaaattgcaactcatagctgctcggggaaaagatggtcgtgtatataatatgcctaatgttctggaaattgctgcacttattgttggtgattttcatccaggctcaaaaagagatattattgttgaaactcaaaatggagaattacaaagaatccatgaacttcaccctagctatctaccactacagtatcctctaatttttccttatggagaagacggttatagagctgacatacttcaccgttctacttcatctagcaaaaaaagaaagcgaaaccgtctgacaatgagagagtggtttgcttatagacttcagtccaggtcaaataaagcatag

SEQ ID NO: 221 - DNA, 1604 bp, Glycine max
  Peptide Sequence Number=SeqID_116999
gttcctgcggcgtgataggcgatctggtcgctattgttaaagatcggtgtcgatccggcggcgatattaaccagcgcaccgtccagcgcttcggcgccgatggcgccactgccgttgagcgtgagcgtgccgccgttgaggttcgccacggcctggctaccgctggcgctgacgccgcgcgtacggcgggtggtgttgccgccattgacgtcgatattgccgctgttgctggcggtggtggcgaaggtgctgcccgcgctgttcaccgcgataccggtgccgccgtcgctgatgctgatattgccgctgttgctgccggtcgccccgctctccacgcgcaggccagtggtattggccccgctgaagttgatgttgccgctgttgctgagctgcgcgcggttgcgagccagatagccggtaatgccgttctgcgccgaattgagttctgcggcggaagtcagccgcgtgctggcgaccggcgcacggctgttagcaccggtcagcgtatgtttctgcccgtcggcaatcgcgcccgtggcgttgctgccactgagggtaatggtggtcgccgcgtcaatgttgccctgcgcaccgccctcgatattgacgccggtggcaccggtgccgctgacgttgatcgtggcgttgttggtcttcaccaatgttccgccaccgccggtgccgttcaccgccaccgcccccgcgccggaggcggtcagcgtggtgttagtcccgtcaaacatcgcgccctgttcgaggcggaagagcgtcgagttagtggtggtgacgtcaaacgcgttgttgtcgtccacgttgatcagcgcattcgggccataggcaaaaaaaccaatttgattgctgccggtgctgaagcggggaatggcattctgcgtgacgttaaccgtggcgttgccgcgcgcgtgcacgccaatcgcgccgttgccggtgaggttaatcggcccgtccacgtttgctgcggcagtgccgctgccctggccttccacccacacgccaaagttgcgcgtgccgctggccggatcggctccgcccgccacgttgatggtcccggtggagctggcggcggcgctgttaccactggtggccagcactttcaggccggtgccgttaacgccgttgaggttgatggtgccgcgattctccagcgtaccgttgctgttagtgaccagcatgccgacgttctcgcgcggcacgcgcgcagcgctgccgttgacgtcgatggtgccgctgttgatcagcgtggcattgctggcaccgctgaccgacatcccggcggcgttctgtacgcgcgagccaatcacaatcgccccgtcgttggtggcgctgccgttggccagcagcgcaatgccgctggtcagcccgctctggttcagggctgtctccgccacgttgtcgctcaggctgttctgcgcgcctcgcccgaggtaaatcgtgccgccgctgttgttggtaaatcggctgctgtcgctggtgagcagcacgccggaagtggtgccgcgcgcgctggaaccgttgacgcccacgttgatattgccgctgttagcggcctgagcatggcatcaaggcggatgcccgccacgccgttg

SEQ ID NO: 222 - DNA, 653 bp, Glycine max
  Peptide Sequence Number=SeqID_117000
atgagctgattctggcgtattccacctccagctcagagaccgtgctgccgcgcatcatgcagaagatggaagcctacggcgcgccgaaggcgatcacgagcttcgtggtgccaaccggctattcgttcaatctggatggttcaacgctgtatcagagcattgcggcgatctttatcgcccagctgtacggcattgacctgtcgctgaccgatgaaatcattctggtgctgaccctgatggtgacgtcgaaaggtatcgcgggtgtgccgggcgtctcgtttgtggtgctgctggccacgctgggcagcgtcggtattccgctggaaggtctggcgtttatcgccggtgtcgactgtatcatggacatggcgcgcaccgcgctcaacgtcattggtaacgcgctggcggtgctggttattgcccgctgggaaaaccagtttgataccaaacaggccgccgcctacgagctgcaacaagtcctgtcgtgggagctgattaggatgttgcttgaacgagggtggattctggatcgtgttaaaggaagccatcatgtgtttgtccgtgcagataagccatatcacatctcgcttcctcatcctgaaaaagacctggcaaccggaacattacgtaagctattgaaaatgatggactga

SEQ ID NO: 223 - DNA, 1469 bp, Glycine max
  Peptide Sequence Number=SeqID_117001
atggcggcgattactgaaagcttgttgcgcgatatcctgcaggcggtcggcggcgcaggcaatgtcgtgcactgcggtaactgcatgacgcgtctgcgtctgacgctggccgatgccgcgcgggtcgacagcgcccggctgaaaacgctgcccggcgtgctgggcgtgattgacagcgatgcccagctgcagattgtgctcggccctggcaaagcgcaaaccgcagcggaaaaaatgcaggcgatgctgaacagcgccacgccagaggcgccgggcgatctgcacagcattgccagcgcgcagaagcagcagatgaaagcgaagcaaaccagcgcgctgcaccgttttctctcctgctttgccaccatttttaccccgctgatcccgggctttatcggtgccggattgctgctggggtttgccacgctgattgagcaggtgtgccatctcaatcagcccggggaacacgcccgctggctgctggataccgtggcttatatgaaggtgttcggtaaagggttgttcaccttcctcagtatcttaatcggctataacgcgcagaaagcgtttggcggcaccggcgtgaacggcgcgatcatcgcctcgctgtttgtgctggggtatgtgccgaacgcgaccgtcggctattacagcggcatgcaggatttctttggcctgactatcgatccgcgcggcaatattattggcgtgctgctggcagcgatatttggtgcctggctggagaaacagctgcgcaaaattatcccggataatctcgatatgatcctcacctcgctgctgacgctagtaattaccggcgcggtgacgtttctggtgatcatgccgattggcggcgagctgtttaaaggcatgtcgtggctgtttatccacctgaacaataacccgttcggctgtgccattctggccggcttattcctgattgcggtgatgttcggcattcatcagggctttattccggtctattttgcgctgatggaaacccagggtttcaattcactgttcccgatactcgccatggccggagccggtcaggtcggcgcttcgctggcgctgtggttcaaagccgataagcactcgctgctgcgcagccagattaaaggcgccatcgtgccaggcctgctgggcgtcggtgagccgcttatctatggcgtgacgctgccgcgtcttaaaccgtttatcaccgcctgcttcggcggtgcgctgggcggcttctttatcgggctggtggcgtggctcggtctgccggtgggcatgaacacggtgtttggcccgtcaggactggtgacgctgccgctgatgacctcttcgcagggcatctttgccggtatggcggtctatctggtggggctgattgtggcgtggatcggcggcttcgtctttacctggtggggtggcaccgaaaacgtcgatttaagttcgaaaagcctgcgccagcagaccgtcaagag

SEQ ID NO: 224 - DNA, 330 bp, Glycine max
  Peptide Sequence Number=SeqID_117002
ggtacatcctttgtggtacaagtagagggtacatctacttgggttgttgtgaccaagaataagagagggtacatctcttgtagatcagttctagtggagggtacatccactaggttgttcaaagagaacaagggagggtacatcccttgtggatctttgattagtggggcgaactcctcgtacaccatggtggattatacttatgatgttgttgtcataggagctggtggcgcgggattgagagctgctattggagttttagaacacgggttcaatactgcttgtattaccaagctcttcccaactcgttcacacactgttgtagcttag

SEQ ID NO: 225 - DNA, 458 bp, Glycine max
  Peptide Sequence Number=SeqID_117003
ggggtgtgtgtatgcgtatttttcataagggtgtgtgtgtgtgtgtctgtgatgaggggtatgtgtgtgtgtgcggggtgtgtgtgtgtgtctatgccatgacggtgtgtgtatttggacagcttctacaattcagaacacagggtccacagtatccacctatggttaagcaaggcttatattatagcatcctcacccttgatgatgaggttcagagccattatcagttgggaaacatagggaagcctctccatagtatgaatttggatgaggtgagcaggtttatggacacccccttgaagcaacaacctagtttgggggaaaacctagaaaattttctagctcctgcaggtgtgatcaatgtaggagatcatcaagatcacaatgttaatgttgttattggtgatgccttcacagcaggaacattggttgcaaatgcaaattcctttagctattaa

SEQ ID NO: 226 - DNA, 231 bp, Glycine max
  Peptide Sequence Number=SeqID_117004
atggcacagatcaaccgatactttcgcagggggagatcggcattacggtcgctgggcagaatgttgctaagtagaaacatcatctatatctgtgtaagagtggtcatgttggtgcgcatgatccacactcgtctctttgcagcggcacgggtggaatcttgccccgttggccctcctccaggatcagggggtggccccgaagctgataaaaggaaactactggccccttaa

SEQ ID NO: 227 - DNA, 725 bp, Glycine max
  Peptide Sequence Number=SeqID_117005
ggtcattggaggaaataagtttcgaaaacaacgacagcgaaatagggacgcaaacgatgagcaaagatgtaatgtcagaaacaaaaccgtcatcagaggacattctgctaagtgcagagggcgatgggcagggtcacagagtcactgtggcacaatggactgaaggacaataccattccaacaaaccacaggtcaataactggaaattactgacacgagcacatgagtgggtcatattcgacacctatagtggacaaagagaacaacgaccgaagcaaccaaggactgacaaaagtgaaaaaatacaagcacaaggggcagtagatgagtctaatcacacctccaactgcctgaaagaaaatgaagacaaaatcaacaaagatgacagagaagggactaataaaggagacagaaaagatccatgtgttggtttacaaaatattgagggtggtgggctctcaatgggcctctcaaaatatactcttcacgacaaaacaaaaggcgcagaaggaaatgtcaattgtgaacaaaaaggcccaaggcacatggagaagctatacttaagaagcagagggtgtagaaagcaactggcccatgggcacactattgggctcttaacaaaatcaaacaacaacgcccacaatgaagtcaacaacgtaattgagaatcgtgacaacctgtcaccagcaatgagaggcagtggactgaaagaagtggcagagtga

SEQ ID NO: 228 - DNA, 280 bp, Glycine max
  Peptide Sequence Number=SeqID_117006
gcgagctcagctcgcccaggccgggttgcttccaccagaaggcccaagtgggcctggaaactttatggattacgccacaatgccctttttgacttctggaatgttgcggaactttacggattgcgcaacaatgcttcctttcgactttcgacatgtcgccgaacttcacggattgcctaacaatggtcctttcgctaagcgtctgcttcttgctaagcgcataatcactcatgctctaagccgcgtgctccagcgcttagcacaccaccctggcacctga

SEQ ID NO: 229 - DNA, 162 bp, Glycine max
  Peptide Sequence Number=SeqID_117007
atgtttatgccaacaacaacaaagcttatgccaccatcaatgatggtagatgcaaccgagagaggtatctctagcgcacatgatgggagcacaagcacaggcattgtatcaccgaaaagtgaagacaagggggacgatgacaagggaaaggatgaagaataa

SEQ ID NO: 230 - DNA, 249 bp, Glycine max
  Peptide Sequence Number=SeqID_117008
atgacaattctaatgaggcagagttcaacttccacgagagaggacaaagtggagactatagacaaagatggaaagggacacactagagtgactcgcggatgcaaagaccaaagatggcataaacggagactcagagagattgtaaagtggaaatggcacagacgcatagacttgttggagattgaagacgaggacatagagattgaagacgaggacggagagactagagccgcaccgctacaaggatga

SEQ ID NO: 231 - DNA, 567 bp, Glycine max
  Peptide Sequence Number=SeqID_117009
atgaacaacaacattttggaacgagtgaggtgcatgcttttaggagcatgtttgcctaaaagtttctggggtgaagctgtaaatattacagtatatctaataaatagatgcccatcgtctgctctggaatctaggacacttatggcaatttggagtgggataccaacaaacttttccaactggagagtgtttggtgctttggcatttgcacatgtcaaacaagacaaactgaaggctcaagttgtgaagtgtacctttattgggtacacagacggagtcaagggaagcaaggagaaagcccggtttgaggtggaatctcctactcatgattcaaaagatgattatcgtataagatcaaatgaagcattagatagggaaaagaatgatattcttatagctagctcaagcaaggatgagattagtatgctcaagaagagattaagtttagaatttgagatgaaggatcttggtattgcaaggagaattcctaggatggatattgtaagaaaaaggggaattgttcttatctcaacaaggttatttgaagaaggtagtggaaaggtttag

SEQ ID NO: 232 - DNA, 285 bp, Glycine max
  Peptide Sequence Number=SeqID_117010
atgagaggagagaggtcttgtgtggagtcttcttcctctgattcaaggagggatagtatgtggttgtatggcattgagaaggagcaagggaaggtacacaattggtgggagagggtgatgagagagagtgcggtgtgggaaggtatatataaagagtggaggaggggagagagcaagtttcggagtttgtggtcaataagtggaaaagagaaagcaattggggaatattaccggggaaactttgtaaagtgtgttccttggactagggtgagagcaggggattga

SEQ ID NO: 233 - DNA, 201 bp, Glycine max
  Peptide Sequence Number=SeqID_117011
atgcatggcggtatcactagcgttgtgacacgtggacgatgccgccaggatgaatggcaagacagctgccacttggatgccgccagtcagagtagcgagacacccgtggatgccgccagtcgtagcagcgagacccgtgacgtgaactctgtgtcaccaactgacctagctagcggtgcagctatgaggcagcagctatga

SEQ ID NO: 234 - DNA, 186 bp, Glycine max
  Peptide Sequence Number=SeqID_117012
atggccggtgtcggtcgttatatggccccgactgatatctttcagccgacattgcgcaatttcttttacaaacgctggccgataatgttcttttatttacggacggctaggtttttccgtgcgagctcaaccgagggttcgttccgaccgacactggcatgttgttcttctcatttaggaggataa

SEQ ID NO: 235 - DNA, 336 bp, Glycine max
  Peptide Sequence Number=SeqID_117013
atggcgtttttatcccctttgccgcccccgccggaaaatgaacggcagctgttcgagcgcgctcaggcgctggccggcgccagctttggcgaactggccgctcgcgcgcagttgccgatccccaaggatctgaaacgcgataaaggttgggtaggcatgctgctggagctgtatctcggcgccatggccggcagcaaaccggagcaggactttcccgagctgggcatcgagctgaaaaccattcctgtcgacgccgccggcaaaccgctggaaaccacttttgtctgcgtcgctccgctcaccggcaacagcggcgtcacctgggccaacagccac

SEQ ID NO: 236 - DNA, 216 bp, Glycine max
  Peptide Sequence Number=SeqID_117014
atgtttaatgatgcaatcctatccccgaagggtattgaattgaagactacaagaggatgggtcccctccttaggaagattgcatcagggtagatttctgagcccatgggccaaggacctcattgaagctcaaagatccagcctccatagaagcttctcaagcaagcttccatcaattggtatcagggcacaggagcttcaagtaggtgctccttaa

SEQ ID NO: 237 - DNA, 228 bp, Glycine max
  Peptide Sequence Number=SeqID_117015
atgagggttagggctaggctttggggtttgcggaaggacttcgaaccccgtgaggtacggtggctccggggagtagatgctagagaggtagttgatggagaggactaccaggtgaggacatggggggtcagaggagaagaaggtgtcgtagagccactagcaaaggtggtacatagccttaatcgaatgagagtgagagacagagggagagtgagaagggtgatataa

SEQ ID NO: 238 - DNA, 369 bp, Glycine max
  Peptide Sequence Number=SeqID_117016
atggagggtgatgaagagcttctggcacaaacaaaggttaaagtagaaccaaaaaggaatgagtggatgacaaaactacctctagaaaggaaagtagaagtgatactagtgtttggacagacacccctttggacagggccagaaagcaaagatgaagtatgtatcctcttccattctagaatgatttgttatttggaagcgtacaatgaagctactgccctagcttcaaatgaagaggataagaaaagggctagtgtggatgcagagttggtggaaaaatacaataaagcaaaatggtcaaaaacattggtacagaagtatcaagaagaggttgctagcaaatccaagaaaaagtcgaaggaactgatg

SEQ ID NO: 239 - DNA, 168 bp, Glycine max
  Peptide Sequence Number=SeqID_117017
atggattcaaggtcacctcaagtaattctactcagaatggattcaagtgcatctgggacaaggatggatgaggccgatgcaactacaacaaagatgaacgaagccatatctctaatagcctcctacaagctggaaggtgatcatcacaacacttctaatttgggatga

SEQ ID NO: 240 - DNA, 591 bp, Glycine max
  Peptide Sequence Number=SeqID_117018
atggcgtggataggatatcctgacaaaaattttaaattaagagtagagacatcggagtttgatcctgaagcagacactccagaggaacgggcccaggttgaagcagcttgtcaacatttctaccacaaccgcttcaaggccaagccatgtgctgacctcctttggtgttttcaggttctcagggaaaataacttcaaacaaacaattcctagtgtgactatagaggatggagaggaaatcacataccaaaaagtcacaagtgccatcagaaggggcgcacaccaccttgcgacactgcagaccactgatggccattggccagctcaaattgtaggtcctctcttctttcttcctcctttgggattctttcatggtgcatgcaagaaaggagtccagattgaaattcttgatgaagggggtttgatcttgggagaagaaaatggaagaaaagagacaacatgcaaggagtgtgtggaagcaatgctttccaagtttattttgatgatgccaaagactcaagtcaagaatcaagagtcaaaacaaattttaagaatcaaagagtcgttcaatcaagaatcaagattcaagtga

SEQ ID NO: 241 - DNA, 231 bp, Glycine max
  Peptide Sequence Number=SeqID_117019
atggagtcaggtgacatgcgggggtaccttatggttatccgcacctttcgtcaaccaggggcaaacgagcccgttgacacgcagagactaacatcgtcttctgcaccatttggccatccagggacagcgagttgggtggcaggcagagatactttatggttttactctcctcgtccagagacatttaagcccgacgacgcacgaggttccgctggtcgggatattgactag

SEQ ID NO: 242 - DNA, 117 bp, Glycine max
  Peptide Sequence Number=SeqID_117020
atgttgcttcaaggtataaagatgatagcagtgatgaaggggggcaaagtggaacccgactttgcatggtgcaaagagggttgtcgtaaaggaagtggtgtaatccattggtgctga

SEQ ID NO: 243 - DNA, 312 bp, Glycine max
  Peptide Sequence Number=SeqID_117021
atgcagagcagtgagtttgagacagagaaagaagcagttcaagattgttgttcaattttgcaaaaaactgcccatcaaatttatggagatccaactaaatttggccttttgttgaatcctggggcctgggggatagtgattaatggagacctgactaatccagagttggtcggaggtttaacctcaaaaatttcctctccaattccgatcaaaatcgacgaaacaagggtacttaaccctccaagcagcaaaccctcaccgttgctggaatttcagtgttactgtgtgattctttcaccgtttcactattaa

SEQ ID NO: 244 - DNA, 579 bp, Glycine max
  Peptide Sequence Number=SeqID_117022
atggatgcagggaactgggaacttcctagcgggctttttttcacaaattatgggcttcctaaattctattttttcttagggcctcaaacaacatattttggggtgttgctaggtgcacccagcagtattgctgatttagagaagagtcttgaatttgttcttgtcattcatatgtctgaaaatgggaagaaaatctacgttgtagtggattgtgaaattggaggaatgtacaagcagtataaggataagttagttcgcaagagtattggaaccataaaatgtagatgcccatttaaattaaaggagaagtttttcagagagttagggaaacattgttgggacatgcgtatcatggttgttttaatcaatgtagaaaaaattatgcttcttcaaatgaccaaaaagatggtgaagcctggccaaattttgttaaaatcaaagatcaagatgccaaaaaatgtcaccactatcaagaccgtatacaatgaacgacaaagatattggcgcaaacaagtagatccaagaacggaggtacaacatctactaaagttgatagaatgcgatcaatatgtatattga

SEQ ID NO: 245 - DNA, 246 bp, Glycine max
  Peptide Sequence Number=SeqID_117023
atgtttgtcaaccaccaagttaatgaggtggaaaaatctttcaatgcacataatgaagagataagacctgtcactgtcgtctcctccttaccatcatcgtcgctggggttcgtgatcgccgtcggggttcatgaccgttggggttcgttggagtccgacttcaacattcaacaccaacaccaacactgcactttcagcattttaggaacaggaacccccatagtccatagtttctcagtcaggtaa

SEQ ID NO: 246 - DNA, 381 bp, Glycine max
  Peptide Sequence Number=SeqID_117024
atgagcaagttgaaggatgagttgaaaaaggctgaggactctcttgcctctgctatttctgccaacattacattggtcgaagacaactcagacttgaaggctcgtgatgccacccttgagctagagtcaaaggggttggagactcatgctatgaatatcgaagactccgcaaagttaaatgtagaggaagtggatagactgaaaacttcactagccttaatagagaagaatggagatgttgaaaaggaagagaaggtacgaattgaacagaaggcctatgatgacatgtacgagatgatgggaggtacaaatgaggatgaaaatgatggtgatgaagaaggcgaggtgcattggaatgtcggtcgtgatgaagattcttag

SEQ ID NO: 247 - DNA, 501 bp, Glycine max
  Peptide Sequence Number=SeqID_117025
atgcatgaattgaatccctcgatgaattcaaatttggttgaaatattgaaatcagaagctagcaaaggcaaagcaaggaagaggtctaattgtagtaaggcctttctttggctcactagagtagggaagaagaatacaaacacacaagagttttatactggttcggcaacaacccgtgcctacatccagtccccaagcgacttgtggtccttgagatttcttttcaaccttgtaaattcctttacaagcaaagatcaaaaagggatgtaccctcccttgttctctttgaacaacctagtggatgtaccctccactagaactgatccacaagagatgtaccctctcttgttctcagtcacaacaacccaagtagatgtaccctctacttgtaccataaaggatgtaccctccaatgtgttaagacaaagttctcaggcggttagtcctttgaaactttgtgaatggggaaacaaaagaattctcaggcggttagtcctttga

SEQ ID NO: 248 - DNA, 300 bp, Glycine max
  Peptide Sequence Number=SeqID_117026
atggtaatcgattacatctttgtaaatcattttgaaaagcaatgttggctactggtaatcggttactaccttctgagtcacgttcaaagcggaggctatgagtgtggctattatgtcatgcattggatgtggaacatagtcgccgggcagcacaagaatgattggacgctatggttcggtgatgagaagcccctaaacatggacaacatcacaaaattgcggaaagttgtagttaacatgcgaacaatcgctttgatgtatatccttctggttgaaactggttctaaaggacatatctag

SEQ ID NO: 249 - DNA, 240 bp, Glycine max
  Peptide Sequence Number=SeqID_117027
atggtcataatctccccttccctgatggccttcttatcaatggacgtggttggaatggaaacaccttcactgttgatcaagatttggcctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaaagacgcgatctacgaacttttaagtga

SEQ ID NO: 250 - DNA, 339 bp, Glycine max
  Peptide Sequence Number=SeqID_117028
atggaattgaactcccctgtcatgtggggttcttgtaaaattttgatggttctctacgaagatatacttaaatgcaacatatttaagaatggcttacagcataggaggaactcatggcaggatggagtgtatggcacaaactgtccaatcccacctgggaggaacctcacatatgctatccgggtaaaagaccagattggtagctatttctacttcccatctcttggaatgcacaaagctgctggagcatttggtggcattagaatttggagccgccctcaaattcttgtcccttttccttctcctgtcgaggacattaccatacttgctggagattag

SEQ ID NO: 251 - DNA, 144 bp, Glycine max
  Peptide Sequence Number=SeqID_117029
atggacaactacaaaggatccatgaattacattctagctatctacctctacaataccctctcttatttccttacggggaaaatggatatagacctgatattctacatagcagtcgatcagatggctacagtgcagatcaaatga

SEQ ID NO: 252 - DNA, 195 bp, Glycine max
  Peptide Sequence Number=SeqID_117030
atgaaaagaacagagattgatcaatcacaacaggagtgttatgcacctcagaaaaacaaggtagatgatcaaggagatgaaaggcaaggaggaattggtgctgtgggtgctccagaaggtccgtggcggcaatggccagcagcggcagtggtggaggaagatccctttcgcttcttcgacgattctaccatttga

SEQ ID NO: 253 - DNA, 210 bp, Glycine max
  Peptide Sequence Number=SeqID_117031
atgtcattgcctagcgctgttcatgtgtctccattatcaagtgcgaagcctttggtgactgggaagcatgttattctgttgttttccagatcggttccttcgccaaaagaaaaaggagtagagacgagagtcgtcatcacggaaaggcaaggcggacgaaatcagtgtcctatctttgctttcctcttatctccgatgagaggtaagtaa

SEQ ID NO: 254 - DNA, 237 bp, Glycine max
  Peptide Sequence Number=SeqID_117032
atgagggttcattgtaatcaagcaagtcggagacctagcatgaccacagattcacctccactctttatgttcccatggacccggaagtccccagtggagtcgccaactgtcgcaacctacccttcggcgggagggcgacacgagactcgcgggggcattttccaaggaaggaaaacgcacagagtcgccaccaccgtttattctaggaaaacgtcgaaaaaaccggaaaaggcgtga

SEQ ID NO: 255 - DNA, 699 bp, Glycine max
  Peptide Sequence Number=SeqID_117033
atggccacaatgatggaggccatgatgagcatgaagaagataatggaagccaatgcggttacagttgccactaccagcactgttgctaaggtgaacctgatgcccccatctggcctcaaccaaatgaatcctccaacctcagatatggtaggcaaagatttgggaagtacaggcggcccacatgatgtgcaaattcaaaacgagcatgccttcccaccatatggcttgcctcccaactatactccacccagtgtggcatacactcccagtgagaatgtcaataactccactcccatactcattgagagcagacaacctcaatctaatcatgcacatgtctctcaacccataggggagacacatgaaattccccaccacaatctagccgacttcgagccttgcctcggatatgccactgaagggcaagtagttggtggtatactcctacaaaacactttggagggccctcaatttcacccacaaccacacccccttgcattccacaacggggccattgaaggaggtgaagattatgcctttgctaacctagaagagttgttcctagtacccaatatcattacccctcccaagttcaaggtgttggactttgacaagtacaaggggactacttgccccaagaaccatcaaaagatgcattgtcggaagatggggcatacacaaaagataaggaactactga

SEQ ID NO: 256 - DNA, 384 bp, Glycine max
  Peptide Sequence Number=SeqID_117034
atggatggagtccataagtttgatgaaaggcctaatgcgtacaacaagattatcaacatgaattgggtactcctaattgaagacattatgctaaagagtcgtcgcctggtggattacgaatatccttatgttgtgcttgcctcaagattaattgactacttcaatgatgatgtctctaatgagattgtggattttaccaaagtggctagtgagattatcaaaaggcatctcaagaagcttggaatgaggtttgttgatcatgaatggataatggctggagagccgacaattggaaactttgaccaaatggaagaagatgataaagctgaagctccacaagagcttgcacatcaatggagtccttttaagtcacttatgatttag

SEQ ID NO: 257 - DNA, 225 bp, Glycine max
  Peptide Sequence Number=SeqID_117035
atgaccaaacttggtctctgcttgtcatcgggcccgccgcctctggatgacaaaagggtgcggataaccgtaagaatgaccaaacttggtctctgcttgtcatcgggcccgccgcctctggatgacaaaagggtgcggataaccgtaaggtatctccgcgtatcatgggtgcagaatgaccaaacttggtctctgcttgtcatcgggcccgccgcctctggatga

SEQ ID NO: 258 - DNA, 179 bp, Glycine max
  Peptide Sequence Number=SeqID_117036
atggatttcgaaatctgccatattatgcagaaaaatgttgttgaattgtgcagcagaatttttcaacatgtgcagaaaatgcttgtgcattgctggttatgggaaagtgttgagaggaatgaggataagggctacgtgggagtgcgtgagctcaatttgaaggtgggcaactggggatg

SEQ ID NO: 259 - DNA, 228 bp, Glycine max
  Peptide Sequence Number=SeqID_117037
atgccttttagagacttgaaaagtgcaagaaaacgaactgcgttttctggaaaacgcgatgaactcgctaagcgagcatgttgcgctaagcgagttcatcaatactcattttgtataaaggtattctcggaagaactcgctaagcgaacccaccgcgctaagcgagtttgtcctgtgaggatgaacactcatcctcttgctggactacctgtggctaagcgatgctga

SEQ ID NO: 260 - DNA, 198 bp, Glycine max
  Peptide Sequence Number=SeqID_117038
atgtttgcttacagtccttttgctaagcgcaagcttcgtgctaagcacatctttggtcatgcgctaagccgagagtctctagcgcttagctctccacccttgcatcttaggctgatttggtcctctaagctggccaaggctgagctaagcccatttcaattcgatctgaattgggctaagcgatggcctgctcgctaa

SEQ ID NO: 261 - DNA, 147 bp, Glycine max
  Peptide Sequence Number=SeqID_117039
atggtcaaataccgccccaaatccaatatagagatgaatcgaggtactcggggacgggcacgaatggacgctaggcccgtgatcaacagattgttgtctcgcatccagctccggacgatcaagaagcgctatcgggaggtagcctag

SEQ ID NO: 262 - DNA, 432 bp, Glycine max
  Peptide Sequence Number=SeqID_117040
atggcgcctactaggcaccctctagacctagagaagtccaacagggccctggggtttccggctctgatcacgggcctctgccagtcctacggagttcctatcacccccagcaaggcgcagggtgatgcacatcaggatgcgggtgcaccaccgccacctcagctggccgattcggctgggccactgggcgtggagcgtatctacagcatttggttcgccagcaggcggccaaccaccgtggatagttgcagatacacgagtgtctctaccggttcagcctcatttggggctgaggtcgcatggcctggagactggcccgatgcccaggcaggggaggagcctgcaggatcccccggtgaggcggatgaatcccgtatggatgaggatatgactgacttggtcggtttcttgggaggaagcgaagccacatga

SEQ ID NO: 263 - DNA, 546 bp, Glycine max
  Peptide Sequence Number=SeqID_117041
atgccaatctccccctacagatgtatcagttgggatcacacccacaagacgcctagtggacccgaagaagtccaacagggccctggggtttccagctctggtggtgggcctctgtcagtcctacagggtgcccgttcccccagcaaggaatcgcacccacaaagagactcagtggacccagagaagtccaacagggccctggggtttccagctctggttacgggcctctgtagtcctacagggtgcccgttccccccagcaaggtcacgtcatcatgacataggtaaggatcgcgcccgcaagacacccagtggaccgaagaagtccaacagggtcttggagttgccaagctctaattacgggcctctgtcagttctaacggagtgcctgtcgccccctactaatcaagctttcatcaagaagtactgcatccccagacaggcgcagggcgaatcaccacagcagcctggggatggctggcagcgggcaacagacgcaccgccatcacctctagagttcacctcagctcatccacaaaaaggttag

SEQ ID NO: 264 - DNA, 273 bp, Glycine max
  Peptide Sequence Number=SeqID_117042
atgacgtctgaggcagcaaagcaaattgctgacaagattgatgtattgactactgtcattgggcaaccagaataccccagtcgtgtgcgtgctgttggagctagtgtgacgatcaagcaatactttgaactggctccaaggacctcccgcacttcttcctccatggctcccgaagacctagagcagctgactcaacaaataagggaccagctggaggagtcgatcacagaaaaagttactcgacagctgatgttatccttcagccagatgtag

SEQ ID NO: 265 - DNA, 681 bp, Glycine max
  Peptide Sequence Number=SeqID_117043
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacagctattggaattatggattttcagtttatgggggcaagtatgggatccgcagtaggtgagaaaatcacccgtttggtagaatatgctactaatcaacttttacctcttattctggtatgtgcgtccggaggagcgcgtatgcaagaaggaagtttgagcttgatccaaatggctaaaatctcttctgctttatatgattatcaaaaaaataaaaagttattctatgtatccatacttacatctcccactactgggggggtaactgctagttttggcatgttgggggatatcattattgccgaaccaaatgcttatattgcatttgctggtaaaagagtaattgaacaaacattgaataaggcagtacctgaaggttcacaagcagctgaatatttattccataagggcttatttgattcaatcgtaccgcgtaatcttttaaagggcgttctgagtgagttatttcaattccataatttcttttctttgactaaaaatgataaggcatag

SEQ ID NO: 266 - DNA, 426 bp, Glycine max
  Peptide Sequence Number=SeqID_117044
gacgtcatcatattgcacgagattagaaggcctaactctctaaaaacagtccccagcggagtcgccaactgttgcaacctacccttcggcgggagggtgacgcgagggctcacgggtgcatcttccaagaaaggaaaatgcgcggagtcgccaccaatgtttagtcgaggaaaacgtcggaaaaaccggaaagacgtggtcgacaaaagcgggacttttgctcctacgtatcctccatcgaagaggaaatcagacctacgtagttctcgcaaaagcagtaagaggagtatgattgatgctaccagtggtggagcccttggtgatataactcctgttgaggctaggaatttgattgagaagatggctcccaactcccaacaattcagtgcaagaaatgatgctattgtccttagaggagtccatgag

SEQ ID NO: 267 - DNA, 546 bp, Glycine max
  Peptide Sequence Number=SeqID_117045
atggcgcgcagagacaaaaattggtcattctgcaccctttgtcatccagaggcggcgggcccgatgacatgcggagacaaaatttggtcattctgcacccctttgccattcagacacagccgtgtccgatggcgcgcagagacaaaaattgacacagccgtgtccgatggcgcgcagagacaaaaattggtcattctgcaccctttgtcatccagcggcggcgggcccgatgacatgcagagacaaaatttggtcattccgcacccctttgccattcagacacagccgtgtccgatggcgcgcagagacaaaaattggtcattctgcaccctttgtcatccagaggcggcggacccgatgacctgcggagacacacttaggtcattccgcacccctttgcccattcagacacagtcgtgtccgatggcacgcagagaccaagtttggtcattctgcacatatgatacgcggagatactttatggttattcgcacccattcttttgctatctgtaagacagaacgcttgatagcatgcaggggctga

SEQ ID NO: 268 - DNA, 1248 bp, Glycine max
  Peptide Sequence Number=SeqID_117046
atgaaaatttgggatcacattgaatctgctgtaattgataataaaaatggaagtaggatattaatcacaaccagggatgagaaggttgcagaatattgtaggaaatcatcatttgttgaggtgcataagctagaaaaacctttaactgaagaagaatctttgaaattgttctgtatgaaggcatttcagtatagttccgatggagattgtccagaagaacttaaagatgtatctcttgaaattgttagaaagtgtaaaggtttacctctagcaatagtggccattggtggtcttttgtctcaaaaagatgaaagtgcacctgaatggggacagtttagtcgagatctaagtttagacttggagaggaattctgagttaaatagtataacaaaaattttaggtttaagttatgatgatttgccgatcaatctcagatcatgtttactgtatttcggaatgtatccggaggactatgaagttaaatctgatagattgattagacagtggatagctgaagggtttgtcaaacatgaaaccggaaaaacattggaagaagttgggcaacaatatttatcagggttggtccgtagaagtttggtgcaagtatcctcatttagaattgatggcaaagttaaaaggtgtcatgttcatgacttaatacacgacatgatccttagaaaagtcaaggatacaggattttgtcagtatattgacgggcctgatcaatctgtatcaagtaagattgttcgacgcctgacaattgcaaccgatgattttagtggaagtataggaagctcacccattcggtcaattcttatcatgacaggaaagtatgaaaaattatctcaagacttggtaaacaaattccctacaaattacatggtactgaaggtacttgattttgaaggttctggtttacgttatgttcctgaaaatttggggaatttatgctacttgaagtatttaagcttccggtatacatggataacaagtctaccaaaatccattggcaagctccagaatttggagaccttggatataagagacacaagtgtgtctgagatgccagaggagattagtaagcttaaaaagctacgtcatcttctggctgattataggtgttcaattcaatggaaggatattggaggcatgacatccctagaagagatacctccagtgtttatagatgatgatggagtggtcattagagaggtaggaaagctaaagcagttaagggaactgtgggtg

SEQ ID NO: 269 - DNA, 537 bp, Glycine max
  Peptide Sequence Number=SeqID_117047
atgactgcaaagaagagtaggagtggaaaagttgtggatgaaggtggggaagtaccgtatcctgtggtaccttccaagaaagaaaaggatcgtcatctggcaagatttttagatattttcaggaaactggaaataaccatgccctttagagaagcgttgcagcagatgtcactctactctaaatttttgaaagatatgttaacaaggaagcacacatatattcatcagaaaaacatcatagtggaaggaaattgcagtgctgtgatccagaagatccttccacccaagcataaagatcatgggagtgtaatgattccttgttcaattggagaagtcaatgtgggaaaagctcttattgacttgggagccagtatcaatttgatgccactctccatgtgcagaagattgggggagttggaaataatgcccactcaaatgactttacaattagtttaccgctccattaccaggccatatggagtaattgaagatgttttggtcagagtaaaacattttatcttcccagcaaactttatg

SEQ ID NO: 270 - DNA, 153 bp, Glycine max
  Peptide Sequence Number=SeqID_117048
atggagagagaagcaattgcaacccttaagccggcacttgatgaaaccctttgcagtaacaagttgaacagccttggcaagttcaagaacgaaggcagcacctgcttgctcttagacctgatctctcttcatcgtcattgcaggttattatga

SEQ ID NO: 271 - DNA, 331 bp, Glycine max
  Peptide Sequence Number=SeqID_117049
atggctccgaaaaagctttccgcgaagagatctaggagggacgccgcggctgaagggaccagtgcctcccccgagtttgatagtcaccgtttccggagcgccgtgcaccagcagtgcttcgaggccatcaaaggatggtcgttccaccgagagagatgcgtccaactcagggacgatgagtacaccgattttcaggaggagatagctcgcagacattggacgtcgctggctactcccatggctaagtttgaccctgagatagtcctggagttttacgctaatgcttggcccacaaaggatggagtgcgggacatgcgttcatgggtgaggg

SEQ ID NO: 272 - DNA, 504 bp, Glycine max
  Peptide Sequence Number=SeqID_117050
atgaagggaaggaatgactctcaatgtttacttctccttcttctagcctttgccttccataaggaattgtattctcttgaaacgtccacagacaattttgtggccaacatagagaataatcctaaggaggagtgcaatgtaattttcattaggagccagaggattgaagatactgagagagaaaagagatctaagggagtattggagtataccaaaagtcagttggccatgaagactagaaaagagataccctcagtcccaatgaaggacatctcatatcccttggtgccatcaaagaaagacaagaaacgatattttgttcggtttcttgacattttcaataagttggggatcaccattccctttagagaggccttacagcagatgcctttgtataccaaatttctaaaggacttcctcgcaaagaaaggaaaatatatcaacgatgagaacataatggtggaaggaaactgcagtgttatgatccaaagaattttaccttag

SEQ ID NO: 273 - DNA, 420 bp, Glycine max
  Peptide Sequence Number=SeqID_117051
atggtgataatggtaattggcattggaggtgacattggtggcggtggtgatgccgatggtggtgacagtggtaatatggtggtggtagtgacatggtgttgttggtggcaacaagtggtggtggtggtggttgcatcaatgttggtggtggttgtggtggcggtgacgatgacaaagtgtggatgggtagttacaacgacgttggtggagattgtgatgttatttgtagcggtgacattgatgatggtggtgatgaagtcgattgcgatagtggtgatggtcacaaccaattatggccgtgacaataatagtgttggtagtgacaatgatgacaatgatgatggtgatgacaatgatggagatggtaatgacaatgatgaagatggtaatgatagtgataacagaaaatatcaaatgtga

SEQ ID NO: 274 - DNA, 1692 bp, Glycine max
  Peptide Sequence Number=SeqID_117052
atggacgcgtctggagtaggcatgggtgtcgtgctctcgcagaagggtcacccaattgcgtatttcagcaagccttttagtcccaagctactcagatcatcaacttacgtcagagaattgtttgctatcacggcggccattaggcggtggagacaatatttactgggccaccgttttatcatcattactgatcatcgaagcttgaaggagctcctgactcaagtggtgcagacaccagaacagcatatgtatctcgtgaggttgatggggtatgattatgagatacactatcgctccggtgccgccaatcaggcaacagattccctctcccgcattccaaaatttgaatcttctatcgctctgatgctttcagtacccagcctttccttcatggacgagcttcgcactcagctccaccgacaccctgattacattcgccgccaccgtgacattgtcaacaaccccgccaaccacccagggttcttcgttgtcaacaacctcattctctaccgccaccgcatatggctgccccgcgatgtcccaatcatttctaccctcctaactgaatatcatactactcccactgggggtcactctggcgtagcaaagacaattgctcgagtttctgaaaatttttattggctcggccttcgtgatgatgtggtcaccttcgtgtccaattgttttgattgtcaatccaccaaatacgaagcgaagaagtttgcaggagtccatctgggcatgcttcccactacgcatacggccttcatggtggccaccttgttcttagaaatggtcgtcaagattcatggagttccccagagcttggtctccgacagggaccccttattcctcagcaagttctggcaggagctcttccggcgtagtggcactcaccttcgcatgagctctgcctatcacccccagagtgatgggcagactgaggtcatcaatcacgtcattgagcaatacttgtgctcgttcgttcaccgtcatcctcgagcttggggcaaacttcttccttgggctgaatggtctcataacacctcttggaactctgctaccggcgccactccttacgaaatcacatttggtcgcaagccatttaatttcccggattatcttgctggcacttctagtaatgacgccattgacaccatgttcaatgaacgcgaggaaacctttctgatgattcgcaagaagttgctcaaggcccaggaaactatgaagagaaaagctgatgcccaccgacgggaagtaaccttcttaccgggacaatgggttctgctccgacttcgccctcatcatcaggtctctgcccgagaacatcctcatatttttgggaaattagcaaagcgcttctatggaccatttcagttcacggaagccattggtaaggggctttctcctgatgaaacctcttgggaggactggtcaaccttgcgccaagactatcaccttgaggacagggtgctttcccaagggcccaagggtgatacagggaagaagataacagagacaagtagcaacacagggcaacctataatagaggcaagcaatgaacacgaggaggagtgggataagcccataggatgttcgttagagccattcatgcacgtgggagacaatgttaacaaactttatcctgaatattccaaagggatagcaattctattagctgaattagtataa

SEQ ID NO: 275 - DNA, 396 bp, Glycine max
  Peptide Sequence Number=SeqID_117053
atggcctttgcaaacagcaggattgctcacaaatgggttctcttctcgaacattcactctcttatcaggaagagtcactcagtcattgtctatctgtttataaagtggaatggtggacaagttggctatttgattcggagggctaatgcttcatgggtgcaaccaaaatggggtgcttccgcagtgcaattagaccccaacacttgggttcttgaatatcagaggagttatatttttgatggtacgaggttgtattctgcagcattggagttcctcaaatataggatttcaagaattgttgccaggctgaagaaagatttctggctgtttgtcgcatttgaagataaacagtacaatggattcacagtaaacaatggacctcaaatcccaacttga

SEQ ID NO: 276 - DNA, 198 bp, Glycine max
  Peptide Sequence Number=SeqID_117054
atgttccactttctccctctccctcccccttctttctccttttgccaccgcgacgcccaacgtccaagtaaggaagagatcttcagggttctcattcttatacaagaatccattcttcatcaggaagatatatgcgctacctttattgtaagatctctacaagaccaaatcttgagcacaagatctttgatgctctaa

SEQ ID NO: 277 - DNA, 198 bp, Glycine max
  Peptide Sequence Number=SeqID_117055
atgtggtaccatggagaccagtcagggtcacgctgttttgcaagaatgctccaaccatgtgggatcggcacaggcttaaaggagcactcaaactgggtgacccccaagacctacactctgaagagttcgttagggcctctccctcctgattcaggtccaacccctaaaatcatttttgcaagcagacactgctcatga

SEQ ID NO: 278 - DNA, 183 bp, Glycine max
  Peptide Sequence Number=SeqID_117056
atggaagcattgatcgaaacactaaggtgtgccatctatggtggagctcacaattctggctgctgtatccccaatgaagaactaggtcgtgaagtcagttatatggggaatcagccaagacaaaatttcaatgcaggtggatatttcggatttcagcatggccagccatataattcacagtag

SEQ ID NO: 279 - DNA, 342 bp, Glycine max
  Peptide Sequence Number=SeqID_117057
atgaccaccttgactcagatctggatgactttgctgctcagcaacatccagcccagtgaccataattccgacctccccctgccgaattttcagctggtgtacgccatcctgacacggatgagcattcacgtggctcagttaatcgttgatgtcatctatctatttgtaggtatggcgcctaccaggcaccctctggacccggataagtccaatagggccctgggatttcccgccttgatcacaggactctgccagtcgttcggagtccccgtcgcacctagaaaaactaaagaggaggaacatgaagtgcagacttgtattaaagagttggatggtgcatga

SEQ ID NO: 280 - DNA, 384 bp, Glycine max
  Peptide Sequence Number=SeqID_117058
tcctctgtgggtcccaccgtcctcttgatagtctcgtccccacatagaaccggcatcctcctccgcctctaccgcctccgccgtctcgaaaccccctccttctcccgggtcactgacgtcctctgctcccataaagacctccgctttgaacctaacctcggcgtcgtgctcaacgccaagcacggcgcctcggtcaggctcgccggctccgtcaattacttcgcgctccacgccctctcaagtaacaaggtttgggtcttcgccgtgaaagacgacgacgatggtggtttgagattgatgaggtgtgcggtgattgagtgcacgcggccggtgttttccgtgaacgttgcgttcgggtttctgattctcggcgaggagaatggg

SEQ ID NO: 281 - DNA, 486 bp, Glycine max
  Peptide Sequence Number=SeqID_117059
atggctacaacatcatcaaataatggtcttccagcacacctaccaatatttgatgggaaaaactatgatcaatggatcgcgaagatgaaggtaatattcagatttcaagatgtggttgaaatcgtgaatactggagttgctgcattacccagaaacccaactgatgatcaaaatgctgcgcacaaagaacaaaagaaaagggatggtaaagctttgttcatcattcatcaatgtttggatgcagacatttttgagaagattgtgcattgtgaaaatgcaaaagaagcttgggatactttggctaggaactatggtggagatgaaaagttaaagaaggtacgattgcaagctctaagaaggcaatatgaattgctgcagatgactgagggtgaaactgttaatcaatactttgtgaggttaacaagcttaactaatcaaatggtgagaaatggtgaaaaaatctctgatttgatgaagattgagaag

SEQ ID NO: 282 - DNA, 842 bp, Glycine max
  Peptide Sequence Number=SeqID_117060
gaatagaaattgtgatgtccacagaaggagtgcttattcatcagaagaagtatgcaagagacatattgaagaggttcaatatgaataatagcaagcctgtcaccactccaattgatactggtacaaagctaatcaaggaaggcgtagaagaaccagtggatgctactttgttcaagcagattgtaggttcactgagatatttgtgccacactaggcctgatattacttatggtgttggattgattagtagattcatggaaaagcccatgacttcacacttggtagcagctaagaggatactaagatatgtgaagggtacagagggacttggtattctatatagaactggaattgacacaccagatgctgaactatatggatactcagactctgactggagtggagatgttaatgacagaaagagtactgcagcttatgtgtttatgtatggtaatgcaccattctcatggtgttcaaagaagcaggcagtggttgcattatcatcgtgtgaagctgagtacatagctgcttcaatggcagcttgtcaagctcaatggttatgcatgcttatgcaggaattgggtttgaagtctgatgataaggttagaattatgttagatagcaagtctgctatcgatttggctaagcatcctgtagctcatggtagaagcaagcatatagagaccagatatcatttcttgagagatcaagtgaacaatgataagctggagcttctgcactgcaagactgaagatcaacttgcagacattctgactaaggctctgaagacgagcacacttgaaaacctgaagatgaagttagagatgaattcgacaagctaa

SEQ ID NO: 283 - DNA, 360 bp, Glycine max
  Peptide Sequence Number=SeqID_117061
atgtttaacaaaaatgcggtggcaaaatgttttgcaaaccctttctccctcaccactttctccctcctccacaacagtgcattttgcaacccgtcaccgttgtctcctcatcaccccaggtcgtttggtgtctcctcgtctgcgagttggggttcatcattactgccacgagattcaaattgtcagcatcttggacttttgaaaacacttctaagcatcctcttcatcacttactcgaagatacattccgttgaggctgtagcaagaggactaaaggatccttcttttcgtgtgattcaaaaccactttgcaatttcaggaattctaggagagacagtagcaaagattggagacctataa

SEQ ID NO: 284 - DNA, 793 bp, Glycine max
  Peptide Sequence Number=SeqID_117062
atggagttcggagggaacatgttctgccttaacaacagagaccaaaatggaaacactaacaacaacggtaacactttcgcttgggattcatgggaaacccccgccaatagtagtaataataacaacaacaacaacaccagttccagactggtcaacgctttccaccttccagccgcctcgagggtcgcggaggcggatggatccgtccccgcgacccgtcatgaagcggcagggctggccagcgcgctcatgttcctccctcagaacggcggcggtatgcgtcaccgccagcagcagcagcatccgtacggtggggatgggtcccacgtgcacccggatccacacctcatgtgcttgaagcttgggaagaggcattactttgaggacactagcggcagtgggagtgggagtgttgctgctgctgctactttgggtggagggttggtgttgggggataagagagggaaaggttattcctccggtggtggtgcatcggtgaaggcggcggggttaacggcggtgacggtgccgaggtgtcaggtagaggggtgccacttggcgctgctaaacgcgaaggattaccaccggaggcacaaggtgtgtgagatgcactcaaaggctcccaaagttgtggtcttaggcatggaacagaggttctgccagcagtgtagcaggtttcacgtggtgtcagagtttgataattcaaagaggagttgtaggaggagactagctggtcacaacgagagaagaagaaagagctcccatgattctgttgcaaggaattcttcaaaag

SEQ ID NO: 285 - DNA, 1224 bp, Glycine max
  Peptide Sequence Number=SeqID_117063
atggaaatctccggcaccgttccgagctcggggtcctctctccgactcagcagcgatgatggcgatcctctcttaggttctcgtatcagagctggaaaagacgatgctttaacagcggacacagatctagaggcttcctcctctggtcgaattgcttctagaaagcaaaaatattgggtgagcagcatcaaattgtttggggtagaattatcccctgataatgttgctgttgcgatggtttattttgttcaaggtgttttagggcttgcaagactggctgtgaacttttacttaaaagatgatttgcatttagaccctgctgaggcagctgtgatttctggtttttctgcattgccgtggcttgtcaaacctctttacgggtttattaggtcatacctagttttgtcagggctgcttggtgcactctcgtggagtttgatggctacttttgttgacaacaaatatagtgctggtttttgcatacttcttggatctctatctgttgccttctcagatgttgttgtagattcaatggttgtggagagggcacgtggtgagtcccaaagcacctcgggatctcttcagtctttatgttggggttcttcggcctttggtggaattgtgagctcctacttcagtggatctttgctggatgcatatggagtaaggtttgtttttggtgtcacatcattgcttccattgataacatctgtagttgctgttcttgtaaaagaacaacctatgtttggtacaacaagagggctaaatattctttttgctgggccagagtttttggaaagttcaaaacagcgcattattcagctgtggggttctgtgcgacagcgtagtgtttttcttcccactttatttattttcttgtggcaagcaactccgcagtctgactctgctatgttctactttaccatttacttcagttttaaaaaacttcttatccatttcagcacaaattctcttggttttaccccagagtttttgggacgtgtcaagcttgttacctcaattgcatctctgctcggtgttggtctttataatggatttctgaagaatgtgcctttacggaaaatattttttgcaactacccttttaggttcaactcttgggatgactcaggttttccttgttactggactaaaccgtaagtttggcattagtgatgagtggtttgcaattggtgattcattaattctcactgttttgagtcag

SEQ ID NO: 286 - DNA, 504 bp, Glycine max
  Peptide Sequence Number=SeqID_117064
atgtggggcactctagctataacttacaaaggaacgtcacatgtaaagagaaacaaattaagtcttctcactcgtagaacttatgataactatgatcatattgacaaaatcttaagaagtttgtctagaaaatggagaccacaggtaacaacactatgggctctaaagaatcttgactcaatgtcccttgaagaactagttgatactcttaagtctttggctctcagcaattggaagatcaagaaggcctcttctagagagcaagcatccaaaagttcgtccaaagcccttaaagctaaaaactcatctgctgaagaatttgaggaaaagtatgatgaagatgaagttgcattcatctcacgaaagattcacaagatgtggaagatcaaaggcgaatgtagatggaagaactcctccaaaagggtgttcaaggaaaagaaagacaaagacaaaagctccataatatgctatgaatgcaagaaatatgggcacttcaaagtgtga

SEQ ID NO: 287 - DNA, 744 bp, Glycine max
  Peptide Sequence Number=SeqID_117065
atggcaactaatcaggctcagacacttatggactaccacacccctaccatcggaggagccaacaccatccaacttcccgatctacctaagggagtgacatttgacttcaagcataggttcctacagatgctggataagaatctgtttagtggtgctgcccatgaagatcctatgtggtacatgaggaagttcatcaagcatgggactggttgtgctcactacttgagaatagtatcactacatggaaccactgtacaagtgccttctaatgaaggtatttctttcccgacaagtttagatttttcttgtgggggtaacctcctactaaaaccccctattgatgctatcaagatcattgaagatatatgctctaacccctatagcaacacaggggataggaggattatgaagagagacgtgagaaaagatgattcccaaactgaattggaaaagcagatgcaagatctaacattgaatattgagacacttacgagagctcaagatcaagtccctatcactacaccttcattcccaacctatgatagggattcaggaaaaatcaaggaatgtataggtcttaacccatgcaaaatcagaggcctagataagaggggagattggggatgtgctggtgaaggtggacaagttaggcttggtagactcacccttagactaggggatgagaagtgtgtggcgatgtttggccctccagagagatttctcattgatgaggacctttactag

SEQ ID NO: 288 - DNA, 218 bp, Glycine max
  Peptide Sequence Number=SeqID_117066
atggacgaggttgctcacgcttgtcttgttcttttttcgccttttcaccctcctggcgtcccttttctttccgttccctctccttgtgtggttactgattttctctttcttcttgttgctcctcatgctcaggaacaagcctgcaacgaatcttacattgttgtagcttgtatggatcctgcccgctcttgcaactctgtaggcatcgctgcttctgt

SEQ ID NO: 289 - DNA, 213 bp, Glycine max
  Peptide Sequence Number=SeqID_117067
atggggggagttgcctatgtacagggtgacctcaacacttgctacctagttttcctaagtgagagtgtcgtgtggacacacttaggttatttcctgacgaatggtaccacattgcatttgaaagttgaggtcagcagaatggagaagaagaagagtttggaggagacgccacttcaagaaaaagatgagtctagaagaagctcaccaccatag

SEQ ID NO: 290 - DNA, 561 bp, Glycine max
  Peptide Sequence Number=SeqID_117068
atgcgtacatttaaaacttgttggtttagcaggaaagctcgtgctcacggcatcaccgataaggcgttgtgtcgggcagtaaaagacgtgcaacggggtttggctacagatttaggcggtggcgtatttaaaaaacgtcttaatcataatcgcgaccgcgcgttggcccagaccaatattacaggggcagaattacacgcttttcgcaagttagccatgcagtttggcgcgttgagcgacgaccaggaaaaaacgtttcggagtcaggcctttgaggcgattcacagcgccgctgaaggattgcatcgtgctggcgccatttctctggaaaccctacgcagttttgatgagtcttgccttgcgccggtcgagatgttgcagccccaggagatcaaagcgttgcgcgagcagttacgtttaagccaaccggtttttgcccgttatctgaataccagcgtgtcgaccatacagaaatgggagacgggggtgaaacggccgggcggcgtgtcgcttaagctgctttcgatcgtacgcaagcacgggcttgaggtcttgttgtag

SEQ ID NO: 291 - DNA, 1170 bp, Glycine max
  Peptide Sequence Number=SeqID_117069
ctgatcgagctgtccggcttctcccgttcgatcgtcgcggcggcgatccgcattctcggccggcgtcacgccattccggtgatcgtgctggtgtgcgcgctgctgacctacggcggggtgtcgctgttcgtggtggcgttcgcggtctatccgttcgccgccgagctgttccgccagagcggtatccccaagcggctgatcccggccaccgtggcgctcggcgctttctccttcaccatggacgccctgccgggcacgccgcagatccaaaacatcatcccgaccagcttcttcggcaccaatgcctgggccgcgccctggctggggctgatcggctcgctgttcatcatcgcggtcggtctgctgtatcttgaacgccagcggcgcaaggcgcagctgaagggagaagggtacggcaccgatctgctgaacgagccggaaaccccggacgacatcaacctgccgaacccgctgatcgccatcctgccgctgattttggtcggggtattcaaccttggcttctcccattggatcccgcaggggtacggcgccagccacaagctgacgctgccggggctggccaagccaatcgccaccgacgtggcaaaaatcaccgccatctgggcggtggaagcggcgctggtgtcgggtattctgctggtggtggtgttcggttttcgcaatattcgtggccggttggcggaaggcagcaagacggcggtcggcggggcgattctggcggcaatgaacaccgcctccaaatacggcttcggcgcggtgatcgccgcgctgccgggttttttggtgctgtcgcaggcgctgtcggcaatccccaatccgctgctgaacaaagcgatcagcgtcaccctgctggccggcatcaccggatcggcctccggcggcatgagcatcgcgctggcggcgatggccgataatttcgtggccgccgcccacgccgcgcatatcccgctggaagtgctgcaccgcgtggcctcgatggccagcggcggcatggacaccttgccgcacaacggcgcggtgatcaccctactggcgatcaccggcctcagccaccggcaggcctatggcggcatcttcgccatcaccctgatcaagagcgccgcggtgctgttcgtgatcggcgtgttctacctgaccggcattgtttaa

SEQ ID NO: 292 - DNA, 618 bp, Glycine max
  Peptide Sequence Number=SeqID_117070
atggcggtctactatatagagttcgatgagttcaaggaggaactcgaaagaagccactgggacgaggagttgactgactttggggatggcaacattgatgttgccattgtgaaggaattctatgccaacctctatgaccccgaggacaaatcacctaaatttgcactcctgaggcctgatcctcaggagttggctgctaagctctgtatcccagggaagggattcgagcttaatgctgatgggcagcccctgaagattttgaggaagaacttgaccaccttagctcagacatggagtgttctttccttatctaacttgattcccacctcccacacttctgatgtcactcttgacagggctagactcatttatggcattattatgaagatggatatgaatgtggggtacctaatctccctcactgctcagcatgacacatccagacttggattcccggccttgattacagctttatctaaggctaggggagttcagtctgattcaaggtccctagagagcctgagtcctgccattaatttggcttatattaagaaggactattggaatcttgatgatccaacaataacattcagaggacctaggaaggccaggggctag

SEQ ID NO: 293 - DNA, 231 bp, Glycine max
  Peptide Sequence Number=SeqID_117071
atgtctgaaaaagttaaaatgataaagccaggagatgctcaaatcatcaaacagagagggatggttgaagaattcgaggggaaaaaaaggaaaggaaaggatatgataaagaagttgaaacgcaaaagaaatcaagtaggaccaactagtaattcaataggcaggaaaggaaaacatcaaaaaggaaagaatgccaatttggagagatatcattttctgaggcctagttga

SEQ ID NO: 294 - DNA, 291 bp, Glycine max
  Peptide Sequence Number=SeqID_117072
atggccaagtttgatcctgagatagtcctaaagttctacgctagtgcctggcccatggaggagggagttcgggacaagcgttggagggccagcggtgcgagttcagccagaggagggactaggcctcgacttcgacgaggaggccatcgcccagctgttgtgtatactggggtaggactttgcccggaccgctacggggaggcgggtgcggattatgcgcaccagcatgactactttgactcagatatggatgacgctgctactcagcaacatcctgctcaacaaccataa

SEQ ID NO: 295 - DNA, 174 bp, Glycine max
  Peptide Sequence Number=SeqID_117073
atgaagcttgcttctacaggtaacactgatcatggaaacatcagagcagaggaagtagcctcagtgtcctcagatgaagtatcagatccaatagaggacatcacatcatccacagatggtgaatgtaacttagatggaatgacaacctctggcacgggcatgacaaaatggtag

SEQ ID NO: 296 - DNA, 276 bp, Glycine max
  Peptide Sequence Number=SeqID_117074
atgttaacatgccttaaggaacacgagcagaaagaagcagcaataggaagaacaacctttggaattgcgaagcttatccatttgtcgtcaatgctacctcaaatctcaatttccttgcttttggtattaatgctgagaacaaccagaggaacttccttgcagatacagagacagagacaagtgcaggagcttgcgttccctgggtctgctcaagttgttgagaagctaataaagaaccaaagggaatcatactgtgtggatgcacagcctcaatag

SEQ ID NO: 297 - DNA, 1497 bp, Glycine max
  Peptide Sequence Number=SeqID_117075
atggacattgcaagttgtgcactgctcattgtcttgacatgtgccatagttcatgctcttcttggttcattccttgcaatggccacaaaagcaaaccataagctgccaccgggaccatcccgtgttcccatcataggtaacctccttgaattgggtgaaaagcctcacaagtcattggcaaagcttgctaagatacatggcccaataatgagcctaaagcttggacaaataaccactgttgttgtgtcttcagcacaaatggccaaagaggtgcttctaaccaacgaccaattcttgtcaaaccgaaccattccccaatctgtgtcagttctaaaccatgaacaatacagccttgccttcatgcccatttcacctttttggagggaactcagaaaaatatgcaacactcagttatttgcccacaagtctcttgatgctagccaagatgttaggcgtaagatagtgcagcaactagtctccgatatccatcaaagcagccagataggtgaagcagtggatattggaacagcagcattcaagactaccataaatcttttatcaaacactatcttctctatggatttgattcactctacaggtaaagcagaagagttcaaggacttggtgaccaatatcacaaagctggttggaacaccaaacttggcagatttttttccagtgttgaagatggttgatccacagagcatcaaaagacgacagagtaagaactcgaagaaggtgttggacatgtttaaccacttggttagccaaaggttgaagcagagggaggatgggaaagttcacaatgacatgttagatgccatgctcaacatttcaaatgataacaagtacatggacaagaatatgattgaacatctctcacatgatatatttgttgcgggaacagatacaacagcatccacccttgaatgggcaatgactgagttagtccgcaatccagatgtaatgtcaaaagctaaacaagagcttgaacaaatgactagtaagggtaatcctattgaggaagcagatattgctaaacttccatacttgcaagcaatagtaaaagagacattaaggttgcacccaccagttccatttttactaccacgaaaagctggtaaggatgtggacataggtggctacaccatcccaaaagatgcaaaagtgctggttaatatgtggactatttgcagggaccccacattatgggacaatccaactatgttttctccagacaggttcctaggatctgatattgatgtcaaaggacggaactttgagcttgctccatatggtgctgggcgcagaatatgccctggcttgctattggccaataggatgttactgttgatgttgggttcgcttatcaactcctttgattggaagcttgaacaaggtatagaaacacaagatatcgacatggatgataaatttggaattaccttacaaaaagctcaaccccttcgaattgttcctctcaaaataaacaactaa

SEQ ID NO: 298 - DNA, 1506 bp, Glycine max
  Peptide Sequence Number=SeqID_117076
atggacattgcaagttgtgcactgctcattgtcttgacatgtgccatagttcatgctcttcttggttcattccttgcaatggccacaaaagcaaaccataagctgccaccgggaccatcccgtgttcccatcataggtaacctccttgaattgggtgaaaagcctcacaagtcattggcaaagcttgctaagatacatggcccaataatgagcctaaagcttggacaaataaccactgttgttgtgtcttcagcacaaatggccaaagaggtgcttctaaccaatgaccaattcttgtcaaaccgaaccattccccaatccgtgtcagttctaaaccatgaacaatacagccttgccttcatgcccatttcacctctttggagggaactcagaaaaatatgcaacactcagttatttgcccacaagtctcttgatgctagccaagatgttaggcgtaagatagtgcagcaactagtctccgatatccatcaaagcagccagataggtgaagcagtggatattggaacagcagcattcaagactaccataaatcttttatcaaacactatcttctctatggatttgattcactctacaggtaaagcagaagagttcaaggacttggtgaccaatatcacaaagctggttggaacaccaaacttggcagatttttttcaagtgttaaagttggttgatccacagggcgtcaaaaggcggcagagtaagaatgtaaagaaggtgttagacatgtttgacgacttggttagccaacggttgaagcagagggaggaagggaaagtccacaatgacatgttagatgccatgctcaacatttcgaaagataacaagtacatggacaagaatatgattgaacatctctcacatgatatatttgttgcgggaacagatacaacagcatccacccttgaatgggcaatgactgaattagtccgcaacccagatgtaatgtcaaaagcaaagcaagagcttgagcaaatgattagtaaaggtaataatcctatagaggaagcagatattgggaaactcccatacttgcaagcaataataaaagagacattacgattgcacccgccagttccatttttactgccacgaaaagctgataaggatgtggatataggtggctacaccatcccaaaagatgcacaagtcttggttaatacgtggactatttgcagggaccctacattatgggaaaatccaagtgtattttcaccagacaggtttctaggatctgacattgatgtcaagggacggaattttgagcttgcaccatttggtgctgggcgcagaatatgccctggcatgctactggccaataggatgttgctgttaatgttgggttcccttatcaactcctttgattggaagcttgaacatggcatagaagcacaagatatggacatagatgataaatttggaattaccttgcaaaaagcacagccccttcgaattcttcctgttcctgtcaaaataaacaactag

SEQ ID NO: 299 - DNA, 420 bp, Glycine max
  Peptide Sequence Number=SeqID_117077
atggcgatatttgctgcaagattaagcagagaaaggaaggaactgtctcaggtcgagatattggggaaatttgctggtgcagttggaaattacaatgcacatgttgcatatcctgaagttaagtggcctcacattgcagaacagtttctacaatctcttggattaatttttaatccttatgttgcccagattgaaactcatgactacatggcaaagctttttcatttgctcatccagttcaataatatatctttgggttactttaagcaggctggggagattgggtcatcaactatgcctcacaaagtgaatcctattgattttgagaacagcgaacgtaatctaggtgtagctaatggaggactgtctcatctaagcatgaagttgccgatttcatgttggcagggaaggcctccttga

SEQ ID NO: 300 - DNA, 453 bp, Glycine max
  Peptide Sequence Number=SeqID_117078
atgtgtatgcttcctgttagattaaatgcttgctgcagctatctcggattcctgaaattgttgaggttcccagtttcagtgacggtgctaaatctttttttgcaaggcctgattgatgactttagtgttgatgatgccttggaggttaaaaacattgagagggtcacaaatgatgatgtgaaagcagtggagtacttcttgaaacaaaagtgtcaatccaatgcagaagtggttaaggtgcttgagtttttccactttgcttgcacatctgaggatataaataatcttgcacatgccttgatgctgaaggaaacaatgaattctgtcatgtttcctgtcatggatcaaataatcaaagctttgtgtgacatggctaaagataatgctcttgtcccaatgctttctcacactcatggacaggaatgttcatttgtgcatttgttgaaaatttaa

SEQ ID NO: 301 - DNA, 399 bp, Glycine max
  Peptide Sequence Number=SeqID_117079
atgcttgcatctgctggcagatgggaagaagccactattgtcaggaaagaaatgagagatatcggtattaaaaaaaatgtgggatatagttgggttgctgtaaagaatagagtccatgttttccaagcaaaggatagttctcatgaaaagaactctgatattaaggcaatgctagctaagctgaaaggggagacgaaaaaagctgggtatgttcatgataccaatctatcgctctttgatttagaagaagaaaaagaaaaggcttcagaagtgtggtaccacagtgagaagattgctcttacttttggcctcatagctctacctcatggatttcccatacgtatcacaaaaaatcttaggatctgtgtagattgtcatggtgccattaagttcaactaa

SEQ ID NO: 302 - DNA, 456 bp, Glycine max
  Peptide Sequence Number=SeqID_117080
atgggggtgggtttgggggctaatgtaccattccgcataggtatgaaggagtgcagggggggattatcatttatttatgttggtggtattaatggtatcttatgcctggattggatgggggattacatttttttgggtggtcgaggcagctgccatggtgtttgtgcagagccgtatgaaggtcaatttaaagctggtgtggataatgaaaatctatggactatggagtttggtcttcagacaaacgtacgccagtgcatcacacacgcaaggtatcttcattggacacatgtatacaaaataatatatgcttccggaggcggcagcaaagatagggctgtggagtggtggtatttcatgatgtgggagtttggaccatttcatgatgcttgtcaaacagaacaatctgattttgggaggcagagcattgtgattgaggtttacatatttaactag

SEQ ID NO: 303 - DNA, 501 bp, Glycine max
  Peptide Sequence Number=SeqID_117081
atgttgttgttttttacagcaaccttccggagagactacggtggcgtcggtggtggttgtggttgtgcgtcagacacggggcggaggacaatagttggaggacgaggggttgagggagtacttggggactctgacgccgccaccggtggggatcatgaaggtgcgcgtgtcgggggactcgacgatggagttggaggtgcccggggaggagaagaagaagcgctgcgaggcgaagatggaggcgaagtctggctcagtggaggagccggaggaggtggtggtggtggtgtcggtgaaggggaagattgtggagttgtcggaagaagagggtggtggggtgtgatcgctgtggtgaggttggcagagaatggtggggtatttgagcttcaagaaacagaggtggaggtgtttggagaaaaggctgggcatctttgcacaatgaaaaatcaaagggagagacaaaacaatgagagagactttgtttctgtgtgccttatataa

SEQ ID NO: 304 - DNA, 411 bp, Glycine max
  Peptide Sequence Number=SeqID_117082
atgctaccactgatcttgttgccaagtgtaacaagaatacaaagccaaaacactgaagatatcgacacctttcaaaacgcaattcagcaacagaatacgaagatgagtcaggagcagctaaggcgtcgatccccattgagtatggcgagtgctgaggtgagtaacaagccggatgtcactgccactcccgatggcgtagccgcttctgtggcggcagctgctaggctcaacgaaaatgttaagagtatatgtaaggagtgttgtagtctattgggtacaagtggttcaggatcatacgtttctttatggaatatttacatcacaatggagtcaaagtttatttttcttgattcagcaaagagattagtatatgtaacattgagggtaatggaagttcatttagccgtttga

SEQ ID NO: 305 - DNA, 271 bp, Glycine max
  Peptide Sequence Number=SeqID_117083
gatatgggctacgtgggagtacgtgagctcagatggaggtgggcaacaggggatggtgggtttatgcgcgcattgtggatgtgggtgaaacttcctgcttttattgttgaccacaaagtggtacctggagatatgtcgcgggggtcaggagaccttggggacgtcaggcttgagaaacgaagtcaggaaactaagggagcctctggtaatcgattaccagcctgtgtaatcgattacacagagggatgggtcactggtaatcgattaccag

SEQ ID NO: 306 - DNA, 1137 bp, Glycine max
  Peptide Sequence Number=SeqID_117084
atggttccttacctcgacaggatatattatggcgaattcgtccagattccattgtgtcttccacaatggaatctgataagtgagatatggaatctgataagtgagattccgggtaattgtttacataatcttcttctgtccgaagaaattattcatcgaaataatgagttactattaatatcgacacatctgagatcgctaaatgttcaggagttcttctattcaatccttttccttctccttgttgctggatatctcgttcgtacacatcttctctttgtttctcgagtctatagtgagttacagacagagttcgaaaagaatctctttctagttgctctggaacaattaggagattctctagaagaaatacggagttttgcttttggtggcaacatgctatggggtggtggtcccacttatggggtcaaatcaatacgttctaagaagaaatatttgaatctcatcgatctcataagtattataccaaatcccatcaatcgaatcgctttttcgagaaatacgagacatctaagtcatccaaaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgtgaatgagtcgtattacttatccctcggtcttttagtgaactatctctccagggtttgtgaaagatgttctactagaatattcttgttattgcttcgactcatattccccaaaaagtag

SEQ ID NO: 307 - DNA, 153 bp, Glycine max
  Peptide Sequence Number=SeqID_117085
atgtcttttgatcaaaactctaagcttaagggacatgaggtcttgagggaactacctcctgagattgtaaaaatctaccaagagatagaaaccctcaaagacaaactaggcaaatttggtgatggtcacgaatgttatgtagagtttgattga

SEQ ID NO: 308 - DNA, 183 bp, Glycine max
  Peptide Sequence Number=SeqID_117086
atggaggttggatctttgagcttcaataagatccttcaatggttattttcagccatggagtcgcaacggatgataaaggagaagaggaatattccaagaatattccaaaggcatcttagtatattccctttagatgccacaagcatggaaggtgtgactctagcacataggaagcttccttga

SEQ ID NO: 309 - DNA, 366 bp, Glycine max
  Peptide Sequence Number=SeqID_117087
atgcccaaaaagtcatcgtccaaagccatttccgtgaatgatgcttcagaagaagaatccaatgatgattgtgatgaagaagatgttgaactaaaagattcttcatctaacgaggacaataaggaagaagccaacctatgtgtaatggttgatgcgtccaccagtaaggcagaactagcattcgatgcaagtttggacgatgaggactcttccccaaggacactagagcacaaggatctcaagaaagctcatcaagttcacttagttgattttgtcctagaaaccacctcgcttagtagtgtacaagatgcctctgtttgtgaggaagtcaaagcactactggacaaaaaggtttccagtggatga

SEQ ID NO: 310 - DNA, 318 bp, Glycine max
  Peptide Sequence Number=SeqID_117088
atggctagctgggatctctcaatggatcaaagctctaaagtctatataaagcttgaagatgtttgtgttaagagtataggaaagaaaactcctgaaatgatggaagaaggatatgttgtgaacaagcccccattgttaaagggagagaactacgactattggaaggaaagaatgattgccttctttgaatctactcacattgatatgtgggacgttgtagaaaaaggcgatcacattcctttagacactcagagaaacaagatctgtagggacagatggacggatgaacataagtccaaatctgttctcaactcttga

SEQ ID NO: 311 - DNA, 315 bp, Glycine max
  Peptide Sequence Number=SeqID_117089
atgtgtaataactttaggcaattttcccttaggatagtgttttgttgggattccacaagtttggagaatttgcggatggttacagcaagatgcaaacatacaaagattatagccggagagccaccaccaccagcaaacatggaccagatggaagaagaagcagaagaagaagctcaacaagagcctacacaccaatggaacccttttgagtctcttatgattcagaagatgaatgctattcttcacctccatcaagagcgtcaagtcgaagttcacagttccttagaaacattaccactatgcttgagaacatag

SEQ ID NO: 312 - DNA, 357 bp, Glycine max
  Peptide Sequence Number=SeqID_117090
atggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtcccctggaagggggcgccagagagggtgagagccccgtcgtgcccggaccctgtcgcaccacgaggcgctgtcggcgagtcgggttgtttgggaatgcagccccaatcgggcggtaaattccgtccaaggctaaatactggcgagagaccgatagcgaacaagtaccgcgagggaaagatgaaaaggactttgaaaagagagtcaaagagtgcttga

SEQ ID NO: 313 - DNA, 2070 bp, Glycine max
  Peptide Sequence Number=SeqID_117091
atggctagatcatacttgtgttcacaaacaccaagtggattgagaaggttgagggaagaggaattgaagctactaagagggaatggagaaggagaacgcaagagctcggatagaatatatgattatggtgtgtacaatgatcttggggatcctggttctaacattgacctcaaaaggcctattctaggtggctccaaacaatatccatatccaagacgatgtcgtaccggtcgagaacattctgattcagacccatcatatgagaagagaagttcaagtttctatgttcctcgtgatgagacattttctgaagtaaaacagtcacagtttactaagaccacaatatcctcaggagtgagtgcagttttagaatccttggatgcaattctcactgaccaaaatcttggattcagaagcttcgaagacatagacacgatctacaaagaaggatttaagttatcacctcttaaagaaaatggcctaaatttcctccaaagagtcattcccaggttgatcaaggctgctaatgatagccaaaaccttttgcgctttgatacaccagagacagttaaaagggacagattcttttggttttcagatgaggaatttgctagggagactttagcaggggaatggcctctaagaagtaaacttgaatcccaaatctatggtccaccagaatcagctatcaccagagaagtcatccaaccacatataattggttatggcaccattgaagaggccattaaagagaagaagttgtacatgttagactatcatgatctattgctaccatatgtaagcaaagtgagagagattaaagacaccacactatatggatcacggacactattcttccttactgaacaaggaacattgaagccactagctattgagctcactaggccacctatggatggcaagccacaatggaagcaagtcttcactcctgcttctcattcaaccaatctttggctttggaggcttgccaaagctcatgttcttgcccatgatgctggtgttcatgaacttataaatcattggttaggaactcatgctgtgatggaaccctttgtcgttgcaacaaataggcaacttagttccatgcatccaatctacaaattactgcatccacatttgagatacactttggctatcaattcacttgcccgtgaaattcttatcaatgcaaatgggatcattgaaaaatcattctcacctaataaatattcaatggagttaagctccgtggcatatgatcaactttggcaatttgatttgcaagctcttcccaatgatcttatttatagaggaatggctgtggtagatccaaatgcaccacatggcctaaagctaacaattgaagactacccttttgccaatgatggtcttctcatatgggatagcatcaaacagtgggtgactgactatgtcaaccattactatccaaccccaagcatcatagaatctgaccaagagctccaagcatggtggacagaaatcagaacagtaggtcatggagacaaatctgaagaaccatggtggccaaatctcaaaacaccaaaagacctaattgacaccatcaccactataacttggacggcgtcagctcatcatgcagctgttaactttacccaatatacttatggaggctattttcctaatcgaccgaacattgttagaaccaaaatacccacagaagacccttctaaggaagagtgggaaacttttctaaacaaccctgagcaaactcttttggagtgtttcccatcacaaatccaagcaactacaatgatggtagtttttaacatactatcatatcattccccagatgaagagtatattgggcaatacttgaagccatcatggactgaggatccaactgtaaaggcagcctatgaaaagttcaatgggagactgaaggaaattgaaggcattatagactcaaggaatgcagattgtaatatgaaaaatagacatggtgttggcgtggtgccttatgagcagatgaagccattttcaggacctggaatcactggaaaaggaattccatatagtgtatccatttaa

SEQ ID NO: 314 - DNA, 808 bp, Glycine max
  Peptide Sequence Number=SeqID_117092
atgactatggacagtcatgcattggagtcgtctagttatgtcattgctaacagttatgaggtggagttgtatgtggaatgtgttggtgataatgagggggatgtacagttatatgactctaaggaggaaaggaaaattggattggatgatggttttgatttacctattccagaatttggaagaatgaaaaataaacgaataaagaatctgactttaaaaaaggtgtgtaattcaagtgatgatgcttgtgacaatgcttttgttcataaagatgatgacatagctaataggcaacgtgtacgtgtcgaattagatgaagtatctattgattacttcagccaagagaaaaacttaaacctaccaagtgaagtgcggagtgatgcacattttaggctggtggacaaggttgttgatggtaagaaggctattggtggaggtaagaaggctactagtaggggaaaaaagcctattggtagggtaataaggctagtggtggaggatattgttaatgttgaaaccaacaaatgggtgttcattagtgatcaacaagagaataaaccccaattgagaaggagaaagcctaatgaggaccctaacaagaccaggctaagaagggacctaactccatataaatgcagcagatgttgggcaacaagtcataacacaaggaggtgtacattgccacctctagtagtacctgaagaagaaaatgaggtacctagaggagctgctgaaggtgtagttgagggtggcactaaaggagcgacagaggatggcactgaaggagcagctcatggtggaaatgagg

SEQ ID NO: 315 - DNA, 459 bp, Glycine max
  Peptide Sequence Number=SeqID_117093
atggcaacaagcagtggtaaaaccaacacaaaatctcagaatgtgaacgtgaatgtgaaagctattgtgactattgaacaaagtaatggtggacttctgctgaatctcattaattcagcggttgatgggatcaaagagttggctggaaaaacacttgttttggagcttgtgagtgatgagcttgatccaaaaacaaacttagagagaaaaacaataaaaggtaatgcacgcaagaccgaggaaaaagagaatgaggtgctttatgaggccacatttgagttagcagcagagttcgggaaagtgggtgctgttttggttgagaatgaacaacacaatgagatatttttaaaaagcgtagtctttgatggcttccctgatggccctgtgcacctcacctgtgattcatgggttcagcccatgcatgataatcctgtgaagagagtcttcttcaccgataag

SEQ ID NO: 316 - DNA, 210 bp, Glycine max
  Peptide Sequence Number=SeqID_117094
atggatgggactgataatcaagtctcacccttagaccttttggttggagcggaacatatctcatcttatgatttaaaatctgccatagatgggtggccgattaatctacaaggagacattttggccttcttatttggatcagaagtggaagtgccattccgtagggcccctcaccgtaaaggtggtcggggtggtcatcacccttgttga

SEQ ID NO: 317 - DNA, 588 bp, Glycine max
  Peptide Sequence Number=SeqID_117095
atgaatgagttattgaagtcattcctacgcaaatttgtgactgtctttttcgacgacattctggtcttcagtccgacatttgatgatcatctcaagcacctcgcctgtgtgtttgacagtcttactgagggacaatttttccttaaagaatctaagtgctcgtttgcacagcaacaacttgagtacttgggccatatcatctcagccaaaggagtagcaccaaaccttgccaatataaaggaaatggtggaatggccagttcccaccaccaccaattctttaggtgggtttctcggcctaactaggttctatcagaagtttatcaagggtctcaagcgagccatgactcaagcaccggtattggctttaccggatttctctgcaccgtttacactagaaacagaagcttcagggactgccatgggtgccattctcaagcaacatgctcacccgctggcctttttcagcaagcatgtttgccctcgtctccaacgagcttctacatacggagtggagttcagttgtgcttcttcttcttcttccaagcttgttcctagtgctcttgagcctttgattcatcaagcttag

SEQ ID NO: 318 - DNA, 426 bp, Glycine max
  Peptide Sequence Number=SeqID_117096
atggttataggagatttcatcagcagactctcctttcccgcatgtttgcattttagtggagaaaacaccgagactttttccagtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcacctcgtcattcagtgatcccaagtgtgattgacgagcagagaccaatatggtcatctgcgccctttccggagatgtcagcattttccaatggagacttttcaagtctcacaagttatccagaactacgtaggtctgagttcctcattggaggatacgtaggagcaagagccttgcttttgtcggccgccccataa

SEQ ID NO: 319 - DNA, 201 bp, Glycine max
  Peptide Sequence Number=SeqID_117097
atggaaagcgcacccgtgagcctcgcctcgctcgcccgcaaaagggcatgttgcgacaaaacttatatgctaaaaactatcaaatgcatgcctaaattactaaaccctcgatccctcgtcagactaaatatccaagcttcatccgcagatccctcatgtaagactaggcttaaactaaacaacattattgtaacagcataa

SEQ ID NO: 320 - DNA, 360 bp, Glycine max
  Peptide Sequence Number=SeqID_117098
atgggactcaatcagacaatccgagtaaaaagttattgtcgtttgaatttgctcagagcatcaacattcaatttcgagcgtctcgatatattacgggactcaatcagacatccgaagaatcgacattcaatttcgagcgtctcgatatattacgggattcaatcagacatccgagtaaaaagttattgtcgtttgaattcgctcagaggttcaacattcaatttcgagggtctcgatatgttaagggactcaatcagacatccgagtaaaaagttattgtcgtttgaattggctcagagcttcgacattcaatttcgagcgtctcgatatattacgggattcaatcagacatccgagtaa

SEQ ID NO: 321 - DNA, 129 bp, Glycine max
  Peptide Sequence Number=SeqID_117099
atgtggttgcagtcacggaagcgcagtttttacaaaaccgatgttaacaacggcataaaaaccgatgttaataaccgatgttactatggagtagttaacatcggttttggaaaaaccgatgttaactaa

SEQ ID NO: 322 - DNA, 645 bp, Glycine max
  Peptide Sequence Number=SeqID_117100
atggccaaatctcctcctccttcttctgctactccttccttctcttcatcttctgctttcccacactcaatctttgaggagctcactgatttgaacttcttgctgtggaggcaacaagtagaaccagcgatcaaaacacatcaactacaccgatatctggtgtgtccgaatattcctcttcaatatgcaagtttacatgactacaactcagtgatttcagtcaccgaaagcaaatttcagccgatgcaaatcgaggaagttgaatctctctttcttgcacatgagatgagtttggaaaagttgcagaagaagctcacatctgaaaccgcttcactaaatctgatcgaaatcccttcctcaaagtcgcaacaacaatcgtcctcctctgctcaagcaaatgttgcttctgaaaatgcaaacttgaactacaactcgtactttgggtttcgcagctttggacgtggtcgcagcagttggaacaatcgtggtggaggccgcggttgtcgcggtcggttttccaatgtgcagtgtcaagtctgctacaagtttggacatccagccttggattgctatcattgttatgatcagaattatcaacctcaaatgcctgctaatcttcaaggatttcagacttcaaatctttag

SEQ ID NO: 323 - DNA, 369 bp, Glycine max
  Peptide Sequence Number=SeqID_117101
atggcggtctcatttctaaaagatgttgagggccatagaattcagcctcaaactagagatcagtgggtgtggacggctgatccaaatggtcaatactcggttaggagtgcttataatgtgcttacggaggacttatcacaggagatccaggatggagcgttcgaggaactatggaagctcaaggttccatttaaaattgctacattcgcatggagactactcaaagataggctaccaaccagagtaaatctgcggaggagtatggtgggaatcgttgtcttgggtgcatttggtgggtgctttcccgcatcatccaagaaaacattttctccaacacatttatggagtgtcggagggaatgaaggctaa

SEQ ID NO: 324 - DNA, 468 bp, Glycine max
  Peptide Sequence Number=SeqID_117102
atggacggatcttggattgaagagccggcaacagtcaaagaggcagtcaggaggttcttttcacagcgtttccaagaatatgactttgatagacctagattggatggctatggagaaaaggatatatcggggattcttagttggcataaacaaggtggaaaacaatggaaagttgatgcagccaattacctcaattgtagctggatgtctttcccttttacatacctcggcgttccgattggagcaaaaccaagaagatgtcagacatgggaccctatcattagcaaggttcctaaaagtgtgatggacaagctggagagtttacagcggactttcctatggggtggtgcgtatgagcaaaacaaaatagcttggatcaaatgggaaatggtgttcctaccaaaagaagttgggggtttgggagtcaaagatatcaattccttcaatctatcactgctggctaaatga

SEQ ID NO: 325 - DNA, 489 bp, Glycine max
  Peptide Sequence Number=SeqID_117103
atggatcgaacactctgcctctctctacttttcttcacggcggcggtagcggcggagaccggcggcgcagaacccaacctcacttccggcgggctgttatggtctactgctgcggaggaatccgatctggccccgccgccggatgacggcggcttttcttcactcgatggcatgttgcagtgggctataagtcattctgatcctggaaagttaaaggaatcagcagaagctcagcaacggcttccaccaagcgagctatataaacgtcaatttgaaatcaaggaaataatggagaaaatgaagatgccttctgatgctgaattgatgagaatcgcaataagtgacttgaataacgtgtctacatccttggaagataggcaccgtgctttacaggagcttcttgagcttgttgagtcgattgataatgcaaatgggacctctaacctagggtataactactgcaaattgcagttgaagactgcaatttaa

SEQ ID NO: 326 - DNA, 1371 bp, Glycine max
  Peptide Sequence Number=SeqID_117104
atggcttttgcatcttctaatcctccttcaccctcttcaccattgttttcatcgtttccggaggctgaaacttctattccggtgaatgcgacaccgatccaaacagaaattccgacgaatgtgacaccgcctcaaacggataggatgctgattccgacgccaaactcaacggtgactctgacaccgactctaatgtcgatttcgatggctgtgacattgtcaacacagtcttccacctttttcttgcatgcgattttggaaaaattgacgaactcgaactacttgttgtggtgtcagcaagtagaaccagtgttgaaaggccatcatcttcatcacttcctcgtgaatttgtcgattccaccacgaactgcatggcacctttgggataaacatcactctcatttccgatccatgattcgtgcaaaagtaggtcagtctgaaaattttctacatattcagatgcttgtaaattctctagacttgattggtgtgtcgattactctcgaggagcaacttgatgttattctcgaaggtctgcatgaggagtatgagtcaactatgtcattgatttttagcaagtttgaacctctctccattgatgaggtgcttcaaattcctaattctctgtctaacttgcctaattcttcaattgacaattcaaataatcagaattttgatgcacaagcaaatcttgctcaggcgagattaggagagagaaacatgagaggagagagaaatagtgggtgggagagagttaggactaggagggagaggaaagagagtattagagagagatctagagagggtcaatgtctgaacttcgctggcaactggaaaggacgtcaacaaagctacatgcgaacaaattggagagaccataaggatatatcatccttctacttcacctgtttccctgaggatgcaactaaggaagagctgtggcaacatttcaaaaaagcgggcgacttagggaggaagttggacaatattgtctttggtgggctaaaaatgtttgtcaacattccaaaatttggaagagctattcctggaaagtcacaaccagtagcctatggacgagtatacgctaagccaagtgaggaggagaacagagatgcgtacttgagaatgaagcaaggagggtccatgggaatgaagcgaggatcgtacgcggatgctgtcaagaagaataacccaagagctgaccaggggcataaatggctcaacgaagcatgggtggggagattaaaaaacttgtccttgtttgatagagtcgaggatgacattctatgggatttcgaagttaacgtatcaccaaagtacattggagacgacatgatcctgctcctcggcctcacagacgacaaagcatga

SEQ ID NO: 327 - DNA, 330 bp, Glycine max
  Peptide Sequence Number=SeqID_117105
atgcagcaaatgaagaagatagtggctggtatcggtgacatggtcgatgtcgatgatgacgtagagggacttcggaagacggatatggcaaggattttacttaaaacaccgtggagaccgcttatccaacatatcgttactgtgcacattcaagcggagatatttcattgccggcgcgatatggagtacagttcatcggacgagatacaattagaggagagtgctgatggctcgccgcggtggataacggcgccgatgacgcaggagaatgatggctcgacgcgctggatattggcgtcgacgatccgatggacaaaacagccagcctga

SEQ ID NO: 328 - DNA, 309 bp, Glycine max
  Peptide Sequence Number=SeqID_117106
atgattgtatcttcaacagattctataggacaatgcctggcaataggaaaactagaagatgccttggaagatcgaggttcttcttttggagttgttgctgcttctaaatcttgcaaaaattttatgattctctctgaattacgccttctacaggtggcgttaatctccaaatcaatgggaatcaaatcacctacagtaaatcttctttgcatacaagaaaacaaaatagcaattatccagtccaaaagaacaatgaatgtatgggaaattccgtttgccggaaagcgcaccagatcgttaagtatttaa

SEQ ID NO: 329 - DNA, 135 bp, Glycine max
  Peptide Sequence Number=SeqID_117107
atgtatgtgagtttagccaaggggatgtgtgtgatgaatggcccgaggaagcttgcctcaagaggtccaggaggacaaggcggccgaaggactagttccgccccggagtacgacagtcaccgctttaggagcgtt

SEQ ID NO: 330 - DNA, 186 bp, Glycine max
  Peptide Sequence Number=SeqID_117108
atggagaaaggtacaagtcttcctatggagaaagaagttcctatggagaaaggtacaagtcttcctatggagaaaggtttcaagatcctgttgtttcctatcattgatagtctaggaaaccccttaagaatttttacatgtggtatcagagcatgtgttatgaaatttttgattctccaagaatga

SEQ ID NO: 331 - DNA, 561 bp, Glycine max
  Peptide Sequence Number=SeqID_117109
atgtccaaatcttgtggatttgggatgaccggccctctcgatgagtcgatctcttgctttctcatacgggtggacccttggagaggactacacgtcctcaccatcagagggttgcactccctcacctccagaggactacatgtcctcgccttgagagggctacacgccctcaccttgggtactagttaccctcactgtcagaggactacgcgtcctcaccttgagaggactacacgtcctcaccatcagagggctgcacgccctcacctccagaggactacatgtcctcgccttgagagggctacacgccctcaccttggagggctgcacgccctcaccttgagaggactacacgtcctcgccaacagagggctgcatgccctcaccttgagaggactacacgtcctcgccaacagagggctgcacgccctcaccttgaagaggactacacgtcctcgccaacagagggctgcacgctctcaccttcagagggctacacgccctcgccatcagagcactgcatgtcctcaccttccgaggactacatgtcctcacctttag

SEQ ID NO: 332 - DNA, 452 bp, Glycine max
  Peptide Sequence Number=SeqID_117110
atggttgatggggcatggacggacgacccgacgacagtcaaagaggcagttaaggtgttctttgagcaacacttcaaagaaaatgagaaggacagaccaacattagatggggttgctttcaagaccattgacaatcagcaaaatcaaactctagtgagctgttttcaagaagaggagataagaagggcggtgtgggactgtgggagtgagaagagtccggggccagatggtctaactttcaaattcataaagcaattctggaatataatcaagcctgatgtcatgcgcttcttagatgaattctatgttaatggaatcttcccaaagggctcgaatgcatccttcctagcactcattcccaaagtagcggatccacaattgttgaatgaatacaaacctatctcattgataggttgcacatacaagatagtggcgaagatactggcgagcag

SEQ ID NO: 333 - DNA, 138 bp, Glycine max
  Peptide Sequence Number=SeqID_117111
atgaattcacttcaccagttatatatactagcagtgttgcagtgcagactggtaagtgcagagactgactcagttgaattggggagtgatgatatcatggttggcgtaggatcactgttgattttgccgcttgcatga

SEQ ID NO: 334 - DNA, 791 bp, Glycine max
  Peptide Sequence Number=SeqID_117112
atgacgatttccctgcatacccagactggcgcccctaacacctcagcggcgaccagcgtatccccgctggagcagtcaggctcctcaaaaacgaaattttccaaaaatagtaccgacatttatcagtcagttactgacagtatcatcgcggcactggaggccggtgttaagccttggtcatgcccatggcagcgcgtaccgggcatgtcaggattaccttcaaattatgcgactggcgctgcatacagcgggatgaatatcatgttgttgtggagcagtgcgtcagaacagggattcaatgattcacgctggatgacctacaaacaggcaaaagcggagggcgggcaggtacgcaagggagaacacggcactaccgccattttctataccacgctggaaaaggaaactgacgacggagaaactgactatatcccgattctgaagacgttcaccgtgtttaatgttgagcaaattaatggtttgcctatgagtgacgaagccgttttcccagcagggacttttgagccgttgccgcctgcggaggcgcttttccttaacagtggtgcaaccatcattgagaagggacagaatgccttttttgcaccatcaaccgacgaaatccatttaccggaacgtcgtctttttagcgatgctgccaatttctacgctacgggcctgcatgagttaattcactggtgtggggcaaaaagccggctgaaccgtgaaatgaaagggaagtttggcagtgagagttatgcttttgaggagctgatcgccgagttgggaagcgc

SEQ ID NO: 335 - DNA, 334 bp, Glycine max
  Peptide Sequence Number=SeqID_117113
aatattctataaaaaggttgaatatgtgcttgaagattgtaatgaggttctcgtcaaaatcaacaaatttgtcgtcaacaaagaaggcttagtatgtgtggaaacgttgtgtatgcctgttactaaaccagaaagatttgagttggatgcttttgagttagatgaacctgaagatgctggcaggtatatagttagaaagagcataaagagtgcaaaagacatagttcgtttccctttccaacagaatgccaccatactttacatattgcacactgtgtacagaggcagagagaatctcccattacttactgtgcactatgtaagtttgatttga

SEQ ID NO: 336 - DNA, 381 bp, Glycine max
  Peptide Sequence Number=SeqID_117114
atgaagaggaaagaagaaagattcaataagtttctaaggaacaaaggaaatcaaagaagaataaacttcaattcaaagaaaagaggagaagattcatcttctgttccaaagtgctatgaatgtaatcaacctgaacatctgagagttaattgccctagtttcaagaaaagaatggaaaaaactgacaggaaaaccttcaaagataagaaagcaaagaaagcttacatcacttgggaagataacgatatggattcattcaaagaatcagaaaatgaagtcgtgaatctaagtctcatgaccaaaaactataaaagcgaagaagagaacttcaagatgcattcaatgacttacataaagaatcaatcaaacttgccaaactag

SEQ ID NO: 337 - DNA, 386 bp, Glycine max
  Peptide Sequence Number=SeqID_117115
ctcgtagttggaccttgggttgggtcgatcggtccgcctccggtgtgcaccggtcggctcgtcccttctgccggcgatgcgctcctgtccttaactggccgggtcgtgcctccggtgctgattctgatcctattgtgttggccttcgggatcggagtaatgattaacagggacagtcgggggcattcgtatttcatagtcagagataccgtcctagtctcaaccataaacgatgccaaccagggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 338 - DNA, 216 bp, Glycine max
  Peptide Sequence Number=SeqID_117116
atggcttcctatggtggtgagcttcttcttgactcatcttctcccggaagtggcatctcctctcaactcttcttcttctccattccgctgccattaaaattcaagaagcaaaggactccattgataaagaagatccaaggtctacaagctccaatggagctacatcatgcggtatcaagagcatcttcatctaggttctatcattttcagtcataa

SEQ ID NO: 339 - DNA, 270 bp, Glycine max
  Peptide Sequence Number=SeqID_117117
atggagcttgcatcagcccatgggcccgaaatctaccctaaggctcataagaaccctagggccttctcttgcatctctggcccaatctacttggagttttctatccaatgcccttgcggggtaggattgcatcacaaaccattggtttatgccatgatgccatgcattcttagcctttattttagctacacactaacgtatttcttcatggtgaactcaaacaggagatctatcatctatatagtgcaacctcctagttttgttgcttaa

SEQ ID NO: 340 - DNA, 1053 bp, Glycine max
  Peptide Sequence Number=SeqID_117118
atgctcgcgacggtcagcgctgatgccggtgcacagtgcctgcgcggcttcggtctggccgaggccggcgatatcgtccagctcgccctcgatgctcagcagcgcggtatcgcggatcgccgacggatcgaccttctcgccgttgaccacccactcgccacgcggcagcaggaagtcctggaacaccacggaaatcgtatccaggtagtacttggccggcatgtccagcactgcgttgtactcgtcgtagaaacgacggtgcgcatcggcgtcttccaggtcgcccttgaccaggtcggtgtagaaatcccagtgcgagctgaaatggcggctggggttcatcgacaggaagccggcgtgctgcaggaagcccgggtacacgcggcgaccggcgccggggtaactggccggcaccgtgtggatgacgttgttctcgaaccacgacagcgggttctgcgtggccaggttgttcactgcggtcgggctgcagcgcgcatcgatcgggccacccatcatcaccagcgtgcgcggcgtcggttcgccacggctggccatcagcgaaaccgcggccagcaccggcactgtgggctggcacacgctgaccacgtgcaggcgctcgacaccgaggtggcggatgaattcctggatgtacgcaatgtagtcgtccaggccgaattcgccctcgctggccggcaccatgcgcgcgtcgacccagtcggtcacgtacacgcggtggtcgcgcagcagcgtgcgcacggtatcgcgcagcagcgtggcgtggtggccggacaacggtgcgaacaccagcacgaacggctggttgagcatcgtatgcagctggtcggcttcattgctgtggcgcttgaagcgcagcagcttgcagaacggcttgctcacttcctcgtgcaccacgatcggcacgcgttcgccatcgacgtcgatttcgttgatgccccattcgggcttctcgtaatccttgccgatgcgatggaacagctcattgaccgccgccaggcgatcagcgccgggcatctgcgaccaccagtggccctg

SEQ ID NO: 341 - DNA, 372 bp, Glycine max
  Peptide Sequence Number=SeqID_117119
ggccctggggttccagcattgatcacacgcctctgccaatcattcaggattcccgtcacccctagtaaggacacagatgcaccaccgccacctcatcaggtcgatcccgctgggtcactaggcatggagcgttatctacagcacttggtttgccagcaagcggccaaccaccggggacaggggcagggtttcgctccttttgcatgccctaatccagagcagtttagggctaaggtcgcgtggtccgaagattggcccgaggcccaggcaggggaggcgcctacaagatccccgggcgatgcagaggaggcccgcatggatgaggagatgacggatttgctcagtttcttgggagggagcggagccacatga

SEQ ID NO: 342 - DNA, 795 bp, Glycine max
  Peptide Sequence Number=SeqID_117120
atggaggccatgaaagagaaaatggacacaatgatggaggccatgatgagcatgaagaagataatggaagccaatgcggttacagtttccgctaccagcgctgttgctaaggtgaatccgatgcccccatctggcatcaaccaaatgaatcatccaacctcagctatggtaggcaaagatttgggaacacgccttcccgccatatggcttgcctcccaacttacaccacccaatatggtgtacactcccaatgagaatgtcaataactccacttctatactcattgagagccaacaacctcaatctaatcatgcacatgtctctcaacccatgggggagacacatcaaatgccctaccacaatctagcggactttgagccttgcctcggatatgccactaaagggcaagcagttggtggtatacccctgcaaaacactttggagagccctcagtatcacccacaaccacacccctcacattccacaacggttaaaaaccctcatgctatggcagaaatgggaaagttggattatctagaggaaagactcacggccattgaaggaggcaaagattatgcctttgttaacctagaagagttgttactagtacctaatatcatcacccttcccaagtttaaggtgtcagactttgacacgtacaaggggactacttgccccaagaaccatctagagatgtattatcggaagatgggggcatacgcaaaagatgagaaactgctgatgcatttcttccaagaaaagtcttactggggtagctgttacctggtacactaa

SEQ ID NO: 343 - DNA, 225 bp, Glycine max
  Peptide Sequence Number=SeqID_117121
tccatgatgattggatgtggaattacctggatgttggggaagcttgggaggattgatggggacccggtgttgagagaaacgaggatatgggctacgtgggagtacgtgagctcagttggaggtgggcaacaggggatggagaccttggggacgtcaggtggggtgctattgcccaaaaccaagcttgaccaatcccgacccaacccgggcatagtcagtcagtga

SEQ ID NO: 344 - DNA, 216 bp, Glycine max
  Peptide Sequence Number=SeqID_117122
atggagggtccaaatcttaataacctaccaaacactgacctcaagtggtgtgatcctgtgaagaagaacaacaccttccttacccgattgagcatgcatgcagaaagaagtcctagcaacttgtctatgagcattggattacttgaaggagaaacaactgagaatagaagcaccattgttaggacagaatcaattaaaccagctgtggctgagaaa

SEQ ID NO: 345 - DNA, 402 bp, Glycine max
  Peptide Sequence Number=SeqID_117123
atggtgcttctattctcagttgtttctccttcaagtaatccaatgctcatagacaagttgctaggacttctttctgcatgcatgctcaatcgggtaaggaaggtgttgttcttcttcacaggatcacaccacttgaggtcagtgtttggatgtgagacaactgtccatggaacagtcatttgcatttataggctggttgttgttggcactgagaggacacttttgacactagctctgagagttgaagtttggcagcttcaagtcctactactcctaaattctgtctaccaagtgtttcctgagccttctctaacactgcctgaaggtattttccttgagcctcaatacgtagctgcaggagtctttgcacctgaatatgtggtcagatgggtttttagttag

SEQ ID NO: 346 - DNA, 1485 bp, Glycine max
  Peptide Sequence Number=SeqID_117124
atgcattttctcattcagacagttgctagagatatccctgttgcacctgaaaagtctgctgttgcatttaaaaatgagaatccaacagtttcagtgctagagcagaaagaaatatatcttcttcctactgtacggatgaccaatttgctgcattcccagatagatgtcattctaagtgaaacagatcagtcgaatctggatggatatgacaaaattggaaagcaggcagtcatatcatgtggttcaacagttgacttttatgccaatccagaagttatatacttcactgttactttaacttctaattcaagttccaagctggtaaatagtggggactgtgtgaagaagtttctgaagaagaacaatgatgtccatcatctggatataaatttggactttgatggaggaaaattttccgcaaccttgagattgtaccgtggaagcaggggtgtattagaggttgttatcctagcctttgttttcattctgcagaatatatatctggctgtaatttttacatcgtattccatgaagaatgacacagacttcccaatttatgttcttgaaactaaaaggtcacctttatccagaattgagttggagaatttaaatccgagcattccttcagcactaggcttatgtttgcctccaaagtcaattagctcatggttcttgaaatctgaaagagtgctaatgaaattgctggacaaccatacatctgaggcactgcttgacttgggttctttatcaggccttacagaaataagctttgagaaagaagagggatctgggattaaatctgtgacaaagcttggagtttctataggtccttcttcaggagaaattgttgtgccatcacaaatggtgactttggttccacggtatgttgtttgcaatgaatatgaagaatgtatcaccatacgccaatgctattttcaggatgaggtggcaggtgttatctccattaacagcaaacagagaatgccactacagctgaaagaaggatttaaaaacacaagagagttcagtttatttgagcattttatcagaaagcacagaagtaaaagtgacaattccttgttatatattcagattcaattaaatgaggctggattgggatggtctgggccagtctgtatagcctcactaggacattttttcctgaaattcagaaaacagactaatgaagatacaatatcagacaacaaaatgacacaatttgcagctgtgcatgtggtggaagaaggttctactcttgtctcaaggttctacaagccaccaaatacgagtctgccttatcgaattgagaattgtttgcatagtctatcaataacttactatcaaaagggtttgttggagccagaggttcttggacctgcatgtagtgctgattatgtctgggatgatctaacccttcctcggaggctggttatccgcatcaacggttgtcatttgaacctggctatagactctttctttaaatga

SEQ ID NO: 347 - DNA, 1233 bp, Glycine max
  Peptide Sequence Number=SeqID_117125
atggaaaccttttcacaaacttgggcaacaaagggtattggctccacgtttgcttttagacaaaagatcaagagatcagatgatgggattcattcttcttcttcttcttgcttcctaatcgaagctccttcaatggttgaacctgttatcaagtcgcacaagtttcagcacttcgttgtcaatccgcagattcctctgcgctacctcaacaatgatgatcgtgcttccgatcacgtcaatcttgcatttaaggctgcgactcactcctacgaggtgtgggagacgattcatgagtacttccaactgcagatgaaggttcgtgtgcatcaactttgccccgacctttgctcggttcaacttgatggaaaatccatgtgcgagtacctttcgcagatcaagagcatagcagatgaactcgccagcgttggcattctggtgaagcatgaggagtatgttgatgtgattcttgtcaatcttccacaagaatatgcgctggtcattgctgttattgaaggaaatttcaaaacgcctccggtcaatgaagttgaggctcaacttctttcctttgagtctctcaacaatcagttttgtcagcagtcctttccgagggtcaattacgcgtcgcacggtggttctggaactcgcggtggctcctctggcagtcgtggtggctatggagcctccagtgttagtcacggcagtggtagtgtcttggaacacggtggtgcctctgattgcagtggccgtggtcgcggtgctgatgaatcctatcaaccaccagattctatggtgttgtatgatccaacaacacagcaacctgtcaatttcaaaagttccaacatttggacgaatcctagttacaaatctgctgctcctagtgctatgatcactgattccacctctcaaggttcttctgctgaagccaacacaacttggatcccagactcaggtgcctcgaatcatgttactggtgcagttcaaaacatcactcagttttcacactttgatggtcctgaccagatctacattggtaatggtcaagttttgcaaattaagggttctggtgctgttggatccaattgtctctattcctttcctcatctaaggctgcacgattcttctgattctgctgtttccccttgcaagaataaggctgatgtacattctgtccctgtacatttcctggctactgtcacctctgttgatgttccagctcctgctgttgtcttctag

SEQ ID NO: 348 - DNA, 348 bp, Glycine max
  Peptide Sequence Number=SeqID_117126
atggagtttggccttaagaacctcaaatctggatggagagcagtgttgttaaatggcggccatggcggaaaggcgtggcggttttttgaaaaaacgccaccgaatagcggtggcatggcgggttgtgaatggcagcgccatggcggtcatggcggcgtggcggaaatggcagattttttttgttttttgtccgcggtaggagttgggctgacccgacccaaccctacccgttgtgaatcagaacgcagccctccaactaaaagcgcactcagccgcaacgccccgcacccagccgcgacaccccctgcatgcagaacgcagccaacaaagactaccctacggcggtga

SEQ ID NO: 349 - DNA, 960 bp, Glycine max
  Peptide Sequence Number=SeqID_117127
atgacattaggacaagtattcctacgtaaatgtatcaaaggtaaaggtttttcagggacaaaacggtactttggtgatttagggaaaactcatattaatcaattcatgactggtcagcagttgagatcagctggctccaatatagcttttgcagttgtagctgaaatatcggattctgttctgaaaggtgcagaggcgaatggtttcaatggattggtgagtggctttcaccaaggaattctaaaattggctatggagccatcagttctgggaactgcattgatggaaggtggtccagatagaaaaatattgcttgatcgaagtccaggagtcgatgagttatacattgaaggatatatccaagccatgcttgatacagtttatagacaagaataccttagagtgagagttattgacaatcaggttatcctgaaaaacctacctccaaatcattctcttatcaatgagataacgggtcgtgttaaggagttccttgtgagcaaggcattgctaaaaggagatccctcaaccacatcgcgccctttaagccgtcttcgtggagaaagtagcttgacttgtttggaaatctgcatacttcttgatatagaatcgctaatggccgaatggagaatagggccaacagtgttgacattgtgcgaacatctttttgttagctttgcaatacgcattctgcgaaggcaggctaataagtttatgttcagcataaaatggggaaagaagtcagaggatgttggcaatgatgccgaagtgccagaaaactctagtcaaaaagtgcagaaagtgagcttcattcgaaaatggggaatcggcaaatttgtcttgtctggcttgttggcatatattgatggacgtctatgccgtggcattcccaatcctgtagcacggagagtagttagtggttttctattgagttatattgaccaaaatgatgatgaataa

SEQ ID NO: 350 - DNA, 435 bp, Glycine max
  Peptide Sequence Number=SeqID_117128
atgttatcatattccattcacagtgaaagcacagcagcttccattgtgaaggaagaagatgacaatgagagcaaagattttacaccaattgtaattgcaaagcttgggaatctgcacatgattagtatttctaataatcaccagacatataaccagttcagtttacagtacatcaatttggagcttaagtggaatggagctccctttgcatcaatgcttcgcagacatcaattagattactgtgactcaaatgatagtgtactgacggttgtttttgttctacttgcatcaagttccaatgttaagcaatttagatactcatcaatttttcttcagatcattgcaaactttatccctggggaatcacgttcaagttacagctcaacgcaggaggctctgaggtccttaattcatagtgtgattaaggttgtttaa

SEQ ID NO: 351 - DNA, 219 bp, Glycine max
  Peptide Sequence Number=SeqID_117129
atggagtgcgtggatgatatgatgctcacaaagcctcgaagggaaagggtggcgcgaggggatgggtggtgtagaggagggaggcacgatctggggtggcatgagggagggtggcaacacatgtgttctggatctagactgggtgacggagacagttttgaatttaaggagaaaggaaatgggggtgtggggattgatgaatgggcaaaagagaaatga

SEQ ID NO: 352 - DNA, 204 bp, Glycine max
  Peptide Sequence Number=SeqID_117130
atggctaccctaaccttgagcactgaagatgtcacccaggtagtaaagatctcgaccttgagcactgaaggagtccacttcgtgtgggtcatgactatgggtcgtgaggaggagcgaccatggatgagtgtgggttgtgaagaaaagcatccaaggaaagggaaggggagcggtgtgaggagagaaagagaagaggttctctga

SEQ ID NO: 353 - DNA, 2109 bp, Glycine max
  Peptide Sequence Number=SeqID_117131
atgtttcactacaacacaaagttcgctatggtcctcactttctttatcttcatgttctgttttttctgttcaacgagcgccagaagtaacaacaattgcgagcgtagctgtggagaacattccctgcaatacccttttggcttctcttctgattgcgaagtgaaactaaattgcagcaaagagaacaaagctgaaattggcgagttagaggttcagagcgtgacctctgatggcatcttcgttagtcttccggtgcagtgcaaccgcagcgtgagtttcattgaccctctcttcagagacaactttgctcccacgtggaacaacacctttcttgtgcagagctgcaagcccaagctcgatggctgtgttatccccacatcgagtttcgctggcggccgcaaagatgtggaggggtgtgaagatcttagttgcttcacgcagttgcagaagagtaagagtaatggctcgagggaagatgatgttctcacgcacagtgattgggagcgagttgggtgtagattcttgttctctgctcttgcttttgataggagtaaagtgaaggagctctcgctccaatttcagatggttgaattggggtggtggcttcaaggaaactgtagttgctccaacaatgcgtcctgcacggaggtgaatactgatggtggaaaacgaggcttccggtgccgctgcgatgaaggtttcatcggagacggattcagagccggcgatggttgccggagagtttctgaatgcaaagcttcaacactgtggtctggcggatgtaggaaagcagtcaaaattggtgtccttgttggagggatcatatttggaggtatccttgtggctgctctgtttcttgtatgttactttaataggcgtcagtcctcttggctgagaaaacaagtgacagtaaagcgcctattacgcgaagctgcaggagattccactgttcctctatatccctacaaagaaatagagagagccaccagttttttctctgaaaaacataggctgggaactggggcttttggcacagtttatgctggacaccttcacaatgatgagtgtgttgctataaaaaagattaagtatagagacaccaacagtgttgaccaagttatgaatgagatcaggctcctttcttcggtgagtcacccgaatttagtgcgcctcttaggttgctgcatagaagggggagagcagatacttgtttatgagtacatgccaaatggaacactatctcaacatttgcaaagagagaggggtggagtacttccatggacaataagactcaccattgctactgaaaccgctaatgctatagcatatctccattccgcaaatgatcatccaatttatcatagagacataaaatccagcaacatactcttggattataattttcaatcaaaagtggcagattttgggctttctaggcttggcatgtcagaaacatcacatatttcgaccgccccacaagggaccccgggctatgttgatcctcaataccaccagaacttccacctttctgataaaagtgacgtctacagttttggagtggttttggtagagataataacagccatgaaagtggttgatttcgcacggcctcagagtgaaatcaacttggctgcacttgctgttgataggatcaagaagggttgcatagatgacatcatagatcccttccttgagccacatagggatgcttggacgctctattctattaacaaggtggctgagcttgcatttagatgccttgcttttcatagtgacatgaggcctaccatgattgaagtggctgaggagctagatcttatcaggcgcagtgggtgggcgaccatggaggaaaccatatgcatggcttcttcggttgggtccgtgtgttcatcgcctcgaaatggaagtgttaattcacttagaggtgttagttttgagagagctgcaggacttgggagtgagacattgattgttccccacaagactgatgtttttttgcaatcaattgaggaggtgaaggacagctctcctgtgtctgtgcatgatagttggttaagtggaactagctcaccttcaacaaatagcttgttaggacatgtagttcagtga

SEQ ID NO: 354 - DNA, 255 bp, Glycine max
  Peptide Sequence Number=SeqID_117132
atgtcagaattcacaagcaattgtcctcatcgaattttagccaaactgcatcaattagactttgcaccttatgtttcagggtcatacaatgctcaatggaatgccccgaaactcctccatgataagcacatgttgcattcgagttatatcctcgggaaaatggagcaggcgagttttgtggccaatttaggggtggcctttgtggatgattgggtgttcttggctggtagggtggggggtaatgagaaggaatga

SEQ ID NO: 355 - DNA, 834 bp, Glycine max
  Peptide Sequence Number=SeqID_117133
atgctgttccgtctcggcgacgaggtgtgcctggcggcttacgagcgcagtttgcaggcggtggtcgcccggcatcaggtcttgcacagcctgattgtccagatgccatcccaaagcgccgtcgcccgcgcctgtgaactgacgctttcgctggagcgcgtgacgctggcggcggcgcactggccggacaggctacggcaggatatcgaccggccgtttgcgctgggggcggaattgccgatcagggcagccgtttaccgggtggcgcagccggatggcgggtgggtgacttacagcctgattctggtgcatcacctggcgtttgacggctggtcgcagccggtgctgttgcaggagctggacgtgctgtatcaggcgcagcggcaagggcaagaggccgggctggcggcgttgccgttgcactatggcgactatgccgtctggcaacggcgctggctggaatccgctcaggcggatgaggcgaaggcgtattggcggcaagcgctggatggatggcaggcgctggaaatgccgctcgatttcgtgcggccggcccgcttcgatcatcgcggtgccaaccacgtcatcgcgctgccggagaccctgacgatgcaggcgacgcagttcgcccggcgccagggcgtcacgccgtttgcgctgtatctcgcggcctttaacctgctgctcggttacttcagcggccagcaagatattctggtcggcacgccggtcgccaaccggccggtggcggagacccgctcggcgatcgggttcttcgtcaacacgctgccgctgcgttcgcagatcgacgatgcggcgtcgctgaacgactat

SEQ ID NO: 356 - DNA, 342 bp, Glycine max
  Peptide Sequence Number=SeqID_117134
atgccgctggggggatattactataaggcgaaagagaaactgtgtccgataggtatgaagtatcagaagattcatgcttgccccaacgattgcatactgtgtaggcatgaattccaagaaatgtccaaatgccctatctgtgggacttcacggtacatcaagcttatcgataccgtcgacctcgagggggggcccgtcgggaaacctgtcgtgccagctgcattattgaatcggccaacgcgcggggagaggcggtttgcgtattgggcgctagcggagtgtatactggcttactatgttggcactgatgagggtgtcagtgaaatgcttcttgtgccatga

SEQ ID NO: 357 - DNA, 240 bp, Glycine max
  Peptide Sequence Number=SeqID_117135
atgggtagaatattacaagagtatgtggctatgaaaaccgatgctgttgttgctagtttaatcgattacgatatagaagaactcaaggttgcagccaataagctcctccacgatgccaccatgctaggaggcaaaggctttggcacttctttctttaaatggatagcttcctttgctgccatgtataagttcaattttcaccctgtttgccaataccaaccaatacatatgtttgtctag

SEQ ID NO: 358 - DNA, 606 bp, Glycine max
  Peptide Sequence Number=SeqID_117136
gaggaaattgccaggaggcagtggactcaacttgcggcacccatagctaagtatgatccaaaaatagtcatggagttatacgccaatgcatggcccacagagaagggagtcagggacaagcgctccaaggggcaacactacgaattcaatcagaggaggagccaagcctcggggttcgatgaggaggccatcagtcaacagctgtgtattacgggggatcatgcctcccagacacccactagacctgaagaagtccaacaggacactagagtttccagccttgatcacgggcctctactagttctatggggtgccggagaaggaccaccagcagccagccgcagatacgccgccgccacctctatgcatgtgaccgaccagcaggcgactaatcttaggggtcaagtgcagctgaatgagagcttctaccagtacaccttgcatcagcagagccaagatcctagccctttcccgtggcctaccctagagcagtttggggccacagttgcatggccgggagataagcccgattttaaggcaagggcaggacccgcaggggcccctggggatgaagatggagctcaggaagatgatgacatggccgat

SEQ ID NO: 359 - DNA, 228 bp, Glycine max
  Peptide Sequence Number=SeqID_117137
atggctgaagacatgaacgtcgatattgtcactcaagtgcagactactacctttgtcctagacaagtctaagattgaggaacatgttgacacactgcttgacatggataaggtagccttcacccttaccatcaagaagccaaactctgcagcacctatcaaagagcttgaacaatggaatcaagtaataagaaatgatgctagaaatgatgctgctttgattatgtga

SEQ ID NO: 360 - DNA, 123 bp, Glycine max
  Peptide Sequence Number=SeqID_117138
atgccaaaaatgtatagactttctacatggcttaggccagcaacatggcaatccactaacaggttaatgactaagaaaccactcactcactggtatgaatgtgtgcaagccctgaacaattaa

SEQ ID NO: 361 - DNA, 199 bp, Glycine max
  Peptide Sequence Number=SeqID_117139
cctggcttctacgcatatgcttcacttgaggttttcacctttgtctttgtttatgctattccacagctacttggtaactgtcatgggtttggtaattccctggagcataacactgttggttgtagatgcatactctgtctttataaaatgtttacccctccaacgaagacttgtactgatcgtctttctgggagacatg

SEQ ID NO: 362 - DNA, 201 bp, Glycine max
  Peptide Sequence Number=SeqID_117140
atggttaacacaatcaagattgagaaatttacaaggaagaataacttcaacctttggcgcatcaagatgaaaggtatgacactgaaggaacatcttgatgagctaaactctgttatgatggagctatacgacgttgatgtcaagatggaagatgaagatatgacaatgattatgttagcctttcttcctccccccctatga

SEQ ID NO: 363 - DNA, 441 bp, Glycine max
  Peptide Sequence Number=SeqID_117141
atgacttcatcatttctcatgggtacagcagaagtccctatgacttgtgtttatcatagcaaggtggagaatagtttccacatctatctattactctgtgtgggcaacatgctgatagtatctcaaaatttgttggcaactcagaagctgaagtcactacttagtaatgaatttgagatgaaggacatgggagttgctgaaaagattcttggtgtggagatcaagtctagaagaagctattactatgtcagaaggaatacactcagaaagtaccttaagggtacaactgatattggactcgtataccatggagacatgtcctgtgctatcgttggttactcaaattttgactatccattagatttggatgcaaggaaatctgtgactgggtatgcattcataattgacaattctcttgttagttggaaggaaacactttag

SEQ ID NO: 364 - DNA, 204 bp, Glycine max
  Peptide Sequence Number=SeqID_117142
atggttgttgttgttgtcattgtcgtcgctttgaccactgttgtcaccaccaataagaccgatgtcactatcgttgttgacggcggcaacgacattgtccatgttggtagtgacaacgatggtcataaagacaatttcatgttggtggtgataacgatggttatgatgacaatgatggtgattgtagtgacgatcttgacataa

SEQ ID NO: 365 - DNA, 486 bp, Glycine max
  Peptide Sequence Number=SeqID_117143
atgggagcgctcagttatttgcctcattccagctataaagagacgtaccaccagggcgaacttgatctgcacgaattaggtttacaggcgcaggcgatatttgatggtcaaacggatgatgtgctcggtgcattagtcgcagcgggcagttcaggtggtgccagaccaaaagcgcaactctatttttctgacgacgattttctacattgtcgggccattgccaggcccggtgatgaagcctggctggtgaaattcacttccgggcatctcgctctgggtcatgaagaaggcctttgtgaagcggcgtacctgacgatggccgcccgggctggcctcgccgtgcctgactggcaactcttgccagcccctgccgtatcaggggctcgctattggctggggcttaaacgttttgattggattagcgggtcggaacggaatggcaggacgatcagggtaactggtctctggccccgttttacgatgtga

SEQ ID NO: 366 - DNA, 501 bp, Glycine max
  Peptide Sequence Number=SeqID_117144
atggaatcaaagaagagaaaggcacctgccacaccttcccaggtccgatatgaccgatccaagttcacttctcctgaggcccgagaaaggtacattgatattgttgtaccgaggaagcttcttccattcaatgaagaactggagagaagaaaatgggatgaggaattgaccagttttgttgaaggcagcattgatgttgccattgtgaaagagttttatgctaacctctatgatcccgaggataaatcacctaagcaggtgagggtgagaggccatttggtgaagtttgatgaggacacgcttaatacattcttgaagacccctgtaatcattgaggagggggaaacattatcagcttactccagatttgcactcttgaggcctgattctcaagagttggcaactaagctttgcatcccagggatgggatttgagctgaatgctaatggtcaacctctaaagatcctcaggaagaacctgaccacactcgctcagacttaa

SEQ ID NO: 367 - DNA, 150 bp, Glycine max
  Peptide Sequence Number=SeqID_117145
atgacatcgattgattttgtcaaatatgccaaaaggtgtgaggaatgccaaagatttgggattcctaagaccataatgactgaccatggcattgtatttacaagtaacaaagttgtggcatttgacctagagagtttggcattaggttag

SEQ ID NO: 368 - DNA, 372 bp, Glycine max
  Peptide Sequence Number=SeqID_117146
atggtcgctggggagaatgttgctaagcagcaacatcatccagatctgcgtgagggtggtcatgctggtgcacatgatctgcacccatccccctactaccctccgggcaaagtcctgccctggaacgcacaacaaatggctgataacctcctcatcgaagccgaaggcctgactccacctctggctgaactcacaatgccggccttcttccaagaccagtggatgccccaaaatttgattgatggcatcctcatcaaaggaaatccactggccccttacccaggagcgcttatctctgactcctttttctataagccaggcgttagcataaaactccacgactatctccggatcgaacttagccatgggtga

SEQ ID NO: 369 - DNA, 647 bp, Glycine max
  Peptide Sequence Number=SeqID_117147
atgactcaggtgagtgtccacatcgcccagctgatttcagatgctatctatcagtttgcagggattatgcctccgagacacccagtggacccggagaagtccaataaggccctaggatttcttgctttgatcacaggccttttccagttctatggagtgtcgggtcaggcaccccagcagccagatgaggaccagcagcagccagctgcagatgcgccaccgccgcctgtagaggaggtaccatcgctgaggtccatctccgatcacctgtggaggatagaactcctgatgcagaagtacatgcagcatgtgactagccagcaggcggagtatgctgagttccaagaggaaatagcccggaggcaatgggctcagctcgtatcacccatggctaagttcgatctggagatagtcatggagttttatgctaatgtttggcctacagaagaaggagtcaaagataagtgcccctgggcctttggcttcgatgaggaggctatcagccatttgttgtgtgtttcggggcaagactttgcccaaagcgtagtagggagacaggtgagtgtccacatcacccagctgatttcagatgctatctatcagtttgcagggattacgcctctgagacacccagtggacccggagaa

SEQ ID NO: 370 - DNA, 456 bp, Glycine max
  Peptide Sequence Number=SeqID_117148
atggtgctcggtgcacctagcaacacccatctttcggatggaggagtgaatgggctaggggaatgggaagaatcaaaagaattctcagactgtgtcgttttgaattctttgacaagggagaagggagacacaaaagaatttaggcagttagtccttcgttcttttggaaaagggagaagagagacacaaaaagaattcagacggttagtccttggcgaattctttttggcaaagggagaagagaatgaaaagatgaatagcacaagttttcaaggttttgaaaaccagaaaacttcagaaagcttttggtacaaagaagaagaagaagttcaaagagattcaaggcttgtaaaggattgtatgaataagtatcaaagtgtcttgaaaagcaaatcaaagccttgcttttatagactcttcatgtctggccaagaagaccatttagaagagttataa

SEQ ID NO: 371 - DNA, 1532 bp, Glycine max
  Peptide Sequence Number=SeqID_117149
atgaatgcattactatttcatccaagcttagatgcagcactttcagaggaagcaatctcaaagattgaggaaaggaaacacacaaaggtgatgaagaaagctcatagtgcaatcttgcttagccttagagatgaaatgctttgggaagtggctaaagaaaagtctgccatggtggtatgggagaagttggagtctttgtgcttgaagaattccttggcaaatagattgtacctcaagaaatgcttgtatgcatcattgatggaggaggaaaagcctttgaagaaacatttggatgatttcaataggatcatcttggatttgaatagcattgatgttaaggccactctatcaatggttgaggttaaggcaacattaaactcaaaagaaagtcaaagggagaatgactccaagaaggaagaaacagctaaagggctctttacaagtaacaagaatgggaagaaggatttcaagaacaataaatcaaagttcaagaataagaaaatgaataagcacaatgtggatgtggaggccctagttgtgtcaaacgaagactctaaaaaagagtggatcttggattcaaggatcagaatgtacaacggaatggataaggtgctggaagatgttagacatgtcccagaattgaagagaaatctaatttctttaggcacattggacaatgatggttgtggctacaagtgtgatcaaggtagccttgaagtctataatggaaatatgttggcacatgtcagtcaaagagggatggaagaattggcaagacatgttgcttttgtgcaaaacaagattgagtcattgaatttttgtgagcattgtgtgcttggcaaggcaaaaaggttgaaatttcccaccaacactcattccagcaatacaactcttgattatgtgcatgctgacctatggggaccatccagaattgagtcacacggaggggcaaggaagttgaagaaactagggacaagtaatgggcttgaattttatgatgaaatgttcaaaactctttgcaaagagaatgacattgctagacacttaattgtgagagggacaccacaacaaaatggcttagtggaaaagttcaatagaaccatattggagcaagtcagtggcatgaaagcttattatggtgagctgaagacttttggttgcattacttatgcttatctcaagcatgacaagttggaattgagagccttaaagtgtatcttcataggctatctagaaagggtgaagggacataaactttggtgcttggagtctggacacaagagggtcttaggaaggttcaatttgaaaggatcagagttagttaccactcccttagcacaacacttaaagttgtttaaggagcaagagccaaagccagatctatcatattctatgagtgtggcaagcagatttatggccaatctaggcaagaagcatttggaggctgctaaatgggttctgagatacatatctggaaccattggtgttggactgaagtatgttaatcatggtgaagttcctaagattgaagg

SEQ ID NO: 372 - DNA, 249 bp, Glycine max
  Peptide Sequence Number=SeqID_117150
atggggagtagttgcattggcgtacctctacgaccatctctcctaggcgagctaacattttcacatccatccagtgttggctacttagagactttgggttatgatgttgatgacccgctagccattagatggaagccaatgagaggtatcgagaatgcctttctggttagggagaaattgataagctcgagggcacaagtcatcattagttcatacaacaagctttctgattgttgtcgaaggacttag

SEQ ID NO: 373 - DNA, 258 bp, Glycine max
  Peptide Sequence Number=SeqID_117151
atgtcactacttgttgatgggttaaccaaggtgacaacggataagtggatggatataacggacatgggacatgtcattgcatcaaggtataacgtttatttaaaagaacgttgtcccttaccgcctgtatcattgttatggtctagcaattgtcatccgcaggcgaagtcatggccaaatccatatattagcagaatgcagcattacaagagctttgtgatgttcaagagagactatgttgacttaaatgatgattga

SEQ ID NO: 374 - DNA, 247 bp, Glycine max
  Peptide Sequence Number=SeqID_117152
atggcattcttgggagagacaagcagtcaaacagttgtgaactccacattaggttttatttttccaaatggatccattgttcacaacgacagtgatgtttccttccaagcttccactccagttcctattcgagtacctaacgggtgtgattttcaaacgttaaaaaccaaaatacacaatacccttaagctaaccgacaagcaatttttggatgaaatttactaccgacagcctttcacgtatgcag

SEQ ID NO: 375 - DNA, 481 bp, Glycine max
  Peptide Sequence Number=SeqID_117153
cctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcggattcccactgtccctgtctactatccagcgaaaccacagccaagggaacgggcttggcggaatcagcggggaaagaagaccctgttgagcttgactctagtccgactttgtgaaatgactttgagaggcggggcactgcccctctttttggacccaaggtcggcttcggccggtcgatccgggcgggaagacattgtcag

SEQ ID NO: 376 - DNA, 618 bp, Glycine max
  Peptide Sequence Number=SeqID_117154
atgtttgagatgttcaggaaactcgttgcttggaaacccgaagatgaatatcaagttaaggaaaatttcaaatctaaaggatcaaagcatctatctcaaattcttttagagaagttctccatccaagccaagaagaattattcatctgaacaagggggatctatgcacacagggggatctatctcagcccttgattggatagtgcatttgtttcataggtttggaaaacctccccacattgtgaagctgttcaaagagacacgcagtaggaaaaaggacaacacttgggtggataagagatcaaagcaaaaacctatgccttggggacgtctttatggggctggaaacatgtcctcccattataggcttagtgtggaatcactaacacaagtgaatcgagcatcttgtaggtcatctaaaaccattgctccaaaaattgaacaacaaatgaaagagcaacaagaacaacatcaaaagacacaagaaaagatgctcaacagcattagggaacttaatgcatatgtgagtgaccttagccagtgtcttcaatctcatcatcatcacgattcaaacaatgaggaatactttgatcatgatgacaaataccatcgcacctag

SEQ ID NO: 377 - DNA, 282 bp, Glycine max
  Peptide Sequence Number=SeqID_117155
atgcagagtattcacgactcggatcagcatcggcctatcattagcatggaggatttcatggcacaggtggcctggccaagagtccagccttctcctttggggggaggtgaggctttcacagcccaggagcctcagccaaaacctcagatgaaggtagctccagaggccactccaaaggctactccacaggcttcaccagttactacaccaggggtagaggtctctgaggaggaggattacgctgcttatgtggattatgcagctgatatgactgtagcatag

SEQ ID NO: 378 - DNA, 165 bp, Glycine max
  Peptide Sequence Number=SeqID_117156
atggtggttaagtcgactaatggtcgagatcactggactgctttgaaggaattgtttgagatgattagggatttcaatttgaaacttaatcaaaagaagtatttgtttggtggcctagctggaaaacacatgattagagacatgtacaatcaccttaggatttaa

SEQ ID NO: 379 - DNA, 288 bp, Glycine max
  Peptide Sequence Number=SeqID_117157
atgagtcatcattcatcaagtgttaatggtgagggaaggcataggtcacagcttagacctcactcccataggagagaaaaggaaagaaagcctcaaaaggctaacattaacctcccatacttctatgggaaggacaatgtagaggcttacttagattgggaaataatggtagagcaacaacttaaaaggaagtctacttcaaaatcttatggccctcactcttatccaaagaaagaccaaggtcaaggcatcttaggggcaacaccttctaagtccaaagatgataag

SEQ ID NO: 380 - DNA, 222 bp, Glycine max
  Peptide Sequence Number=SeqID_117158
atgcaaaacagccaaccgcgacaggctacggcacgacggtctggcgaggcaggcaacggcacagcggatgtcaacttcgaggttctgagcttcgcgcgtggcgtcgtggagaatccctacttgcaaaccagccccagcttattaagggaaagctctttgcctataatatgcgaagttggaggaggactatggacaagcgaagcgagctatgaaggcttatga

SEQ ID NO: 381 - DNA, 156 bp, Glycine max
  Peptide Sequence Number=SeqID_117159
atggcggaattgtttgagcttccgaatcggttagcaatccttcctttcaggaacaaagtccttttgcctggcgccatcatccgaattcgctgcacttcccccatcagatggggagaggagaaattgtttcttgatttggtgtattggagaccataa

SEQ ID NO: 382 - DNA, 255 bp, Glycine max
  Peptide Sequence Number=SeqID_117160
atggcacgcagtgtgtttgctttgtgcccctattttagggacctacatgggagggagctaaaagggcttttagtgataattcccaaggttgtcatatctctcttgatggtctctagaggtatcatccccgtcgaagaacatattgcggcagtaggggctgtcgcaacctacccttttgcgggagagcgaggcgaggctcacgggtgcgtcttccataggaggaaaatgcgtggagtcgccaccaacgattattaa

SEQ ID NO: 383 - DNA, 156 bp, Glycine max
  Peptide Sequence Number=SeqID_117161
atgtggtcattgctgaaaaggaggaacgcaagtggggttggattctatgtgtttggctttaagcttaaacgagcagaccaccgtttggccttgtatgtacccctaagggaagtggattcatcactagcatttgccactcatgttcatcggatctaa

SEQ ID NO: 384 - DNA, 501 bp, Glycine max
  Peptide Sequence Number=SeqID_117162
atggagaagagtgaagagtgtttttggaacttggaagaggaatttgaatttctcaaaacgtgttcgtactcacaccgtgctgtactcattagtcttcttccaaagtcaagcaatctctgtgttcgaaatggctcgtacgaagcaaaccgcaaggaagtccaccagaggaaaagcttcgagaaagcaacttgccacgaaagcagcacacaagtccgctccggcgaccggcggcgtgaagaagccgcaccgtttcaggccaagtacggtggcgctaagggagatccgaaagtaccaaaagaacaccgagcttctcataaggaagcttcctttccaaagactcgtaagggaaatcgctcaggacttcaagaccaatctctacttccacagcagcgccgtctccactctccaagaagccgtagaggcctacctcgttgtgctcttcgaggacaccaacctctgcaccattcacccaaaagagttaccattatgccaaaggactga

SEQ ID NO: 385 - DNA, 182 bp, Glycine max
  Peptide Sequence Number=SeqID_117163
atgagtgtagcttcttatgaggtgcaccaagaagggtcaagacgtgtagagtatgaagtggacgattttaggccaacaacaccaggccatagccctggtgttgtggtgaaagatttgagtggattgactggagaagctattgagctagaagaagattttcacaagtttcaaagtgggggagg

SEQ ID NO: 386 - DNA, 138 bp, Glycine max
  Peptide Sequence Number=SeqID_117164
atgtatcgtgggccccgtggctcgttcggtgtagaaggtcgatcgaaagtcggcccgtccgggcaggcagaaggaatatacactaatgcaccggatcccatcagaactccgcagttaagcgtgcttgggcgagagtag

SEQ ID NO: 387 - DNA, 600 bp, Glycine max
  Peptide Sequence Number=SeqID_117165
atggaattggaagccgaagaagacggctacctgattgccattctcaaaggtgacggagaaactgttccagtaacggaagtcatcggttacttgggagaagaaggagaaaacatcccaaccgctggcggctctgctcctgcggaagcaccagctcctgcaacagcggcagccagcacagatgaagataagagtgatgatgcttacgatatcgttgttatcggtggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 388 - DNA, 240 bp, Glycine max
  Peptide Sequence Number=SeqID_117166
atgggtcagctccagcgacaagcctttcgcaaagcttatggtaagatctgggacctaaccgtggcagaggactccacggaggccattgcctctctcgcccaatattacgaccagcctttgaggtgcttcacctttggggacttccagttaacacccacagtagaagagtttgaagagatcctgggatgccctctgggaggaaggaaaccatacctcttctcagattctatccctccttag

SEQ ID NO: 389 - DNA, 207 bp, Glycine max
  Peptide Sequence Number=SeqID_117167
atgttgagttcagctcatcagtgggctaagcgcgcgtccactgctaagcgcagcttcagcgcgcttagcgcgacagaagaatctagcaaagcatcaatatcaaggtcacatgctaagcgcaagatcagtgcgctaagcgcagcagttgtctttagccaggctcagcgcacgactggcgttaagctcaaatccacttactcgtgctaa

SEQ ID NO: 390 - DNA, 216 bp, Glycine max
  Peptide Sequence Number=SeqID_117168
atggcgaaaagggtgtggatgaccataatttgcctccgcgtgccattgaacttgctgtatctagatggcgaaaagggtacggatgacataatttgcctccgcgtgccatcggacttgctatctctggatggcgaaaagggtgcggatgaccataatttgtctctgtgtgccatcaaacttgattgcctctggatgacgaaggggagactaaagtag

SEQ ID NO: 391 - DNA, 321 bp, Glycine max
  Peptide Sequence Number=SeqID_117169
atggcatacaaagaccgtaatggtcgctcgctttccttgtttcgacactatcaaagtccccttatcatccagagacaagcaagtccgatggtatgcggggacgatgatggtcagacgaacatagtcatctgcttcccttgtcgagagactcaatgtctgttgaccaaagctactgaagtctcccctgctatcccgagacaagcgagtcccatagcatgcggaggtcgtcacgattatccattttattactttcaaggcaccaaagcttttgctgatgcacctgatgtcttttatgctctttcttttgacaggttttgctga

SEQ ID NO: 392 - DNA, 594 bp, Glycine max
  Peptide Sequence Number=SeqID_117170
atggatcaactccaacatcaagctttccacaaggcctatgggaagatttgggatctagctatgatagaagtctctgtcgaagccattgcatccctcactcagtattatgatcaaccgctaaggtgcttcacatttggggactttcagctagtgccgactgtggaagagtttgaagagatcctgggatgtccactaggaagacaaaagccatatcttttttctgggttctatccctccatggcaagaatagccatggtagtcaaaatctcaatgcaagagttggaccaagtaaaacaaaacagaaatgggatagttggaataccaaggaggcacttggaggaaaaggcgaaggtgttggcggatcaaggtgaatgggctttgttcattgatgtcttggcgctattggtatttggacttgtcctccttccaaatgtggatgggctagtggacttagcggcgattgatgccttccttgcttatcaccatagcaaggaaagtccggtcgttgctattttggccgatacctatgacactttcgaccgaagatgcataaataatggcacaaggattgtttgttacacaccagctctttat

SEQ ID NO: 393 - DNA, 612 bp, Glycine max
  Peptide Sequence Number=SeqID_117171
atgacgatccagcagatcgcgcgcctgcacccagcgttcatcaccggcggcgaggttaagaaagcgggtcagcgcgtgcgtttccagcatttcgcgcagttcaaacagcttttcggcgtactcctgatcaaatttcttcattcgccagtggccgcgtttaaccggttccagcaggttatagcgcataaagcgcagcaggaactcgcgcaccaccactggactgacccgcacctgctgcgccagctgcagttcggtaaaactgtcgcctggcatcagcaagcgctggttaatcaggttaaaaaacgcctgctcaaactgcaccgcctgttggtcgatcggtgggctgagtacgctaaacccatcctcctcgcagggatcgcgcacgatcacgtaggtctcagccactttttccagcacgccgcgctgatgcagatgctgcagcgtgtgccgcaccgtggtgcggctgatattaaacatctcggccagcgccgcctgcgggggcagcggcgagcgcacatggcggcgggcaatggcttccagcatttgattgatgacgttctggcgcagattccgacttcgactcaaacggccctccggttttttatgcattaa

SEQ ID NO: 394 - DNA, 507 bp, Glycine max
  Peptide Sequence Number=SeqID_117172
atgcgccaggcgacaggcgtggatgaacaaatcgcaacggtgctgcatacgctgcagcagaatgatgcgctgaagaataccgtggtggtgatcacggcgcagcgcgccattaccttcgacaacagcgataatccgggcaaccgcgcgacgctgcaggtgccgctggtggtgcactggccgaataccccggcgcagagcatcgatcgcctgaccgatcagcaggatgtgatgaccacgctgatgcagcgcctgctgcacgtgcgcaccaatccggttaactattcacagggtgaagatctgtttgccgcgcagcgcagccataactgggtcgccagcagtgaagatggcaaactggtggtgactacgccaacggtgacgctggtgctcagcaacaacggtaactacagcgcgtacgatgcccagggcaaagagctgaaagatcataaacctcagctggcgctactgttgcaggtgctgacggaagagaaacggttcacggcaaactga

SEQ ID NO: 395 - DNA, 636 bp, Glycine max
  Peptide Sequence Number=SeqID_117173
atgtcagtctatcaacgtggcattcgccgccgccttgcgccgatgctggagggcaatatccgtcggctggcgctttgtcatgcggtgttactgtcgctgcctggcgtgcctgtgatgcgctatggcgatgaaatcggtatgggcgaggatctgtcgctgaaagagcgttatgccgtgaggacgcccatgcagtggtcagccggggtgaatgggggcttttccaccgccgcggcggaaaaattactcgtcaggccggttgccagcggcccctggcgatatcagcaggtcaacgtcgaactggcgttgcgtcaacgccactcgttgctgcagcgagtgcggcagatggttcaactgcgcgccgaatatcatgagcctggcaccaccccctttgagctggtatccggcttgccgccatcggtgttagcgctgcgctaccgcagtcaatctcgcgatctgctgatgctggcgaacttcagcgaacgcccggtagaggtacgattgccacgtcaggagacaggttactggtcctgcgtgctggaggaccaccgttatcgcgatagccctaccggcggcaaggtctgccggttacagcttgccgattatggttatcgctggtttagccgccagcacgattaa

SEQ ID NO: 396 - DNA, 875 bp, Glycine max
  Peptide Sequence Number=SeqID_117174
ttggaactcttacgtgccgatcaacgtctcatttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccacctaattcgaaagaagaagcaatcttagaaagtattattcacttggctgcgaaactggaattggtagtgactgcagaaggggttgaaacgcaggagcaagcggatattttgacacatcttggatgcaatcaattgcagggatatctgttaggtcgtcctgtgaatgttgagaatctaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 397 - DNA, 129 bp, Glycine max
  Peptide Sequence Number=SeqID_117175
atggttgcaactagccaaataaaaactaaaagaagtgtgaaagataagcaagctagactatgtgaaggcttggatgaccctttaaaggtcccaactagctcttcacttagtctacacggtttaaactaa

SEQ ID NO: 398 - DNA, 219 bp, Glycine max
  Peptide Sequence Number=SeqID_117176
atgaggtgtggcccaatgcgtagtacttcaagccacgagtggagtatatatgcacgaagtggctttggtacacaaccccttaagccacaagtggagtatgcacaaagtgggtttgtagagttcgggttgaccgaggtgtggcacaatacacaatccctcaagtcacaagctagagtgaagtatgcactaagtgagtttgcagagtactatcaagattga

SEQ ID NO: 399 - DNA, 99 bp, Glycine max
  Peptide Sequence Number=SeqID_117177
atggcctacactttgaagagtccgttagggactctgcctcctgattcagacattgctcatgaattatataatacccacgaccttacactcgtgttttga

SEQ ID NO: 400 - DNA, 669 bp, Glycine max
  Peptide Sequence Number=SeqID_117178
atggcgctaaaggcgcgcgacctatacccgggccgtcggggcaaggaccaagccccgatgagtaggagggcgcggcgggtcgctgcaaaacccagggcgcgagcccgggcggagcggtcgtcggtgcagatcttggtggtagtagcaaatagtcaaatgagaactttgaaggccgaagaggggaaagggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccgatcggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 401 - DNA, 202 bp, Glycine max
  Peptide Sequence Number=SeqID_117179
atggcacgcagcatgtttgctccgtgcccctatttaagggacctatatgggagagagctaaaaaggtttttagcgataatccccaaggtagtcatatctctcttgatggtctctagaggtatcatcctcttcgaagaacatattgcagcagtacggactactagcaacaatatgttttcaaagagaaaaactctagatgagg

SEQ ID NO: 402 - DNA, 354 bp, Glycine max
  Peptide Sequence Number=SeqID_117180
atggtgtttattagggttactgttgtaagggagtgtgttctagaggacattccttttagaaaatacaggtttgctggatttgcggatgttgtggctggccagtttgaacctaggctattggttgatgttattggtgttgtggaggaggttgtctttcggcaagtttcaggaaaaggtagatgggtagtctttaaactaaaggacttgagccagcaattgctatcttgcactttgtgggatgattattgcttgcagtttttaaagttcttagatgattacaaaggtgatggcccaattacagttctattgacccatggtagaataaaggaagctcagggtatatccttatcttga

SEQ ID NO: 403 - DNA, 888 bp, Glycine max
  Peptide Sequence Number=SeqID_117181
atgacacaatctaagcaagcaaaaaacgtcgttgtgattggtacccaatggggcgacgaaggtaaaggtaaaattgttgactggttaacagaccatgcacaaggtgtggtccgtttccagggcggccataatgccgggcatacgctggttgtcggccagggcgctgaacaaaaagtctataaactcaacctcgttccctctggtattgtccgtgaaggcgtcaattgctatatcggtaacggtgtcgtgctggataccactcatttgttgaatgagatttccacgctggagcagggtggtttggatgttaaaaaccgcttgaaagtcagtcctggctgcccattgattctctcacatcacgtggctgttgatttggcacgtgaagccaaacgcagtgccgacaagaaaatcggaaccactggcaaaggtattggcccggcttatgaagataaagttgcccgccgtgctttgcgcgtgtatgacctgttttatccagagcgctttgctgaaaaactgcgtgaggtcatggattaccacaacttcgtgttgaccaattacctgggtgcgactgcggttgatttccagcaacagtatgatgccagcatgcaacacgcagctgcgttgaaacctatggtggctgatatttcagccgctttgtatgaagccaatgcccgtggtgagcatttgttgtttgaaggcgctcaaggcactttattggatgtagaccatggtacttatccttacgtgacttccagtaactgtatcgcgggccaggcctcagccggtactggtgtcggtgccaatatgctgcattacgtactggggattaccaaagcctacaacaacacgtgtaggaggtggcccattcccgagcgagctggatattga

SEQ ID NO: 404 - DNA, 420 bp, Glycine max
  Peptide Sequence Number=SeqID_117182
atggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatcttttga

SEQ ID NO: 405 - DNA, 675 bp, Glycine max
  Peptide Sequence Number=SeqID_117183
atgcgtagtgattgcctagtgcaattctccatgctccacttttattcggagccccatgaattgattgtcgttcatgcatcctccaccaatgagtctggagccatgcgtagtgattgcctagtgcaattctccattctccacttttattcggagccccatgaattgattgtcgttcatgcatcctccaccaatgagtctggagccacgcgtagtgattgcctagtgcaattttccattcttcacttttgttcggagccccaagatgtgattgttgatcatgcatcctccaccaatgaatctggagccatgcgtagtgattgcctagtgcaattctccattctccacttttattcggagccccttgaagtgattgtcgttcatgcatcctccaccaatgagtctggagccacgcgtagtgattgcctagtgaaattctctattctccacttttattcggacccccatgaagtgattgtcgttcatgcatcctccaccaatgagtctggagccatgcgtagtgattgcctagtgcaattctccattctccacttttattcggagccccttgatgtgattgtcgttcatgcatcctccaccaatgagtctggagcaatgcgtagtgattgcctagtgaattctctattctccacttttattcggacccctatgaattga

SEQ ID NO: 406 - DNA, 291 bp, Glycine max
  Peptide Sequence Number=SeqID_117184
gggagtccgaagggagattgccgggaggatgaggcgcgcctgttcgtccggttgcgggccgcccactccgtccagacatgccgccggtcgattggcgagtgtacgactgtcagcggcccagggggacggcgcaaaggcgccatcctgccccgctgccctgccccatgcgcccgcaccgcccacggcccctgcggcaggaaattctccccgatttcaaccgcgccttccacgcgcgctatatcgatctcccgcaacactaccggacccgcttcagcggttcataaaggatga

SEQ ID NO: 407 - DNA, 909 bp, Glycine max
  Peptide Sequence Number=SeqID_117185
atgtcctctccttcagaggactacatgtcctcgccttcaaaggactacacgactacatgccttgccattagaggactacacgacttcaccttcagagggctacacgtcctcgccatcagagggctacacgccctcaccttcagaggagttcacgtcctcgccttcagaagactacacgtcctcaccttaagaggactatatgtcttcgccttcagaggactatacgtcctcgccttcagaggactacacgtcctcgacttcaaagggctacacgtcctcgccttcagaggactacatgtcctcaccttcagaggactacatgtactctccttcagagggccactcgtcgtcgccttcagaagactacacgtcctcatcttcagaggactacacacctcaccatcagaggactacacatccacgacttcacagggctacacgtcctcaccttcagagggctgcaagccctcaccttcaaaggactgcacgctcccacttttacaggactacacagggttgctcgccctcgccttcagaggactacacgtcctcgcaatcagagggctacacgccctcaccttaagaggactacacgtcgtctccatcagagggtcgcgtacccacaccttcagaggactacacatcctcgccatcagaggagggctactcgccctcgccttcagaggactacatgtcctcgccatcagagggcaatacgtgctcacctttagaggactacacgtcgtcgccatcagagggtcacatacccacaccttcagaggaccacacatcctcgccatcagagtgtcgcgtaccctcaccttcaaaggcctacacgtcctcgccttcagaggactacatgtcctcgccttcagaggactacacatcctcgccttcagagggccacat

SEQ ID NO: 408 - DNA, 483 bp, Glycine max
  Peptide Sequence Number=SeqID_117186
atggcgaagaagatactgtgtccaatgggtatggagtataagaaaatacatgcatgccctaatgattgcatactgtacatgaagaaatacataaatacctcgggtcatctgtttgctaatgcaaatgatgcgaaagaccttacatggcatgcggatgggagaaattgtgatggaatgatctaccatttacctaattctacccagtggaagaagattaatctcctatatccggaatttgggaaagaggcaagaaatcttaggcttggacttgccactgatagaatgaatctctttggcagtttaagcactcagtatagttcgtggcctactttgctagtaatttacaacttgtctccttggttgtgcatgaagcgaaaatacatgatgttgtttatgatgatatttggcccaagacagccaagaaatgacatcaatgtttgtcttggtccgttgattgaagacttgacatatttgtcgaactag

SEQ ID NO: 409 - DNA, 522 bp, Glycine max
  Peptide Sequence Number=SeqID_117187
gtatgctttaaatcagattgctgctgaatttgagtgtgttcactatgctggcaagaatccttccacttgtggttgtgtgatgagaaccatgcacggtcttccttgtgctcgagagctatccaaatatgttgttggttgcatcccactagattcaatccatatgttctggaggagactcggtttttcagaccaagggttatctgagcccgatgtgagcattaaggaagtaatggaaacaatatccaaaagatttgaagaacttgatatttgtggtaagtttactctgaagactaagctttgcgaaattgcatacctttatcaaaattcgatgtgtcctcctccagcaaagtttaacacaaaaggtgcaccgaagaaaccgatgaaaagaaacccaagtgcatcatcttctgagcaatccaatccaagaaggatcatgcctatgttggatcaatttcagccatttatccacgacttcattgataacattgttgatgtccaagctgatagaaactgtgggtatcg

SEQ ID NO: 410 - DNA, 231 bp, Glycine max
  Peptide Sequence Number=SeqID_117188
atggagaattggcgtacaacgctacgcaataacttcgcggggttccagagtcgtaggtggaggatgcatgaacagcgccaggcaatgacattcatggggctccgtaaaaaagtggagaatggagaattgactcgttggtggaggatgcatgaacagcgacaggcaatgacattcatggggctccgtaaaaaagtggagaatggagaattggcgaagagcgctactcaataa

SEQ ID NO: 411 - DNA, 681 bp, Glycine max
  Peptide Sequence Number=SeqID_117189
atggcggatcgcgcgcgggaaaccgccgatatcatcgactgggcccggcgggacgggcgcttcgatgcgcgctgcgtggggctgtggggcaccagccaggcggggtgggtgatgccggcggtggcgcgtttgcgccccgacatcgccttcacgctggcgctggcgccggcgatcaactggctgcggcaagggcgttataacacccgggcggcgatggcggcggcaggggatgatgaagcgctgatccaggcgcgcgaggcgcattggcgccacattcagacgctgctcgaacagccggacggctacgcgcagtaccgccgcgagtatggcgccgccgctgcattgagcgccgaccgctggcactttatccgcgctaacatggccagcgacgcgacggcggaattgcggcatttcaccacgccggtgcacctgatcctgggcgggcgcgacgtcaacgtggacgcggacgaaaccgagcgcgtgtatcggcaaacgatcccggcctcgctgctgacggtgacgcgcatcgacgaggccgatcatgtgatgatcaaaccgttgttcgcccgccatccgtggctgatcaacgtggttggcctgtttgcgccgcgctcggtgcaatacgacgcctaccgacaggacgtggcggcctttctggccgctcagccctgcgggcgctaa

SEQ ID NO: 412 - DNA, 1347 bp, Glycine max
  Peptide Sequence Number=SeqID_117190
atggattttcaccagccgatcgagggcgtactggaccacccactgtttcagcgcctgcgtgcgcaccgtcacgcgggtggtgaacgagcggtcgcccagcgccaccacgccgttgaagaccggctcgccaatcaggaaatgcttcacctgttcatcttgcttcagcgccgcgatggcctgatgcagcacttcattgacccgatcgatatcctcgtcgcggctgacggtgtagttggcgcggtataccccgaattcgcgcgcatagttggccagcgtagtgatcgaggagtacggcacgatgtggtagacgccgtagtcgtcgcgcaggccgatcgagcgaatggtcatgcgctccacggtgccggtgatgccgctgacggtgacgtattcgccggtgttcatgccgttttcgaactggatgaacacgccggtgatcacgtctttcaccagcgtctgggcgccgaagctgatagccagccccagcgcgccggcgcccgccagcagcggcgcgatgttcagccccacctgcgacagcacgatcatcacggtaatggtgctgataacgatggccagcacgttgcgaaacagcgtcagcagcgtgcgttcgcgtgcgctcggccgcacgccgttgctcagttccagcgccaggcggtgctcgatgatgctggccatcagcgtccagctgaagacggcgatcagcaggatcagcaggatatgcaccagcccgccgagcgttcgctggccattttcgctgcccgcccactggtacaggttgatcaggtgccaggcatcgagcaggaacagcgtcaccgccagcaccaccatcacccgcagtatcttcagcccgttggggatgtaggagttgatgcgccgctcgagcatcggatagcgcagattaacgtcggtcggcagcgaaatgcggcggaaaatccagcgggtcagcatgccggacagcagagcgccgacgccgaccaccagcaggcttttcaccgtggcgctcatcataaagcgcaggctgttgccgatgtcgaactgggacagcacgaacaacaccagaaaataggcgatcgccagcagatgccagatatgccccaggccgcgcaggatcgcgctgaaaaacgccatcgaccgttcggccagcaggttgatctgttgctgtatcggcttgcggttgtgcaggatcagccagatggcgtacagcgtcagcgccagcatcaccaccagattgacggcggcggcggccgggtagctgatctgcaccgtcacctccggcaccaccaccatcacgacgtagccgatcatgccgctgagccacgcgaggcgcgtgttccagtagcgcgcgctctg

SEQ ID NO: 413 - DNA, 306 bp, Glycine max
  Peptide Sequence Number=SeqID_117191
atgcaacaacaattgttctcatccctaaaatctgtaaccctatatatatatgaaagattttcatccaatttccattgcaacattctctacaaaatcatctttaaagttcttgctaacagccttaaacctattctcccccactgcatctcccttgagcaattagcttttgttgatgatcgtgcaatcctggacaatgttatattggcctgcaaaattctccatcacataagattcaggaaaacagggaaacaggggaaaatcgccttaaaaattgacattagcaaatcttttgacatagtggattga

SEQ ID NO: 414 - DNA, 384 bp, Glycine max
  Peptide Sequence Number=SeqID_117192
atggttatgggagatttcatcagcagactctccttccccgaaaacaacgagactttttcaagtctcacaagttatccagaactacgtaggtctgagttcctcattggaggatacgtaggagcaagagcctcgcttttgtcgaccacaccgccttttgttgccataactcaagagccggtagcccgcggagacaccttacggttatccgccccccctttgccattcagacacagtcgtgttcgatggcaagcagagaccaagtttggtcattctgcacacatgatacgcggagataccttacggttatccgcccccctttcccattcagacacagtcgtgttcgatggcaagcagagaccaagtttggtcattctgcacacatga

SEQ ID NO: 415 - DNA, 1659 bp, Glycine max
  Peptide Sequence Number=SeqID_117193
atgatcggcattttcgggcgtttgccgacggcggcggaaatcgattactacgacagcgcatttgatatcggcagccagccgcccgcctatatggccagtattttaatgagccaacccgatgccgcttggatgaacggccaaagcgaatacgacattctcagccaggtttatttctccgtttacaataccgctcccgatccggattacatcaatgccttgctgcagcaggggcatttcaacagcgctgtcgccagcgttgtcatcgaactcttcaactatccgggggacgatccggtaatgctggcgcagcgtgatgcgctcgatcagcgcattgcagaaggtttgtatcccggcactgcagccgatgccgccggcggaagcggcgacgcgcaggcgatgttttatctgctgcgagcgccctggcagaccgatgaaattgcccatgacggcaagctgctcaatcaggggggcaatctggcggcgttggcgcagagcaagattgccaccctgccaatcaacgatctttccgatcatgacttcattttgcatctgttcgctcagggatttgaacggccaccgacggctcctgaacttgccacttaccagcaacgactggcggagggcgcgacgcgtggcgatctgctggtggatatgatcgcgcagttgcgcggggtggtggcgccggaagatgctgcggctcaacagcatttcaatgcggcgggccaggaatattcgccgggcgaactgccggcgaccgagtatctggagcagatagcggcgctgttccgtgcattgcccgagcgggcggtggacagcgcttcgctggacaattggagcaagacgctggcctccggcacgttgagctataccgaattggtcacggcccttctggcgacgccggaatttcaggcgcaggtcggtggtttgcagggcgacgactttattcagcacgtctatcaggcggtgcatggccgggcggcggatgaacagcagctggaacactatcgggcattgggcggcgacaaggcactggtcacgcaggcggtgattgccgatctgatcaatgcgccgccggcaggtgacgttcagtatgaacagtggatgttcgcgcgcgatgtcggcgccagcctggcgtataaaacgaccgcttctctcgccaccagcgagggcggcggcaacgcgtcgggtacggtgaatacgcatgctcaccatacgctgagcaatgcggaaaccgccgtgctgttcagggtattcctgcatgctgacgcggacgtcatggttgacctgagctatgcctcgcagctttcttatctgatcgtcaatggcgacgctgcggcggatatctggctgcataataaccctgccgctcggtatggggtggacatgacggtaaacaatgccaatgtgataatgcatggcacctatggcgacgatcgggtgcagctcacctcgcaggccgacctcgccgccgcccaagggcacttttatctgaacaacggtaatgacagtctgctgtggggaggcaatgccaatggcggcgccaatcatgtggggtgggtgttcagcgccgatggcggtgacgggcacgatattttgtccgccaacctgatcgtcaaaatgacctcgacgctcgatctttttggcgcgcgcatcagtacg

SEQ ID NO: 416 - DNA, 156 bp, Glycine max
  Peptide Sequence Number=SeqID_117194
atgtcgcagaacttcacggattgcttaacgatgggtgtcaagttcctcgaagtggtcaagaaaaggttgcatgctattaaacaatggccctcatgtgaagatggatccactcctggaaatggtgcctcagctgatgctggcactggtctaggatga

SEQ ID NO: 417 - DNA, 540 bp, Glycine max
  Peptide Sequence Number=SeqID_117195
atggaggctaatctgtgcatttcgggcaagggctttattctaaacacggagggccaaccatggaagctcctcagaaaatatcttaccaccctggctcagacatggagcatcttcttgtactcaaaccaagctcctacctcccgcacttcagatttgaacacagacagagctaggttggtctatggcttaatcacaaggatgaacatgaacattggcggtttgatctctggacaaatgaccatgatggctcagtctaactcttctcgcttaggcttcccagctttaatcatagccttttgtagatcgaggggagtgggatctgatgcccttacctcctatgaaaacctaaggccggccattgacttagcttatatcataaggaactgttggaatgtgaatgaccaaatagttaattttccagaggcaaggaagaccaagctcagagcagctgatgttccctcttcctttgcaccaatagttggcatccctacatcttctacttcagccctacttccagctttagcagacttatctgcctag

SEQ ID NO: 418 - DNA, 714 bp, Glycine max
  Peptide Sequence Number=SeqID_117196
atgtcggccaccaagtcggtcgtcgcgctggccattgcgttgctgctggacgaaggaaagctggcttcgatcgatacgccggtcagccagatctatcccgaatggaagcagggcaggaagagcgccattaccgtgcgcatgctgctggaccatacctcgggcctgcagaacgtggcgaacgcgggcgaagagctggaaggggccccggacctggtcaggctggcactggccgccgagctgagcgatgccccgggtaccgtgttctcctacaacaacaaggccaccaacctgctgcccggtattgtcgagcgcctggcaggcgagccgctggatgcctatgttgacgcgcgcctgttcaagcccctgggcattgcccactacacctggatgaaggatgaggcaggcaccccgctgggcatggccgggctgtccctgcgcgcggccgatcttgccgccatcgggcaactgttgctggaaggaggcgtggcgccggatggcaaacgtctcctgagtgagcagtcggtcgcgttgatgacgaccgaaagcgcccgtgcgccagatgtcgggctgctgtggtggcgggtaccggcctgggaacgctaccagctcaagccccggctacagactctgctggtgcaaaggagggtggacgacgacgtgcagcgcgcactgcaggccagtgcagggcgtgcattcgaaagccgcagcgcgctg

SEQ ID NO: 419 - DNA, 228 bp, Glycine max
  Peptide Sequence Number=SeqID_117197
atgaccacggcgccccgtgcgcccggcctcctcgtcctcgcgacaaacacaaaccccggcgcttcgtgcgccaaggaactcaaatctgttaagtgcgactcccgggggcccggagacggtaatcccgtgaaccatcgagtctttgaacgcaagttgcgcccgaagccattaggccgagggcacgcctgcctgggtgtcacacatcgtttccccaacgcaaacatgtaa

SEQ ID NO: 420 - DNA, 438 bp, Glycine max
  Peptide Sequence Number=SeqID_117198
atgactgggcctctcgatgagtcgatctcttgctttctcataaaggtggacccttgggtactagtacctatcacctttagaggactatatgtcctcgccatcagaggactgcacatcctcgcctgcagagggctgcacgccctcgcctttagaaggctacgcgtcctcattttcattccttggccaccccctgatattggagggctaccaactgtgccagcacaaccagagagggaggctatcgcgcaactactatgcataccagggcaagatttcatctgtgccgctacaaagagacgagtgcagatcgtgcacaccaacatgatcactcttacacagatatggatgacattactacttagcaacattctgcccagcgaccgcaatgccgatctccccctgcagaagtatcagttggtctatgccgtcatgacatag

SEQ ID NO: 421 - DNA, 141 bp, Glycine max
  Peptide Sequence Number=SeqID_117199
atggggaccaccacggggttatgggaattttacggaagcattacgggtgtcccggaagccttggaatcccattttttaaccaaacgggggaggtggttgccaccaagctcgcccaagcgagctaggttgcttccaccttaa

SEQ ID NO: 422 - DNA, 695 bp, Glycine max
  Peptide Sequence Number=SeqID_117200
atggggccaggacgccggcctgacactggaacaggaactgcagcggctcaatccgccgcaggatgccgaaggtttcccgcacctgatcgctgcattcgatggcggtcaggtggttggcgcagtccagctcaagcgccgggaaatgcaggcgttcccacagtacgaacattggctgggcagcgtgttcgtggccgacagccatcgcgggcgtgggctggctggcgcgctggtggaacaggcagcggcgcaggcggtgcggatgggggttggccgcatgagcgcatccacatcgcgccattcccgctccgcactgatcttcctgatctcagcgatcgttgccgcgctggtgtccatgcccctgctgcgcgcggtaggcatggtgctgtggccggtgttcgtcattgcctggctgatcaacctgggcgcggcctggcatctggcccagtgggcgcggcagcagggccgttcggcgtgggcgttcgggttgccggcagcgttcggcaccgtcgcctcgatcgtggtctatgtgctgctggcattgttggggccgaaggccgcggtgcactgagttttcgcggctgccgtggacaatgtgccgagcatggctcggcactacagcagggccaagccaaacagaaaggccgagccaagcccgcacgtgttgcgtggagcgccggcgcacaggccggcgcccc

SEQ ID NO: 423 - DNA, 448 bp, Glycine max
  Peptide Sequence Number=SeqID_117201
tagtgaagttttccggggcccactgggccaagaaagcttctcaaagctcaaagcatttacttctctagttagagaccaacgtcttggggctaatgtaggatctgctcaaggacctacaggtttagaacctctaaggggtccgaatggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagttggttagctacttctcattttgttctaggattcttcctatttgtaggccatttatggcacgcgggaagagctcgcgcagctgccgcaggatttgaaaaaggaattgatcgagattttgaaccagttctttccatgactcctcttaattga

SEQ ID NO: 424 - DNA, 359 bp, Glycine max
  Peptide Sequence Number=SeqID_117202
atgcaagagaagaaagttactattgctcttctcatgcttgttctagttgctggcatgggggtaacaacaacactcagtgaaaatcaagcatgtgccagtggggatgctcaagtgttacttgaacgttgttttgcttatttgctaggtgaagttccagatggaccacttccttggtgctgtgaaggagtgtcagcagtgtttcaactctccaaaacccctcaacgcagaagagatgtttgtcactgtctgaaacgggacacagccgttttccattttgatcctgaaaaattgaaaatgcttcctcaagactgcaaaattacctctcgattttctcttgacccaagacagaattgtaactc

SEQ ID NO: 425 - DNA, 333 bp, Glycine max
  Peptide Sequence Number=SeqID_117203
atgtgggacaccttagacattactaagaagggtcctctaagacaacaggttacaacattaagagccataaggaatcttgattcaatgactcttgaagagctcgtcgaaactctaaaagtccatgagcaagagcttgctcaagatgaaggaacaaagaaatggaaatcactaacccttatggttcaaagacccaaacacaactccgtgtccaaagagtcatcgtccaaagcccttgtcgttactgatgctttagaagaagaatatgatgatgatgactttgatgaaaaatatgatgagcttagtctgatcacaagaaagataagaaagatatga

SEQ ID NO: 426 - DNA, 1161 bp, Glycine max
  Peptide Sequence Number=SeqID_117204
atgcagaagaccaaaggttcctcaagaataccattatgcttctatgacaggcttgactatttgaaccagagcaagagaaaacgagtagagaggagagtggataggagtggacaacgacagagctacaatcaagataattggaggggtcggaaagatattgcattgttctacttcactcgtttcccagaggatgctactgagaaagatttatggcaccatttcaagaagtttggtgatataagggagattttcgtctccaagaacaggaacaggaatggcacgaggtatgggttcgccagatttaaaggggtagaggatgtgtataatctagaaaggaagctagataacatcgtctatggtggcctaaagatgtacgtcaacaccccaaaattcaggagaaacaggtttcagaggacaaacctgcaggcaaaacgagtggaatatgttgagcaaaaagaagaggaggcaactcggccaaggcatgtacaccaaagtgtgaatcaagggacgtatgcaaaggtcgtggcagagaataataaaggaacaggggcaagcagaccagcaggcaatgcaaatcgcagatatgaaggatcatggtcatcggtgtatctcgacgtaacggaaacagggagcaattgggctaaggaggcttgggtagggagattaaaaaatctggccatttttgacagagtagaaaacgacctgtattgggactttgaggatgacatatcgccgaagtatgtgggggatgatatggtcttgttaataggcctcaccgacgaaagagtaaagcagatgatggaggaagaagaaagaagggccaccccattccattccctggaaaaatggagcccgaagatacacacggggtacagactgacatgggtcacttgctggggtataccactgctggcctgggacaccaaacaaataagcaagatagtggttgtcattagggacatggtggacgtggacgacgacgtcgagctggtacgaaggctggatagggcacgggtccttcttaaaacaccgcggaggccattcatacagcacacagttaacgtacacattcaaggggagacgtacagtgtgcacatagtggaagaaggtggcagcaacccagaaagatgtcaatgtcggcgtcggagtatgcatgagtaa

SEQ ID NO: 427 - DNA, 516 bp, Glycine max
  Peptide Sequence Number=SeqID_117205
atgtatatgataagctccgaacaaaagaaatcacgtttagccaaaaaattaggtcccaaaagaaaagcatcattagaagtggtacacaaacatgggccatgctcccaactgaataatcatgatggcaaagcaaagtctaaaacaccacacagtgagattctgaaccaagacaaagaaagggttaagtacattaactcaaggatctcaaagaacttgggccaagatagtagtgtgagtgaattggactcagttacactaccagccaagtctggtagccttattgggtctgggaattactttgtggttgttggtcttggaacacccaagagggacttgtcactcatctttgacactggcagtgatctcacttggactcagtgtgaaccatgtgctcgttcttgctacaagcaacaagatgctatctttgatccatcaaagtctacatcatattccaatattacatgcacatctacgctttgcacccagctctctactgctacagaagaaacattttga

SEQ ID NO: 428 - DNA, 1446 bp, Glycine max
  Peptide Sequence Number=SeqID_117206
atgtcttctttcctcttagcatcgtttgcacttttgttttgcatctccaccttggagaagagctttgcctttcaagcaacaaaggaaagcaacaatcttcgtcaatatcattttgttcacctcaactctctatttccatcatcttcttgcagctcttctgccaaaggtcctaaaaggaaagcatcattagaagtggtacacaaacatggcccatgctcccaactaaatcataatggcaaagcaaagactacaatatcacacactgatattatgaacctagacaatgaaagggtaaagtatattcagtccaggctctctaagaatttgggtcgagaaaatagtgtgaaggaattggattcaactaccctacccgccaagtctggtagccttattgggtctgcaaactattttgttgttgttggtcttggtacacccaagagggacttgtcacttgtttttgacacaggtagtgatcttacatggactcagtgtgaaccctgtgctggttcttgctacaagcagcaagatgcaatctttgatccatcaaagtcttcatcgtatatcaatatcacatgcacatcttccctctgcactcaactcacttctgcgggaattaagtcaagatgctcctcatccacgactgcatgcatatatggtatccaatacggtgacaaatccacctccgtcggcttcttgagtcaggagcgccttaccatcaccgccaccgacatcgtcgacgacttcctctttggctgcggccaagacaacgagggcctcttcagtggctccgccggcctcatcggcctcggccgccaccccatttcctttgtccaacaaacctcctcaatttacaacaaaattttctcctactgtctcccctccacctccagctcccttggccacctcaccttcggcgcttccgccgccaccaatgctaacctcaaatacactcccttgtccacaatctccggcgacaacaccttctacggtctcgacatcgtcggcatctccgttggcggcaccaagctccctgctgtctcctcctccaccttctccgccggtggctccatcatcgactccggcaccgtgatcacgcggctggccccgaccgcgtacgccgcgctccggtcggcatttcggcagggtatggagaagtaccccgttgccaacgaggacggcctatttgacacgtgttatgatttcagtgggtataaggagatttcagttccgaagatagattttgaatttgccggtggcgtcacggtggagttgccattggtggggatactcattgggagaagtgcgcaacaagtgtgtttggcttttgctgcaaatgggaatgacaatgatattacgatatttgggaatgtgcaacaaaagacactagaggtcgtgtatgatgttgagggtgggaggatagggtttggtgctgctgggtgcaactga

SEQ ID NO: 429 - DNA, 786 bp, Glycine max
  Peptide Sequence Number=SeqID_117207
atggattcccatgcacagctagccatgacatatatattaggcaaattgttgttccattgcaagatattttacgtactaaatgatgctgtgatccacaaaagccaagcaaacttgcttggcactggccacgtagagtatcccttgcggcggaagctgcaccgtgacgccgccggcgaaggaaaaatctatcttgggaatagaaaagacctcgtagccgctgagatcataacacgtgtcgagtatggagagttccccggcggaggggtatttggacatgccttgcctgaaggcggagcggagggcggtgtaggcggtgggggggaggcgggtgatcacggtgccggagtcgatgattgcaccgccggtggagaaggtggaggaggagactgggagtttggcgccgcccacggagatgccggtgatgtcgaggccgtagaaggaggagccgcgggagatggtggagaagggggtgtacttgacgtaggaagtggtggtggtgccgaaggagaggcggccggtggagctggaggtggcggggaggcagtaggagaagattttacgatatacggcggcggtttgttggacgaaggagatggggtggcggccgaggccgatgaggccggcggagccaccaaagaggccctggttgttttggccgcaaccgaagaggaagttgtcgacgatgtcggtggcggtcacggagagccgctcgcggctgaagtagccaacggagaacgaactgtcaccgtactggatgccgtatatgcatgcttttgtggaggctga

SEQ ID NO: 430 - DNA, 1534 bp, Glycine max
  Peptide Sequence Number=SeqID_117208
tgaggatgcctcctctgaaaatgaagaagaagctgttgtggaaggtactgaaacagcaggagttacagaccaagatgcagaagcaacaacctctacatcaagtgattcatctaatgaagatgcatctgtacatgctacagctgaaggaaggagtcgaagagcacccaactacttgcaggattatgaaactggtgaaggattatctgaagatgaagattattttgcaatgtttatctctgatgatgaagattattttgcaatgtttacctctcatgaagatccaagctcatttgaagaagctgaaagagatgagaaatggagaaaggcaatggatttggagattgaagcaatcaaaaagaatgaaacctggcagcttacaactttgcccaaaggtgctaagaagattggagtgaaatgggtttttagaaccaagttaaatgagaatggtgaagttgataagcttaaagcccgactagtagctaaaggctatgctcagcaacaagggattgactacaacgaagtgtttgccccggtagcaaggtgggacacaatccggatggttttagctctagcagcacaaaagggatggaatgtgtatcaactagatgtcaaaagcgcatttcttcacggagaattgacagaggacgtgtatgtggaacaaccaccgggttatgttcgaaagggtgaagaagagaaggtctacaagcttaagaaagctttatatgggttaaagcaagcaccacgtgcttggtatagcaaaattgaagcctattttgtgaaggagggatttgaacgatgcgatcatgagcacactctctttgtcaaaacaggaggagatttagggaagatgaaatatttccttggtgtagaaattcagcaaaattcagaaggcatctacttaagtcagaagaaatatgcttgtgaattacttgagaagttagggctgcagaattgcaattcagtaaagaatcctatagtgcctggttttaagttgtcaaagaaaggagaaggtgctaggattgatgctacttcctacaagcaattaattgggagtctcatgtacattactgtaacaaggcctgatttaatgtatgtgggaactgtggagttaggtgtgttttataagagaggagatgttaaagacttggtggcttacactgatagtgattatgctggagatattgatgatagaaggagcacatccggatatgtatttttactgagtggtggagcagtctcatgggcatcaaagaagcaaccggtagtaacattgtccaccactgaggcagagtatgtggcagctgctgtttgtgcttgtcaatgtgtgtggatgagaaaggtgttggagaagattgggctctcacaaagcaagtgctctgttattatggatctaacaaaaaaggaagtggtgaagctcattcattgtggcacaagcaatcaagtagctgatattatgaccaaaccattgaaacttgatgtgttcctgaaattaagagtccagcttggagttcgtgaggttccaaatttaaactga

SEQ ID NO: 431 - DNA, 394 bp, Glycine max
  Peptide Sequence Number=SeqID_117209
atggtcgaaagaaaaaatccctatttgacaaggcttcttactatacctatgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatcc

SEQ ID NO: 432 - DNA, 183 bp, Glycine max
  Peptide Sequence Number=SeqID_117210
atgggagctggccatgcccgaagtcgttaccttaaccgcaaggagggggatgccgaaggcagggctagtgactggagtgaagtcgtaacaagccacatggatagtttaatgtgctcatcggcgcctgaccctgagatgtggatcatccaactcaacattagcatggcgtacttctcctgttga

SEQ ID NO: 433 - DNA, 387 bp, Glycine max
  Peptide Sequence Number=SeqID_117211
atgtgtggtgtgccagatgatccgaaaaagataaaccacttggttagcctcgatggtgctaaggagaggctgcacctctacaaggcgaatcttctcgaagaaggttcctttgactctgtctttcaaggttgccatgctgtgtttcacactgcttctcccttttatcacgatgtcaaggacccccaggctgaattgttagacccagctttgaaggggactctcaatgttctgaagtcgtgtgtgaacttgccaacgctggaacgtgtcgttttaacctcttctgttgctgcagttgcgtacaacggaaagcctcgtactcccgatgtagtggttgatgagacatggttttctgacccggatttctgtagggaatcacaggtattctga

SEQ ID NO: 434 - DNA, 549 bp, Glycine max
  Peptide Sequence Number=SeqID_117212
atgggtagcgaagaagagagggttcttgagaaccaactggaacttcaattgcaagaacaaagggattctctctctgctatcgatcaagctctcctctctgatccaaccgaccctgaacttctcgcgttgaatctagcaaatggggctagtctctcacgaagtagagaaccaaggtctgaatccctattaggagatgttcatgaggagcttgttcaggcaattaaggatgcagaagaaggacttcttcacctaaaacgtgcacgattgttacaggaagcagattcagtgctgcataacactaatatttttactgaagagaaagtggatccccttgatcccacttatgttgaaccagagccattggaggacaagtgttattctgttggatctaaatgtagattccgtcacaaagatgggcgttggtacaatggtcaagtggtgcagttggataattcagtggcaaaagtttcatttcttactcctacttctgagaatatgttggtattccttgtcctccatctttgtactgttatctctttccaattctga

SEQ ID NO: 435 - DNA, 1544 bp, Glycine max
  Peptide Sequence Number=SeqID_117213
atgtcggctgaaagtagcaactttgtgcagccagcaatacccaagtttgatggtcattatgaccattgggctatgctcatggagaattttcttcggtcaaaagagtattggcatttggtggaaacaggcattcctacagtagctgaggggattcaatcaacagaggcccagaggaagtcaattgaagatcacaaactgaaagacctgaaggcgaaaaactatctcttccaggccatagatagaaacatcatggagactattcttgacaagggaagttcaaagagcatttgggactcaatgaaacagaaatatcaggggactagcagagtgaagagagcacaactacaagcattgaggaaggaatttgaagtccttcaaatgaaaggaggagaaaaagtggaagagtactttgctcggacacttacaattgtgaacaagatgaagatttatggtgagaacataactcaagttatgattgtagaaaagatcttgagatctatgacctcaagatttgactatgttgtgtgctcagtagagcagtccaacaacttggattcactgacagtagatgagcttcaaagcagccttttggttcatgaacaaagaatgaattctcatggtggtgacacaagggatgagcaagcattgaaggtctcacatgaagaacagaatggaggtagaggcagaggtagaggctttggtcggggtcgaggcagaggcagaggaaggcagtctccaaacaaagccacaatggagtgctttaagtgccacaaactaggacacttccaatacgaatgcccaagatggaaggagagtgcaaactatgctgagatttatgaagaagaagagatgctgctcatgtctcttgtcgaagctgacaacttgcaacaagaagagacttggtttctcgactccggttgtagcaatcacatgtgtggaaatagggagtggttctctaccattgatgaggctttcagacactcggtaaagcttggcaacgattcaaaaatggaagtactaggcaaagggaacatcagacttcagatcaatggtgcaattcatgtagtcactgatgtttactatgtcccagatttgaaaaataatttactgagtgtaggccaacttcaagaaagaggactagctttacttatacaagatgggaaatgcaagttgtaccaccctagaagaggattgataatgcaaacagaaatgacagcaaatcggatgtttgtgctgctggctagtgtagtgcttgaagagacttcaacatttctacaactagctactgaagatagttcacaattgtggcaccgtagatttggacacttgagttacaaaggtttgaggactttgcaacacaaacagatggtgaaaggtcttccatttttcaaagattcaagtaaaagttgccctggatgctttgtaggaaagcaacatagagatgtcataccaaagaagagtcaatggagagcttcccataaattacagcttgtacatgctgacatttgtggacccattactcccaactccaatagcaacaaaag

SEQ ID NO: 436 - DNA, 345 bp, Glycine max
  Peptide Sequence Number=SeqID_117214
atggcaaggaatcggtacaacaatgaggaaaactttgccctaaacccaaccctagaggagttgcttgccatcatgaatgaaattgatgccaagcccatcctgccacatttcttagtccccaaggtggagtattttgatggatcgattaagacctttcattcacatatgttaattagtggtggaaacaatgcacttaaatgtaagatgttcatagggacgttgttaggggtagcattggactggtttagtggtattcttgataggtcgatcgttggctttgaagagttctttgcgacgaacaagcaaaagacattgactatggcagatttgtttgacgtacgctaa

SEQ ID NO: 437 - DNA, 267 bp, Glycine max
  Peptide Sequence Number=SeqID_117215
atgttctcacaaaagggtcatttcatttggtttgagggagaggttttgagggatttcgaggttatagagattggagaagataatgatgatgatggtggtggtgaagagattgagaaggtgagagatggaggacgggagagagagagagagaagagaatgggtggtagagggagagaggttttgtggttgaaggaagtgattcagagggtaagatcaacgaagggtgatgatggcatgtggatctttaaattgaatattgttgcgtga

SEQ ID NO: 438 - DNA, 396 bp, Glycine max
  Peptide Sequence Number=SeqID_117216
atgtcttcaatcatttacgctttcaaagactacaatataagtaaaaatgggcaactatcagaccctaatttcatctggggactgtcattcactgatgttttgattctcgctagccgaattgcagtgtttgacaccaattaccacacaaagcaaaggatcactcagtgttttgatcaagaatacaaaagaataccaaggaagggggcaaaagggtcttttcttgatttttctagacccccgcttgccaaggctcgcctgggcgagctcattacttcagggctaaggttcagctcgcttgggtatgatggggggtgttttaaggggttagaaggttcaacattgagaggaattgagataaaagaagaagaaagaaaggaggaagaagaagaagaataa

SEQ ID NO: 439 - DNA, 204 bp, Glycine max
  Peptide Sequence Number=SeqID_117217
atggtgatgtatttcacaaagcatggagagacaccgtggttttctatatggcttctgagcattttggctgatccacgcagatatgtcttcactgggactgagataaatggatttgcccgtcacaggagactaactcaaggtgatgaagtaggtcagaccgcggatgaagtgacaagggtggtgtatttcatagatcatggatag

SEQ ID NO: 440 - DNA, 306 bp, Glycine max
  Peptide Sequence Number=SeqID_117218
atgggctcatacttagcccatgggctcgaaatctaccctaaggctcatgagaaccctagggccttcccttggatctctggcctaatctacttggagtcttttatccaattcccttgcggggtcaaaagatataactggcaagccaaaattcgtatgccacaactctccttaggaaccatcagaatcctatcatcgtgtggtaaattagtttcaagcagaagtgtcatacagaaacattcaagcggcagacccaatgttttaaatatgaaattctccataccaaacatctatgggatattacaataa

SEQ ID NO: 441 - DNA, 1197 bp, Glycine max
  misc_feature (62)..(62): n is a, c, g, or t
  Peptide Sequence Number=SeqID_117219
atgcccgccccgcagcacgtctatgcggcggacggcacccgcctcgccacctatacctgggncgagctcgatgcgcccgtggtggtgacggtgcacggtttcgcgtcgagcgcgcgcgacaactgggtgctgaccgggtgggtgcgcgaactgactcgcgccgggtatcgcgtgctcgctctcgatcagcgcgggcacggacagagcgagaaaccgcacgaatccgccgcctacgccatccgccagctggtgaccgacgtcgagaccgtcatggacacgtatctcgtcgacgacgcgttctacctcggctactcgctcggggcgcgggtcggctgggaggtggctcgcgagcttccgcaccggatcggccgcgcggtgctcggcggcgtgccggacggcatcccgctcgcccgtctcgacctcgcccaggtgcgggcgtacatcgccgacggcacgccggtcgaggaccgtacgacgcagaactacatcgccctgaccgagcgggtgccggggaacgacctgcgcgcattggtcgccctggccgaggggctccgcgcgtccgggacgatcgatcccgacccggcggacgccccggtcgtccctctcctgttcgcgaccgggtcgaaggacgcgatcatcgagggctcacgggcgctggccgccgcggcgccggacggtcgtttcgtcgagctcccgaaccggcatcatttcaacgcccccggctcccgcgacttcaagaaagcggcgctcgcgttcttcgccgaggcccgacccgttcccgtcaggcggagacgtcctcgcgcttgggcagcacccatccggcgcgcgggaagtggcacgtgtagccgttcggaacgggccggcgggctcgatggtggtcacggccttgcccggccagaggccggaggcgtcgacgtcggcgatggtgtcgcgggcgacctgctcctgctcgggggtgagcgggaagatcgcggagcggtagctcgaaccgatgtcgttgccctgacggttcagcgtcgacgggtcgtggatctggaagaagaaggcgaggatgtcgcggtaggtggtctgcgtcgggtcgaacacgatctccaccgcctccgcgtggccggggtggttccggtatgtggcgtggtcgttctcgccaccggtgtagcccacccgggtgtcgatcactccggggctggcggcggatga

SEQ ID NO: 442 - DNA, 1375 bp, Glycine max
  Peptide Sequence Number=SeqID_117220
atggcgagatggcgctggtggtgcggcctgaacatatggaactcggcgatgccggcgcaaatcgcgttcgcggccggccgaagcgcgccttctgactgtacgggtgctgccgggtcggcctatcccagcgctcggcgaaaatgttaccctgagctggcagccggaagcggctgttctggtgacgccatgagtgttgctgcagtttctcaggcgggtacgacacgtgctcgcttccgtttcggtccgctttggctggtcgcgccgggacttgtcttcctgatcattttctttctggtgcctgtcgcgcggctgatgggcttgagcttcgaaaacgcggacaccggtgcgattacgggagcgcattacacgcgaattttcgacacggatgtatattttcgtgttttgcttatcacgtttcgcattgcggccctgaccacgatgttctcgcttctgttcggctatccgctcgcctattggctgtcgcgcctgccggagcgcaagcgcggcatgatgattttgctggtgatggtgccgttctggacgagttatctcgttaagagttttgcgtgggttattcttcttggacgcaccggggttatcaatcagcttggtctcggttcgggcgtgataggctcgccgttggaaatgttacacaatgagttcggcgtcatgataggcatggttcatgccatgctgccgcttgccgtattgaccatgctgccagtcatgagcgggatcgaccgcaggctcacacaggcttcgggcacgctgggggcggattcggccaagagtttctggctggtttatttcccgttgtccctgccgggcgcggctgcggccggtctcctcacctttatttcttccctcggcttcttcattgttcccgcccttttgggcggacgccagcagaccatgctcgcgcagttgattatcgtccaggtgcaggaaatcctgaactgggccttcgcgggggcgctggctgccatgatgctggtcgcggcccttgtcacatgctgggtctatgatcgcgtcttcggcctttcaagcctttcaggtgatacgggagctgcacacaaaggcaagaatggtattctgcgaaatatcggcttgcgtattctggaaatcagtgcacttgcgtccagccgcattgccatggctgtccgcactttgctcggacaagccatcacgaagcgtctattgggaatttactgctttctgtcctgcgcgtttctgatgctgccgacgctgatcgtgatcccgattgctttcaccagttcgcagtttctggaatttccgcctcccggtttcagtctcgactggtttcgagcctatttcacctccgacctctggttatccgcaaccgtgcgctcgttcg

SEQ ID NO: 443 - DNA, 258 bp, Glycine max
  Peptide Sequence Number=SeqID_117221
atgaagaggatggagagagtgaaaggaagaggtgccacgaagaaggtgcgaaaacgcgccaggggaagaaaaattaacgaaacgaaccacacgctcacacgtgtgacgcgttccgaacttaatccaacggctcagatcgtagccgcctctgatctacggacctcgtttgttcaattatttcaacagccatcaaccttttctttcctctattattacgtaatttgtatgctcgtcaaagccacctcgtgtattttttaa

SEQ ID NO: 444 - DNA, 210 bp, Glycine max
  Peptide Sequence Number=SeqID_117222
atgaggaaatcaaaagcagatgagaagattctcagctacaacgatgtggtgcttaggcgattcgatttagacatccttagtggatatcctgctggttccaccatccattgcattttggataatacaatgccctctgttgctgaggctctcggtgatttcatagaaccccttcatttgcctgacaagatgctgctaatattgagcctttga

SEQ ID NO: 445 - DNA, 486 bp, Glycine max
  Peptide Sequence Number=SeqID_117223
atggatttactcttttttagctttcgaagaagttacggaaactcacggattgcgcaacaacacctccttttggtttccgccacattacggattttcatgaatcgcgtaaccctgcttccttttgacttctggcgcgtctcgagacttacatattgtgcaacaaagggtgccaagtatcttgaaacgcttcctgcttcttcttcttcatcttcctgcttcttcttcttcattgcttgcgcgtcttctttgtgcctcttcttcttcttcgttgaggaggttgccgaggtagcttgcggtggtgctgcgaggaagcttctgcaaagtgcaacggtcgttgaggaggtttgcgcgtccaccgtcgagtgttgtcggcgatggcggaaagcgctgtcaaaaatcactgggagctttacggatcaagtgatccgtaaacattttccggatcaacttgatccggaagatgcttacggatcacttgatccgtaa

SEQ ID NO: 446 - DNA, 1242 bp, Glycine max
  Peptide Sequence Number=SeqID_117224
atggcgagcgggaacgagcgttgtcgttttggcacgttagtgacgcggattttacgagatgaggcacgagggtgttgtggatttacgaaaaaccatccaacggtagggggacatgctaggaagaaggttttctcagtagaacaatttattctaccagaagaacctttttttggagaaattatcggaagaagttcttccggtaacttctccggaagaagggtgggtgattgggctacaccggatctagttgttaggagagttactttcggcaccttgcagaattgctgctccgctatgccatttttgttgctttcgtgtttctttcgccgttgctgccatcgttcgcagtcattggtgtcgattgtcactcagtcgtggtttgtcctcgatttctcctttgttgtgattatagttagaatcagaggtttgggttggactttaagtagagttatcggaagagcattatgtagaaaagtaagtcgtgatgccgatgaaggccccaagcggcgaaggcccacaacatctgcacataggcaacgaaaagccgctcctgcacatgttgttgaggatgttgaacatgtggatcatgtttctaaagaggtagagaaatttggcaggcttgctcctaagattgaaggcttagtgactgccacaagattaagtcatttgatcgcatgttcgatggacactggtgatcggggacttatgctttcttttgcggagaggtggcataaggaaactagtagtttccatctaccggtagcagaggtgactatcaccctggatgatgtggcattgttgttacatctgtccaatacaagcgtcttccatagctttgaggatgttcatgtggatgatgtcgtcttcctcttagttgaattgcttgaacatccacctacggtgcgcgatgacacatttgttgaagcatatgttccccaacagccggtggcagcaacgactatggacaaagcacttgcagatgcacatgctgatgcagagcagcctcaacatacagcggacgcacagtttggtgatgacgcatgggaggcgctgctgccacttgaaccagacgttgcggtggtggaggcaaaggagctcgaggacaacagagatctgatcgacgactttttcttgcgtgagggaatcggggccgagcgcgtcgaagaagtggtggacgaagacggcaaagtcgttggcgaagaatgcaacgtttccatttattcgactaattacccattttag

SEQ ID NO: 447 - DNA, 4524 bp, Glycine max
  Peptide Sequence Number=SeqID_117225
atgactcagttggcaacagatccaaacgcaatgcttgtcctccacggatgtttctgcaagtgcaacaactgccaggagtggaatgttgaccacaggttccttgaagagaaatcagaatgctcgtcctgttgtgccttggtgacttgttggtcatgggttcgaatccggaaacagcctctttgcatatgcaaggccactaatcttcagaagcatactggagtaaaaggcccttccaaaaatcctaaaactgtcccaagtaacccaaaagttggtctggctggtaaatgttcagttactagaacacttacccagcaggctgggaaacatttggataactcagtttcagaaacacatccaccatctagaatgcatcaatcaggaactgaagcaaataaggtgtcagaagcttgtctttcacaaggtgtttctgacatcagtgagaaaaggcaacagacacagcttcaaacaacaaaattttcaggcctacggatgccatctccctcattgggattcttttctctggcaaaaacttccagttcacatagccaattacagaaaagttctaaaccttgcaaacctgctaggagtaacattcctcaattacagaatttagaaacaaattctgttaatgaggcaagactaccgcatgcacctggaataaggtctcaaattgtcaaaggtgcagcaaagaattgcactgaggaattaacccttttagatgtaaagtcagaatcaaggatgcaagtggataataagcagatggctggtgtagaggtggaacataattctatgggttctgaaaaaataagcaagcaagaaaaggttgaaaacaatcttgaacatgtcaacataaaacctaaggaacaaggagaactacatagaagtgagaatgcctctagcatggagaatgtgatattccctagacatgaaaagaagcttctttcagtgagtcaaactcaagagcagtcagagaaagaggctggtcaccctgacgttttgtcaaacaagtatcaatctgtgtttcaggaaccacagtctatggaccatcatggcatgctgagaaattccataatgacaggtagtatttcaaatactgtgcataatgccatgggacaagatgaagatgaacaaatcaaactgttcgcttgtgatgttcttacttccaatgaaagtttggtgctacaggcaaagcatggtacttcttttaagggtagtagactctctgaagagttcaaggaatacaatagtgttaagactgcatttttaaattctagtcttgttgatttgagtgaaactgttttgggaggatctatacaagaaatcccctttaagaatactgaacaggtaaatggtgatgctgctgattttgttacaagtggaggagatgcacaagtgcatttattgaatgcgaatctctcagttgattgcaatgaaagcactgaaagtaatttagaggcagttaatcagcagctacaaggggaacaactcaagactacaagtgctggtattgtaggagaaattagttcatcaaaagaagacgaatctcatgtaaatagttgtcaactagtccatatgacaaccttatcttccaagggttctcctcagaagtctataccagaaatcaatggtccggctgaaactgaaccaaaaatagctgaaattgaagactgccagtttccagtagatgatcaatcaggtttcattcagacaagaccagagttggaaggatgtgagaaggttattgactcaaaggcaatgcatgatagttctcaagcatttgaattggatagtttaagtgaagattgtgtggctctttctgcacctgcttgcaacactgtggtaagcaatgtttcttgggaaagcagaccttttcaagagaataatgtagagattctccattttacatcccaactatgtccagtggtaaaagttgattttgatccgagtaaaaatgaaatgtcaaccaatagctgccgtatgatttctgagttgcagcttggagatgaggattcttctagggatgtttcaatgcactatgatgttccgattgatgtccctggaaactttgagcaacaaattaataagaatatatattctaaagcaagcgaaatgctttgtgaaggtgagagtttagtactaaatcatggtcacttgcttgatcaaagtgaattttctgaagaattatctgcagatttcatttcaaacaccaaagattctataagtactgttgctggaaaatcctctggctgtttacaacatacactaccagctcagttatcagtactgttggatggtgactggctgcccacaaatactgcttcttctgaagaaatcaagaaaacaaatttatctgagagtgcattagaaggatgtgatatccatacaagtgagcgcaatgcttctaattatcatattcaggctatgcctgaaattaaagatggaaatattgatgtggatgaaagggaagagcttttacgaattgatgattcaaaagaaggttcttctgacatattgccattagttgaagctcaactcaatgacaacgtgatatcttctgaatgcaattcttctatagaagtgagcaaagattcttttacagacatagttgcttggaaatctgaggaggattgttctttgagtcaaagttcaaacttcccggcttcagataatttaaccttcaacacaggaatcccacagaagttgaatcaaaattccccccatggagattggccggatactgtttctgcaactgcttgtgacacaaaggtaaacaatgtttctcaagaaagccaaccttgtcatgagaatgatgtaggagatctccagtttacagcccaactatctccaatggtgaaagcagattttgattccacagaaaatgatatatcaactaataactgctgtaccatttctgagttggagcttagagatgatggttcttctagggatgcttcaatgcactatgatggtcaatgtggtgtcactggaaactttgagcaacaaactagcatgattacatattctgtagctaatgaaatgctttgtgaagatgagagtttagtgctaagtcatgatcacttggttgatcagagtgatttttctgaagtatctgcagatttcgtttcaaacgccaaaggttctattggtagtggagctgaaaatccctctggccatttacaacatacaatattgactccattagtacaagaatttgatcacaccaacagagagactgaggaatcacatctggaaaatgcacaagtgcagtcatttactgaaaatccagtggcataccactgcagcagtaaacacagtcttgttactgatgataaatttccattggctgataacaatgatataaatgaagattctcatctttctgattttcaaaggcttggtgctgttgttggtgtagattcccagaatgctgataacatacttattgcttcttctcaagaaatcaagaaaacaagtttatctgagggtgcattagaaggatgtgatacccatacaagtgagcacaatgcttccaatcatcatattcaagctatgcctaaaaacaaagaaggaaatcttgatgtggatgaaacagcagagcttttgcaaatttatgatgcaaaaaaaggttcttcagacatattgccaatagttgaagttcaactcaaagattcccagaatgttgatgacttactgcacttagatggtgattggcctcccacaaattttgtctcttctgaagaattcaagaaaacaaatttatctgagggtgcattagaaggatctgatatccattcaagtgagcacaatgcttccaatcatcatattcaggctatgcctgaaaacaaagatggaaatcttgacgtggatgaaagagaagagtttttgcaaatggatgacgtgaaaaaaggttcttcagacatattgccattagttgaagttcaactcattgacaacgttgtatcttctaaatgcaattcttctatagaagtgaacaaagactctgttacggacgtagtaacttggaaatcagaggagcattgttctttgagtgaaagttcaaacttaccagctttagatgatctaacaaccttcaacacaagaaccccacaggtctgtgaagttagttcattgaacagtacaatttttttagatgaagctgaaactgatatctttgagaaagatgagtttccacataccgacatgcagcaccagtcaaatggcaatattaattctgcagaagacagcagcaaaataattcgtttggaggattctgtaactaaatgcaagcaagaagttcctacagtgaagcctccaccaaatgctgctccgttttcggatgaatggttagctgcaattgaagctgcgggagaggagattttaacgatgaaaagcggtgctgtacaaaattctcctcctgacaagcctcagcaagaaccaggtccttggtccccggtgagacgtaagaatcaatcgattggaccctttgattgtaccaaacacaatatccagcattccagtccataa

SEQ ID NO: 448 - DNA, 1383 bp, Glycine max
  Peptide Sequence Number=SeqID_117226
atggcggcatcgcgaatcgtggcccatcctccgccctatccccaccgtcaatctccgccgtcagatgccccgccgtccctcaacctcacacttaatccaaaacggtaccgtaacctcggcattcgcgcctcccttcgcggccacgaggagaagaacaagaacgatctcgccgataaaccccactccgtcgagttgcgagccaccagcacccccgacgacgtcgtttcccgagatctgctctctcttccgcggcctttgtcttcgactcagttatctgcttcggtgtccgatagctctcgccttcgtgttgcatatcagggggttcgtggtgcttatagtgaatcagcagcacagaaggcctacccaaattgtgaagctgtgccttgtgagcaattcgacaccgcatttgatgctgttgaaaggtggcttgtggacagagcagttttgcctattgagaattctttaggagggagcatccacagaaattatgaccttttactccggcacagtttacatatagtaggagaagtaaattttgcagttcgacactgtttgatggccaaccatggtgttaaacgtgaggatttaaaacgggttctaagtcatccacaggctcttgctcaatgtgagaacacactgacaaaatttggattggtgcgagaagcagttgatgatacggctggtgctgctaagcatgttgcctaccacaaactacaagatgcaggagcagttgctagttctgctgccgcaaagatctatggcttgaatatacttgatcaagacattcaggatgatagtgataatgtcacccgatttttaatgttagcacgagaacctatgattcctggcactgataggcgatttaagactagcatagtattttctttagaagagggtcctgggatacttttcaaagcccttgctgtttttgctttgcgccagattaaccttacaaagattgaaagtcgtcctttgcgcaaccaacctctacgagcagatgatagcaacaattccaagtactttgattatcttttctatgttgattttgaagcatcaatggctgagcagagtgcacagaatgccctgaggcatctaaaggagtttgctacattcttgcgagtgctagggagctatcctgtggacactagcttgacgactcccgaatataattactgttgtgcgcagcatagcccttctggggatgcctatgaagatggggccaaaactgtcgtggtcgaggcttgtggggaagaaattggtggtgtggtggaggacggagaaggagaggcaatgcggcagggaggtggtggccagagaaggggggtagtttgggtttatggtgaaggaaagggtctttggaagagggtgagggagaaggaatag

SEQ ID NO: 449 - DNA, 1063 bp, Glycine max
  Peptide Sequence Number=SeqID_117227
gaatcttctcaaggaggcttctcaaggaggtgagcttagttatgagagggcatcctctccaagcttcttatccaaggctcatcttggtggtgaagcttcttcttccatggcttattccctagtggatggcgcctcctctcacctcttctcctttgtcttccgctgcatctccatggtgttttcttttgatgttgtggattttgatggtggagaaattcgggcaacttgcttcaatgttgtggctgatcagttctacaatgttattgaagctaaaggacaaaggttgaaaactatttgtcatgttggggaatttccagttttggctacaaaagctgccagattaaatgatttcaatgggaagtctgtcaggactatagccactagtcagctatatgtggaggctgattttcctgagactgatgtgcggaagactatatctcaaattaaagatgagaagttagggactttagagaagcctgattggatatctgtctttgtagctgtttcacacattaaggttgataacttctgttacctcgggtgccctctcaagataagggatagacaatgtaacaaaaaagttactaataacgcagatgggacatggcattgtgaaagatgtaatcagtctattgacacatgtgactttaggtgcttactgtcaatgcagatagaggatcacactagcataacatggaattggataagtgttcctagagcaggacttagctccaacactacactagagagatgcaaaataagcagaaacaatgatgatggttatgatgaagacatggaagtggatttgactctaagcataggaggaggaaaccaagttaataataacaagaatagtagtagtaagaaaccttatctgcttccattagggtgctcagactcacccaatgggaaaactagggacctaaattcttctgtctctttccaatcagatagggtgagagatttcagtgaccccaccacccctatgagaagctcaagtgtgacatttgatcaagagagaaaggggccacattggctttctcaaggtttaaagcttaaatag

SEQ ID NO: 450 - DNA, 288 bp, Glycine max
  Peptide Sequence Number=SeqID_117228
atgaagaaggcctacatcacatgggatgacaatgatatggaatcatctgaggattcagaaaatgaagagataaacctgtgtctaatggctaaaagttatgaaagcaatgaagaggtatctttgaagaagaaatggtacatagataacggttgttctaaacatatgacgggtgatgcatcaaagttctcacatatctctcccaagaaaagtgggcatgtaacttatggtgataacaacaaaggtagaattcttggagtaggaaaaataggtacgaataaactcaattga

SEQ ID NO: 451 - DNA, 339 bp, Glycine max
  Peptide Sequence Number=SeqID_117229
atggcagttgatgctcttttggcattatctgctataatcattagcttgatttctataagaaatggaaaatttcagcacttgattttcaggaaatttgaaagttggttacctatgccaaggatgagtttacatgttgttgtgaaggcaacattagtgaacttctatgagacactgagatttgagttgaaagatgaggttggaataacgatagccacatgtggttggattggaagtgaaatgacgcggggcaagttcatgctagaggaggatgcagagatgcagtggaaggaagaaagagaagtgcatgtgattgccacaaggggcaagaagagcttctaa

SEQ ID NO: 452 - DNA, 243 bp, Glycine max
  Peptide Sequence Number=SeqID_117230
atgaacccaaaagcggttagtcttttgagtccagtaatcaaccaagaagaaaatccgcttcttgcaatgaacccaaaagcggttagtcttttgagtccagtgtttaaccaaggagaaaatcctgcttcttgcaatgaacccaaggaacgttggtctcttgtgttcagtgttcaaccaagaagactttctcttgaaaaacagtcaccaatagtaggtctcttgaaaaacagtcaacaagagtag

SEQ ID NO: 453 - DNA, 210 bp, Glycine max
  Peptide Sequence Number=SeqID_117231
atggcaaaacaacggaatggacctaccatttctaggattgaaccggatcggaaggctgtggtccgcaaaggtgggattgaacgtgaagaccgacttcatgtcgtgcttctcgaggatatcctccctgacctcaagctggtcctactcctagccgcccagccgcccatcgccggcttgaacaccgccacggggcccttcccctgcttgtag

SEQ ID NO: 454 - DNA, 444 bp, Glycine max
  Peptide Sequence Number=SeqID_117232
atggcacatccagactctattcctacagtagagcagtttattgagatggtagcctggcccgggacccaatcttctcttcataaggaagatgaaggtcccacagcccagatacctcaacatatggagaatgagtcatctgaggccattatcccagagccatttgatataggagaagaggcaaaagagacacaggtgagacaggtagctgctaccactcctaagcgatcccttaaggctacttcagagccttctgcaccaatggtaaatctaccttcacctcagcctgcagcagaaccttccactcctcttctacagatggcagaggacccaactacacctgtcctagctgtggacacttctcctcccgctactccagagcttcagctgaaagatgaggagaatggtcaaacacaggacacacaggaccagtcacaggaattttaa

SEQ ID NO: 455 - DNA, 261 bp, Glycine max
  Peptide Sequence Number=SeqID_117233
atggggtgtagtaggattgcatcaacaaggaagttctttgttgagtctgattgcaatttctcctttgttgtctttctgccatactccatattcatctttactcatcgcgtccaacccatcattaaagaagttaattatgatggtgaaccagttgctaatcctgatgcttttgctcttgaagtctataatcctccaccatcaagggaatatgttaaacttatcaaggctgagctactaaggataatggaagtacttgcttga

SEQ ID NO: 456 - DNA, 1158 bp, Glycine max
  Peptide Sequence Number=SeqID_117234
atgttcgtcatcattcttttgttgctctctaacttgctgatccaaactcaaagtggcgcaagcactgtggtaattgaccccaacactttctcctttgttactttcactcctgagagttgcaccaatggtgagttgctttgcatgggttcagccactgctggaaatgggtacttgagtctcactccagagccacaacaaagtggcaattcgagttcgtcattgtctaacacaacaaacaatgttggaagggttttataccctcttcctgtgaatgtttggccagcaattatctccaccacattcactgttaggatcactcctttttcagaaaattcaaccggctctggggatggaatggcactagtgtttgcacaagataacaggccctcaccaaatgctagctatggctcatatcttggaatgtttgatcagtctacacaaggagggggttttcaacaaatagctgtggagatggacactttcatgaatgaatttgatctagatggaaaccacattgggatagtcacaacaagcatcacaaatccacttgcatctgagagtctcaatagctctggcattgacctcaaaagtggaagagacattgaggtcaaaattgactatgatggatggagtaaaatgatttttgtctctgtgggatactctgaaagccaattgaagagtgtccttaaccattcaattaacctaccagacatagttccaagctccatttatgtaggtttcacagcctccacaggcaacacttttcccgaaagccaccaagtcctcaattgggtattcacatcagtgccactgcctattctttcagctgaacacactaaagttggcaccatcaagaccatattggtagttgtcgcggtatgcttatttcctttcatttggatagctgcttctttgaggagaagatatatgagggctaaaaagaaaggggatatagaaagcctatcaaagaaggctgcagatatcgccgaggtgttcacttacaagcaactatcaagggctacatgcaacttcagccaggaaaatcttttgggaagaggtgcatttggtagtgtttataaaggtatcatattagactctggaaaaactgtagcagtaaagaagatttcagcaacttctaagcaaggtatgttttggtaa

SEQ ID NO: 457 - DNA, 654 bp, Glycine max
  Peptide Sequence Number=SeqID_117235
atgctggactctaatcacgatgctcatttgggagattttgggttagcaagattactcaaaaatgaaggttcagtgactacaaatctaaatggaactctaggatatttggctcctgaactaagctttacagggagagctacacctgaatcagatgtgtatagctttggcatggtagttcttgaggtcacatgcgggaaaaggttaaactggcttaagcaagggaacagttttgtagattctgtgtggaatttgcattctcaaaatgcattgctggagtgcgttgaccaaagactagagaacaaatttgatgaggaagaagctaaaagggcattgatggttggattggcatgtatgcatcctgattccttgttcaggccaaggatgagaaaagtggtgaacatttttcagaacccaaatgaacctttaatggaattaccaggagtgaggccaactggagtttatgtatcagtttcttctagtacatcagcctccaactctagctctagagaagcatgtttggtacttgacactgaacgaagccataaattgtcattgcttgctttgtgggtcagggttgtatcttcgtattttacttggatgaagcattttggtggcattgaacaaggctataaatggtcattccttgctttgtga

SEQ ID NO: 458 - DNA, 945 bp, Glycine max
  Peptide Sequence Number=SeqID_117236
atggaaggtttccaagaaggtggtggacaagctagtatgcgtacagagaaaattcctatggggaggagttgcagatcacaacaagatagcctgggtcaaatggacacagtgtgccttccaaaggataagggggggctcgggatcaaggatgtaaacactttcaatcttgcattactagcaaaatggaagtggcacttattccagcatcaaggacaactgtgggccaaggtattggagtccaaatacggaggttggaggggtctaaatgaggcacctagaattaacagtgaatccatatggtggagggatttaaagatggtatcccatcatccggaaaatggtgaagcactacagaggagcacagtctggagggttggatgtgatgacagaattaagttttgggaggataactggatcggaggtcacggagcattagtagcaaaataccctaggttatacctcatctctagtcaacaaaaccaaaccattcagcaaatgggggtccataaggatatagggtgggaatgggagttcacttggaggagaccgctgtttgataatgacatagaaatggctgtctcattcctaaaagacttggaaagcaagctaattcagtcacaaaggtcagatgattgggtgtggatgacagatcccagtggccagttctcaacaaaaagtgcatacaatgtcatgaggggggttttatcagaggggacagaagatatagcttttgaagaattgtggaggttaaaggtaccaaataaaatattaatcttcacatggagattacttagagacagacttcccacaagaagaaaccttcatagacaacaagtggagataaatgatagaagatgtcttttttgcagtagcatggaggaggacacaggacacttgttttttcattgtagcaaaatcagtccagtttggtgggaatcgttgtaa

SEQ ID NO: 459 - DNA, 207 bp, Glycine max
  Peptide Sequence Number=SeqID_117237
atgaagaacaaaaatttaggagtcaatgttggattgcaattgcgagaccaaagctgcataacattattcatcaacatcaacaacctcactagcaacatcaaaaccaacaacaagaagacaatgagcaggcagatgaccaacaacaagatgatgaccaacagagacacgctcccaatgaatattttgattactgacttaacatcataa

SEQ ID NO: 460 - DNA, 255 bp, Glycine max
  Peptide Sequence Number=SeqID_117238
atgataaccctagaggcacgagcagagcacaagccagcaatgggaggggggaaggtagatataatagggagaagcggagaaagttctagtaggtaccctcgttacgggattagtacattcgctgtgttggggggaggggtgttcgcgctttcgcaccatactgacaggcatgttttggagcggcttaagataataatgtttaatatcaggaatgttttaacattttcagaaagagatataagattgctcaagtga

SEQ ID NO: 461 - DNA, 105 bp, Glycine max
  Peptide Sequence Number=SeqID_117239
atgcgtggacagcacaaagtcagggatatccacgtcggggagcaatcagattgtgtcagcaggaaaggaggcggaggtgtgaaagagggtatgcctcagcggtga

SEQ ID NO: 462 - DNA, 2415 bp, Glycine max
  Peptide Sequence Number=SeqID_117240
atgagtgacgaaggagaaagaacttgtcctctctgtgctgaagagatggatttgacagatcagcaattgaagccttgcaaatgcggttatgagatctgtgtctggtgctggcaccacataatggacatggctgagaaggatgacactgaggggcgatgcccagcatgtcgatctccttatgataaggaaaagattgttgggacagctgcaaactgtgacagattggtgaatggagttaatattgagaaaaggatgaagactcagaaaacgaagtctaaatcaactgatgggcgtaagcagctcagcagtgtgcgagtgattcagaggaaccttgtttacatagttgggttgcctctcaatcttgcagatgaagatcttcttcagcgaagagagtattttagtcagtatgggaaggtcttaaaagtgtcaatgtctcgaacagcagctggtgtcattcaacagtttccgaatgatacctgcagtgtatatataacttattcaaaggaagaggaagcaattcgttgtattcaaaatgtacatggttttgttttggagggtagacctttaagggcttgttttggaaccacaaaatattgtcatgcatggctccggaatgtgccttgcagcaatccggattgtctgtatttgcatgagattggctctcaagaagatagttttaccaaggatgaaataatttcagcatacactagaagtcgagttcaacaaatcactggtgccacaaacaatatgcaacggcggtcagggaatgtattacctcctccactggatgacaatatgaatagttcatctgcaaagcctattgttaaaattcttcaagtctttcaccatattgataactctgttagcactgtaagaggttcacctccaaatggaatatatgggaaaaatatggcccttcctactagtgctgcatggggtactcaggtcacaaattgtcagccccctgctggaggtctatcatatccaaatgggccatccaagccaaaacctgatacaggcagcagcacactggtattttctgcagctgttacaggctcaattcaggcttctgatgttacaaagaggccaccatcgagtaatgggagtcatagtatgacacctagagtgaaaagtgaattgttgaaacctgtcaaacaatataacaatagtgtggacagtctggttagtgaaggagaaaaaactttagcttctgatgtttctcctatgcttgtgaatttgaacaggcagttgtctcctctaccgttgtcccgagatagtgatggaaattgtactacagcaaacacaataaattctactaacatgattggacagtcttgtaactttggtcttgaggaagcaatgactgctaccaatgaagagattcagaatttgtccaacgagttgtcctcaattaacattgatagaaatgccgaacattgcggtataaccaaacctaataatagcccacctactgatcatgcattgattaaatctcctcaaattcaaggatcacagtataatgttgacagatttagagatgaaataactacagatgtggctggtaaagctacctcagattttttggtttgtaattctactgaacagtgtgattggaaattggattctcaatctctagtagtatcagataatgctgaaattgatgatgatgtgacatcttttgataatcaaagactcaaggatccagaagttgtttgtcgttcttattttccaaagtcaaccagattcctgcaagcatcaaaccattctagcccttgtcttctgcagcatggtgaaccttgtactgccataaatgcaggttctgtatctgctgatgatagagttcgagatgaatctatgttacatgcatccaatatattatgtaatggtcaccctgaaaaattggtcagcagcagctcctatggtctgcttcatgatgaaagaaatgggcatatcattcaaagattagttggtgaagcagttaattctggacatgatattgctagggataaaggtgaaagtagtataatttctaatatattgtccatggactttgatacctgggatgactcactaacatcacctcataatttagcgaagttgttgggtgacaatactgataaccagcctggtcctttaaacaaatctagttcttggaaaggtcacagtaacaatcaatcaaggttttcttttgcaaggcaggaggaatccaaaatccaaatgtttgatccacatgcatcttatggtgtcagccatcaacggccaaaccgtacagtcttcctgaattgtgcagaaagagacttgtatatggataagttgggcattgcaaatggattttctaccagtaactttgaggaagctgagaatatggtcagtggtcattccattgcatcttctaataagttttctggtgagtaa

SEQ ID NO: 463 - DNA, 417 bp, Glycine max
  Peptide Sequence Number=SeqID_117241
atgggtcacgccgtccctgctggttattctggtttgagaaacactgagaaaaaccagaaaacagctaaacaagaaccaaacattggggaacaaagtcaagaagctataacagcgcaacggtatttcattcatatcacaaggatgatggacctttcaagttataaagcgatctatttcatacccccattatcagagtatcaaactgtagcatctaaatccatttcaaaacaatttccctttaccagtcgaatcaaacctctacttctacccacaagggtagttaatctaaaagaacagctcacttctgctaatccagaactacaaagaaaagagagggaaatgagtgcacaattaccaaaaaaacaaaacaccaatgtcattcttgacatggaaaatacgaaatccagtacaaaatga

SEQ ID NO: 464 - DNA, 297 bp, Glycine max
  Peptide Sequence Number=SeqID_117242
atggaatcaaaagcctgctccactctctcatgggaagaaaaaccaggtggtggcaacctgcttggaatggaaaatcctggcggggctgaaacttgtgctcttgagatggctgtcaaccataaaataaaaccgtgcataaattcagaggaaggcaaacaggttgcccagagaaagcagacttacatacagctaaaacttttttactttctaactagaaaagagacaatcaagcaacagaaccagcagtcgttatgccactttgataaagtggacataattttctttcatatccagtaa

SEQ ID NO: 465 - DNA, 270 bp, Glycine max
  Peptide Sequence Number=SeqID_117243
atggagagcagcgacacatacacccccacttcctctgccccactttctcactccccctctaattcctcttcttcctcaccaccaccacctcccactgttgtgatgagtccttgtgctgcatgcaagattttgaggagaaaatgtgcagagaaatgtgtgttggcaccttatttccctccaactgaacctgccaagtttactattgcacaccgtgtatttggtgctagcaacatcatcaagttccttcagatatttagcattgatctataa

SEQ ID NO: 466 - DNA, 561 bp, Glycine max
  Peptide Sequence Number=SeqID_117244
atggagttagctagaggaagaagggctggtcccccacctcataaacacataaaacaaaaactctgttctgacaagtgccataatggacctgcctcacacggctcatgcctcaggccgatcctcgttgctacaaagttgcagggtggctccctaatcatagagttaaatttttcttcccctcctttttattttgatatgatgggtcggcatgtatcaccatcaaccaacaacgaaactaattgccattacgaaggtgaagagatcccaaatctcatgggaattgaccgttgttttatacaattgaaggaagaaataagccaatatgcattgcgggtaggcatgctggatgaagtaaaacagagactctggggaattgagttcatagaacttgttggaaagatggcagccgatggaaaggtagctgaaattgagaatcctgatgatgctgcagcagagaacgttggtactggggtagcattgacctggccatgtgtttgccacgcccagttggggagtccgtttgaaggatcaacgccgattctctctgctctttcctgctaa

SEQ ID NO: 467 - DNA, 135 bp, Glycine max
  Peptide Sequence Number=SeqID_117245
atggatccgatcggaaacaaccgaatgagagaggtaatactggtgggttcggtgaccggtcaccgatattgcaaaagggaacagatatttttcgttgctggttctctctctatgcgaaggtcaccgtctcgttga

SEQ ID NO: 468 - DNA, 300 bp, Glycine max
  Peptide Sequence Number=SeqID_117246
atgcagggcattctggatccacctcaacagcattttcaatgcatgtcacaagtttatcatcatcatcatcatcatcatatacaatttgcattgtcaaaccacccaaaacatatgaaaggtgaacaacaactggatactgcaagcactagtgcacctgtttcacccctaacaattctccctttcctcaacagcatgtatggaatcaggacaggagatgttccccaaatgcatgcaagaccaaccccgccagcacacactggctggtacaatgataccatcaagcttttccaaattgaatga

SEQ ID NO: 469 - DNA, 414 bp, Glycine max
  Peptide Sequence Number=SeqID_117247
atgagagagataaattggcctcagtcaggctggtgcatggtctgcatgttatccatgccattaaacaaatctggttgctgcaagcccccaacagattgtggctatgtctatcagaatgagacagtgtggatcccaggatcaggattgatgggagccaacccagattgcacaaggtggagcaatgatcaagagcagctttgctatgcatgtgattcttgcaaggctggtgtgctggcaagtctcaagaagagttggaggaaggtctcagtgatcaacattgttgttatgatcatccttgtcattgtttacataattgcttatgcagcttataggaacaaccgcaagatggataacgatgagccctatggtgaagcaaggatgacaaaggctcaacctagtgccttccatctttag

SEQ ID NO: 470 - DNA, 1839 bp, Glycine max
  Peptide Sequence Number=SeqID_117248
atggctacaagaagtgggtcctctgaagtgcctcagaaggtgtctccacgtgccgtgcgcaaactcaagcctactactctggacatcgactctgcatcttctttaagtcaggctactaaatcatcaaaggaaagaagccccaaagtcactgaccgcagatcacccagaagcccagttgttgagaggaagcgccccagcaaaatatctgagttggaatctcaaatttctcaactccaaaatgacttgaagaaggtaaaggaccagcttattttgtctgaatcatgcaagaagcaagctcagcaagaagctgaggagtccaaggagcaactactagccctatctgcaaaacttgaagagtcacaaaaacaagttctggatctttgttctactggagaagctcgcgttcttgagctccagaatatcgtagaagaacgtgatatggcatgccaatctgagcttgagtcttccaaaaagcagctctcagttgagtctgctgccctggcctctgcaacgaacgaaattcagatgctcaaggcgcaacttgaattggtagctaattgtgagagtgtgcaatctcaacacgcagaatcagcagacattgagcttcttaacctgaagcagaacttgtccgaaacgctttctcttgtggatgccttgaaaaaccaactaagggattgcaaagaatctgaagctcaggcccaagcattggtcaatgaaactatgatgcaacttgaggctgcaaaaggaactgttgagttcctaagggctgatgttgcgaaagctgttgatggctacaactccattgctaaagagttagaccaatctgaagcacgggtgaactcactagaggcacttgttagcaatcttgagacagaccccatcaataataaatgcatcctttcagaaaatgttgcagatgatcataaatttgagtaccaacctgaaatattgaaacagggtgaggatcctagtcagctggaagcagaagttgtttctttgaagtccgaggttgaacgattgagatctgctatagagactgctgagattaaataccaagaagaacagaatcggagcacggtgcagatcaggaatgcctacgagttagtagaccagataaaatctgaatcatgtcagagggaatgtgagctagaggctgagttgaaaaagaaaaaagctgatattgaagagttgaaggctaacctaatggacaaggaaactgagttgcaaggcattgtggaggagaatgacaacctgaacctaaagcttcaagagagcatgtcatccaaaaacgagcacgaactaaaaagggaaattaaaagactagaagaatgtgtggcggaactgaaggcagatatgatggacaaggagacaatgctgcaaagcatatctgaagagaacgaaacgctgaaatcggaaatgaacaactgcagcaaagcaagggaggaagttgctgctgaagtagagcaagtgagggcagcggaacgcgaggctctcatgaaactcgggattgtgatggaggaggcagataagagcaacaagaaggctgcaagagtggctgagcagctggaggcaacacaagccgcgaactcagaaatggaagcagaactgagaagactgaaggtgcagtctgatcagtggaggaaggctgcagaggcagctgctgttatgatttcaacagggaacaacaatgggaggctcacagagagaactgtgtctttggataacaacaactacaagggctcaccctatgctgaagacatggatgatgacttccagaggaagaaaaatggcaacatgctgaagaagatcggggtcttgtggaagaagcctcaaaaatag

SEQ ID NO: 471 - DNA, 186 bp, Glycine max
  Peptide Sequence Number=SeqID_117249
atgcacactcctgagttaagtagtgatgagtttaagaacttgaaaaagggaatacttgagggaagggaaaaagaaagagaaagaaagagggtgggaccgagagggaaggagatattattaattgaaattgatggaagggaaggattgtcgtcgtttgttgaatgtccgggtgatgtggacttgtaa

SEQ ID NO: 472 - DNA, 231 bp, Glycine max
  Peptide Sequence Number=SeqID_117250
atgcagtacatcctttcttgtggattgcttttgccaattgagtcactgtttactatccagtcttctgtattcaactacagggtccattatggtagggaaaacacatggcatgggagctgctcgcaagctgaagtcccaccgaagaaggcagaggatgaagtgcttattgctggttttggccgaaaagggcatgcagttggagatatcccggagttcgatttaaggttgtga

SEQ ID NO: 473 - DNA, 165 bp, Glycine max
  Peptide Sequence Number=SeqID_117251
atggaatttgaggataaaggagaatcggcttttgagacgaaattgatattcaatatgcatccaattggaggaataaagaggcattgggaattcaacgttgtctatattctccgctactacaaagtagaaagcttggagagtttaatttttattttaatcctctaa

SEQ ID NO: 474 - DNA, 207 bp, Glycine max
  Peptide Sequence Number=SeqID_117252
atggatgaaataagagaaattaacagtaagaaaggacctacgagcatttggagttctcgagacttaataaaggtggcactcagaaggaggatcggagatggtgttaatattaatgtttggtctcagcactggattaataatgagacttcgggtcctattggtgatgttcctcactcgcagtcaaagagctggtggttaaagatttga

SEQ ID NO: 475 - DNA, 429 bp, Glycine max
  Peptide Sequence Number=SeqID_117253
atgccaaatacgtttaattttcgatccgtgttcaatgaaatccgtcggcagcatagtagacaagaagaacaattacacggctacgataggagtgtgacaatgatattctggaatgactttaactttgcagagtcattcatctcaatcaagtttgaagagaatggggtggcatcgtgggaaaagagcacagtgtcaaagaaggtgtcgtcgtggaaccatcaaaacaaggacaacaacaagagcgtgatagagcatgggaagtcacgtgacacatttaggtggcgaaagaggataggacacatgctccagctcattcggtggaagaagagcggtggtgtgtgccacgtgggcaccaaggtggagggagtgaaggtcagaaagggttggatgaggactctgacaaagagaaaaacaactaccatggaataa

SEQ ID NO: 476 - DNA, 132 bp, Glycine max
  Peptide Sequence Number=SeqID_117254
atggagtatgcgactggtgaagtagatagagagctggtgcttcccttcctcttgggtacccttgccctgggccaacttaggaccggtggtgtagcgatggttttcttgaagcctaagaaggcttgtttgtag

SEQ ID NO: 477 - DNA, 492 bp, Glycine max
  Peptide Sequence Number=SeqID_117255
atgatagtcaatgaagcatctgggttccatgtgctaagcttcctggatgcttactccggatacaaccagatcaggatgcacgatctagatgaggagaaaatgacatttatcattgaagatgccaccttttgctacagggtcatggccttcatcctaaaaaatgcaggtgctacatactatagactgatggatcagatgttcaagcaattgatcaaacataaaatcaaggtctatgttgacaacatagtcgtcaagtctcaaagcatagcccaacacggggtagacttggaagaggtctttgaagagctcctcaaatacgacatgtgcctcaaccatgaaaaatgtacttttgagaaatgcactgctattttggatatgcatagtttgactaatgtccatgaagtccaaaaactaaatggaagactagcatccctatccaggtttctccccaagctcgttgaaaaaagagaagccattctacaaatcgcttaa

SEQ ID NO: 478 - DNA, 243 bp, Glycine max
  Peptide Sequence Number=SeqID_117256
atgaagacacagttcatgttagacttcccagcagaattcgctgggaacaaccaaaccaccccaaattggtggaccctctatgttgatggtgcatccaacgtaaagggaagtggagcaagaatcattctcaatggcctcgacaatgtcaccctaaagcaagctctcaaactcaacttcaaagccacaaacaatcaagctgagtacgaggcgctcattgcaggttgccaacagataccagactaa

SEQ ID NO: 479 - DNA, 231 bp, Glycine max
  Peptide Sequence Number=SeqID_117257
atggagataatgggaccattgccaaaggccctaggagaagtcaaatacttactagtcgccatcgatttcttcaccaagtggaaacacctcatttgcaggtacgacctcccatacgccattgtcatggacaatgacactcaattcaaagctcagacttacgaagacttcttgataaggcatgatgttaagcaccttgtcacctctgtcgaacatcctcagaccaatgactag

SEQ ID NO: 480 - DNA, 270 bp, Glycine max
  Peptide Sequence Number=SeqID_117258
atgagtcacaatcataacagagtcagttttggaaaaacacatttaaacacctccaaagaaaacaacaacataatcaatcactttcctccatcaacatcgaagacccgtggggtttggacggtttctcttccttatggggtttctcaaaagcctcaaagcacaaacaagcctgtcaaccatatcataaacaacaaagaaggaaaagacaaagcatgtgaggaccttgactctcttgtgtgctataccatttctaaagtaggtggagtgtga

SEQ ID NO: 481 - DNA, 1354 bp, Glycine max
  Peptide Sequence Number=SeqID_117259
atgggatcaagtcaaaagccttcacttaaaaagaggttctatcaagtcaaggtcaagagcctaggaatcaccagcctaaaagagctagggcagttgatgggtcagctccagcggcaagcttttcgcaaagcttacgtcgttgaggtgcttcacttttggggacttccagctatcacccatggtggaagaattcgaagaaatcctaggatgtcctctaaggggaaggaaaccatacctattctcagggaattagaccgccaaaagcaagtcgaaaatggggtggtcgggataccgagaaaatgtttggaggcaaaagcaagaatcttggcaggtagaagcgaatggaccccgttcatagtcgttctcgcactgttgatctttggaggagtcctctttccgaatgtggatgggttggtggacctggcagcgatcgacgcttttctcgccaatcataaccacaaggaaagcccggttgtcgctatgctagccgacctatatgacaccttcgaccgaagatgtgagaagagcagtatgaggattgtctgctgtactcccgctctttatgtatggttggtttcacaccattttcgccaagaggtgaggcatgcctgcccgttagaaagccatcgttcatgcacagagaaaggaagggcgaattgggaccaactcttagcaaaaagagaaggagcatctatcaactggggttgcatcaattacaatcccattcttgcgataaggcaacttggctacccgatgagaggggcaccactagaggaagagctcgcacctgtcatttcacgaggtttcaataagaccaacatggagacacttcaaaaggtccgcaaggcatgggaggtggtacaaaagaaggacaaagagctcagaggcagtaacaatgggcccattagtggctaccgtgagtggttgaaagcccacgtgcaaggtttggattggctcccaagtctgagaaccactaaaagggaggaagttgaggcaccagaggaagacgaagaggtgcaggctcttaggacagaactcgagcaagctcaaacagttaaagaaaggttcaaatcagcagctttgaaaatccgaaaagagaataccgaactgagagatgtatatgtggctaccaccaaagccttggaacgagaaaccaagagggctcgtagggaagaacacggccggaacaagttccgaggggctctgtggggcagtaacagcgagcttaagctccggagagaggaaagggaccaatcgcgagtagacagtttgatcttgaaggatgagttgaaaggcttgctcgaggtccaaagaaaagtttgtctcagcggttatgcgagacagagaccaacat

SEQ ID NO: 482 - DNA, 255 bp, Glycine max
  Peptide Sequence Number=SeqID_117260
atggcgaggacgtgtagtcctctgaaggcttgggcgtgtagccctcataaggtgaggacgtgtatccctctaatggagaggacgcgtagtcctctgaatgtgagggcatgtagtcctctaaagatgaggacgtgtagccctctaatggcgaggaggtgtattcctctgaaggcgaggacatgtaaccctatgaaggcgagggcgtgcaaccctctaaaggcgagggcatgcagctctctgaagatgtggacatga

SEQ ID NO: 483 - DNA, 745 bp, Glycine max
  Peptide Sequence Number=SeqID_117261
aggattacgcctcctctccattagagggatacacgtcctcacctttagaggactacacgtcctcaccttaagagggctacaagccctcgccttcgtagggctacacgcccaagccttcagaggactacacgtcctcgccatcagagggctacacgtgctcgccttaagagggctacacgtcctcaccttcaaaggactacacaccctcacttttagaggacaacacgtcctcgcctttagagggatacacgtcctcacttgtagaggactacacgtcatcccctttagagggatacaagccctcgcgtccatagggctacacgccctcacctttagaggactacacatactcgcctttagagggctacacggcctccccttcaaatggctacacgttctcaccttcagagggctacacctcctcgcctatagaggactattcatcctccccttcaaaggactgcacgtcctcgcctttagaggactgcacatcccaatcatcagagggctgcatgccctcgccttcatagggctgcacgcactcgcatttagagggctagacgtcctcccctttagaggaccactagtcctcgcctttagaggactgcacgtcctcgccatgagagggctacatgtactcgccttcagagggctacacgtccttgccttcagaggactacacgtcctcactttcagaggactgcacgtcctcgcgatcagagggatgcacgtcctcacctactga

SEQ ID NO: 484 - DNA, 312 bp, Glycine max
  Peptide Sequence Number=SeqID_117262
acttatcaaggtaatccttgtggcgtctatcctgacttatcttccttcaccggaagtggcatctacccagacttatcttccttcactggaagtggcgtctacccagacttatcttccttcattggaagtggcgtctaccctgacttatcttccttcactggaagtggcgtcatccaaatctctgtaacctgtatcaaacgatccgctcctactcaggttcacatcatctggttcgtgttttgtgatgaggacataaccaagggcaaggaccatgaagcacttgaagggtcccatgaccagaggcagacttaa

SEQ ID NO: 485 - DNA, 156 bp, Glycine max
  Peptide Sequence Number=SeqID_117263
atggaacgacccacttccactccggaagcctctattgagtactttgccaaaaatgagaaggcggaaatgagtaaccttttggctaaactcatctctatgaagtataagggaaaaagtaatataagagagtacttccactccggaagcctccaatga

SEQ ID NO: 486 - DNA, 513 bp, Glycine max
  Peptide Sequence Number=SeqID_117264
atgcgggcgcggctgttgaacgccttcatccagcgctcgaagcccgacctgctgatcgaacatgttggccatgaaccagatcacgaacaggatcgacacccacgagccgaacacgatcaccacgcgggtgaaggtgatatggaagtcgtcgcgccacaggtagttggcgatcaggcccaggatcagcagcgaggccgcctgccagccgacgatcgaggcgatcagccactggcacttggcctgggccagcacagccacttcatcgcggatctgctgctcgctgaggttgcgccagtgcgccacctgtttgtcgaacgggctgctgtagagctcgttgtcgcgaagcagaattcccaaacccttgaacaaggcaatcatggctggctccttgtggaacgtgcgtcgatcagcattggacggtgtggcggatccagttctagcacttccagcgagccgtgcaatgggggcaatgccaagcggcgcaagggtttgaccggtgggagtgaaaattga

SEQ ID NO: 487 - DNA, 215 bp, Glycine max
  Peptide Sequence Number=SeqID_117265
cactaagattagcaggggattcaatagcaatagcagctccttctgtgcatcttccttatttagctgcgggaacgagtgctgtgcttgccccgaccgataccaccattcattaccgtgaaccagcccctcctataggcagtttccttgttcacaagactcttaagcttatctgctacatcagagtgaaagagaagactgctttcaaggcttgttga

SEQ ID NO: 488 - DNA, 527 bp, Glycine max
  Peptide Sequence Number=SeqID_117266
gatcaacgtggaccactggtctctcggcaccagctagtctactagacaaggatcatagacgtgaggctttccgtgtctgcttcacgccagacgacgaagctgatgcgtcggaaggaagaggaggaggaggaggaggagaaagaggaggaggaggaggcgaggctaataagggcaacgaagggagaattgaaacacataaggcaaaattatcaaatgaagaagttagtgccacaaatgagggtagtgcaaagaatagcatgaaaaacaactatgatgaggttagtagatttgaagataaggacaaagaacaaaccatacaaaattcaaaaatgaaaaccgagggtggttcagagaataatgtcaagaacaaagatgttgaagatgggtatagtgtggatagtaatatcactgaacaagcaaatatagtgaagaatattattctaacttcaaatagtgctcttgtgttgaatctctcattacttgcagaaaaggatttcaattttgttgtaactgacaacatgtgctga

SEQ ID NO: 489 - DNA, 981 bp, Glycine max
  Peptide Sequence Number=SeqID_117267
atggacgacgggtgcgaatttgtccaaaaaacactgttcatacatacagtatttatctatactggatgtgttcactttgtgccattcgggggccgcaagtttgaccggcgcaacgaagtcctggctgaaacgggtggtgccgtcagtgccttaaccccgagagagcacactgtgttacgtcaacaatgcgtcgtgtccggcccgtacggccatcactgcgcaacccctgtgagaacagggataagctggcaacaggcagcggaaagtcctgaaacagttccgctgattcaggttcaagtcgcacctgaggggggcgggaaaccgcccccctacaggcgtccttcgggcgttccgggaagacttgatggaggaaccatgccaccgctattaattgccgcaacaacgccggaggatccggggttcgttgcgctgcgcgccgaaagccttgaacagcacttcaatatgctgcgtcggctggcggaaaactggcaaagcggcaaaaaccgctttaacgcccctggtgaaaagctgctgggcgcgttcgtccgtggccagttagttggggtctgcggtctgaacgtcgaccccttcagccagcagccgcgggccgggcgcattcgccatctctatattcgcgatagccatcgccgccagggaattggccagcagctgctgctctcagtcatcacgcattccggcgcctggttcgatttccttaacactcatgccccggcgcagggctggcccttttatgaacgctttggtttccgcccggtatacgatgagccgcgggtcacgcatcgcctgttctgctcgcttccgctgaccttaactgctgaatctgcctgcgatgaccatcaccgtattctgcattttgctttttcgccgcactgctccacgccagctggaacgcttatcgtcaaagccagcggcgataaaaatgtacgcggcgataagcgtcagcgggttcggcctcgctga

SEQ ID NO: 490 - DNA, 658 bp, Glycine max
  Peptide Sequence Number=SeqID_117268
actagtgcctgagatcgaaggcatgattgctgccaccggattgagtccactgatcaggtgttctgttatcaccactgatcttggactcatatccgcctttgtcgagaggtggcatcgcaagactagcacgttcaacttgccagtaggcgagttgacaatcacgctggatgacatggcgtcactcctacacgttcccatcactggcgcgctgcatacgttcgagccgctggttacttcagacatgattggtctactgacgaaacttcttgaggtcagtcatgaggaggctacatttgagacccgacaggctggtgggcctcatggccagatgatgggttgtagcacccgcatgtatctgctccacttggcagggggattcgcctggggagcggctttattagtccacatgtacgagcatctgaacgacgcgtcgcagacctctacgcggcagcgttgggcgtgctggatatacgagcactttcctacaatgcatacatccgtcattcatgatgcttatgatgaagggagcccacgggcctgcaggtggcttacgggtaaggctcatatgacggggatcaagggagccccgtatcggagacgtcgggatgccctgactgtgactgacgtgtgttggatgctctatgctgagcaccgggga

SEQ ID NO: 491 - DNA, 129 bp, Glycine max
  Peptide Sequence Number=SeqID_117269
atggaattggctaaggaaaatagtgtctttggacactccgtgctaagcgtgaatgatgttgcgctaagcatggttgcactacaagataaacatgtgtttacttcaattatggtgccattgtggttgtaa

SEQ ID NO: 492 - DNA, 165 bp, Glycine max
  Peptide Sequence Number=SeqID_117270
atggaattggctaaggaaaatagtgtctttggacactccgtgctaagcgtgaatgatgttgcgctaagcatggttgcactacaagataaacatgctttaccaaattacgtgtattgtaagttgcaagtggtgaattatgaatgggatcacaccatgagttgttag

SEQ ID NO: 493 - DNA, 573 bp, Glycine max
  Peptide Sequence Number=SeqID_117271
gctagtatgcaagagaagactagctccataaagtgttttaaatgtcttggaagagggcactttacttctcaatgctccaccaagaaaaccatgattatgaggggccaagacatttatagtatccatgatgaggctactacttcaccttcctctagtgaaagtgaggaagcaaaaggggaagaatctagtgaagaaatctacccccaagaagaagaacaacctttaatggttgaggaggagtgtaaggagacacttgttagcactgccacacctcttgggcttgaggttattcctcaagtaaaggagttgttggatgaggttttggttcgtaagagcttaaatccttgtgctttgttagtgcccaaaataggcatgcttgctcagcctggaggttcgagcggtgcgcttagcgaattaattctcgttgagcacatcttggacaactcatctgcttccaggatcttctacacgcttagccacaaattgttgcccttagcggatggctcgctaagccatagaattggcttagcgagcggctcaaaatcagcactgccactaaacttgcctaattag

SEQ ID NO: 494 - DNA, 526 bp, Glycine max
  Peptide Sequence Number=SeqID_117272
atgcgggggtaccgtatggttatccgcaccttttgtcatcccgagacggtgagcccgatgacatgggcgaacaagcctgttgacgcgcagagactaacgtcgtcttctgcaccttacgtcaaccaggggggaagcgagctcgttgacgccaagtccgatgacatgcgggggtaccgtatggttattcacaccttttgtcatcctgagacagcaagtccgatgacatgcgggggcagcgagcccgatgacatgcgggggtaccgtatggttatccacacctttcttcaaccaggggcgaacaaacccattgacgcacagagactaacgtcgtcttctgcacctttcgtcaaccaggaggcaagcgagcccgttgacatgcagagactaacgtcgtcttctgcacctttgtcatccagagacagtgagtccgatgaaatgcagagatacccaagtggttatccgtacaaaacaatttctgttaatcctgacccgagaagtctgggagcaggcggaaataccccaagtg

SEQ ID NO: 495 - DNA, 384 bp, Glycine max
  Peptide Sequence Number=SeqID_117273
atgtcctgcctagtgatcataactccgaccttcctctgccgtagtgtcagctggtgtatgccacccaccaggcaccctctagacctggataagtctaacagggccctggggtttccagcattgatcacgggcctctgccagtcattcggggttcccgtcacacctagtaagcttagcctcagtcagcaaggccagggttttgctccttttgtgtaccctactccagttcagtttagggctgaggtcgcatggcccggagattggcccgaggcccaggcaggggaggcgcctgcaggagctctcggcgatgcagaggaggcccacaacatggatgaggagatgacggagttgctctgtttcctgggaggaagcggagccacgtga

SEQ ID NO: 496 - DNA, 1022 bp, Glycine max
  Peptide Sequence Number=SeqID_117274
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcctgccggcaggccatcggcatgcacctccgacagcagcggactggcctcggccagcttcagcagctgctgcagggccgcgcgcagctcggcctggctctgcccggtacgcgcctgcagggccagcgagaacccggacgaacggccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 497 - DNA, 848 bp, Glycine max
  Peptide Sequence Number=SeqID_117275
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggtgagaagtctctagagctgacccttttagaagaaaggaggtggccctgtgggcagtgcttccctggcatgggcctgggcacagggcctgaactacttgcaggtcccaagaagggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 498 - DNA, 549 bp, Glycine max
  Peptide Sequence Number=SeqID_117276
atgatcctagattttaagagaggtgaggactatattgaggttctttgtggcgctacaaacaaaaaatatggagattatgttgggaggctaaaaattaataacgaaggtcaatatttcatcacttgtgagtgttgccttgagtgtcccttggtgaatgtcactctagaagcatttgagaaacatgctttaagggaagggagcggaaggtggaagagaaacatctgggttcattgtgaagacgaagacaaagttccactctggaagacacctctgataaagtattatacacaccaggcaaatgtggctaaccggaaagactctgcaatgaggaaacaaaactttcacagggatgagttcctacgttgcacgagatgcgggaaggagcgcaggttccatctcaagagcagaccagacattaagaactaccatgatgcttcaaacaacaaatgctggaattgttctctttggccttatcaaaattggtacttagtcttgcaaaacacattatatgctggaaaaagatactggggactcacgatgtgtcaataa

SEQ ID NO: 499 - DNA, 163 bp, Glycine max
  Peptide Sequence Number=SeqID_117277
tcaattgataaactttggagcatatactgacacgtcctgttttaagcatgcagtttctaagaaagatgttgagtcctccaaaattgcctttgtctcttcggccactgcatttgagaagtggacttctatgacaggccttgctgctcagcttaagggcctttga

SEQ ID NO: 500 - DNA, 406 bp, Glycine max
  Peptide Sequence Number=SeqID_117278
gcatcagcgcgtgtatgtcacggtgacgcacagcggcgtcacgctgtcaccgctgattggccggctggtggcggaggaggtgatcggcgacagtcctagagacctgctgaaagagttccggccacaacggatgatcggcaaaaccgccagcgcgtttgcaccgattcagcgaaactttccggcggcacaatggcgcattaccttgatatcccctgtaccacgctggcgcgtgctatgtgtaatcgtggcacgctggaaaaattgccgctgccggcggcggttgatgacagcctgccgctctcctctcgctgctggtcacgcgaagaggtcaggcagtttcgccatcggctacagcgccgccgccatcagcgctaagcgaatccagccggtcgtcctgaccggctga

SEQ ID NO: 501 - DNA, 510 bp, Glycine max
  Peptide Sequence Number=SeqID_117279
ctgaataaacgtgactcgctgctggcggttgctcgtctttcccctggctttaccgccgaactgctggaccgctggcaggagcgggaaaaattcacccatctgcccgatttcaccaatccggcggaagcggcacgtgcctgggcagaacagtttgagcaacgccgtgcggcggaacagcaactggcgctgacggccccaaaggcagaattctttgatcgctttgttgatgtgcatgagtcgctgggttttcgccagttgtgcaaaatgctcaaggtgaaagagccagagtttcggcagtttctgcttgagcgcaacattatgtaccgtgacaaaggtgcgctgacgccacagcagcaccatctgcaggctggctattttgcactgcgcagcggaatgggtgaaaaccagcatgctttttcgcaggcacggtttaccgcgaaaggtgtgaagtgggttgccagcctgtgggccggtcatgtcgctgcacggccgaatggtgtcgccgcctga

SEQ ID NO: 502 - DNA, 264 bp, Glycine max
  Peptide Sequence Number=SeqID_117280
atgcttaggtggcatgaggcatcccatgagcctgaaatctaccctaaggctcatgagaaccctagtgccttctcttgcatctctggatcaatcttcttggagtcttctatccaatgcccttgcggggtaggattgcatcagttgttgagagaactgacttctgatccctctcatctctttcaagaagtcagttctgatgttgtctttatggatgatagggtgttcaccatcacaagtgggaaaccaatctttaagggcctctaa

SEQ ID NO: 503 - DNA, 667 bp, Glycine max
  Peptide Sequence Number=SeqID_117281
ggtggacccttgggtactagtaccctcacttttagaggtctacacgtcctcgccatcagagggctacacgcccttgccttcagagggctacacgttctcacctttagagggttgcacgtcctcgccttcagagggctgcacaccctctcctttagtgggctggacgtcctcaccttcaaaggtagtttccttttgtcagttcctgggccaccccctgatattggagggcaaccaactgtgcgagcacaaccaaagagggaggctatcacgcagctactatacatatcggggcaagatttcacccgtgccactgcaaagagacgagtggatcgcgcccgcaagacacccagtggacccgaagaagtccaacagggccctggggtttccaactctgggatcacgcccacaagacaccctgtggacccggagaagtccaacagagtcttggagttgccagctctgattacgggcctctgtcggttctacggggtgcctgttgcccccagcaaggtcatcaggccccctactaatcgagctttcatcaagaagtattgcgccctcaagcaggcgcagggcgaaacaccccagcagtttgaggatggcctccagcgggcaacagacgcaccgccactacctctagagttcacctcagctcatccacaaaaag

SEQ ID NO: 504 - DNA, 783 bp, Glycine max
  Peptide Sequence Number=SeqID_117282
atgtcccataccgctttatctgctgattctgccctgcgtcgttccggctttttcctgctactgctgttactcaccgccgccaacttacgcacgcccattaccgccaccgggccggtgctggaaaatattcgcctgacatttggcctgagcgccagcgctgccggcgtgattaactttttaccgctgctgatgttcgccacgctggcaccgccagccgcctggttcggcaatcgctttggcctggagcgcagtctgtggggggcgttactcctgatcgtcctgggttcactgctgcgaatcagcggcagcgaaacggcactgtggctgggtacgctgattctcagcagcgggatcgcggcggccaacgtcctgctgccgccgctgattaagcgggattacaccgcgcataccgcgcgttatatcgggctgtatgccatgaccatgggcatcaccgccagcatcgcttccggcgtggccgtgccgctggccgaactgagcagcgccggctggcgtctgtcgctggcggtctggctgattccggcgctgatcgcgctgctggcgtggctgccgcagctgaaaaatcacgcgacgcgtgagcagcgcgcgacacaggtcaccgtaacgcgttcgccgtggcgttccgcgattggctggcaggtgtcgctgttcatggccagccagtcgctgctgataatggcatcagtcaactccaggcgggcggcatgttgttcgtctatcaaattgtggcgatcgcctccaatctggcctgtatgcgggcgctga

SEQ ID NO: 505 - DNA, 1433 bp, Glycine max
  Peptide Sequence Number=SeqID_117283
atggtgacaagcatagagcagcaatgtgacatcgctggagaatgtgctggccgcgctgggcaatccgatgcgcatggcggtcgtcgcgctgctggcacagggggaggcgcgcagctgcggttcgctgctgcaaggcgtatccaaatcaaccttaacccatcactggcggtgccgccgttgacgatgccgccacccgaagcgcgctgcaggcttttcagcacgcggagtagcgcccttttcgccggagcggctgcaattgcaacagcctggcgacagcggctgctgcatccacaacagacattcctcatcctctcattcagtggtttagtcatcagtcagatcgagcagcgcacgcgctgggacgcggagtacaaccgtgaactggcgaaaatcgctgaacgcgctggcttcgattatgccctgacgcagattcgcttcaccgctggctatggcgctgataatcagcccgaatcagtcaccttctctcaggatatgctgagccacaccacaaaacttaaagtgattgccgcgctgctgccggggccgtggaacccgacgctggcggcgaagcagatcgccaccatcagccatctttacggtccgcgcatcgcggtgaacattgtcagcggctggtttcgcggcgagttcaaagcgattggtgaaccctggctcgatcacgaagagcgctatctgcgttcggaagagtttattcgctgcctgcgcggcatttggcgtgaaagcagcttcagcttcgccggggatttttatcgcttccgcgactacgcgctcaagcctaaaccactcgatccgctaccggaaattttccagggcggcagctcgcgcgccgcgcgggacatggcgtcacgagtgtctgactggtacttcaccaacggcaacacgccacagggcgtacgccagcaggtggacgatatccgcgccaaagccgccgtcaatcagcacaccgttaaaatcggcctgaatggttttgtcatcgcccgcgagagcgaacaggaagcccaggcggtgctgcaggagatcatcgccaaagccaatccggatgcagtgaaaggcttccagcatgaggtgaaaaatgccggcagcgcgtcgccggaaggcgagggcaactgggccaaatcctcatttgaggatctggtgcaatacaacgacggtttcaaaaccaatctgattggcacgccgcaacaaattgctgagcgcatcatggagcagaaacgcgctggcgtggatttactgctgctggcgtttctgcatttccatgaagaggtggagttctttgggcgtgaagtgatcccacgcgtgcgcgaactggaacggcaggaggcgcttaacgccgtcacgcgcgcttaccgccaacagcatcagcagcgggagctgccagctaccgctgacatcatgcagcatgccgaagcacagcg

SEQ ID NO: 506 - DNA, 1227 bp, Glycine max
  Peptide Sequence Number=SeqID_117284
atgaatgcaaatccgatagcgcatcccgctgctttgcggtccctccaggcgttgtgtctggtcaattttttcatggccgacgtgcgggatggactcggccctttcctggggatctttcttactgagcatggctggagagcggatgatattggctgggcgatgactgccggcggtttagccggtctgctggctacgctgccggcgggtctggcaaccgatgccacgcaccataaaaaagggctgctgattctggcctcactgctcattacgctggccaccctgatgctgtggtggtttccatacggtggagtggtagtgggctcgcaggtggttaccggcctcgcggccgcgcttattgccccattactgaccggcgtgaccctcggcctgaccggctctcaggggttcagccagcagatgggtaagaacgaggcgttcaatcatggtggcaatatgactgccgcgctgtttgccgggtttgccgtctggctgtggggcaccgatgcggtttttatcctgatgaccgcgatggcactgtgcgcatgttttgccgtggccgccattcagcgtaacgcgatcgatgaccgcgcggcgcgcggcggtgccggacagcaggccgcagagcttccgggtttctctgccctgctgcgcaatccggtgctgctgattaccggtctgacgctgctgctgtttcacctcggcaacgccgcgctgttgccgatgctgggcattcgcgcggcggcaacgcacagcggacagctcagccccggtgtttataccgctgcaaccgtggtgatttcgcaatgcgtgatgattcccgtggcgttattcgccgcccgaaacgccagccgcctcggtttcccgctgctgatcaccctcgcgctggtggtactgccggtgcgtgccggcatcgcctccctgttcgatggcacctatgcgatggtaccggtacagattcttgatggtctggccgccgggctgctgggcgtggcagtaccgggctacatcgtcagcgtgcttgacggcagtggacacaccaatgccggccagagtttcgtcatgctgatgcagggcgtgggcgcggcatgcagcccggcactgaccggcagcatcgccgccgcctggtcttatcaggtcgctttcgccgtgctcggcagcattgccctcgccgcactgatgctctggagccttagccagcgcatcagatgggttaaaagccgggcgtga

SEQ ID NO: 507 - DNA, 3474 bp, Glycine max
  Peptide Sequence Number=SeqID_117285
atgggaagcatttccggtcaccctttactgttgctggtcgatgggggtagcacccacaatttcgtccagcaacaattggtgactcacttgggattaccttgtcgtgaaaccgcaccacttcgggtaatggtcggcaacggtcaatacctggaatgtacctctatctgtgacgccattaacattcatattcagaatcaaaccttcatcgtcgacttgcatatactacccatctccggcgccaatgtggtattgggtgtgcaatggcttaaaacgttagggccggtcctcactgactatacatccttgactatgcaattcttctaccaagggaatttgatcaagttacagggtgaccccgaggcaacactaagttctctttcgtcttctcagtttcgccgtctctgccagacacaaccctctggcctgtgctttcatatcacagtcctctcagaagaacattcgacttcatctgaacccgtggacccatccattcaatctttgctcaccaaatataatatccttttccgacaaccgcaaaccttaccaccagaacgcacaacagaccatcatattcatcttttacctcaagctactccggtgaatgtccgtccgtatcgatatccacatttccaaaagaaggaaattgagcagcaagtcgagaccatgcttcaaaaagggctgatacaacctagtaacagccccttctcttctccggtcctcttggtcaagaagcacgacggaacgtggcgcttctgtgtagattatcgtgcgttgaactcactcaccatcaaagaccgcttccccattccgaccattgatgagttgcttgacgaattgggcggagcacagtgcttctcaaagcttgatctcctccaagggtatcatcaaatccgcatgcactcagcagacatacccaaaacggcgttccgaactcatcacggacattatgagttccgagtcatgccctttggcctctgcaatgcgccgtcatcctttcaggcgacaatgaatttaattttccggccattccttcgccgttttgttatcgtgttctttgatgacattcttatttacagcggtacctttgaggatcatctccgacacctggacataaccttccaggtattacttgacaatcaatttgtcctcaaaatgtctaaatgcttctttgcaaaaacgcaggtagagtatctggggcatctcgtttccggcagaggagtggaacccatgaccgacaaggtggccgccattgttaattggcctagacctcaatccatccgagctgttcgtagctttctgggcctagcaggtttttatcggcgattcatccgcggatacgctatgattgcagagccgttagttcgtctcaccactatggaaactcttcagtggacccctcactctcaacaagctttcgagaatcttaagtctgccttggccactgcaccagttctggccttacccgatttccaggttccattcacggtagaaacggacgcttcaggcaacggcatgggagcagtcctatcacagaaaggacacccaattgcttactttagcaaaccgttcactccgaaattattatcggcatcaacctatgtccgcgaattgttcgccatcacttctgccgtgaagaagtggcggcagtatcttttgggccaccaattcacgatcataacggaccatagaagcctgaaggagctcttgactcaggttattcaaacccccgaacagcacacgtatctggcgcgtttaatgggatttgattaccaaatccaatatcgatcaggcgcgcacaatcaagcggcagacgctttatccaggtccccggaaaatgctacaccggaatatcctgcttcccaatttttgatactcttcgttccctgtttaacatttctggaagaattgaaacatcaggtgactattaatcagcaatattgtcagaagcgacaagctattcttgattctccagactcgcattctgatttcaccattcatcagaatttcattcttcagaagggtcgattatggcttccgcgagatctccctattattcagtccctactacaggagtatcactccactccaatggggggacatgctggggttaccaagacattagcacggctgtcggagaatttcatttggccaggactcagggctgatgttgttacctatgtcgccaattttagggaatgtcaggtcacaaaatatgaaacgaaacgcattgcggggttgctatgccctctcccagtaccattcagaccatgggaggatctttctattgactttgttgttggtctacccccctttcaaggcaaaacggtgctcctggtgatcgttgaccgtttttcaaaggggatccatttgggcattctgcctcaggtccataccgctcacatggtagcacagctcttcatcaacattgttgtcaagcttcacggtatccccagaagcctagtatctgatcgtgatccattgttcattagtgggttttggcaagagctcttcaagcttagtggcactcatcttcgaatgagttctgcctaccatccacagagtgatggacagacagaagtcatgaacagagtaattgaaggttatttacgagcttttgttcatcgtaggccaacatcatgggggaagttcttaccctgggtagaactatctcataatacttcgtggaatagcagcacaggctcaaccccttatgagataacatatggacgcaagcctttttcttttccagattatattgcaggatcctctaaaattgatgcagtagatgatcttctcttgtctcgtgatgaagtgttcactactattcgccggaaattactcaaggcacaagcttccatgaagaaaactgcggatgccaaacggagggaggttaattatgagcccggcagttgggtattattgaagcttcgtccttatcaacaaagctcagtgaagggtgctcaggcagtgaatggcaaactgtccaagcgcttctatggaccatttcagatcatagaacgtgtgggtaaggtagcttatcgtttgaagcttcctgatggggctcgtatccatccggtatttcactattccctgttgaagccattccacggagaccccattcttgattcacccaactcgctgccgacacgctttattaacggccaaccgatgcttaccccgcttgccattcttgattataggcgacataaggagagggacacgtgggaagtattggtccagtggcatggactttcccctgatgaatcctcttgggaggactgggaacagcttaagcaggatcatcaccttgaggacaaggtgattctccaagggccgaaggaagttgatagcagtatattaacagaggtagcatcaaaagggcaaactggggaatcaatcaacaaggaaggtgtgcaattagcaaaagcaaagagaaaggttaccaggcccgcatatctcaaggattatgcctga

SEQ ID NO: 508 - DNA, 216 bp, Glycine max
  Peptide Sequence Number=SeqID_117286
atgaactatcgcatagctaatctatttgttcggggtcttgaagttaaagcttggaggacaaaacaaagtagtgtacaagtacttggtgctatggcataccgtgctcctgaacatttgtctcggtgtctccctaagattgttcccaaattgattgaggttgggaatgtgataaagagtccagaaatatctggtcttgtccctactctacttaagtaa

SEQ ID NO: 509 - DNA, 621 bp, Glycine max
  Peptide Sequence Number=SeqID_117287
atgcgtagtgattgcttagtgcaattctccattctccacccgttttcggagcccatgaatcgcgttttcgttcatgcgtcctccaccttcgagtttggagccatgcatagtgattgcttagtgcaattctccattctccacccgttttcggagcccatgaattgcgttttcgttcatgcgtcctccaccttcgagtttggagctatgcgtagtgattgcttagtgcaattctccattctcaatctttttcggagccccatgaattgcgttttcattcatgcgtcctccaccttcgagtttggagccatgcgtagtgatttcttagtgcaattctccattctcaaccctttttcggagcccatgaattgcgttttcgttcatgcgtcctccaccttcgagtttggagccatgcgtagtgattgcttagtgcaattctccattctcaaccctttttcggagcccatgaattgcgttttcgttcatgcgtcctccaccttcgagtttggagccatgcgtagtgattgcttagtgcaattctccattctcaaccctttttcggagacccatgaattgtgttttcgttcatgcgtcctccaccttcgagtttggagccatgcgtag

SEQ ID NO: 510 - DNA, 471 bp, Glycine max
  Peptide Sequence Number=SeqID_117288
atgaagccttggaatgagaaaccaagaaggcccgaaaggaagaacacgaccaaaacaagttttgaggggctttatagggcagcaatagtgagctcaagctccgaagaggtgaaaggaatcatcacagggaatatatgggccatcatcgatgagtgcaaagagaagctaaatctagcggcgactcatgagcaaaggctagaggatgagtatgccaagatatcagcagaaagggaagcaagggaaagggtaattgattcattgcaccaagaggcaacaatgaggatggaccgatttgctcttactttgaataggagtcaagaacttccccgattgctagccgaggccaaagcaatggcggacacctactccgcccccgagaagatccatggacttctcagctattgtcatcatatgatagacttaatggatcatatgatagacttaatggatcatatgattagaaaccgctag

SEQ ID NO: 511 - DNA, 2745 bp, Glycine max
  Peptide Sequence Number=SeqID_117289
atggagtcaaggagctgcatgaacgtggcgtgcgccacctcgacgacgattcggtggcgcaaaggctgggccctgcgatccggcgaattcgccgatctctgcgataagtgcggttctgcttatgagcaatcaacgtattgtgatatgtttcactcaaatgattctggttggagagaatgcacatcatgtgacaagcgtctccattgtggatgcattgcttctatgtctcagcttgaattattagatactggtggtgtaagctgtataagctgtgcaaggaattcaggactgcaacctattgcaaacaatgaaaagcctaatggatccgggacatcaaaagtacaaaatgtcagtacacagcagcagtacacatctctggctaaccaattaactgtgaggggtatgcaagtagggcattatgcagagaatgatgggcttcggtgctggttcaaacctcataatgttgaaacagatgggccttctgcagaaatgaaaccagaaattttaccttcagttggagaacttggaaacactttgatatcacaatttcattgtgagtctaatggatcatctaaggcttccaaagcagagaactgtaaggcagaaacagaaatgcgagatatatatgaatcattggcacagacaaatttgagtatgacccttgctgctcctttaggaaattcaaatccctttcatagtgctgttgttgatgaaagggaacaaagtaaaacatctccacttttattggggtcaaggtctcgtcatcttttacctaagccccctaggtcaactattgggacaagcttagaagcaaatgctggcatggtatcccagattcgtgtggcaagaccacctgctgaaggacggggaaggaatcaattgcttccacgttattggcctaggattaccgatcaagagttgcaacaaatatcaggagagtatccagcgttttcaaattctacgattgtgccactctttgaaaagatgcttagtgcaagtgatgctggtcgaattggtcgcttggttttaccaaaagcatgtgctgaatctggtaatttgttaaaactgaaagacgagagcattgtgcaggcatatttccctccaatctctcaaccagagggccttcctttacgaatccaagatgtgaaaggaaaagaatggatgtttcagtttagattttggccaaataataacagcaggatgtatgttttagaaggtgtaaccccctgcattcagtctatgcaattgcaagctggagatactgtaacatttagccgtatggaccctgaggggaaacttataatggggtttagaaaggcaacaaattctactgcagtacaggaaacactaccatctaatatgcccaatggttctcattcaagtgaaacttcctattctggtgtttatgagaatctacctatattaagtggttactctggccttcttcagtcacaaaagggatgttcagaaacccacctaaatgcgctgtctaagaaatggaactcagctggtggtgacatgaattggcatagcattgacatgcctgaaagcagaaaaagagatgggttgccattgccacctgtgatggttcccgagaagaaaagaactcggaatattgggtcaaaaagtaagaggttgcttatcgatagccaggatgcgctggagctgaaacttacttgggaagaggctcaagatttgctccgtcctcctccaactgttaagccaagcattgtcatgattgaggatcatgtatttgaagaatatgaagaacctcctgtctttggaaagaggagtatattcgtagttcgatcaactggggtaaatgagcagtggatgcagtgtgatagttgctcaaaatggcggaagttgcctgttgatgcacttattcccccaaagtggacatgtgtggagaatttatgggatcagagcaggtgttcatgtgctgctcccaatgaattgaacccaagggaactggataatcttctgaggctgaataaagatgtagactggaactctcaaaagagtttcccatttaaatttggatcagatgctgttgttgataattcaagaaacaaagactggcagcaagccagagactggccctggaacgggaatcttcaggactggatgctttggcaaatgcagcaatactgggagatgatgcaagtgactctggcagaacaccagttgttaccaccacaaaacatcctcggcatagacctgggtgctcttgcattgtctgtatccagccaccaaaagcggcaatccgaacgtgaagcagagattgctcagagaaatcagttatcatggcggacgaaagatgaatcagaagtagatagcacctctcgccatttaactccagttgacggtttggagaatgaagtaagggtgcaaaatgaattagattcaaggagtccagacgatgcggtggctgaagctgccaagggacaattagacttgaattgccaacctgatcgagaagatgtgcaagctgggccgaacagcttgagcatgacgagtcttcttgaagaagcaaatctcccgctggagacctacctgaagcaaaatggccttactagcttgataacagagcagcaaacaaattcagcttcaaatgtgcaggcacagacaaccaatgatagtgaggtgaaacacaatgaggattgcggaaccgcttcggttattcatgcgcaggaaagcagccctgaagagaacagtgggcaagataaagagcaaaacaattaa

SEQ ID NO: 512 - DNA, 249 bp, Glycine max
  Peptide Sequence Number=SeqID_117290
atggagtttctggatgaaagcggtctgaacaaggtgggggttaaaggctttgaagtttatgactttatttccttttctttaatgcaatacacaaatgatttgatgatgtttggtgaggcatattgggacaacttgtgggctattaaagccattcaacggatctttgagcttgtctctggtttgaaggtgtactgtccagggttcacgagtgacgtggcgagtgatgcaacattgagtagtccttattag

SEQ ID NO: 513 - DNA, 891 bp, Glycine max
  Peptide Sequence Number=SeqID_117291
atggggtgtttcactgtcttgaaatacaagaagaaaaagatcaataaaatccgatactcaacatatgtcagccacaaggagcatgcaccaacagtgctaccagaacctcaaactcatcctcattcgctgcagtctgcacctcctagttttaggaatagagtgaaatcttttcagcctattaatcaagttaccaataacagaacccgggcattatctgctccttcagctcttgatgtagccaaccaagatactcttaccacggttgagtttgaggaacaagaagaatcaagataccatgtgggatcgctgatggagcagcgctcgtctagtccgcaacctttacctcttccatcacgtcagggtggtggtgcattgaacgctaatggaagctttaagtcagggatagctagtgtttctctgtatgcttctggactagctcctgaagtaacagaacaagatgctttggcctcggttgattatgaggaacaagaagagttgagacaccgagttggattgatgaaggagcaatgttcatctattccgcaacctttgcctcttccttctcctcagggtggtagtggtggtgtattgaaggctattggcagctttaaatcagggacagctagtgctcctggacctttgcctcttccgcctactgggttgattagaaactttacatatgaagaaattgctgctgcttgccacaacttctcttcagatcgatgcatgtcagaacgtctttcttctaccatatatagtgcttcatttggtgatgatgcttcaagtgcaaagaagtttgaagccaccgtcactcgccttcattcatcaactcagccttgcattgagaggtttatgatttttctccctagacaaaagtctgaaagcagctga

SEQ ID NO: 514 - DNA, 153 bp, Glycine max
  Peptide Sequence Number=SeqID_117292
atggctataccatgtggttctgcttcgaccacgaagaagcccttaacccttatgaagtcaaagaaattgagcagaatgaaaaaggctgagtggtgggaaagaattggtctcaaacgggttggaaaatcaacacaagtggtcaaaatgaaatga

SEQ ID NO: 515 - DNA, 243 bp, Glycine max
  Peptide Sequence Number=SeqID_117293
atgatatacccaaatcaacagcccacaaaaccaaaatccaaagcacaaaatcaacaactcatggtaaacaaattacttgttgtcccctctttcagggtgccatcgtcgccctatgtccgcactctgtgtatggtgttgcctaggagcaaaaaggtttacggaatcaggattgaaatagaggggtttaacattggtttaggaagtgaggttgggaattggggttctaaagggtccaaagactag

SEQ ID NO: 516 - DNA, 2538 bp, Glycine max
  Peptide Sequence Number=SeqID_117294
tctcattcatttcttctcaacacttcttctctccgtcgccgccgccggaatatcctttctccgatgagaaaatccaccagactctccgccatcggtctctcaaagcctccggaaggaccagaaccgccgaagccttttagcactcgattttcgctgcggtcgtacgcgaagcgcgtgcagctgctcacaccggagcagagatcggtggttttgagaacgggcttcgggaaccttctcctcgttccgaaccacacgctgaacaaggtgttcctcacggagctcatggacgcgtggagctgcgagcgccgcgcgttcgtgctacgctccggcgaagaaattccgatgactcttctcgacgccgctcttatactgggcctgccggttgccggtaaccccgtgaatctcaccgaagaggaaccgttctctgaattggaagaatcttacggagcaacggaaacaaaaaggaaggtggcgatgagttttctggaaaataggttagattcgataggggaagatgtgagtgaggattttgtgaggagcttcttgctctacacaattgggacgtttctcgcttcgaacgatgggaaggtggattcgcggttcttgcggtttcttgaggatttggatgaggtttcagggtttgcttggggaggtgttgttgttgatgatttgtgtcagtggctggataagaggaaagagaataatgtgcagtatgttggaggttgtcttatttttctccaaacatggtcctatgaacattttgatgtagcagcgcgaccacaagtgcaagatcatgatttgacctttcctcgtgtgtgtcgatgggataatactaaacctaagcggggtacttcatggtttaaagacctggatgatgaccaggtgatttggaaactccaacctacttctggagagttacaaatagaggtaatcaaagaagcactggagttgctaggtggcaacaaagagcttcaaagtccagaaagcagttcaacaagctcaacatctagtgttcctgatgtagattcagggttacagcttagtatcaacaaagaagtacatggagtggacgaggatgatttggagaatcaggtagtggaggacactcccacaaagtcgagcacttgtgatgaagaatatagagagcaaatcaatcctgaaaatctgatagtgttggacactcccccagatttaaccatttgtgacaaagtaggtagggggcaaggaatgaatcttgaaaacctggcagtggttgttgaggatacccctacagctaccagtattgctgaggaagtaagtggagatgaagaggtcaacagtgaaaaactcatagtggaggatactcccccggattccatttgtgacaaagtatgtagagagcaagaaatgaatcttgaaaacctggaagtgctagttgaggatacccccactgctgacaaagtaggtggagatcaggagttcaatggtgaaaaactcatagtggaggatactccccctgtgctgagtttttatgatgatgatataagaaagaagaatgtcatgttagaagtgaaaaacactgaattgaagatgaaaatagaccaagtaatggaggaaaatgaacttctccgtacacagattttatcaaatacccgatttgaagagcagaacgctgagttgaagaaagagctggacttgttgagagaagaaaacagaattttaagactgtcaataagtgattttgcagatcggattgatagacatccttcagaccttgctgcagccacaacattgatcaaccccagttcttccgcaaagtataggattgtgggtaatcaagaagaaatcagcagtggcatgcgggggttgaaggtgtcctggtttgatgaatgtaattcaatagccgttggtatctttgttgtggcggggcacatcttcttgggacatactgtcatagtcgctctgtttgtgtttatggtttcggtggttcaattctacggtttgtttgaagtgaagtttgtgaaggttgcgtctgaaaggaatttgtattgtggatgtgttgagatgggtaggaaagtctgtgtcggggctgatctggtagggaatgttaaccccacagttcttgggaaggttagcagcaaggttgagattgaagtgagagtaggtgaagccactgttcctaacagcgttcttgatgcagttgcaaacagcttggcgatctggttactcacaacttggccacatgacacttccccttgtgccattggaataatggttgcaccaagagccagcaggcacagaagggccatcaagaaaaccctagtttgcaaactagccatgacaaaaaccatagttggtagtactgattgtgtgttgtgggtttttttctttcttctagggttagggttcgggtttgaaggtgtgatgtgttttgagaaactactatgtggtgggtttagggttgggcttatatattgggagaaggctatgggactatgtgtctatggggtgcagtgcaggcagaaggggcatgtgggtggtgcttatttgggtagttga

SEQ ID NO: 517 - DNA, 393 bp, Glycine max
  Peptide Sequence Number=SeqID_117295
atggcacaaggggaagtgtcatgtggccaagttgtgagtaacctgaccccatgcatctcctatgtgctatatggtggagccacggttcctgcacagtgctgcaatgggatcaggaacctctatggcatggctcagaccaaaccagatcgccaagctgtttgcaactgcatcaagaacgctgttaggaacagtggcttcacctactctcacttcaatctcaaccttgctgctaaccttcccaagaactgtggggttaacattccctaccagatcagccccgacacagactgcaccagttttaagttttttcagggtgcagtgaggttggtgcatgatgtttatgttagcagtgttagaataagaggccacgtgacacgacaagggactggctag

SEQ ID NO: 518 - DNA, 177 bp, Glycine max
  Peptide Sequence Number=SeqID_117296
atgaatatccgcccaggcgagacattctcgtctaggcgaatagaagacttcaggatgaagaaagcttgggtcgcccaggctattgattattgcctgggcaagtcttggaaaatgagtacattcatccagagtgaatcttcaaacaaaaggttatatacaaacatagctcatgattga

SEQ ID NO: 519 - DNA, 243 bp, Glycine max
  Peptide Sequence Number=SeqID_117297
gctgctgaagaccgctctccatcaccacattctcagagagatgactcttcctctcttatgcacaacattcttgacaagttggatggactccacaccttcataggtgaacgctttgactcattggatagccgtattgatgccatggatgcacgatttgcagcgatggacacacgtatcaccaaacttgaggaggatgttacttatgttcgccagtgctttgaccttccaccaccatcctcatag

SEQ ID NO: 520 - DNA, 288 bp, Glycine max
  Peptide Sequence Number=SeqID_117298
atggctagcctcaaggttgcatttttggcttcattgttgtgcatggttgtgctccctggccccatgcatcggttacctccagaagggaggatcaccgccggcgccatgctgcagctgagtgaagagcctcaacgccgccgccaagaccaccaccgaccgccaacaatgccgtcttgcttcccggcaaggcaaatgtggcgtcagcatcccctacatgatcatcatcaaggtttgaaaagaaagtcacggacgcaggaaactggaaactacttactagcatatcagtag

SEQ ID NO: 521 - DNA, 1056 bp, Glycine max
  Peptide Sequence Number=SeqID_117299
atgtttcagcagctcagcatgaatctgtattgggaagaattcatacttgttattaagaaaagtaattacatgtcttttatggatgtcacagtcatttttagaagaagaggaggagatgatttggaacaaaaccacagtaaatggatatcaactatccagtcctccccagatatcattgagatgactttctgtcctataactgatctccttgatgaagtacctgccaaggagcatttgactcgtgccattagtctttatcttgaatataaacctccaatagaagaacttagatatttcctagagtttcagattccttgtgtatgggctcctttacaggacaggattcctggtcaacaaaggaaggaacctgtatgcccatctttgcaattcagcataatgggccagaaactttacattagtcaagaacagattacagtcggacgtaggccagtaactggcttatgtctttgtctagaaggaagcaagcagaatcggctgagtgttcacgttcaacacttagtatctcttccgaaaatccttcatccatattgggacagtcatgtcgctataggcgctcccaagtggcagggccctgaggagcaagacagccggtggtttgagcctgttaagtggaagaacttttctcacgtgagcacagcaccaattgagaaccctgaaaccttcataggagacttctctggtgtctacatagttactggagcacaacttggagtgtgggattttggttcaaggaatgtattgtacatgaagctcttgtattcaaggttacctggctgcacgatccgaagatcgctgtgggatcacgtcccaaacaagccgccaaaaacagtgaatgctgaaaacacctccaacccggataactcaacccttagagaaaatgccacagccaacaagttggtgaagtatgttgacttgtctaagatgaccaaaggaccccaagaccctcctggccattggttagtcactggtggaaagcttggtgttgaaaaagggaaagttgttttgagagtgaaatattcattgcttaattactga

SEQ ID NO: 522 - DNA, 879 bp, Glycine max
  Peptide Sequence Number=SeqID_117300
atgggggagcaagtagcagcggtgcacactgcttctaacgctttgcaagcattagggaggggttttgatgtgaactttgatacgaggttgctttattgtaaaggagtttcagggtctagggtagttgagattgatgaagaacaccgtagggagctgtggttgtacaaggatgtggccgttcccgatgtttccagggacattggatgctccccggaggccatggtgcgtcagagttctggggtccgcagttttccagagtataggggacatatctatgggatgtttgatgaatttgacagtggttttgagttgctttttatgattgtggagaagagatggtcctggtgtaatgaaattgagatggtggaatactttaatgaaagggcaaatatatcagggaacttccctattgggagttttaattctgcatttagcttcactggttcaaaacatgttgatgctgcagctacgaaaaccttgtcctcagatgggttttacattcctcttgcaaaggttcagcttcaaaaatcccacctaacgttgcaaggaaatgtcaaaaaggctgtcccagtcaattgggacccaccgtccttggcaagttttattgaaaattttgggactcatgtcattacatcaataactatgggtggtaaagatgttatttatgttaaacaacatcatacttctcctttgtcaaagttggagatgaaaaactatattcaggatattggaaatcagagggtgttgatgcattttcattcaatagtcaaggggtttacccccaacccacgactgcaacatatcctattgggaaagaagcatagaagcatacagtgtctgaggttctaccccattgtgggtttcaccgagaacctctaa

SEQ ID NO: 523 - DNA, 1227 bp, Glycine max
  Peptide Sequence Number=SeqID_117301
atgatgatcaggaagcagctccaggaagaactgtggatagcggctcaatcacatgagtctattctaagacagaaggcgaaatctagatggatcagagagggtgactgcaactcaagatattttcatttgttgataaatgccagccgtagaaataattgtttgaaaggagtaatgattgatagatcttggattgaagagccaacaaaagtcaaagaggcagtaagatctttctttatgcaacgttttcaagaacctgatcaagacagaccatggctggatggtatattcttccgaaccatagaaagacatcataatgataagctattggagcgtttcaaggaaggcgaggtgacaagtgctgtgtgggaatgcgggagtgagaaaagtccaggaccagatggactaaatttcaaattcatcaagaaattcttgcatctaattaaacccgatgtccttaggtttttagatgaattctatgttaacggaaaatttcctaggggctgcaacgcttcatttatagcccttctccccaaagtacaggagccacagcttttgaatgattacaggcccatctcactgatagggtgcgtatacaagattgtggcaaagctactggtcaaccaattgaaggtcatgcctctcatcatagatgaaaggcaatccgcattcatagaaggaaagcatatgctacgcagcacggtaattgcaaatgaggtggttgaggaagctaggagagggcataagtcatgcattgtttttaaagttgattatgagaaggcgtatgactcagtatcatggaattttctgctttacatgataaggaggatgggtttctgctctaagtggattcgatggatggagggatgcttaaaatctgcttctatctcaatattggtgaatggtagcccctcgcatgagttcataccacagagaggcctaaggcaaggggatccattagcaccgcttctatttaacattgtgactgaagctttaaatggactggtaagagaagctattgggaaaaacctttacagggaattcctagaagggtcaaacaatgtcaatatcagcatcctccagtatgcagatgatacaatattctttggggaggcatccatgagaaatgtaaaagcaatcaaagcaattttgaggacctttgaacttgtatcgggactcaaaattaactttgtaaaaagcagttttggtgcattcggcatgtctgagtag

SEQ ID NO: 524 - DNA, 552 bp, Glycine max
  Peptide Sequence Number=SeqID_117302
atgggctatgattatcagattcattatcgttcaagaactcataatcaagttgcggatgccttgcccagacttcctgagcaggaatcatcttccctgatgaccctttctgttcctagcctcacctatgtcgaagaacttcataggcaccttcgtgacgacatagcacaattcgtggctcagtgtgtagattgccaacacaccaaatatgaaaccaagaagatggtgggactgttgtgcccccttccagtgccttattttccctgggaggatctctccctcgacttcatcactggactgcccccttatcatggcaattcagtaatccttgtagttgtcgatcgcttctccaaaggtattcatctgggcatgttaccttcctcacatacagctcatgcagtggcttctctgttcatggacatcgttggaaagattcatgggttaccgggaagcctggtctctgatagggaccctctattcgtcaaatatatcgcgggttcatctaaactagatgttgttgatgacatgttgaaggacatagaggaaatattttag

SEQ ID NO: 525 - DNA, 753 bp, Glycine max
  Peptide Sequence Number=SeqID_117303
atgtattttcatatcacggtgctctctaatgatcatcctgtcagcattagccatgatcttcttctagccattcaagctctgctcaacaagtttaattccttgttccaggctccccaccaacttccgccgaaaagagacactaaccaccatattcatctgctacctaattctgctccggtggattccatgcttcagaagggactcatacagcctagcacaactcctttttcttctccggtactattggtgaagaagcaagatgggttgtggaggttctgtgttgactatcgtgccttgaatgcactcacgatcagggaaaaatttcccatccccaccatagatgaacttttggatgaattaggcgacgctcgttgctttttgaagctagatttgttacagggttaccaccaaatcagaatacactcagaggatattccgaaaatagcctttcgcacccaccatggtcattatgagttcagagtattgctcgacaaccacttcgtcttaaaattatctaagtgcttctttgctcagcctcaggtggaatacctcagtcacttagtctcccaccaaggagtgcaaccagtggcttctaaggtggctgccatccatcaatggcctgttcctcaatccacaaatgatgagaatcctgaaactggccaaatacaggctaaaggcccaagtggagaaggacgaaggcccaagtggagaaggatgaaggcccagaggcagagacattatcaagactattaa

SEQ ID NO: 526 - DNA, 150 bp, Glycine max
  Peptide Sequence Number=SeqID_117304
atggtgaaacggtggccaagcaagtattggcgccatttcttgactgtcgaggttattgtgaataattcatacacatacgtggatgcaccctttgataaatcggcgatagaactcagcgaggcccaggaaactccgcaaggcctttgttga

SEQ ID NO: 527 - DNA, 1599 bp, Glycine max
  Peptide Sequence Number=SeqID_117305
atggaagctcgcatgaggaagtaccggcaagtgagtccagagagggccaaggtgtggacggaaaagcccccaaagtaccatcagaaccggaaggtgccggtgctttactatctttgccggaataggcagctagagcaccctcatttcatggaggttcaactttcatcccctaatgggttatatttgagagatgtgattgatagactaaacgctttgagaggtagaggcatggcttctttgtattcatggtcgtgtaagagaagctacaagaacggatttgtgtggcatgatctctgtgaagatgatataattctacctgcacatgggagtgagtatgttctcaaaggttctgagctattttacgaatcaaattcagaacgttctggccccattagcaatgtgaaaatacagaacctgaagcagttaccagagccggtttcttttaggagccatgatgaggcttccacttcttctagcatgactgagaaagagacaagaaactccctagaagatgacctttccccaaggcaacaagctggttcatctgatgtgtctcctcagtctagagctagaaagagtgattctcttagcttaccatcgacagaatgccaaatctacaagaatgatggattggcagatgcttcaactcagacagaagaaaatgttagcaaacccgaaacccagaatacttataccaggggtgtatcaaccgaggatgatggttcattagaacctgaatgccatgaaatatgtgaaactcaagtgcttcaactgaaagataattctgaaatatgtagggatactgtttctcctcctccctcaacttctagcccatcgtcttctggagggaaaactgagactttggagtccctgataagagctgatgtgagtaaaatgaacagctttaggatcatggaagaggagcgtattcgaatgcaaaccaatgcaaggctgaaagcctcaaatctgctgatgcaactgatctcgtgtgggtctatatcagtgaaaaaccatagtgttggccttattccttcctataaggataggttttcccactcaaaattcccctccccgttgttctcaacttctgttatgtttggggactttgattgcatagcagagaaaacaaatgtgatgggcctcaaattggaagacaaagaatattatagtgggagcatagtcgagtctaaagtactgaaggaaggagatggacatagtgttatgaaacgctcttcttcttgcaatgctgagaggacatctgaagagttgaaatcacaagacacagaggaatcatcatcctcagggaatccaaaatgtgttccacagtcagttaaggcttcattgaccaagcagctaccaagtgaatgcatgagatctcctgtttctgatggatcaagaaattccatggataaaactgatggttcaggcatatccccagtaccatctaacggtagcagcaaaagaatcacggaaccttcatcagggtttgggagaaagcaatctaagagggacttaggagtgtcttcttacagttttcagtcattgattgatgagtttgattttaactctacaggcttgcttcaggagctcgggttataa

SEQ ID NO: 528 - DNA, 273 bp, Glycine max
  Peptide Sequence Number=SeqID_117306
atggcttacaaatacaaaaagggacgaagcactaagcgagggagacgcgctgagcgagtctggtgtgctgagcgagtctggcgtgttgagtgcgactctccagttcttcaattctcttccatgctttctgttgtgtctatacaaaaagagcatatacttataaaattattggaagcattttgtgggatggtgacagttcattccaagggcaccggcatatttgattatgatatatattcctccgaccttatcatgggtatttttttcatttga

SEQ ID NO: 529 - DNA, 309 bp, Glycine max
  Peptide Sequence Number=SeqID_117307
atggctttatcagtgtcatgcgcttctgaggtgattgaggggcctcaaccgtacaaagaaagagggagaatggggttgtttcagggtggtgtgaggagggcactacaggggttgttgccgtcgtcgcacttccaagtaaaggtttgggcaacacacaatgaaaggagtgaaggaggtgttatagggttggggaagggaagtgctataacacacaagtcattaaggataattttgtcatcacaaaattgcttgggaggtgtaggtcaagagatggatagtataggaaacaaatgcctcaatactacatag

SEQ ID NO: 530 - DNA, 1024 bp, Glycine max
  Peptide Sequence Number=SeqID_117308
atggagccacgaaacccttctccgtcgccgtcaccggttcgagtcctcattcgccctccgtcgtcttcgtcttcgtctccgtcctcctcctccgaccatccctctccggcaccggcgccgtcgctccctcgctcctccgacggcgtggtggtcgtcggcttcatcgcacggcggcacgatgattccgcgcagctcctcaaccgcgtcatcgactccaacgtcttcgcctccggcaacctcgacacgccgctgctcgtcgacgatgaggaggcgagggagtggttcgagcggaggagaatcagctactttcacgaccacgacaaggggattttgttccttcagttctcttccactcgctgtccggtgaatcacgccgccgccgcgccgtcgggattcgattccgccgtcgaagagcacgagttcggcgacctccagggaatgcttttcatgttctctgaggggtcacattttggtactgggattttaaggaattttcgtgtgctgcaagcagccaagcatgctatggctccctttgttagataccagactatggggcctttaccgtctagatcgcatccttcaccgtcctcccaacctgtttcgtcggtgaacaattcttcacctggtagaggtggtggtaacttgggtcgcaatatgtcggccatatctctcatgtcaggtttaggttcttatgcttctttgtttccaggacagtgcatacctgttacactgtttgtattcatcgatgatttctccagtttgtcgaattccagtgcaaatggggaggaatctttggatggctcttcgcttaaccagtcttctagtttgagtagtgcagccaaagaaaacttgcctgctaaaggttctggttcggtagttgtgctggcacgccctgcaagtcgatctgaaggtggatttaggaagaaactacagttgtctcttgaagcacaaattcgctttctggttaagaaatgtcggacattatcaggttctgaaataactcattcgggtgtgagaactgggg

SEQ ID NO: 531 - DNA, 456 bp, Glycine max
  Peptide Sequence Number=SeqID_117309
atggccgcccacactattctcttttcttccttcccagctcctcaatccattgcccttcccgccactaccaagaaagccgttgcaatcctcaagggcaattcctccgtccatggccttgtcactctaacccaacaacaagacaacggcccaacaactgttactgttcgtgtttctggtcttactcctgggcctcatggttttcatctccatgagtttggtgatataacaaatgggtgcatatcaactgggccacatttcaatcctaataaactcaaacatggtgctccggaggataaaattcgccatgcgggtgacctgggaaacatagttgctaatgccgatggagttgcagaagcaacaactgtggacaatcagataccactcattggacccaattcagtagttggaagagccttagtagttcatgagcttgaggatgaccttggaaagggttag

SEQ ID NO: 532 - DNA, 540 bp, Glycine max
  Peptide Sequence Number=SeqID_117310
atgacttacagagaacatgaaaagcattccctggaggtcgccgaactcgtgctcttcgacggcggaatcgaatcccgacggcgcggcggcggcgtgattcaccggacagcgagtggaagagaactgaaggaacaaaatccccttgtcgtggtcgtgaaagtagctgattctcctccgctcgaaccactccctcgcctcctcatcgtcgacgagcagcggcgtgtcgaggttgccggaggcgaagacgttggagtcgatgacgcggttgaggagctgcgcggaatcatcgtgccgccgtgcgatgaagccgacgaccaccacgccgtcggaggagcgagggagcgacggcgccggtgccggagagggatggtcggaggaggaggacggagacgaagacgaagacgacggagggcgaatgaggactcgaaccgttggcttggcttcgcggtttgcagtgcgctatttgtaacatggactttggagttcgacagttcgagttcggtctcaaggattcaactcaaaatttcaccacataagtga

SEQ ID NO: 533 - DNA, 303 bp, Glycine max
  Peptide Sequence Number=SeqID_117311
atggcagatttcatcactattgggtgcatcaagaaactcaactataaaaattatagcacatggaagacatgcatagaatcatatttgcaaggtcaagatttgtgggaagtagtcaatgggaatgagacaacacgaccatcagatgcagaatctttgacaaagtggcgtatcaaatctggaaaagcaatgtttgtgataaagatgaccattgaggaggagatgctggaacacactcggcatactacaactccaaaggatgcttgggacaattttgtctcacgatctgctacaaaaataaaatga

SEQ ID NO: 534 - DNA, 198 bp, Glycine max
  Peptide Sequence Number=SeqID_117312
atgagaaaaacatgccgtgagaacgagagtgacagtgacacctacaccgtgagagagagtgaaacttgccacgagagtaaaagtgagagtgacaccgtgagcgagacactgtcgttgtttcagtgccacaagagtgagagtgagattgacaaaggagggttcatgagggagatgagtcgtgagggaagcaaaatgtga

SEQ ID NO: 535 - DNA, 249 bp, Glycine max
  Peptide Sequence Number=SeqID_117313
atggtgggtggtcgcagcggaagcgaaggcgaggtccaaggaacaaagactggctctgacaccatatttgcttcaactattgtgatgctcaagagatttagaagtttgaaagaaggactccaaaagatggttattagtcatgaatggtctacttacaaggatgatgatgttggaaagacaaatactaatatggtttgtcttcacttggtatatgaaatgtgggattcaatgattgaaaagatattgtag

SEQ ID NO: 536 - DNA, 2721 bp, Glycine max
  Peptide Sequence Number=SeqID_117314
atggcgaagggcgccgattccgacgagttcgttgtgctttctagggttcgtacgggtctcaagagggagttcgcattcgccatgaaggcccaatctgagatctgcggcggctctctgggccgaacgcgggccagcaagaaccgggtcgaggccccggttcagcccccctcggcccggaaaaggtcgaggaagtccgaggaggcgaaaaccttggaggatgctatgagcgaggaagaggtcaagagcgacgtggtggatcttcagagcgatgatgaacctaagaataataatcacgtgggagaatcagaatccgcggcaatgcaggtttgtgaggaggaacccaagagtgacgtggtgctagagactcttatcagcgaagagcaaccgaagatgttagaacctgaatctgttatcagcgaagaggaaccgaaggtgttggatgatgttatcaatgaagaggaagcgattgtggccgagacgttgaaggaacaggaacctattgtgcctgagacattgaaggaagaggttgtggatgagatggcagaacaacccctttgtatagaggaatcggaggagaaagattctaatggggttgccctagctttggttaatgatggtgctaaggggaagaagagcatgaagaagcggttggagagacctcaatcggagagaaggtttacgcggtcggcattgaaggtaaaatccgaggaaacaaacgatggggaacatgttggtgtggctggaattagtgatggtgttaagagggaaactgaagctggggcttcgttggtaatgactactcctagttcggtgaagttttcgaatagagggaaactgaagaagtttcctgccaagttgagggatcttctggcaacagggattcttgaggggctgccagtgatgtacatgaagggagtgaaggcaggttggaaagacggggaaaaggggcttcaaggagtgattcaagactctggtgttttgtgcttttgtaagatttgtaagggggttgaggttgtcacacccactgtgtttgagctgcatgctggcagtgcaaacaagcggccccctgagtatatttacatccatgatgggaatagtggaaaaaccctccgtgatgtcatgaatgcctgctgctgttgcgattttccattggagtccatggatgaggctgtccaaaagctccttggtgacttcactatgaagaaatcttccatctgtttgaactgcagaggggcatgcaagggtgtgtcaaggctagtatgtgattcatgcttagtaagccccgctcaaacagccgtggctagcaacaaaggaatttcacaaccagttcaacccagatcaccagaaccagttgtgattcaaaaatcattagacaatgaagtgcagccaaattcattacacaatgaggtgcagccaaataaattagacactgggatgcagccaaactcattagacaatggcatggagccagattcactaaacaatagtatgaagccaaaatcgtttagcaatgggatgaagcacagtgcatctcgtggtaagagtcagggaagactaactaggaaggatttgcgcttgcataagttggtatttgaagcagatgttttgccagatggaactgaactagcctactatgctcatggacagaaactgttggttggttacaaaaagggatatggaattttttgtacctgctgcaatgagcaggttcccactgtttcatattttacaatttcagattgtgtccctttaccatgcattcctagtggtacttggtattgtaagtattgccagaatgttttccagaaagacaggcatgggcaacacgaggtgaatgctctggcagctgcaggaaggattgcaggccctgatattttggaactgatgaacaaaagatgcattcgtgttgtcagaactttagaagttgaccatggtggatgtgccttgtgcagtcgtcccaatttcagtaaaagctttggtcctcagacagtaattatttgtgatcagtgtgagaaagaatatcatgttggatgtttgaaggatcataacatggagaacctagaggaattgcctgttggaaattggttctgtagtggaaattgcagtcaaattcatactgctctgatggatctggtggcttctaaggagaaggatgtcccagatccccttctaaatttgattaaaaagaagcatgaagagaaaagtttagacattggagctggtcttgatgttaaatggagggttataaactggaagttagattccgattctgttgaaactaggaaattgctttcaaaagctgttgccattttccatgagaggtttgatcctatagttgattcaacatctggccgtgatttcattcctgcaatgttatttgggaacattcgtggtcaggattttagtggaatatactgtgcagtgcttactgtcaatggggatatcgtgtctgctggagtatttcgtgtctttgggttagaaatagctgagcttccattggtggcgacaactgctgatcatcaaggacagacgctacttggatctttaaatgtgaaaaaccttgtcctaccagctgctgatgaagctgaatcaatatggactggtaaatttggctttacaaagctacctcaagatgagataaacaaatataagaaattttatcgcatgatgatatttcaagggacctcagtgttacagaagcctgttgctgaagcactctga

SEQ ID NO: 537 - DNA, 474 bp, Glycine max
  Peptide Sequence Number=SeqID_117315
atgaaagttaaactttgtggtcatgccacattagctgctgcgcacacactattttcatctggtttggtggataccaatgttattgaatttgtgacgatatctggagtattaactgccaaaaagatcccagcgatccatatcaccaaattcagatttgatgagagtgcttcacaactttccggggcattgaacggtgcttccataattgatttaaagaggacacaaatcagagatgacttacttgttgtagtcacatctggaaaagctgtctcagaactacagccaaaacttgatgcaatagttaaatgtcctgaaaggggggatcctgtttgtgggagtgcacattgtgcattggcatcctattggagcaagaagctagggaagtgtgatttcaatgcttatcagattacatctgagcaggcatctcccagagggggagttctcaatattcatcttgacgagcagatccaatga

SEQ ID NO: 538 - DNA, 774 bp, Glycine max
  Peptide Sequence Number=SeqID_117316
atgcctctctcttcttcccaatgccttctctcctccttcctaggctctcgagaagatgcgtccaccaccagaatcaaacccactctagtaggtgagcaacagattcatacttttgcaaaacaacttcttccccttcacaccaccatccttttcctctttatagtgctcaaggtttcaacatcatcgttagtgatattctacaacaagtgcccccaccaagtgtggcctaggatccagcccagcgcaggaaagcttgttctggcccgcggaggcttcaagctctcaccaaactgggcctactcgcttcagctacccgacctctggtttgggcgcttatggggtcgccacgactgcaccttcgacatcggcgggcacgggcgttacaccaccgcaaccctggcgaagttgaccctgggcgtgagcttggtggatggttacaacctacctatctccatcaccccattcaagggatccggaaaatgcagctacgaggggtgcgtgagtgacctaaacaccatctgcctcgtggacctcctagtttgctcatgcaacaacaagcacgtggttgcctgcaagatacatctattcaatccttttcaggttataatcagtttttttcaaactgctttctacacacaggaaggagttggagcactttggactgggattggtccctacatagcaaggaatggtattattaatgttgttgaactaggcagttatgatcaagtgaaacaggtaatgaaaaagacactggactgcattgtggagtaa

SEQ ID NO: 539 - DNA, 237 bp, Glycine max
  Peptide Sequence Number=SeqID_117317
atgccacctccacatagcagcaaacacaccaccgcaccaccacccaaaaatccactattgccacccaccatcatgttgcaccactcccatatagttttggatggtgcgatacaatggtgggtttggtgcgacgaggaggttcgagtcatagtgatgtgtatggcgatgacaagtgattgggttgcgatgcagtgtggtcatggacatttaggggagaggcagctagggtttacttga

SEQ ID NO: 540 - DNA, 402 bp, Glycine max
  Peptide Sequence Number=SeqID_117318
atgcaggactcgtccacacggtgtagacgagtcctacaccctctccattctcccttccttggccaccctcactgcaaagaccacgtggggcgccatgcgaggactggagacattctcccagcttgcatggggcaaccctacgtggattgcagtgggggtgcaggtgttggattccccactctacgcccaccgtggtattatgttggatacttcaaggaactattttcctgtgaaggacttgttgaggacagtggaagcaatgagcatgaacaagctcaacgtgttccattggcacgtcacggactcacacctgccttggctgaaaagggtgcttattcatctcacatggtatactcacctgaggatgtgaaaagggttgtggagtttggtcttgattgttga

SEQ ID NO: 541 - DNA, 582 bp, Glycine max
  Peptide Sequence Number=SeqID_117319
atgagagacttcagtggaggaatgtttatggagatgttcgcccctgaggggacaagtgggtggtggtgttcggattttacgaggttttggtatcaggcgacagcggcagagaggtgtttattgtggtggggagctgaggtggtgatggtgaatgtggaggcaatgagggtggcttggtatggtggggcccacgtgaggtttcttggttttggccacaagttgattatggttgttgagtgtgcattgttcactgttattaggcatgacaacatgaaaagtagtagtaaaaagagtgttggctctagttttgtcattgtgatggtgttgttgacacttcctttgtttttcattggagatttatctaaaaaggaacaagttaagagcaacggactgcacccaacaaggatatgccgaagcaaaacagcattatgcagcaaagcagaattatgcagcaaaacaagactatgcagagaacaggcccaagaggaagagtacaacacctgcgtatttgaaggattacaacctatgctgatgtggcaaaccttgtctgatgcttgtctgccattaggaccccacttatag

SEQ ID NO: 542 - DNA, 552 bp, Glycine max
  Peptide Sequence Number=SeqID_117320
atgaagttgtgggtactacccccatcaactaaaatcaccacagggggtgtcatcttcatcccttatcaacaggaattccctagacaggcatttgtgtccgcgatgatacttctcattgcaggggaaattggagggctcgagaaagttaggggtggggaagtgtttgggaaggttgaggacgagccaatccagcatcctgagccatcgtcagcggatggtgtgcttgaacttctctgcgaatcttcggagactgccccgaaacgaagcaactcaggaggaaatgggaggggcttgaagaaaaatgggccaggatgtaaactgcccattgctcgtcatccactggaaccaagccagcgcacgaccgtccatgtagaaagatgcaatggtcaaccgttcatgctctggggtcgcgtgatactcgaagaattggttgatcttgaagatccaaccaagtgggtccgctccatcaaacctgggaacctcgagcttcatgcggttactgatgagctcgtcaattttgtgcgtgaggttatgcaaggtatcattgagtga

SEQ ID NO: 543 - DNA, 2793 bp, Glycine max
  Peptide Sequence Number=SeqID_117321
atggtggatctgcacctccttcctttaagtggtgctaacctggtgctcagagttcaatggctcaaggctctcggacccattctcactgactacaacaccctttccatgaagttcttccacggtggcaatttagttgaattaaagggggatgatgcttctactttgagtcttctctcacaccctcaggttcatcgtcttcttcggaaggatggcgcaaatacatacctccacatagccattacaactacagagcccccttcaaacccaaccattgcaaccctcccttctgaaatacagcctctcataaccaaattcaactcactgttccaaccaccccaatccctgccaccttctcgacccacagaccaccacattcatctccaacctcactccgagcctgtgaatgttagaccctatagataccctcatttccaaaaacatgaaatcgaaagacaaatcaaagatatgttagagagagaccttatccgcccaagtatcagccccttttcgtcccctgttctgttagtaaggaaacacaatggttcatggcgcctctgtgtggattatcgggcactcaatgcgataactatcaaagatcgatacctcatccccaccattgatgagttgttagatgagttgggaggcgccaattggttctcgaaactcgatcttctgcaaggttactaccaaataaggatgcatgaacctgatgttgctatgactgcgtttcgaactcaccatggtcactatgaattcaagcacctgatccacctagagaaggctttcgagaccctcctccacaaccagttcattctcaagttctctaaatgctccttcgcacaatcacaagtagagtacttgggtcatgtggtttcgggtcaaggagttgcaccaattgcttccaaaattcaggcaattgatcaatggcccattccaatgactacaaaagctttatgtagctttctaggactcgcggggttttatcgcaggttcatacggggatatgcttccattgttgctcccctgataaaagtcaccaccaaggaaccttttgaatggacagccgaggccgataaagcatttcgagttctaaagactgcgttaatatcggctccagttcttgtcttaccaaattttactcttccgttcaccttggaaacggacgcgtccggagtgggcatgggggtcgtgttatcccaaaaggggcatccaattgcgttctttagtaagccattcacacccaagatgttgcaagcctcgacttatatgagggaattatgcgcaattacgaccgcagtcaagaggtggagacaatatttgctggggcatcaatttaccattctaaccgatcatcggagccttaaagagctcttaactcagggaaatcgcatttggctaccacagggtatccctttcattcaaacgcttctcacagagtaccactccactctgacagggggtcacatgggggtggcgaaaacactagccaggctcactgagaacttttattggccagggataagaaaggacgtgaagcattttgtggcagcttatgtggattgccagcagactaagttcgagaccaagaaggttgttggtctcttatgctcgttaccggtaccgtgtcgtccttgggaggatctctctctcaattttattaggggccttccatcatttcacggtcacacgaccatcttagttgttgtagacaggttctcaaagggggtacacctgggaatgctacccacccaacattctgcttactcagtcgccatcttgttcatgaatattactggaaaacttcatggcatgccacggagcttggtttccgatagagacccactctttatcagtaaattctggaatgagctgtttcgtttaagtggtacgaagctgaggatgagctcagcttatcacccccaaatagataggcaaactgagaagccttcttcatggggtaaacttctttaccgggcagaatggtcttacaacacgtcacgccattctggtactggtgtctctcctttcgaaatcacctttggacggaaacctccagactggccgcaatatatcacaggtacttcaaaggtggaggctgtggatgagtttcttgctgatagggagtccatttttagtgaattaaggaagaagcttcagaaggcccaattgattatgaagcattcagcagataagaagcgcagggatgttgaattcaacatcagagacttggtcatggttcgtctcagaccacgccgacaagcctcggtcacgggccaccataggggttttcacaagctcgataagaagtattatgggccttttaaggtgcttgaccgaattgggccagttgcttacaaattgcaattacccgatagcagccatatccaccccgtatttcatgtctccatgctaaaacaatttcatcaatcagctctagctactgatcacagtgcacttgctttaccacaggtagcaattgacaatgaactagtggtttcccctctcgccattctgaataccaggtacattgtagactccgacaaacccaaacttcaggtactggtgcaatggaagggattacttccagaagataccacatgggaggattgggagcaattgcaagcagaatatcaccttgagaacaaggtgtctttcgaaggcccaggggatgatagccaacaaggatatgccgaagcaaaacagcattatgcagcaaaacaagactatgcagagaacaggcccaagaggaagagtacaacacgtgcgtatttgaaggattacaacctatgctga

SEQ ID NO: 544 - DNA, 1668 bp, Glycine max
  Peptide Sequence Number=SeqID_117322
atgccaactttgatttcatataggtttcttttgcttgttggagagtcactccacatgagaagggctttggccacttctaggtctgttttattgcacactagtgtcaagtgtatgagccaggtggaaccccatcatggttccctaaccgtctctggcataggtttacaaactgaaactgaacccagaaacagaagcaaaacaaataaggttaagccattgggttcaccctctgagaatcgcaagagcaaaggaaagcccttaggcattaatgagaagaagaagaaagcttttagggttgtagagaaacagcaaatagagtctgccccttttgctgcagagtcattttcagaacttggcctcccacatgtgttgattgagaggctagagaaggagggtttcaccgtgccgaccgaagttcagtctgctgcagttcccaccattctgaacaaccatgatgtcataattcagtcttacacgggttcagggaagacattggcttatctgcttcctatactttcagttgttgggccgctgagggggaaaactcctgaaggcaacagtgatggtggggagagtgggaagaagttgggaattgaagcagtgattgttgctccttctagggagcttggaatgcagatagtgagggagtttgagaaggtgctaggaatggataacaagagagtggttcagcagcttgtggggggtgcaaaccgaaccaggcaggaagatgctctcaagaaaaataagcctgcaattgttgttggcacacctggtaggatagctgagctcagtgcatccgggaaacttcgcactcatggctgtcgatatttggtattagatgaagttgatgaactcttgtcattcaatttccgggaagacatgcaccggatattggagcatgtagggaggagatcaggtgcagacccaaactcagattctagaaaggctgaacgtcagttaattatggtttctgcaactgtgccgttttctgttgtaagggcagctaggagctggggttgtgacccacttcttgtccaagctaacaaagttgccccacttgaaactgtctctccctctgaacccatcagtttgtctcggtcttcacccagctcaagccctagctcggctatgccatctccggcagcagtagagagtctacctcctgcattgaaacactattactttgtaacaagggtgcagcacaaagttgatgtgttgagaaggtgtattcatgcactggatgccaaatttgtgatagctttcatgaaccatactaagcagctaaaggatgttgtcttcaagctggaggcccgtgggatgaaagccatggagttacatggggatcttgggaagctagctaggtcaacaactctgaagaaattcaaaaatggtgaggtgagagttctggttacaaatgaattatcagcaaggggtttggatgtggcagaatgtgatcttgtggttaatctagacttaccgacagattcaattcactatgcacaccgagctggccgaactggtcggctaggtaggaatggtacagtggtaaccatatgtgaagagtcagaagtgtttgttgtaaagaaattgcagaagcagctagcaataccaattgcagcctgtgattttgcagaggggaagtttctcgtcactgaggaagagaaaaca

SEQ ID NO: 545 - DNA, 717 bp, Glycine max
  Peptide Sequence Number=SeqID_117323
atggcccaagatgacgcatccaataaagttaactacatgggcagtcataatcatcaaggattccatcaaagaggaccaccaggattctatcagagcgataattttctgcaggactacgattggagatattatccaagtaacaacttcaaccaagggggttcaccctatcagcatcctagccaggggccgagtcaagaagagaagcccattaatatagaagaattgctaatacagttcatgcaagaaacaagatcacatatgaagaggactgatgcaacaataaaaaatttggaggtacaaataggccaactagctgagctagttgctgaaaaacccactgaaacctttgcggtaaatgctgagatgaagcccaaagaggattgcaaggtaattttcactgagagagaagagaaagaaaaaaaaactgaggaagatgtgcatgatgaggaaggagaaaagaaggaagaaagagaaagaaatgaggagaaagcacaacaatggaagaagtactcacaagtagaaattcaaaaagaaagcattctccaagtcaatacccctcctcatcaacttattgtcaaggaagaaagacacggagaacatgagaaagccttaagtgtcattcattccttgatcaccaccacttctcttgcaataatgtggaaggtgcttccagaatacacgagtttcatggcgtctctagctaagaggcgaaaatga

SEQ ID NO: 546 - DNA, 2286 bp, Glycine max
  Peptide Sequence Number=SeqID_117324
atggcagttgctggcgtgcataatgtggctgtgcaatctactttcctaagggaatcccattctcaatcatctgggaggcagggagatggagggaggggaggcacccggtcgccttcggtcttgcaaatgtggcgagagattgaagatgagcaggtagtgagacaagttcaaggaagacctggggaggtacaaaggagtgatgggttggttgtggacctctcacaggaaaatgtgcccaatagcagcaaccagagagaagagcatatgatagaggatgcagttttgggtgagaatgattctgaaacctggtcgcaaagtcagaatgagttccatgatgaacaggaggaattaaacaattctagccgtgaaacctcctctgattttggagtagttgaaagggaaagagtgagacaaatattcagggaatggatgaatagtggttctaggggtcatgcatcgaataattcccaaggaaataattcaaggggagaatggctgggggaaactgagcaggaaagggtgagtgccacaagggagtgggtacagatgagtagccatcagagaggtgtttcttctggggaaaatagggaagagcaatcttctgaaaatggtacccaaattgaatgtgttcgtgatggatttgttgttaatcagaacgagggccaatgccaaactgagcatacacggaggggaatccgtaaattatggggtcgacaggtgtttcttgatatgcttaagaaggctgagatggaaagacaaagagaagtacaggaactggaaggtttcgtttttagaaaggacaattttggttgtagtcatgcaaccagtaacacatctgatacctcatccgagaacgacattgatgttaatacaattgaagacactggagctagcagctcacaagcagtcccaactgtacattctcaacaatctgaacctaataacagggtaagtgatggacttgagatatcaggtgatcagatttgttcaaaaggaaccatttgtgagaatttagattggcaaggctctactgctcatgtggaagcaagagatttggaatcatctttcagtaccagggttgaaagaggagatggcactggaggaaatgttgatatgatgccaactgaaaatccttctaatgactgtagtcaactaagcttgcaaattgaagatacagagcatgacaatatgcatgagtttagtgaggtacatactgagcaatctcagcggggtgatataaataatgatgaaagcaatttttcaaatcatgatgatcgtgtatacagcaatattgttgatgatgtagatttgattgaatctattgctctggaaggggagcaacaggaagaagttattattgaaaatgacggaagtgactggcatcaaagtgtggatgatattcagctcagtagcacaacaaatgaatggccccaaaacatattgggaagtgaagatggagaaaattctcgtatgcaggagcaagaagtccctgaagtgtggcaagaggatggtggctttcaagaggctgtggaaatttggttaggaggaccttctgataatgaagtagctccagttggtagaattcatggattttattttcctgaagatgacaatgtatacagtgttgaactcagggaattgctaagtaggagaagtgtctcaaacctccttcgcagcagttttcgtgaaagtcttgatcaattaatacaatcatatgttgaaaggcaaggtcatgctcacgttgaatgggagctgcaagagacaaccccttcttctcccttggcagaacaagtatcggggcaacggagtaggggtccaattgttggtcctcaggctactgttaatagctcacttaacagacccttgccaccaacgcctccgcctcagcctttatgggatcggcactcacgtcatgacaattggtcccagagtgacataaataatcagcgcttaggaattgtgcgttcatttgccggacataactgcttttctttagctgatgagtgggatattgttaatgacttgagaattgacatggttaggctacaacaaaggatgaataatatgcagagaatgctggaggcctgtatggatatgcagcttgagttgcaacgctcaataagacaagaagtctctgcagccctaaatcgctcaactggttcatcaggccaggttggtatttttatgactcttgaaggtgaatcgggttggctcgacccgtttatctatcggcctgtgctgggccaacctgtggagggtcggactggcccgtttttccaggtctaa

SEQ ID NO: 547 - DNA, 342 bp, Glycine max
  Peptide Sequence Number=SeqID_117325
atgagtactggatcaagtgagaggcaaggtagtccacaaactggagaaaaggattatttgaagccaaagttgatgattcaaccacaaagagtgatggaggaggaggagatagaagaatgcaagaccccaacttggcaatcagggaaccaaataacaaccatgttggagtgcccacctgcaccaagaaagaaaaagccaacttcaccaaatatgagaaaatcatcagcaattgatgatcatggtcaattgaatttctttgaagagataaagccagaggaggtatctctctcggaagcattcttgttcaaaatacaattcgacactaaagatgaactcttctag

SEQ ID NO: 548 - DNA, 942 bp, Glycine max
  Peptide Sequence Number=SeqID_117326
atggcagggcacactggatcttgggctttagcctacccagaaattgtaacatgtgccaacatgttctggtggccagcagaaggtgatataattgctgcagaaccaggaacaggtcatttgaaccctctaaaccccaagacttaccaagtcctaaagaatgtaatacgtgacacgaccacattgttccccgaaccattttaccactcaggtgctgatgaaattgtaccaggttgctggaaaactgatcccacaattcagaagtatctatcaaacggtggaactctcagccaagttcttgagaagttcatcaacaacactctccctttcatcgtgtccctcaaccgaaccgtcgtctattgggaagatgttttgctgtctgaaacagtccatgtgccatccacaattcttcccaaggagcatgtggttttgcagacatggaacaatggacacaacaacaccaaaaggattgtttcttcggggtaccgcgccattgtgtcgtcatcagacttctactatctggattgtggccatggtggctttgtggggaataacagtatctatgatcagcaaaatgggggtgacaaagacagtggtggctcttggtgtggaccttttaagacatggcaaaccatatacaattatgatatagcatatgggttgagtgaggaagaagaaaagttggttttgggtggggaggtggcactgtggacagaacaagctgattcaactgttttggatggaagaatttggccaagaagttctgcattggctgagtcattgtggtcagaaaatagggatgaaaagggtatgaagagatatgcagaggccacagatagactcaatgaatggagaagcagaatggtaagtagaggaataggtgctgagcccattcagccactttggtctgttaggaaccctggaatgtgcaacactgttcactaa

SEQ ID NO: 549 - DNA, 444 bp, Glycine max
  Peptide Sequence Number=SeqID_117327
atgaaacgctccgaagaatttgagttcgagtttccggcagctgtttatgtttccggcggcgtccccaacgacgtcgttttctgcggcaaagtcatgactcgccgaaccgaaggtgaaacccgggcactgttgaggtcggaaacttccaacgggttcatggcgtggctccggtcgccgtccgggagggagagccgccggtaccggaggatcgagagttgccggagacgatataacggaatgtttgggacagtgatgaagtttccattgcaaatggagttgagtgacattaagatgaggcaggagcggagggagcttcctccgacgatgccgaaggtagcggcaaagggcgacggcggagagagttgctgggaactggtccagccgttgaggcgtcggggaacgctcaagaatgcattgtttggatgccttgttcccgttgtttag

SEQ ID NO: 550 - DNA, 363 bp, Glycine max
  Peptide Sequence Number=SeqID_117328
atgggttcatttgatggcataccaggtgtgaaaggcaaagaggtgttatttagacatggcaataaaacccgtacccatgggtacccgcccaaatccgtcctgactttgacgggtaatacccgagttgaccgggtatgggtacgggttcgggtttttcccgataaccaaaagtcgagtacgggtacggattggggatacccgatacccgacgggtacggggatgggacaataaactcaaacgcgtcgggtatcgggtacgggtatgagaatatgttgatgagtcgagaaagagaagtaagtgcagaagcaaggtgttccgagatagggcgaggagacccttttgctttggagctatctggttaa

SEQ ID NO: 551 - DNA, 153 bp, Glycine max
  Peptide Sequence Number=SeqID_117329
atggcattgaacgagaaattaggggcaagtggtaacgagaaagaacaactcaccagtgacgacgacgttggggtgatactccggcaaaaggcgacgagggagctcaggctacggttccacggcgacggcgggggaggttctttgaacctttaa

SEQ ID NO: 552 - DNA, 264 bp, Glycine max
  Peptide Sequence Number=SeqID_117330
atgaagacaataaccagttcttttgaaggcatgtctaatcaaggtgcacctcggtgggttgaacccaagagtaatgtgcaaagtggagggtttgagtgcggatattatgtcatgcactggatgtggtgcatcgtgactgccggtttgaaggatgattggcacaagtggttttctgatggatcaccgttagacgtggaggccatcacaacagttcggcagaaatgggcaacttactttttaacttttaggaaaagcagttgctaa

SEQ ID NO: 553 - DNA, 714 bp, Glycine max
  Peptide Sequence Number=SeqID_117331
atgtgtgaagcatttaataaatgcatcttagagttaaggggaaagcctattattaacttggttgaagggattaaggtatatttgatgatgaggattgttaggataagggaaatgatgttgaaatattgtggtcctacctatccaaaaattcaacttattctggccaatatagagaaagatgctaaagcttggactcttaccttgtgtgttgcatgcttgtggcacaacaattacaaacctgaggactatgtagctgattggtacaagtatgtatattttggtataagaaaaacacttatttggccagttattcatactatatttgagcatgtaatgatccagacaagtggccagaagagtgatcttccaccaatcaaccatcatgacataaggagagcacctggaagaccaaagaaaatgagaaacaaattaaatgatgagtcaatggacaagtttaaattacctagacatcaattctcagttgtgtgtgcaaactatggaaaatttggtcacaaaaaaggacctgtaaataaatctaagaaggatgcaacatttgagtctacacatggtgaatcatttggatcagcacaggctagaccaactaggattactaattcaagtgcacgtatgcaatctagtgcacctacactaagccaaatctcatctcaaagtattgatgcatcagcaccacagactcaacaatcacaagtttag

SEQ ID NO: 554 - DNA, 393 bp, Glycine max
  Peptide Sequence Number=SeqID_117332
atgaaagggtcaccaagctgtgcgttggaagctttcatcctatcatctgagccaatgaatgcagtgtgtacatttgaaagcaggatatgtcctgcattctgtccaatgccccaggcaaaggctaaaaaattgcaaaccctagcttgtggacaacttaagcttcatccatgtttcaagcccaacagagcttttactagaggtggcaagccagagagggatgcgttcattgtagaaaattcagaatttttgtctggtctgcttagggaatggaatattcctcataatgttctaaatgctagacccaagcaaaagaagctgaaattgttgctcaagccggacggaaacatgccattaccctctctgcaaatatggcaggcaggggcacagatataa

SEQ ID NO: 555 - DNA, 459 bp, Glycine max
  Peptide Sequence Number=SeqID_117333
atgcattctagagcatatgtgcatggtgttgtaaaacctgagaatgtttttcttggaaccctagcaaatgttgaggagaaaaagctttttctagttgatcttggattagaaacccattggcaagatagttcggcaagccttcatcttgagtatgatcaacgcccatatgtatttaggggaacaactcgttatgctagcgtgcttgttcatattggtagaacaagtagaaggagagatgatttggaatctcttgcttacacattaatcttccttcttcatggttggctaccttggcaacttaagagaggacaattgattgtagaagaagaaaatgatgagcaaccgaagaagaaggtcagaatgggaatgctagcaattccatggattagtgtgtacaatggtcatcgacctatgaaggaaagttaccatttcaatgttactgatgtccatttatcctaa

SEQ ID NO: 556 - DNA, 495 bp, Glycine max
  Peptide Sequence Number=SeqID_117334
atggatcagaagaatggggctatgtacaagtcagacccaaagcccacatgttctggttggctatacagaagtgcccacagagtggacaatccatcaaagccatggccaattattctctggttgcagggaggacctggctcttcaggagttggaaacttcaaagagattggccctctggatgacaatttaaagccaaggaatttcacatggctgaagaaagctgatctgctatttgtggacaatccagttggaactgggtacagttttgtggaggattctaggctcttagttaaaacagataaggaggcagccactgacttgactacattgttaactgagttattcaacggtgattacagcctccaaaagagtcctttcttcattgtggcagagtcttacggtggtaaatttgctgtcactcttggattatctgttatcaaagctattcataaaggaaaattaaagcttaaacttggaggtatatttctttcttaa

SEQ ID NO: 557 - DNA, 480 bp, Glycine max
  Peptide Sequence Number=SeqID_117335
atggtccatgccttggaacttccatcccattggagagtacagtggtttgacgtcaaatggaacgtggagcaatacaaaaaggagaaacacatggacccaatttttcttgaattagctaaattaaatttcaatatgattcaggccaaacttcaaatcgaggtcaaggaattatccaggtggtgggagaatcttggtataaaaaaagagttgagctttgcaaggattaggttggttgaaagcttcatgtgtgcagtaggagttgcttttgagccaaagtacaaatctatcaaaaaatggctcactaaagttattatttttgtaataatcctcgatgatgtttatgatatacacgcctcatttgaagagttgaagccgttcacaatggcatttgagagatgggatgacaaagaacttgaagaacttccagagtacatgaaaatttgcgtccatgcacttaaagatgtcacaaattgcttatga

SEQ ID NO: 558 - DNA, 321 bp, Glycine max
  Peptide Sequence Number=SeqID_117336
atgaaggagttcattcgagatgcattggaatggactgcactagatggaagtaaggcaaggcagaccacaggatcagtagtggaccctattcatgctcccgctgttagatctctcatttttcaaatgaaagagggatttggttcccatgcgatggtgcggtacaaagaagtgacgagcaaagacgcagagttgaggacgacaaggcaagaggccgcactcacgacgatgaccattgtgcaggatgacgacaatcatgtaaaaaggatgaagattatgaaggcttacagctggtgtctcgctaagcgaggcttgtgcgcttag

SEQ ID NO: 559 - DNA, 222 bp, Glycine max
  Peptide Sequence Number=SeqID_117337
atgaagaagaagcaagaagcggaagaggaagcaggaagccaaagaggaagaagaagtggaaaacggcatagcggaatagtgactcgtccatacgagtcactatttgtttttataaggataggtgaatcccgtctcaaaggttgcgattattgcaaacgtcggaaacacgacgcagctattgcctatttcagcagccggctaaatgcaaacttatatggttaa

SEQ ID NO: 560 - DNA, 371 bp, Glycine max
  Peptide Sequence Number=SeqID_117338
caccgttactatgggaaatcagtaccatttggatcgagggaagaagcactgaagaatgcaagcactattgggtatttcaactcagctcaagcaatagcagattatgcatcagtcctcatacatattaagaagacattacatgcccaaaagtccccgtgcttgcttcatggtttaggctcaaatatccccacctggctattggtgctctggcctcatcagctccaatcctctacttcgataatattaccccacaagacggaggccagtgaaacatgctaccaaactatattgaagtcctggtctgaaatcgacagagtagcttctcagccaaagggtctttccattcttagccagagattcaacacttgccg

SEQ ID NO: 561 - DNA, 279 bp, Glycine max
  Peptide Sequence Number=SeqID_117339
atggagcttaataaaagaaccaaacatgttaggatctcaacacttatctccctagaattcaaggattgggagcctcctaagaagaaagttttaggattctcatcattccctccttcttggaaagcatttgccctctgtcccaacctacccttcgacaggagggcgacacgagggctcacaggtgcgtcttccaagggagcaaggcgcgcggagttgccaccaatgtttattcgaggaaaacgtcagaaaaaccggaaaggtgtggtctacgaactttaa

SEQ ID NO: 562 - DNA, 251 bp, Glycine max
  Peptide Sequence Number=SeqID_117340
atggacccggtcaagtacatctttgagaagcccactctcacggggcggatcgcttggtggcaggttttgccatccgagtttgacatagtctacatcacccaaaaggcgataaagggaagtgccttggcggactatttggctcaacagcctctcaatgattatcaacccttgcatcccgagttcccagatgaggacatcatggccttatttgaagagaagctagacaaggacagggacaagtggattgtgtg

SEQ ID NO: 563 - DNA, 195 bp, Glycine max
  Peptide Sequence Number=SeqID_117341
atgggaagtgttgtgaggcatggattgagtgggagtagcatgtggtggcattgggtgaggttgttcgacatagggatccatagacctacactacaaactacttgccttgctggatgcaactcagctgaggagatgctactgtcaaggaagaaagccaacagaggtggtagaggaggtgaccgcaaggatagttga

SEQ ID NO: 564 - DNA, 2019 bp, Glycine max
  Peptide Sequence Number=SeqID_117342
atggcaagtaatggcagcttatgctggccactggtggtcgtgggtggtggagacgaaggtacccctctcatccctctggcggaggatacctacaagtttgacacaggagatcgtggagcctattcaaatgacgatccatccttgatgtcagtccactccagatttcggcgagaatcacccccggaaaactccaatcctcttccaacaaccatggtggacaatgatgctctccgccaactcgaagcccgcatcgcagagatggaatgccaccatgaggaggaactcaacaggttgaaggccgaccacgacgaattcaaggctcatgttgacctacccaaagtttggaaaccactcaacctggagcgttatgataggaccactgactcggaggatcacttagacacgccttatgacctggcaagtttgtcaacaacctatgcaaaaaacctcctagtagcatggatgagttacgagagtgatctaagggctatattcagatggaagaaatgtcgaggttttgaaacaaagtttgacagactggacaaaagtgtgagaaatgagagattagcacaaggaccgactcacccaagtcggacaagtgacacaaataggacaagcgtcaacctcttccaaggggaccaaggagtagagatgctgataaaagaagggaacaaaccgaggagagagggaggcagaggcgtcacccgaaagggcgtgaacaccaaccccaacaagagcaagaagatgaacttgcctagcagattaggggcggattttcctatggaaggctatctagccattccttacagcatcattcctatgccatcagaggatgaccccatggttttctccaatggcattgctaacttcatggtgtctaaattccttaacgaccaaggcagttcctcagatatactctattggaagacatttcaaaggcttgaaatctcacctgccatgattcaaccacaatatggaccattccttggtttttctagagaaagagtggaaaccagaggctacaatacattgaatgagcttggagctatagtctctacaccacacctcaagatgaagtttcataccttaacaagagaaattgtgattgtcaaggcagatcaaaagcaagctcgacaatgttacaataagagcttgaaggtggcttctcattctcccattagagaactaggcaagccccactcctcctttgatggcagtaatagtcaagtcatgagtgttaacgaagatctctcaataaagaccctgaccgtttacgaaatagccaggattgacaagttgctcaaagcccagtttatcagagaggtcagatactcgacctggccgaccaacgttgtcatggtgaagaaggccaatggaaaatgccgcacgtgcactgactacaccaacctcaacaaggtgtgtcccaaggatgcatatcccctacctagcattgacaagctcgtggatggcacgtctggcttccaattgttgagtttcctggacatgtatttaggatacaacaaaattatgaggcacccttcagatgaagaaaaaaccgctttcataattgaaggtgccaatttctgttacagggtcatgctttttggactcaagaattgtggccaacatgtagtagatttagaggaaatgttcagagtgattcgtaagtatgacatgtgcctcaatcctgaaaagtacacctttggggtcgacggtgaaaaattcttgggattcatgatcacctattggggaattgaagctaaccctaacaattatacgataatacaggaaatgcaaaaccttaccaatgtcaaagaaattcaaaagcttaacgataatcgggcctcattgtttaggttcctcacgaagctcgcaaaaaagacgaagccattttataggctacttaggaaaactgagtcattcctatgggatgaggcttcgaagcaagctttcttagcctttaagatagccaattctaagttgaccaaagccaggagcacccctactcctttaccttaa

SEQ ID NO: 565 - DNA, 417 bp, Glycine max
  Peptide Sequence Number=SeqID_117343
atgataagcccaaagtatgcggggaagtttctctttccacaagcccttggacttgtcaactctcgtgcgcagggctttaaggataaccttatttgttgcttccacctagtcgtttgtctaagggtgctcgatagaagttacgaggaattctttgtaggcttaagccttgaattgggtgccgttgtcagtgacaatggcatagggaggatcgtatctgcatatgaggtgtttccagctcaggttgtagaggttgtcggggggtgtgcgcggaacatctatgaattgttggcatcttttgcatctcctcacgaagttgagggcgtcagccttgagcgtcaagcaatagtagccggcacatactaccttggtttccagggagtgcccccttatatgaaggccgcagattccttcatgtaa

SEQ ID NO: 566 - DNA, 1113 bp, Glycine max
  Peptide Sequence Number=SeqID_117344
atgggatccgttttgccctcatttcaatggctttctttgttctttctaattatctcagttaatgtttgtgctttcaaaattccaaggttaggaacttggcagagatcaaccaaggaacgcgaccccgaaatcagttcttccttgcacttgtctgatgatgacctcaaaacattttattatacccaaagactcgatcacttcaactacagacctgacagctaccacactttccaacaaagatatatggtcaatttcaagtactggggtggagctaaatcaagtgcacccatttttgccttctttggtgcagaaggaccagtggatgaggatgcaaaatatatcgggtttctcagagataacgctcctcagttcaatgctcttattgtttttatcgagcatagatactatgggaaatcaataccatttgggtcaagcgaagaagcaatgagaaatgcaagtactcgtggctacttcaactcagcccaagcaatagcagactatgctgctgtgcttctacacatcaagaaaactttgtctgctcagaattcccccataatcgttattggaggctcttatggtggaatgcttgcatcatggtttcgcctaaagtatccccacattgctcttggtgctcttgcttcatcagcaccaattctttatttcaacggcattgccccacaagccggatactactatattgtcaccaaggatttcaaagaaactagtgagagctgttaccaaactatacgtaaatcatggtctgaaattgacagagttgctaagaagccaaatggtctttcaatcctcagcaagagatttaaaacttgcgacaaattgaacaaaagttttgatctcaaggactacttggactcgttatatacggacgcagctcaatacaattacccttctgagcacccagttaagatcgtatgtggagcaattgacgcagctgctaagaaaaccgatattcttggccaaatatttgaaggtgttgttgcttataagcaacatcgttcatgttatgacatgaatgaatataaccatccaactgaatctttcctgggttggagatggcagttttctttgctcgtccggtgcatggtttggttttaa

SEQ ID NO: 567 - DNA, 710 bp, Glycine max
  Peptide Sequence Number=SeqID_117345
atgaattcattacctagcgctgttcatgcatcctccaccaacgagtctggcggcccgcgaattgattgcctagcgttgttcgccagttctccattccccacttttattcggagccccatgaatttattgcctagcgctggtcatgtgtcctccaccttcgagtcaagagccccgcgtattgattgcctagctcttgtcaccaattctccattctccacttttattaggagccccatgaattcattgcctagcgttgttcatgtgtcctcctccttcgagtctggaaccccgcaaattgatttcctagcgctgcttgccaattttccattctcgacttttattcagagccccatgaattcattgcctagcgctgttcatgtgtcctccaccttcgactctggagccccgcgaattgattgccttgcgaagttcgccagttctccattctccacttttattcggagccccatgaattcattgcctagcgctggtcatgcgtcctccaccatcgagtctggagccccgcaaattgattgcctagatctgttcgccaattctccattatccacttttattcccagccccctgaattcattgcctagcgctatgcatgattcctccatcgacgagtctggagccccgcgaattgattgcctaaaactgttcgccgattctccattccccacttttatgcggaggcccctgaattc

SEQ ID NO: 568 - DNA, 453 bp, Glycine max
  Peptide Sequence Number=SeqID_117346
acatgcagcgagataattatgccaataggtcatgaaaagaacgactcaatgtttccaccagcacctttcaatatgaagacatttgttcaagagtgtaggagcttatatggtgtccttccccagcctcattgggtgaccacatattatgggggtcctgatttgaaactgatcctccataggtttgccagcaacatcatattctccaatggattgcgagatccgtacagttctggcggggtgttggagagtatttcgaacactgtcgttgccgttactactgtaaatgggtgtcactgcctggacatacagtcaagaaaggcaaatgatcctcaatggttggtgacgcagagaaataccgaggtcaagataatcaaaggctggattgccgagtacaaagctgatctaatagcacttactaaacaaatcaaagcaccagcagaacccaaaagctaa

SEQ ID NO: 569 - DNA, 432 bp, Glycine max
  Peptide Sequence Number=SeqID_117347
atgtcaataatcagagatattacaaatgttatcaaagtagacctatctcccattatggtagatttggagacgaaccaagtgaaaactgatggacattataatgttgatgcttcagttagggaaacatgcccagttgttgggtgtgaagacattctaagggattttgtggtggaaacctggatgacaacttttacttgtaagttgggatcttgctctattataacaacaaaagattggggaaggtttccagctctccaacatgcttgggatatgggaaaaaaatcagtgtcgatcgaatcagactccttaacagcggtgaagattcttcaacagcgtgtcttagcgaatcattcctattttgatttgatcagacttggtcaatccttggttaatagaagatggagaatgaggatcactcatattcatagataa

SEQ ID NO: 570 - DNA, 152 bp, Glycine max
  Peptide Sequence Number=SeqID_117348
atgaaggattgggggaatttcctccaccgaatccttgaggaggattctgaggattccactccaattacaacattcttcttggtgtggaggttcggcggcaagcaacgacggctcatggtggccaccgggggtcgtgggtggtggagaaggag

SEQ ID NO: 571 - DNA, 426 bp, Glycine max
  Peptide Sequence Number=SeqID_117349
atggctacatcgaaactcaatctgttatttttaagaatgaggaacccagtgcagaaattaggcaaccagtttggttcatcatggaatgcttgggaatatgagtttaagtttggtagcgtagaggggttaagtgctgctgcgtctaaatgtgcagggacgctttttggttgctgggggacgagttatattgagaaagacatcaaatttttcactatttctgaaaacaacccgttcttcatgaagcaaacccacccaaatttggatgatgaagctttggatattatgatagaaaatgttgtgaccaatgaaagcagtgcatcaatgagttcctcaacatcaactaacgttccaaattttgaaaaggtttttgttggccaacgagtcactggtggtaacgaccggagcactggtgctggtgccactgag

SEQ ID NO: 572 - DNA, 459 bp, Glycine max
  Peptide Sequence Number=SeqID_117350
atggcattcttgggagagacaagcagtcagacagttgtgaactccacattaggttttatttttccaactgaatccattgtttacaatgacagtggtgtttcctttcaagcttccaccccagttcccattcgagtacctaacgggtgtgattttcaaacgttaaaaaccataatacacaatacccttaagctaaccgacaaacaatttttggatgaaatttactaccggcaacctttcacgtatgcagctactatgacccctacttatgatgccctgctatattacaatgggaggtggaacatgtcacgcaaaaatgagtttgttggttactcgttcataggaaaaaatcccaaaaagtttgacattcccattggatgtaccatggatgaactgaaggatttgatcaagcaagttgtgcctcctgggatttccctttatggtattgatgaaacacaaatg

SEQ ID NO: 573 - DNA, 1593 bp, Glycine max
  Peptide Sequence Number=SeqID_117351
atggcggaggaccgtagtgaggtgagtgattacagttcggaggacgaaggaaccgaagattacaggcgcggagggtaccacgcggttcggattggtgacactttcaagaatgggagctatgtggtgcagagcaagcttggttggggtcatttttccactgtttggctcgcttgggacactcacaaatcgcgatatgttgccttaaaaattcaaaagagtgctcagcattacactgaagcggcaatggatgaaataaagattcttaaacaaattgctgacggggatccagatgacaagaaatgtgttgtaaagcttttggatcactttaagcattcaggacctaatggccagcatgtttgtatggtttttgaattccttggagataatcttctcacacttatcaaatatagtgattatcgaggagttccccttcccatggtcaaggaaatttgtttccatattttggtgggtttggattacttgcatcgtgagctttctgtaatacacactgatttaaagcctgagaatgttcttgggggggggtctccaatagatccatctaaggatcctagaagatcaggcattccactttatccttcgggggctttgaatggagatctgaccaagaatcagaaaaagaaattgcggaaaaaggctaaaaaggctgctcaaggctgtgctgggaaggaaaatgctgaggaagttgaggaggattccaaagcacctgacgagcaagatgattgtagtaatgatgtgaaaccaagtgtagaacctggtgaagttaaacctaatagtcctgtgaggaaagatcaatcgacaaagacttctgaaaataaagatattcctcaaggaagtcatggtaataggaggggtagccgctctacaagaaagaagttgctcgaagctgttgatcttaagtgcaagctggttgattttggtaatgcttgttggacctataaacaattcacaaatgatattcagacaaggcagtataggtgtcctgaggttcttcttggatctaaatactcaactccagcagatctgtggtcctttgcttgcatttgctttgagcttgcctctggcgatgttctttttgatcctcatagtggtgacaactatgatagggatgaggatcatctggcattgatgatggagcttcttgggatgatgcctcgcaagattgcacttggtggatgctattcccgagattttttcaacagatatggagatttgaggcacatccgtcggttgcgtttctggcctcttaataaggtgctgacagagaagtatgatttcagtgaacaagaagcaaataacatgaccgatttccttcttccattacttgattttgtccctgaaaagaggccaactgctgctcaatgccttcagcatccttggttcagtgcaggtccccagactcttgagccctcattgactgctgtgaagcatgatgctattgaaggggaaatatctgaaaaaatgcagagggaaaaagctgagcaggaggctgtggaagttggcatggggaatatggccatagatggaaatccaaagccactcaaagagttccaatctatgaagccatcagaatag

SEQ ID NO: 574 - DNA, 316 bp, Glycine max
  Peptide Sequence Number=SeqID_117352
atgaccaactcaacaacactagctaccacaatagacgatgttgctacaaggtcttcaatagttagggattttgtggcttcatctggttctatttcaacaaaggaagcacactctgtcaagggctttaaaaagatggtgttgttgatgggggattgggcagataaggcggttgagatcggaggggaagagaaaatcatcatttatgtgttaggaagaggtgttggcaatgatggagaagttgtcagagtcaaagttggagaattttcaggtctaggaagtgtaatgggggatcagggaaattggtgggagggagaag

SEQ ID NO: 575 - DNA, 1002 bp, Glycine max
  Peptide Sequence Number=SeqID_117353
atggggtcttctagttatttcttcacttccttgcttctggttgtagtgttcaatctggctaaagggcagcctctggtccctgcattgttcatatttggggactctgtggttgatgtgggaaataataaccacttatacaccattgttaaagcaaacttccctccttatggaagagacttcaagaatcacaatccaacagggaggttttgcaatggaaagcttgcgtcagattacacagctgaaaaccttggatttacctcttaccccccagcttacctcaacttaaaggccaaaggaaacaacctcttaaatggtgccaactttgcctcagctgcttctggctactatgatcccacagccaagttataccatgcaattccattgagccaacagctggaacactacaaagagtgccagaatatattggtgggaacagtagggcagtctaatgcttcatcaattatatctggttctatatatcttatcagtgctgggaacagtgactttattcagaactattatataaatccactgctttacaaggtttacactgctgatcaattctcagacattctcttgcaaagctatgtcactttcattcaggcatcaaggaagattggtgtgacaacattacctccaatgggttgtttgccagcaaccatcactctctttggctctgatagcaaccaatgtgtggttaaactaaataatgatgctattaacttcaataagaagctaaacaccacatctcagagcttgcaaaaatcgctttctggtctcaaattggccatccttgatatctaccaacctctctatgaccttgtcactaagtcttctgaaaatggcttgctagaaacatctgtgttgtgcaatcagaagtccataggaacatgtgccaatgcatctgagtatgtattttgggatggttttcacccgtctgaggctgcaaacaaggttttgtctgatgacttgctggctgctggcatctctctcatatcctaa

SEQ ID NO: 576 - DNA, 828 bp, Glycine max
  Peptide Sequence Number=SeqID_117354
atggctcaagaaggccaagaaaagtgtggccttgaacagaaagcacataggggactcgtaactgtttttgacttttgggcagtcaatttccaagttgttgaagcagcattgctttcaagaatacagcgattggaacagagattgatggaattagaacctcgtgtacaagctcttcttgaggcattgccaaatcggttgactggtgacatattggagcagcttcgtattagcaaacaaactttggttgagttaggttctaaggcaggagctctcagacagatgctgcttgaccttctggaggatccccatgaaatacgccgtatatgtatcatgggaagaaactgcacacttagtaaaggaaacaatgacatggaatgttcagtgccttttgaaaagcagattgctgaggaggaggaggaggaaatagaaatgcttctggaaaattatcttcaaagatgtgaatcttgtcatggtcaagctgaaaggcttcttgattctgcaagggaaatggaagattctatagctgtcagtttgagttcacgaaggcttgaggttagcagagtagaactgcttttgcaggttggaacattctgtgtggcaataggtgcccttgtagcaggacttacaagatttagaataggacgtactcaacttgatattagaaggaatgttacaaaggaacatgcaggtatatttggcatgaacctgaagtcctatcttgaggaacatgtgttggcattttggctgacaacagcggggataattattggtggcattattgctttctttctaatgtattcctacctcagggctaggaaaatattttga

SEQ ID NO: 577 - DNA, 1837 bp, Glycine max
  Peptide Sequence Number=SeqID_117355
atggctccagctgggaagctttctgggtttcgtcgagaaggcagtgactggttctgcaatgggggactgccaagtgatatcactgtttccatcgatggtgtcactttccatcttcacaagtttaactttgaaattcctgcagcttatgttgagttaggggtgggacagggacaatttcctcttttatcaaaatgtggaaaaattgttagagcacatgaagagtccaagaatactgatggggctctgaaaatggtgctggaagaatttcctggtggtcctgacactttcttaattgcagcaaaattctgttatgggtatcgagtggaactgacagccagaaatgtggtatcagttcactgtgctgcagaataccttgaaatgacagatgaatttggagaaggcaacttgttgtcaaaatcagagagttttttccataaaaacacactgcgcaactggaaagattgtattttggctctccaaagttctgagcctgttctaccaaaagctgaaaagcttcatttagtgggtaagtgtttgaatgctctatctatgatggtttgtacagacccaagtctgtttggatggcccatgatgatgtatgggagttttcagagccctggtggaagcattctttggaatggtataaatactggtgctaggattcggagctcagaatctgattggtggtttgaagacatctcatatctcagtgtgagtttgtttgagaggcttattaagacaatgcaagcgagaggcatacgacctgaaaacctggcaggtgccataatgtactattctagaaagcatttgccgggtctaggtcggtggcacggtggacaaggtggcaaggccagaacagttgcaagtttcagcttgacacctgccacagttgatcagagggttctattggaaagcattgagaaatttcttcctgacaagaagggaaaatcttattgtcgattcttgctgggacttcttcgtgtggctttgatattgaatgtcagtcaaacttgcaaggattctttagagaggagaatagggatgcaattggaacttgcaactttggatagtcttctgattcctacttattcagattctgatgcattatataacactgaatcatcaccatcatcatcatctgaatcgttgaggaaagttgccaagttgatggatagctacattgcagaaattgcttctgatgttaatttaaaaccgggaaagatacgcaggcttgcagaggccctccctgagtcatcaagattattgcatgatgggctttacagggcattggacatatatttcaaggctcacccttggctctctgatagagagaaggaagaactatgcaacatcatagactaccagaaactctcaatccatgcttgtgctcatgcttcccaaaatgacaggttacccctcagagctgttcttcaagtgctcttctttgaacaactgcatttgagaacagcattagctggatgtctcaatgcattggatggtgaaattgctccggcagctcctgttcctataactgccctgggcgacacagcaagtgaaattgtacaaagggatggatgggtgactgttgtgcgtgaaaaccaggttttgaaggtggatatggataggatgagttctagagttggagaacttgaagaagagttcagtaaaataaagcaagaaatgaaaagtgtgacaaaatctcacagttcacgaagctcgcctcggttggttgccaggaaaatcgggtgtaagcttgttccacgaccatcagatgctcaaccagaatccctcaaccgcaccggatccacaccaagagcatccattgaatgggcacggc

SEQ ID NO: 578 - DNA, 345 bp, Glycine max
  Peptide Sequence Number=SeqID_117356
atgacagaacttgtgagggtggccgagaaaagcgaggctcttgctcctacgtatcctcaaatgaggaactcagacctacgtgcagataaccgtaatgtgtctccgcgggctaccagattcttgggtcatggtaacaaaaaaggtggtgtgatcgaaaaaagcgaggctcttgctcctacgtatcctcaaatgaggaactcagacctacataaccgtaaggtgtctccacgggctaccagattcttgggtcatggtaacacaaaaggtggtgtggtcgacaaaagcgaggctcttgctcctacgtatcctcaaatgaggaactcagacctacgtagttctggataa

SEQ ID NO: 579 - DNA, 651 bp, Glycine max
  Peptide Sequence Number=SeqID_117357
atgaatcattccaccgtgctgccgctggcagtgctgccggtcgcgcttggcctgctgttggccagtggccatgttggcgcccaggctgtttcgtcccctcccgcaccactgagccaggccgaactctcacgcctggtgcagcagcaggcgctgcagatccagcagttggaggcgcgcctgcgtgccgtggaaggcgggcgcggcacttccggcgcggcggtcgcaacgcaggctcccgcgctggacacccgcattgccgcactggaatccagccaggccaaggcgcccaaggtcacctggtccaagggcgcaccggaattcagcagtgccgatggcagcgtggtgttccgtccgcgcggacgcctgttcgtcgacgcatccagcaccgatgggtcctcagtgagtgaccgcaacatctccggtaccgagatccgctcggtgcggttgggcgccgaaggccgctacggcatcctcggctgggcggtggaaggtgacttcgccgacaacgcggtggcgtggaagtcggtctacaccaccgtggaccaccgcctgttcgggctgccggccgacctgaccgtgggcaaccgcctcaacgaccggggtatcgacggctccagcagcacgtccaacacgccgttccaggaccgcaac

SEQ ID NO: 580 - DNA, 372 bp, Glycine max
  Peptide Sequence Number=SeqID_117358
atgatgacaatgatagtagacacattatcagtattctactatggaaaatggtgggctatgcaccttcaaagctttgcggatttggtctttgccagtgaaaggatcgatgtgggtctgaaaaaaggcaaatttagtcatcctgcttggacgaatgagaaaactgggacaaatgaagagggtgaggatgaaggaaaagcccgtgctgtgactgccattcctatacagccaagtttcccaccaacccaaccatgttgttactcagccaataacaaatcttctccttacccaccgcccagttatccacaaaggccatccctaaaatcaaccacaaagcctacctaccgcacttccaatgacaaacaccacatttag

SEQ ID NO: 581 - DNA, 267 bp, Glycine max
  Peptide Sequence Number=SeqID_117359
atggtggaggaagaagagaagaagaaggctgctgagaaaaacctgacctttgaaacgctaaaatcctacctcggtttgcgtgccgtttctctggttccagttcctcgtgtttctctgcgtccgtcagggccagttttcaaaaaaatttccaggatgttacaacacgtagaactgcatccgtcagtcaaggtagcagtcatcgctgtctatcatacggtggaggtgctcgccggcacgaagaacctgagtcatgccttgcgttgttga

SEQ ID NO: 582 - DNA, 306 bp, Glycine max
  Peptide Sequence Number=SeqID_117360
atggaaaataaaatgcggttccagaaatcaatcgtaccacaactgaattcttcttcttcctcttctcctcttccgttttcgttcgcgtttccgcaattcggagctgaagatcaaccaccgctcaaattcgcgtttggatccgatcgaatccgcaatccaatcgagtttcgggatctgaagagaaagagaagagagggatctgcgagcgccataggcgatggcgatgtcggggatgcgaggactctccgtgttcataagcgatattcgcaattgccagaacaaggagcaggagaggctccgcgttga

SEQ ID NO: 583 - DNA, 2919 bp, Glycine max
  Peptide Sequence Number=SeqID_117361
atgctttacatatatatgcttggctatgatgtggattttggtcacatggaagctgtttctcttatatctgccccaaagtatcctgaaaaacaggttgggtacattgtaacatcaagtttgcttaatgaaaatcatgactttctcaggttggctataaatacagtgcgcaatgatatcattggtcgtaatgaaaccttccagtgtctagcattgactatggttggaaatattggtgggagagaatttgccgaatccttagcaccagatgtacagaagttgctgatatcgagcagctgcagaccacttgttagaaaaaaagccgcattgtgtttgctgcgcctgtacaggaaaaatcctgatgttgtcaatgtagatggatgggcggatcggatggcacaacttctggatgaacgagaccttggtgttttgacatcttctatgagtcttcttgttgcattagtatcaaacaaccatgaggcatattggagttgtcttcctaagtgtatcaaaattttagaacggcttgctaggaaccaggatatcccacaagaatacacttactacggtatcccatctccctggcttcaggtgaaaacaatgagggctcttcaatattttcctaccattgaagatcctaatgccagaaggtcattgtttgaggtcttacaaaggatactgatgggaactgatgttgtgaaaaatgtgaacaaaaataatgcatcccatgctgttctttttgaagcccttgctctggtctatcatggcccgcttacacccctatttgctggctgtcttcatttctatacatctggacgcatttggtggtggtgtggtgtatatggtatacatttggtgggttctgtgatgcatcttgatgctgaaaaagagatgatgtctcagtgtgtggctcttcttggaaaatttattgctgtccgtgaaccaaacattcgatatcttggcttggagaatatgacaagaatgttgatggttactgatgtacaagatatcataaaaagacatcaagctcagattattacctcattgaaggatcctgacatcagtattcggaggcgtgctctagatttgctttatggcatgtgtgacgtttcaaatgcaaaggatatagttgaagaactactgcagtatctcagcacagcggagtttgcaatgcgtgaggaattgtcacttaaagcagctattcttgctgagaagtttgcaccagatctttcatggtatgttgatgtgattcttcaattaattgacaaggccggtgattttgtcagtgatgacatatggtttcgggtggttcagtttgttacaaacaatgaagacttacagccttatgctgcggcaaaagctcgagaatatcttgacaaacctgctatacatgagacaatggttaaggtcagtgcatacatacttggagagtttggacaccttctagcaagacgacctggatgcagtccgaaggaactatttagcattatacatgagaagcttcctactgttcttctaacccatttgctcatctttagatatgaaagctcaattgaagtcgaaatacagcaaagagctgttgaatattttgcattgagtagaaaaggtgcagctctaatggatatattggccgaaatgcctaaattccctgaacgacagtctgcattgattaaaaaggctgaagacaatgaagtggatacagcagaacaaagtgctataaagttacgagctcagcagcaatctcaaacatcaaatgctttggttgtaacagaacaaagtcatgttaatggaactccacctgttggccaacttagccttgtaaaggtgcccagcatgagtagtaatgtggatgaggcagatcaaagattatcccaggaaaatgggactttgagtatagtagattctcaacctccctctgcagatctccttggcgatctcttgggtccactggctattgaaggccctcccagtagcagtgtccacctgcagccaagctcaaattcaggagtggaaggaactgtagttgaagccacagccatagtacctgctggagaacaggccaattctgtacagccaattggaaatattgctgaaagatttcatgctttgtgcgtgaaggatagtggtgttctatatgaggatccttatattcagattggcattaaagcagaatggagagctcatcaagggcatcttgttcttttcttgggaaacaagaatacttctcctcttgtctctgttcaagctttaatattgcctcccacgcatttgaagatggagctctctctagtaccagaaactatacctccccgggcacaagtgcaatgcccacttgaggtcattaatctccacccaagcagggatgttgccgttcttgacttctcctacaagtttggtaacgatatggtcaatgtcaagcttcgcctacctgctgtcctaaataaatttcttcagcctataactatatctgctgaagagtttttccctcaatggagatcacttcctggaccacctttgaaacttcaagaagtggtcagaggtgttagaccccttccactgctcgaaatggcaaacttattcaatagttaccatttgacagtttgcccagggcttgatcccaatcctaacaatcttgttgtgagtacaacattttattcagaaagtacaagggcaatgctttgtttagtaagaattgaaacagatccagcagacagaacccagctgcgaatgacggttgcttcaggggacccaacactaacatttgagatgaaggagttcatcaaggaccaattagtcagcattcccgccatagcaacccgtgtaccaacacaaccagctccgacatctccaccactggcccaaccaggcagtgctcctgcagcattgacggatcctggggcaatgctggctgctcttttatga

SEQ ID NO: 584 - DNA, 207 bp, Glycine max
  Peptide Sequence Number=SeqID_117362
atggaacaaggaggtttatttccagctcaagataattctactttggcttctctaggcaattcggtttcttgccacaaagttcataagatcattagaagtacgagggcattcaaagcgtcagatcatcggaagtatgaaaacattcaaagcatcgagcctagatggattccaggctatcaatgggagattgtgggagaagttctttag

SEQ ID NO: 585 - DNA, 4857 bp, Glycine max
  Peptide Sequence Number=SeqID_117363
atggaagaacctcccgtcgtgagatccaggggccgcccgcgcaaacggaggagagaagacgacgcaaccgtcaccggcgacgcgaaaactcttcccgaggcgaagaagatgatgccaattgcattggttggacgatacgtgctgaaagagttccgcagaaacacggttcttctcggcaaagtcgcgcgttacgcgagtggattgtacagagtcgtgtacgagagtggcggtttcgaggatttagatagcagcgagattcgtaggatacttctccttgatagttatttcgacgacgatttgattcggaggaaggttgaattggaggaatcggtgttgccgaagatcgctgcagaggaaccggagaaaggttcgagcgaattgcaaggtgaattatcggttgagaacgaggaggaacgagctaagacggatgatgatgagtcgttcggtgaggctagggattcaagttccggttccgaaatgccagaaacgcagataccgccgccgcttacgctgccgccgtcttccggaacaattggagtgccggaaccgtgcgttttgaatctcttttcggtttacggatttttaagatcgtttagcattcgcctgtttctgagtccatttactttggatgagtttgtcggtgctctgaactgtaaagtttctaacacgttgctcgatgcaattcatgtttcgctgatgcatattttgaaacgtcaccttgaaaatatttcaccagatggctcgcggcctgcaacaaaatgccttagctttatctcatttgtctttgatcatgcttaccgtgttatagaccgtagtgtgtatttagcaatttttggatacacaaaaggacctgagtggaaaggattttatgatgaaatcttttatggcgagtattatttattgcctgcaagtaggaaattgacaatattgcaaattctctgtgatgaagttttggcgtctgaggagctaaaagctgaaatgaacatgcgtgaagaatcagaggttgggatcaattatgataatgaagatagccttcctgctgaaaatgggcctagaagagtccatccaagatattccaaaactactgcctgcaaggatgctgaaactaagaagtatgtttcagaattgaatgcggaggatgatggtgatgttgatggaaatggagatgaatgtcgcttatgtggcatggatgggaccttgctttgttgtgatggttgtcctgctgtttatcattcaaggtgtattggtgtgatgaagatgcatataccagaaggggcatggtattgtccagagtgcaaaataaatttgattgggcctacaattgcacgggggacatcacttaaaggggctgaagtatttggaaaagatttgtatgggcaagttttcatgggtacttgtgaccacttactggtactcaatgtcaaaagtgatgacttttgtcttaaatactacaatcagaatgatattcctagagttctccaagtcctttatgcatccgaacaacatagacctgtatacaatggtatttgcatggcaatgttagaatattggaatatttcagaaaacttcttacccctctgtgtcagtaaacttcctcctatgattgaagaagagcataaagctgttagttcggtgaaggcagactacagtttaacgtttgggaatgggatttgtagtgataatttggtgccatctcttgatgcttcattggttacaactcgaagtcctgctcctggaagcagtggcaatgcaagaactactgtgaatctgaagcttcacgaggaaactgcaatggattcgtctgtttcaactaaccatcagtctgacccaaagtgccgaaattatgttaataggtcagctgcagtaagccctgccaagtgctccttggtaagcagccaatttagtaattatggggacgctaatgatatagggttgcctatgaatttgtctttgcaaactaaaggtgaccaatctggttttggaaagtgcaaaagcagtttaattaatgattttgtgtacatgggttgctcctataaaccacagtcatatattaattactatatgcacggtgattttgctgcatctgctgctgctaacctggccgttctttcttcagaggattctagatcagagggtcatgtgtctggcaacttggggaaagctacatctggaaacacttatttgctagcaaaagcattctcccaaacagcttcacgctttttttggccgagttccgaaaagaagcttgtggaggttccaagagagaggtgtggatggtgcatttcttgtaaagcccctgtttcaagcaagaaaggatgcatgttaaatcatgctgctataagtgccaccaaaagtgcaatgaaaatcctttctggttttgctcctgtaaggagtggagaaggaatcatccctagcattgctacatatgttatatatatggaggaaagtttgcatggtttaatagttgggccctttctaagtgaatggtatagaaagcattggcgtaaacaggtggaacgagctaaatcatttagtgatataaagccccttttactcaaacttgaggagaacattcgaacaattgctttttgtggggactgggttaagttgatggatgattggttggctgaattttctacaatgcaaagtgctgcatgtactcttggaacaacacagaaacgtgcaacttgtgggaggcgtaagaaacagttatctatcaataaagttacagctggtggttgtcaggaaaattttgcatggtggcatggcgggaaatttaccaaatctgtatttcagaaagctgttttgccaaaatccatggtcagaaaaggagcccgccaagcaggtggtttgaggaaaatttcgggtatattctatgctgatggctctgagattcctaaaagaagcagacagctagtttggagagctgcagttcaaatgagtaggaatgcatctcagctggcacttcaggtccgatatctagattttcatatcagatggagtgatctgattcgtcctgagcataacctccaggatgtgaaaggtcaagatactgaagcttctgcttttaggaatgcaaatattcgtgataaaaaaattgcagagggcaaaattttatacagagtagcctttggaagccagaaacatcttccttctcgggtaatgaaaaatgttgaaatagagcaaggtcctgaagggatggaaaaatattggttttctgaaacacgtattcctttatatttggtaaaagagtacgaattacgcaatggaaaagtactatctgaaaaagagtacctgcatattacatctcatgtgcacaaaaggcggttgaaagctacctacaaggacatatttttttaccttacctgcaagagagacaaattggacatgttatcatgctctttctttctaaggccgcaatttttctcttggtttaatttcaggaatgctctcaagtgcagtgcctgtcaaggttattgtcacacgggttgttccgtgagttcaacagtctctacatgtgaagaagttgagttcttggccacatgcaaacaatgtcatcatgccaaattacttactcaaaaagagtcctgtaatgaatctccaactagtcccttactcttacaaggacaagaacgtagcactttggcagttctgaaggggccaaggcctaaatgtgatggtcaaggattgatttctactaggacaaagaatagtcgacttgacatgaaactagttgcttctgatttccctttggaaacaaaaggccgtagcagaagttgttcttggggtgttatatggaaaaagaagaataatgaagatacaggctttgatttcaggctcaagaacattcttttaaagggaggttcaggcctgcctcaattggatcctgtttgtcgcttgtgccataaaccatatagatctgatctaatgtatatttgctgtgaaacatgcaaacattggtatcatgctgaagccgttgaacttgaagaatccaaactttttgatgtgctgggcttcaaatgttgcaagtgtcgcaggataaagtcacctgtgtgtccttactctgatttgtataagatgcaagagggcaagaagttactcacaagggcttcaaggaaagagcactttggggcagattctgattctggtacacctattgacacgagaacatgtgagcctgcaactcctatctatcctgcaggggatgtctctagacaagacaatgatcctctgttgttctccctttcaagtgttgagctcattacagaaccccagttaaatgcagatgttgcaggtaatactgtctctgggccagggcttctgaaattacctaaacgtgggagggagaacaatggttcttttagaggtaatcttcatgctgagttttcaacaagcaatgaaaatgaaatggtgtccaaatctgtaaaagatttatcacctgtagaatatggctctgctgactgcaatcttctgaataactccgaaattgttaaatttgatgcattggtggattttgaacctaatacctacttctctctgactgaactgctccacacagacgataatagtcaatttgaggaagctaatgcatctggggacttagggtatttgaaaaattcttgtagattaggtgtacctggagattgtgggactgttaatttagcatccaactgtggatctacaaattcgttacaaggaaatgttaataattgtcggctatgttcacaaaaggaactggcccctgatctctcttgtcagatttgtgggattaggattcacagccattgttcaccttgggttgaatcaccatctcggcttggtagttggagatgtggtgattgccgggaatggcgatag

SEQ ID NO: 586 - DNA, 2664 bp, Glycine max
  Peptide Sequence Number=SeqID_117364
atggggagcaaggtgagcgaccaccacttatccaccgtccgatccatcgtgggttccgaattctccgacatggacatcatcagggccctccacatggccaaaaacgacgtcactgcggccatcaacatcatcttcgacactcacaccgcccccaaattcaaggccacgcgccccaccaatcccccaccagtttctcccccagaaccgacgcctcccgctcccaccgtcaccgccaactcaaaccacagagtcggtgaacgacacagcgacagtaaccgcgacgattggtggttcgtgagttgtggtgaaatgacgggtttgtccacgtgtaaagggaggactataagctccggcgagaccgtggttttcaagttcccggcaaagaagctctccgcttcgccctctccagggaaggggttcgggcgggcagtggcttgttcggagattgttcgattctcgacggaacaagctggggagattggtagaataccgaacgaatggggtcggtgccttttgcctctcgtgcgggatcataaggttaggattgaggggcagtgtaaatacgcccctaatgttttgggtatcatggactccattgttttgtcagtgagtgtatttatcaatagttcgatgtttgataagcatcaccaggtttctctcaaggatgctgccaactccactgatgaatcagtgtttcatccgcttccaactttgtttcggttgctgggtttaaacccttttaagaaggtggttgttggtcctgtgtcacctgcggagttaactcctggtgatttctattccaacaaacgtcctctcagtcaaagggtcccattaccacgtaccaagtctgagcatccttctcaaaatggtcaggagaatgacaatgaggattccatttctgaaattgatgttgagaacattgttggtgttggatcgagctcagagttagaggaaatggacccccctggtaatcttatgtgtgaactgcggccctatcaaaagcaggcgctttattggatgatccagatggagaagggacaatctatggacgagacagcaacaaccctccatccatgttgggaggcatatcacctggctgacaagagggagcttgttatttatttgaatgcattttctggtgaagcctcaatagaatttcctagcacccttcaaatggccagaggaggaattttggcagatgctatggggcttggaaagaccatcatgaccatatcccttctcgttgcccattcaggaaagggtggatcaatagccagtcaacccataacccaatcctttattgaaggtggtgaagttagtgatacagtgcacaatttttcaaacatacccaagaaggcaactaaatttgctggttttgataaaccgatgaagcaaaagaatgttctaatgagtggtggcaacttgataatatgtcccatgactcttcttgggcaatggaaggcggagattgaaactcatgtgcaccctgggtctctgtctctatatgttcactatggacaaagtaggccaaaagatgcaaaaagtctcgcccaaagtgatgttgtaattactacatatggaattttggcctctgaattttccagcgagagtgcagaggataatggtggactcttctcaattcggtggtttagagtggttcttgatgaagcacataccataaaatcttctaaaagccaaatttctttagcagctgctgctctaattgctgacagacgttggtgtctaacaggcactccgattcagattattgtcatgataacaattgattcatttagtcgaggtgatactcaagaatttgccgatctaaacaaactagctaagcgcttccttagaggaacctatagtgcttcagaaggtgaagtaaaagatacaccttcacgggcttatgttcaagaagttgtggaagagctacgtaaaggggagcaaggagagtgtccaatatgtcttgaagtatttgaagatgctgtgttaacgccttgtgctcaccgcttatgccgggaatgcctcttgtcaagttggcgaaatgctacgtctggcttatgtcctgtttgtaggaaaacaatcagcaggcaggatcttatcactgcccctactgagaatcggtttcaggtggatattgagaagaactgggtagagtcttgcaaggtaactgttcttttgaatgaacttgaaaatctttgctcatcaggctccaaaagcattgttttcagccagtggactgcttttctagacctcttgcagattccctttactcggaataacattccgtttgttcgtcttgacgggactttgaatcagcagcagcgagaaaaagtaatcaagcaattctccgaagacggcgaaaccctggtgttgttaatgtcactaaaagctggtggagtaggtataaacctaacagcagcttctaatgcttttgtcatggacccatggtggaatcctgctgttgaggaacaagctgttatgcgtattcatcgtattggacaaacaaagaaggttgccattagacggtttattgtgaaggggacagttgaggagagaatggaggcagtgcaagcacggaaacaacgaatgatttctggtgccttgactgatcaagaagttcgaactgcaaggattgaggagttgaagatgctttttacttag

SEQ ID NO: 587 - DNA, 850 bp, Glycine max
  Peptide Sequence Number=SeqID_117365
atggagtgtgggagaaagagctctgttagggcttctaaagaagatgatgaacttcttaaaagcactaaaaaaaagtcaaacgtaaatctaatgatgatgaatgaggcatttacaagaagggtgaggaggttgaaggttgcattaaagagaattttcatattggtgcaagccttggaaggggtttctcatggtgattgtgttagggaagcgagtgggatatatgatgttggaggccaaattgaattgtgtatgagctcgaagtatggttataaggaggatgcttgtctagagaagaaggtggccctggaggagaaggtgagtggtaatgatggggctaaggttggtgtagttccttcggttagggttgagctaccagtgcaaggggttacctcaggttcacgttttgaaatacttaataaggaacgtgatatggaatctgaagaaacacatggaagtattaaacaaggtagaatgaaggatttttgccctcattttaaaaatgggtcgaaacctgatagcaacaatgggcctcgtggtcatgatccgaaagagattgaaaggggtaatgccgatatggagacatatgtcactgttgaggtcaatgaagttattcctaggccacttgaggccacaaaaacccattccaatggttttaaggttgataaaaccattaaaaggattctcctagatagttcttgcgttgaggaagcttatgggcattctggaggcatttggattagtggcactgataatccctcattgcaggggattcttggatttaaacttctggcagaatattatgatgttattgatgcagggtttcaaggttaccccttcacctggaagaagg

SEQ ID NO: 588 - DNA, 360 bp, Glycine max
  Peptide Sequence Number=SeqID_117366
atgagtacgctgcttccaacctcaacaacagtacgcgaagcagagaaccgaattgcttctcaacaacatcatcgaagagatgcaggcactctctttgtcctcaaatcaaaaggttcatggattcactgtggttaccacttgataacttcaattgtgtctccatcactactaagtcttccttatgctttaaccttcctcggatggaaggcaggaatactttgtttggtcattggagctctgcatgctcaattgggtaatcgccagctgctatatagagacatggctcgtgacattttaggtactacacttcttccctgtatcattaacacggtagttaagaaaggatttaactatatgtaa

SEQ ID NO: 589 - DNA, 312 bp, Glycine max
  Peptide Sequence Number=SeqID_117367
atgtatagtgttctttactcaccttcatgcattgtccaccgagaagagcacagagcacttgattattatagcacagtgcaaattgaattggccccaccaaaaaccgagcccaacgtggaccttccaagtctatcgagtggtttagtagtgaccgatgcttgtggtgccaaacatggaaaattcttattatacgacacttgtccctttagcatttgtttcatgggtaacataattaagatggattttttcctactccaatatatgtggcaaaaagagaaggatttcaatgcatggagtaggggtaatggttaa

SEQ ID NO: 590 - DNA, 240 bp, Glycine max
  Peptide Sequence Number=SeqID_117368
atgacgagttcatggatgcactgtggttatcccttgacaacttcaattgtggctccaccactcctaagtcttccttatgctttcaacttcctcgcatggtcagccggaatattttgcttggtcattggagctttggtcagtttctactcatacaatttgttatctttggtgtccttgagcaccatgctcatttgggcaatcgccagctacgatttggagacttggctcgtgacattttag

SEQ ID NO: 591 - DNA, 114 bp, Glycine max
  Peptide Sequence Number=SeqID_117369
atgtttttagagactgtaggaatcctcgcctatgtagctagcaatgtagtaactctaatggacagggcaacagacaatgaaattgatggacacccagaagcaagcaatggataa

SEQ ID NO: 592 - DNA, 1137 bp, Glycine max
  Peptide Sequence Number=SeqID_117370
atggtgtcgtggaacaggttgcggctgggaatggacggtgacggcgaggagttgactgcgcaggagaccgctttgtatgaccgtcaaattagggtttggggagctgatgctcaaagaagattaagcaaatctcatgtcttagtctatggaatgaaaggaactgtagctgaggtagtcccagaacttgtctctctctggtatctcaaatttgactttgacaaacacacatacacaaaaaggagtaaaaaaatgggttgtgtttggtcgttatcatatttgttgcacttttgttttccttatattgatgtaataatgtgtgaggagtttgagtttcctgttgttggtagtctgactttagtagatgaccgggttgccactgaggaagtgctttcctcgaattttctcatccctcctgatgagaatgcgtatagtggaaagacccttggtgagctttgttgtaattcacttaaagacttcaaccctatggttcgtgtttccattgagaaaggtgatttgtcgagttttgatgttgaattcttcagcaaattcgatgttgttgtcgtcagttgttgctcgctttcagccaaaaaactggctaatgacaaatgcagaaagctatcaaaacgtgtagcattttatgctgttgactgcagggattcttgtggtgaaattttcgtcgatttgcaggattataaatattcaaagaaaaaacaggatgaaactgttaaatgtgacctgaaatatccatcattcgaggatgcattatctgtaccttggagggcacttcacaggagaatgtcaaagctgtactatgctatgagagtaatagaaaagtttgaagaggctgagggacgtagcgcaggggaagtttccattgcagatctttctggtgttctcaaactgaaaaaggagatttgtactgcacaatctctcaatgaatctcatgtgcctgatactcttctagaaagattggtgacaaatgcaatagaatttccgcctgtttgtgcaattatagggggaatccttggacaggaggttatcaaagcaatttctgggaaaggagaccccctaaagaattttttcttttttgatgcttttgatgggaagggcattatagaagacctctctccgaagtga

SEQ ID NO: 593 - DNA, 480 bp, Glycine max
  Peptide Sequence Number=SeqID_117371
atggcatcgagcatccaacaagtggaaggcatgttccctcttgccttctattcccctcttgatggctttcgcttgcatcttccctcacatctggtggttgtctcaaagatacttcacttgtccaaaaatacactatttctgaagaaccctataataagcgaccgggcatgtcctcataaaacctttttttttatttttattattggctactttttaaagacactttcagaaaatataaagagaaatttacttcccagaatactgcaactgcaggggcaaagcacaaaactctattacttgataattgagatgagcccaagtgctgccttctgggtatttgacaacttcattgatttgacattcattgcacagataccagacgactgtatggaagatctctctgctgatatcaagttgttgaaattacaaggtttaggtggaaaaggagggaaattgagtggagacacagtaaacaattaa

SEQ ID NO: 594 - DNA, 525 bp, Glycine max
  Peptide Sequence Number=SeqID_117372
atggtgcaagaagtcattgaaattgttgccagcggtgttaagtctgaagaaaacacgttgtcaaagagttactatgaggcgaagaagatactgtgttcgatgggtatggagcatcagaagattcgtgcatgctctaatgattgcatattgtacaaaaatgagtttgaagaaatgcataaatgccccaggtgtggggtatcacagttcaaagtgcaggatgataacgagtgtagtagtgatgcaagcatgaagaaaggtcccccaacgaaggtgttatggtatctttctatcattccaaggtttaagtgtatatttgctaatggagatgatgcaaaagaccttacatggcatgcagatgggagaatctacgatggaatgctctgtcattcagatgattcttctcaatggaagaaaattaatcatttgtatccagatttcaagaaagaggcaagaaatcttaggcttggacttgccactaatagaatgaattcatttggcagcttaagcactaagcacagttcgtga

SEQ ID NO: 595 - DNA, 219 bp, Glycine max
  Peptide Sequence Number=SeqID_117373
atggtcgtcattttgcctaagaaaaatgttgtcatctggttttgttcgttgcataacaggccaaacaactacctgaaaggaattattaacagtgctttgaaagtatttgacgatactctacaaagtaaatctaaggctgctgctaggtggattgttattaaaacaaaaaaggaagcactaagtgtgggtattacatcatgcattggatgtcaactataa

SEQ ID NO: 596 - DNA, 387 bp, Glycine max
  Peptide Sequence Number=SeqID_117374
atggcgccattgttttctacttggaaatggatcagggaagagagaactgtgaaatcattgcggctttcaaaggcattgacagttcctgaaacaacaaccgtctatgaagcttgccgtagaatggctgctcgcaaagtagatgctctgttactcactgattccaatgctttgctctgtggaatcctcacagacaaggatatagcaacaagagttattgctcgtgaggttaatctcgaagaaacacatgtttccaaggttatgacaaggaatccagtatttgtcctttctgacgctcttgctgttgaagccctccaaaagatggtgcaagggaggttcagacatttacctgtggtggagaatggagaagttgttgccatactgacatag

SEQ ID NO: 597 - DNA, 1066 bp, Glycine max
  Peptide Sequence Number=SeqID_117375
gatcgaaaaacactggggaacatctactcctggctccaattcgacattcatggagactcttcgggagcagatatttaagccatctttgtctacaattattcctcagaattcaaaggttgtaacagtttcaccaacagactcagttttgacgacaacaaagaagatgcttgaacttcgtgcaagttcagctgttgtgacggttggtgacaaactttgtggtattcttacttcaaaggatatcttgatgcgggtaatagcacagagtcttcctccatcgtcaactcttgttgagaaggtcatgactccaaatccagaatgtggaacaattgatacaccaataatcgatgcacttcacactatgcatgacggaaattttttgcatcttcttgtggttaatagagatggcattgttgttgctacggttgatgcgattcatatcacgcatgctgctgtggcgacagctagtcaggtcggaaatactcccaattttaacagcgaagctgccaactccatgatacaaaaaatttgggattcggccatggccttagctccaaatgaggaggaagaggattcacaaagcgagacttccttgaaaatgatttctgagggaggagaaacaggaagatccatttcttatcttgcgtcaagcatgcagaacgcattttccttcaaattacaagacaggaagggcagattgcataggttcacatgcgatactcggagcttggcagaggttataacgtccgtcattcagagagtcggtgatgatattgaccccatggacctgccccaaattttgtatgaagatgaagaaaatgataaagttgtactggcttcggacagtgatcttgctgcagctgtggaccacgcaaagacggctggtttgaagggactgagattgcatttagactactctggaacacatggttatggaactgattcaagttcattaagttggaaatatgctaattcagaagcatgggcatcggcatacagtgccattgctgctggagctgcagttgttgctgccttaggtctattggcgtttgtgaggcgaagtcaatga

SEQ ID NO: 598 - DNA, 369 bp, Glycine max
  Peptide Sequence Number=SeqID_117376
atgccggttgtggtggtggtggagatggtggcgggtgtgacggcggacgttgacgcctatggtggacagagcaagaggttgaggggcaacgacgcggacgacgatgagaacgacgggtgcaagaaggagccagatagagatagagcgagagatcatgattgcgaacattcctctggccgtcacaggaagcttccatgggaagccgccatgacaagtgatgctgacttaggtgcgggactaggtggcatgatcatgcgtgacttcagtacggagcttccatgggaagttgccatggggagtgatgttgacttaggtgcagggaatggaatcggagttgacataagaatcggagttgactataaaatgtga

SEQ ID NO: 599 - DNA, 297 bp, Glycine max
  Peptide Sequence Number=SeqID_117377
atggggctccctctcgcaacttggcaacccttgttgctacaaaggttgagaaacccatttgattttcatgccatgccccctcccatgtcgatgcttggcattccgagggattttcaactttttctctccaaatttcatgtgggtgttgctccaggagtaaatggcctaattggtacccggaggccggagcagcatggcggtgttggcaaggttattgacagcagacatgatttcaatgaggcccacttattgagcggggaagagctgcagggaagggctggatttgcgactgattga

SEQ ID NO: 600 - DNA, 522 bp, Glycine max
  Peptide Sequence Number=SeqID_117378
atggatgtggtcaactttcataatgacttccataagtttgatacttttcctagaggtatcaatgcgtctttcatcacccttattcccaacttggtctccattcttgttaatggaagtccaaccaatgagtttatcccacaaagagacttgagacaaggtgactcccttgcacctttcctctttatcatagtggtagaaggtttaagtgagcttatgagggaggccacacctaaaaggcttttctctagtttaaaaggtgtggtgataccatttggatccatttggtggagagatgtgaaacttgtatgtggaggtgaaaatgatgtttggttcaataacatggtagaatggaggatgggggatggtaagcttactagattttgggaggatgcttgggggctatgggaagttgggatcaagggaggtgagcttgggaatttaggaggaaaccaaggggtgactttgaggtaccaagaagatgatacttcgatatggttggaggatgcctcaaacttattcatg

SEQ ID NO: 601 - DNA, 3372 bp, Glycine max
  Peptide Sequence Number=SeqID_117379
atggaaaatcctgacgttgaaaagtctgaagaaaccaatagacaaattgacagtaacacaaaatctaattctaaacagcagagcgtagagaaagctaatgaacaccctgattggttacctgatggctggaacgtggaagtcagaacccgtaaaagtggtgtacacatgggatctggatataaggtgtgttacattgagccattgaaaggatacaaattcttctccaaaccggaggtattacgatatctcgaaactgtaaaggacaacagttgcacttccaagaaggggaagaaatgcagtaacatgcattctccaaaacacaacagttgcacctccaagaaggagaagaaatgcagtaacatgcattctccaaacgacaacaattgcacttccaagaaggagaagaaatgcactaacatggattctccagacgacaacagttgcactctcaagaaggagaagaattgcagtaacatggattctccaaacgacaaaagttgcacttccaagaaggagaagaattgcagtaacttggattctccaaacgataacagttgcactctcaaggagaagaattgcggtaacatggattctccaaacaacaacagtttcactcccgagaaggagaagaattgctgtaacatggattctccaatcgacaacagttgctcttccaagaagaagaattgcagtaacatggattctccaaccgatgttgtggttgagaagtctactgtggaggatttaccacctggatgggtgaaagaattaaagattaggaagaacagcaagggcattcggaaagatccgttttatatagatccagcgagtggatatgtattccgttccaagaaggatgtacttcggtatcttgaatctggtgatatacgttcatgtgcatttaagccaagtagaagacaagtccaagatgaagacaatttaactccaccacctgctgccaagagacagaaactgaagcagtctgcacccgaacaacagctttcttcagccacagaaattcttgataaaagcaacttagaattgctagatgctaacagctcaaggaaagggaaaaatgcaaatgtgtcatctggaatgatggttgcttctgttcccatgggtgaatctgttgaaaagatgcattcactggaggatggagctgcaaactcttctgaattgaagaaaacatctgacccaagtagctcagcacttttgaatgaatccttgaaagaatcagaacaagtactttctgcagatgatgtgcaagagaaggagcatgttgtgaatatgatggagaatgctattgaaaagaatcacagtaactatagcatatccaaaaacaggaaggagttcaatgtacctcaccggtcatcaccaagacttgctggaagtaaacctgtccagttggccaacaatgtgatgaatgaacagactctccaggttcctaaaagaaacttgaggaaaagtagaaacactctagatattgatatttctgaagaccaaacagtttctaaggaacaaccgcatcagcaagaagcagataaaatagaagacaaaaagccagaaattcaaattagctcaaacaaatcaagtaaaaagaaagagtaccaccttcctcgtcgggcttcaaaacgattagctgcaattgaacatgagtcaatgaactccaaagcaaaattgcagcaaagtgagtgtgggccagttacagtgcttgcagatcaagcaccaacaaatggaaagtcagcaaataaaaggaaaaaatcagaacctcagctggggaaacgtgaaaatgaagaaatggaggatgagaaatcagaatctcagctgtcctttgcatttcactactcctggtctgacccaagtttggaatatgcaatcaataccctcactggtgtgttaccaccagctgaaactgatataccaaaaactttggttgacaatgttacgggaaaaggcgccactaccatccctgaaactgatattccaaaatctttggttgacaatgctacaggaaaaggcaccactacagtccctgaaactgatattcaaaaaactttggttgacaatgttacaggaagaagcggaggcagtgaaaacaatttgcttgacactgttgcaggaagcagggacagaaaatcccaggcacgttcaaataaacccaagaaaaagaaagaggtcaaagtacctatgcgattatcaaagcgacttgctggccttgaacctgaggtactgcctgctgaaagagctcttgaatattcgactagaaaatcatgcaaagaagaaccaactgcaactgctactttaactaatggagtgtctgaccatcacgatgctggggaagaaaccaagcttactcctcaagcttctgacagtttgaaaacagaagtactaggagaatcattaaaccagagtgagaagtcatatgatgcccaaactggtcacaaggaacaattgcagaaagttgaagctgaaaatattggggatgcaagatcagagccacagctccccttaccgtttgggaactcttggtcagatccatgcctagaatttgcaatcaagactctcactggtgctttgccagttgatgctggtgacattatgcccgctttgcctcctggctttgataatccgccatataagcaattgcatgggaatgtggtgacaagcattaatcaagaagctcacgataactcaaaccaatcacagaacaagaaagagcttaatatggttagccagcttgtgttgaggtccagttccacctcttatgaaaatgctcccaaatttacaactagacagtcttatcttgatcaaggcaacataatagggaatttgaatgaagaaccccgtcacactggaaacataacacctcctgtgcatcattctaggaatataaactcactaacacatgaagagccattaaagcaaaatggacaggttgtcgagggtggatttgttacaacggagcaacaactatttgaaactggaacggtaaaccatgataattctgaattacagtactgtgctccgtttatgaattcttggtcagacccatgcctagaatttgcatttaagactcttacaggcgtgataccagtagaggaaaatttaacacttcaaggatgtttccaggaacctgttaactatcatgaacgaagggatggtggctcaatgttgccagatttaggatcttcctgcttttctcaaagtgatttttcgtttctccatgatacaggggttaagtccatgccggggcagcagccatcaataagttcttcattcctaccgttggaaaaaacgagcctgcaaggtttcgctggcgttgatcctcaaacacagttttctcagtgcaacaataattttcaaagaaggtaa

SEQ ID NO: 602 - DNA, 396 bp, Glycine max
  Peptide Sequence Number=SeqID_117380
atgcctcagggaagcctcgaagtttttcttgttaacgccaaaggccttgaaaacactgattatctttgtaacatggacccttatgtgatcctcatatgtcgcactcaggagcaaaaaagcagtgttgcatcaggtcagggaagtgagccagaatggaacgaggcttttgtattcaacgtgtctgaaggcgtttccgatctgagattgaagatcatggacagtgattccaccacggctcatgatctcgttggagaagctaccattccactggatggattgtttatcgaaggaaatatcccaccaacttcatacaatgttgtcaaggatggccactattgtggggagattagaatcggcctcacttttactcctcaggcatgctatcatatatgttaa

SEQ ID NO: 603 - DNA, 996 bp, Glycine max
  Peptide Sequence Number=SeqID_117381
atggcgttgcaggagaggctagacaagttcaagaaacagcaagagaagtgccaaacgacactttcgaccattgcagctaccaaggccgccgcggcaacccaaaagtccgccacacatgcctcggcaaatggaagaaacgctgcccctgcggttaagttttccaacgacaccgagaggcttcagcatattaatagcattcgcaaggcccctgtgggtgctcagatgaagcgtgttattgatcttcttctagagacacgacaagcttttacaccggagcagataaatgaggcatgctatgtcgacatgaaggctaacaaagatgtctttgagaatctgaggaaaaacccaaaagtgaactatgatgggcaacgattatcttacaagtcaaagtatggtattaaggacaaaacagagcttcttcaactggtacgaaagtatcccgagggccttgctgttattgatctcaaggatgcttaccccactgtgatggaagatttgcagtcattacaaaatcttgctgttaaaggtgctgctagcttgaatgcggttcaatctttcctgctgttttctcacacattgggtttggacttttggggccgtgttagcataggcagaatttcaaatgttgtcagttgtgcaggagttcagtctgaagctatgaaagctgcagggcagatttggcttctgtccaacttcgattcacaggaagacattgcctaccctaacgaccccaaagtacacattaaggtggatgatgacctaaaacatcttttccgcagtattgaattgcctcgtgatatgattgatatagagaaggatcttcaaaagaatggaatgaagcccgctaccaacactgcacagaggaggagtgcagctcaaattcaaggcatttcttccaagccaaagcctaagaagaagaagagtgaaatcagcaagagaacgaagcttaccaatgctcatcttccagagctctttcagaatttaaacagttcctga

SEQ ID NO: 604 - DNA, 1319 bp, Glycine max
  Peptide Sequence Number=SeqID_117382
ctccatgcctagtcccaagagcagccgcagcggccagatcgagagtcaccggaggggaaggtcgtcgtccttccacggccagtgcgcgatccgccgaagatgctgctgaaggtgacggtgctgagaagcctcgcgcccgtgcaggtgctgatgacgccgggatccaccgtccgcgacctgatagcggcggcggtgcggcagtacgtgaaggaaggtcgccggccaatcttgccgtccagcgaagtttggataggaaggagaagctgctagagcttggatctaggaacttttttctatgtccgagaaagccagctacaacagtggaagatggcgtaacgacgtcgtttgcgtcttgtgcgaaagaggcagagaaagagagggagggatatggtggtggtggtgcatctgatacattgttttttgatttaggtgccgaggttaaggttggtgagtctgttaaggtagatccagccgaattcgaggcatgcatacacctttctcaggctgctcttggtgaggcaaagaaagacaaatcaaatgaaccagttgttctctacttgaaagttggtcaacagaaatttgtcttgggaaccctttccagggagaaaattcctcaaatacctctggaattggttttggaaaaggagtttgagctttcccacaactcaaagaatgccagtgttcatttctgtggatacaaggcattttatgatgctggcgatgaatatccttatagcgaagaggatgttccattgcttaaagcagagaatggaaaacctgaaacaaaagctgaagagttgaaggtacctgaatctaaaaaagctgttgccaaggctagtgcatcagcaaaacaagtcaagattgttgaaccgaaaaaagacaatgaagaggactctgatgatgattctgacgaagatgatgattttggaagttctgatgaagaggatgctgatagtgacagtgatgatgagagtgatgacaaagaagatgatgatgaagaaacccatcctaagaataagaaggcagatctaggaaagaagagacccaatgaatctgcatcaaaaactccagtttcctccaagaaagctaagaatgccactcctgaaaagactgatggtaagaaaggtggacatacagcaactcctcaccctgcgaagaaaggtggaaagactcccagcagtgaagccaaagccaagactcccaacaatgaagccaagactcccatgtctggtggactctcttgcaaaagctgcagcaagtctttcaactctgaaagtggtctgcaacaacataacaaggcaaagcatggtggtcagtga

SEQ ID NO: 605 - DNA, 225 bp, Glycine max
  Peptide Sequence Number=SeqID_117383
atgaacgacagagagcgcgggagttgggaattgggaattgggcaaaaccctaattacgtagctagccaagaagcaagtagcgatgatatgcagaaagaaagacaagagaagctaaccgcgaatggaagcaaccagcaaggactttgccgttactcagtgctgttagaacttacaatagagtctccacttattattgtgtcttgtgctccttctagttgtggataa

SEQ ID NO: 606 - DNA, 1645 bp, Glycine max
  Peptide Sequence Number=SeqID_117384
gggagaagcttgccacccagctcgcccaggcgagcaaggttacttcctccagaagcaacaggcttctggaggaaggatctggaaggcccaagttacgaatccttacggattacgtatttactcttttttagctttcgaagaagttacggaaactcacggattgcgcaagaacacctcttttcgacttccgccacattacggaatttcatggatcgcgcaagcctgcttccttttgatttctgagacgtctcgggacttcatttattgtgcaacaaaggacgccaagtatctcaaagcggctaaccaaaggttgcatgtcatcaaacttgggatctccgaattatttggtgcggataaccgtaaggtgtttatgcatgcccccgaactcttgggtcgctggatagcaaaaggaaaggatgcatatgaccacattggtctctgcgtgtcatcggactttgggtttccgaatgatgaaggtgcggataaccgtaagccggaagacgctgacagctctaggaaaagtgcagatgaccacattggtctctacctatcattggacttggggtgtccgaataacgagactaggggtcttcgaatgacgagtgtgaggataattgtagggtgtccctacatgccaccggactcttggggtgcagatgaccacattggcctctctgtgtcatcatacttggggtctccgaatgacgaggtgagacgaaaatattctcgaccggaacctatcgacatctccaaaaagcgtgcagatgaccacattcgtctatgcgtgtcatctgactctgggtctccgaatgatgaagattaccatattggtctctgcctgtcatcgaacttggggtctcctaatgacgaaagtatggataaccgtaaggtgtctcatcatgccaccggactctcgagtcacaggatagcaaaaaactttgggtctccgaatgatgaaggttcggataaccgtatggtgtctccgtataccaccggactcttggattaccatattggtctctgcctgtcatcgaacttggggtctcctaatgacgaaagtgtggataaccgtaaggtgtctcatcatgccaccggactctcgagtcactggatggcaaaagacgctgacatattcaagaagggtgcagatgaccacattggtctctgtgtgtcatcggacttggggtctctaaatgacgataaggtgtctcatcatgccactggactctcgggacgttggattgcaaaaggtgcggataaccgtaaggtactctacctgccattggactcttgggtcgctggacagcaagaagatgaccacattggtctctacgtgtcattagactcggggtctccgaatgacgaggtgctaataaccgtaagaaagggtgcagattaccacattggtctctgcgtgtcatcgaacttggggtctccgaatgaggagcacatttgcagcttaacagtgaatggatcttctttcttgggagatcccactgctccttcttccaagggcaaggatggaaattcttatcctgggtcaaggtttatggcagatgagttgagattagggctcaaaaggcttgtagaaaggccggacatgatgtatgtcatggtgttggtttggccagcggttcagggataa

SEQ ID NO: 607 - DNA, 702 bp, Glycine max
  Peptide Sequence Number=SeqID_117385
atggtaatctgcacccgttccaaagatgacaacattttccggtcgagactatttcggtctcacctttttgctatccagcgacccaagagtccggtggtatacggagacaccatacggttatccgaaccttcatcattcggagacccaaagtctgatgacacgcagagaccaatgtggtcatctgcacactttctggagatgtctacagcttccggtcgagaatattttcgtctcactttttgctatcctgtgactcgagagtccggtggcatgatgagacaccttacgcgacccaagagtccggtggcatacggagacaccataaggttatccgaaccttcatcattcggagacccagagtcagatgacacgcatagacgaatgtggtcatctgcacgctttttggagatgtcgataggttccggtcgagaatattttcgtctcaccttttgctatccagcgacccaagagtccagtggcatgctgagatgcctttcagttattcgtacctcgtcattcggagaccccaagtatgatgacacagagaggccaatgtggtcatctgcacccttcttcaagatgtcagcatctttcggccgagactatttagtctcaccttttgctatccagcgacccaagagtccggtggcatgtagggacaccctacaattatcctcacactcgtcattcgaagacccctag

SEQ ID NO: 608 - DNA, 1128 bp, Glycine max
  Peptide Sequence Number=SeqID_117386
atgggtgagacagaggaggtgcaagagcgaatgaaggctgacacggaggccatgaaagagcaaatggccacaatgatggaggccatgatgagcataaaaaagataatggaagtcaatgtggctgcagtcaccgctaccatcgctgttgctggggtggacccgactcccccatctggcctcaaacaaataaatcatccaacctcagatgtgggcggcccccattttgtgcaaattcacaacaagcacgccttcccgccatatgatttgccttccaactatacaccacccaatttggcgcatactcccattgagaatgtcaataactccactcctatacccattgagagccaacaacctcaatctgatcatgcacatgtctctcaacccatgggggagacacatgaagtaccccaccacaatctagttgacattgagccttgcctcggatataccattgaggggcaagcagttggtggcgtacccctgccaaacactctggagggccctcaaattagcccacaaccacaacccttgcattttgcggtgggaagagtgcctcctgccatggtgaaaacggagaaattggatcacctagaggaaaggctcagggccgttgaaggaggtggagattatgcctctgctaacctagaagagttgttcctagtacccaactttgtcatccctcccaagttcaaggtgccatactttgacaagtacaaggggactacttgtcccaagaaccatctaaagatgtattgtcggaagatgggggcatatgcaaaagatgagaaattgctgatgcatttcttccaagaaagtcttactaaggcagctgtcacctggtatactttggaaccttcccgagtccattcttggaaggacctagaggttgccttcgttaggcagtatcagtacaattctgatatggctccaaataggatacagctacagaacatgggtaaaaaggggcatgaatccttcaaaaaatatgcccaaagatggagtgatctgcctgcccaagtggcacccccaatgatggaaaggaagatgataacaatgatagtagacacattaccagtgttctactatgaaaagatggtgggctacacaccttcaagtttttgctga

SEQ ID NO: 609 - DNA, 399 bp, Glycine max
  Peptide Sequence Number=SeqID_117387
atggatgcctcagagccctacactggggcaatgaaaggaaccatgcataagcctcaagcgaacctaggggcagatcaaaagttctcacccagtaggttccctactacaaggaccaaagaagatttgcttcgagattcggtcggtaccacaccaagtccaaagagaaaggcccgtgatcgacagatcatcgtaatgcgtccggatcaagacattaaagaagcgctactaggaggtagcctagaaatgggtccaaagaagctccccgcaaagaagcccaagaagatgaagacatggctgatctgttcaacttccttggaggaggcagagccatatggctggaatcgccaaacttgtgatttgacattatcttcttccaattattatatccattgtgtttga

SEQ ID NO: 610 - DNA, 526 bp, Glycine max
  Peptide Sequence Number=SeqID_117388
ggatcgcacccacatgacacccagtggacctgaagaagtccaacagggccctggggtttccagctctggttacgggcccctgtcagtcctacagggtgcccgccccccagcaaggtcatgccatcgtgacataggtaaggatcgcgcccacaagacacctagtggacccgaagaagtccaacagggtcctagggtttccagctctgattacgggcctctgtcagctctacggagtgcccgtcgcccccagcaagggatcgtgcccgtaagacacctagtggacccgaagaagtccaacagggtcttggagttgccagctctaattacgggcctctgtcagttctgcggagtgtctgtcacccccagcaaggtcatcaggccccctactaatcgagctttcatcaagaagtactgcgcccctagacaggcgcagggcgaaacaccacaacagcctggggatggccagcagcgggcagcagatgcaccgccaccacctctagagttcacctcagctcatccacaataa

SEQ ID NO: 611 - DNA, 336 bp, Glycine max
  Peptide Sequence Number=SeqID_117389
ttcttccggaagtgcgcgtcttccggaattcttccggatgaaccacttcttccggaaagttcccggaagaggttttccgggagtcttccggaagaagtgttcttccggaagacgtttggttacttctggaagaacacttcttccggaaactttccggaaaaggttcttccgaaactttcggaagaacccctaacggtgcataacaaaaccaaagctaagaagaaggccacctacctcgaaagcaaatgggtccaagggctgtcggagaagctcgcggagaagaagcttgtcggggaagagagaagagaagaagcttttgcggaagagactcagtga

SEQ ID NO: 612 - DNA, 613 bp, Glycine max
  Peptide Sequence Number=SeqID_117390
atggcggtttcacaatttcagccacaacctcaaggttttgaatcagttggtcagctaattatttcaactagtgtcagcatctactcatcttcccccatcagatgtatcagcacctcacttcttgacatgtatgaaggtgaatggtttcaaaacgatgtggagggtcatggtgtagttgaagtcgatatacctgttatagaacctgctcctgggtccaagcttgaagcaaagatgcgagctcaaggaaagataatagcaagggattttctgtccccagaagacagagaatggcttgagaaggatattgaagatatgtattatcttgcagatgggaactatgaaatccccttttatgagaatgaggaatgggttaggcaatttggaagaaagccggagaaaggtcgctatcgttatgctggccagtggaagcatgggaggatgcatggatgtggtgtatatgaagttaatgagcgtatcttatatggtagattttattttggagaatatgtagatgacatttcgggatgcgatgaagacatttcagcgatgcatgctggtatagcagaagttgctgctgcaaaggctcgcatgtttgttaacaagccagatggaa

SEQ ID NO: 613 - DNA, 639 bp, Glycine max
  Peptide Sequence Number=SeqID_117391
atggcgaacgaccaagaccagcaagactctccccaacaaaatgcccctttctccgattccgactccgactccgactccgactacgactccgactactcctacgacgaggcggaggacgaggccttccgccgcgcctttggccaacgcgacgatggtgacgactcgtcatcgccggagaacccgaagcgcgaagacccggaggcgaactttcgcgccttctcggaggcgctggagagtcccgcgatgaaggagctgcacgaggagctcgaccctttgattgcggagaagaaaaacccttacgacttccccagagaccccgaggaatggaccgagcaggacctcagggagttttgggccgatgggccctacgaaatcggcggcacgggctgggaccccgtttgggccactgacgacgagtggcgctatgtgaaggagcagattgcggacggagaagagcctcccattgcgccgttttatcttccttaccggaagcattaccctcccattcctgataaccattacgacattgccacccccaaggatgctattgaggagttggataggattgaggagtttctcaaatgggttagctacattttcgaagatggaagcacgtatgaaagggactgtttgggatga

SEQ ID NO: 614 - DNA, 474 bp, Glycine max
  Peptide Sequence Number=SeqID_117392
atggcatcaaaagctgcaaattataataaactcccctcacctatcgtgaggtccccagaaagacttagaagtcaggattacctcggagaagctacaaaagagaggattgagggatttttctccacgaaatccttgaggtggattctgaggattctgattcaattaaaatgttcctcttggtgtggtggttcagcggcaagcagcagtgactcgtggtggccactggtggtcgtgggtggtggagaagaaggtgttagggtttggatctcgctttgcgagctcgtctcgctaagcaggagcggaattctcactaagcacgacaattctcgctctatgaaattccctctcgggttggaatttgcgctgagtgcaacaattctcgttgagcataattcctcttgcgctaagcacaacaattctcactcaatgcaattacctcttgggttggaattgcgcttagcatgcttctcgtga

SEQ ID NO: 615 - DNA, 945 bp, Glycine max
  Peptide Sequence Number=SeqID_117393
atggagaaggggcataaagaacatattatggtgaaagcacagtcacaaaagaaagaagaagcttgtcatgttagtacaacgttggctgccactgatttgcaccgtccatcattgcaacctccaaagccaaaattccttagcctcagtcttccaaattcagccaattcatcaccttcaactctgatggagaagaaaccgaaacacaggagcatagaatcaccatgtcaagctagtacactcatccatcaacaacaacaaactcttataccattggatgaggtcggctacatggatcagatgcaggatgaccaactgcaagacatgcagttaaggaggagcaagtcatgtggtgagggaagagcatcatgtgcaccctcagatgaatttgatctctggtgggccaaaccaggtgcagtggaacgcaataacatgcatcgtaacagcttctccaaaactgaagccattcttgtgagtggcaagaatgtggaaacatgtgaagatgagggctttaagtgcactgcactttgcatgtatctaccagggtttgggaaagcaaaggctgttaaaactagaaaagaattaggatcagaagtggaaggctgtgcagtaatatcaaggacggtatctttggaaaagtttgagtgtggttcttgggcttcttctgcactgttccatgagattaatattgaaggagaccccataaattcctcatactttgatctgccactggagttgatcaaatgcagtgctaatgatgttcattcacctgttacctcagcttttgtgtttgagaaggaccttaagactggtttctctacaaaatcacctcgccatgttcggttttccacaccatcaaagcctgcctctccagcatcctgcattactcctcgtttaagaaaagccagagaggatttcacagcattcttagaagcacaaagtgcatga

SEQ ID NO: 616 - DNA, 138 bp, Glycine max
  Peptide Sequence Number=SeqID_117394
atggagaagagggtgtggagggtagccgtagcaggagctcatcgaatttttgggccatggattgaacagtttcaccaagtgagacctgtaaggtgcaaagattacaaaaatatggaatttgttatggctgtcccctga

SEQ ID NO: 617 - DNA, 678 bp, Glycine max
  Peptide Sequence Number=SeqID_117395
gtgatgcttaactccaaggccaaattcaaagtgtggaatttcaatggagctaagaatttcgaattatggcagaggtgtgttaaggatttgttagcacataaaggttttctaaaggcattgtgcgatgcaaagcctaataagatggatgatttgggttgggaggagttgcaagagagggttgcgacaattatatgcttgtgtttggaagacgaggtcctttatcacgtgatggagttgacatctccaggggagatacaagagggtttggatctccaacaacatgtaaatgtcttcaataaaattatcatctatctggaaaggctggaggtgaagattgaggatgagataagacatgggaaacaagaacatggaaggacacaaggcaagggttctgatggtagccagaggaagagtccaaaatctagtgaagggcatcctgctcagcaagtgtggcagatactgatgattcagactactagagtgaggcagattttctctcaggtgcaaattgctatggatgatgatggagctaatggttttagttacagaactgatggagatcaagatacccttggagttgagttgcatttgttgaatctaatgatgatgctacaagattgtgacatctacgtttgggtcatctcagtgagcatgggatggtggagcttcataagatag

SEQ ID NO: 618 - DNA, 729 bp, Glycine max
  Peptide Sequence Number=SeqID_117396
atgggtttagaaaaggtggaccgagttgaggaagtctttgtatggattgaagtagtctccatggtagtgggtgatccttcaattgtgggacttgtgaatactgactatgctagtgatcatgataacaaaaggtctacaacagggtacatctttactcttgtagcagaatacatggcgacagcagaggctagcaaggaatttgtgtggttagtagtgttagtgaaagagttaggcattgcaattgacaagttccatagatttgacaaagaattagcatataagggccacctgttgctgggttatgaagcgggttggggtgcaaggaccggatatgacacatgttgtaagccaaatctacaagtttatgttggactcaaggaagtgacatttggcaacagtgaagtggatcttgagtccattattcagtctcttgaagcaatgtcaacaactgaagtaaagtacataacggtagcaatggctagcaaggaaactgtgtggttagaaaggactcagttgtatcattcgagaaccaatcatattgatgtgatgtttcacaagatcagggagttaatcacatctagccaggttttgctatggaaggttcacactacagaaaatgcagttaatatcttgacaatgatagtcaaaactaacaagtgcaaactttgcttggacttgttgaatgttgctcatgctagatgtgacaggacccttaacccaggagactga

SEQ ID NO: 619 - DNA, 1695 bp, Glycine max
  Peptide Sequence Number=SeqID_117397
atggcaatggccaacaaggagagggagaagaagttcttctttgtagggtcactagtaaactacgcagctgaactaaagcttcttctcgcaactctcttccttctttgtggtgttgccactctccttcaattcctcccttcgcgtttcaccatttcctcctccgatctccgcttctgcatctcaagggtgtccctaacacccccaccaccctctacacccccaccaccctttacatcactttctacacccccaacaccactctcttccacccaaaaacaccttcccaatggcaccatcaagcgtgtcttcaaccctcacggctccgcggcctacaacttcatcaccatgggagcatacagaggaggactcaacaccttcgccatcgttggcctttcttccaagccactccacgtttatggcaaacccacctacgtgtgtgaatggatccctgatctcccttcactgcaaaactcttcaaaacccatcatcacaaaaggcctcaagtacctccctgactggggctatggccacgtctacaccgtggtggtagttaactgcaccttcaacggcaccgctgtcaatggtgacaacaccggtggcaagttggtgctccatgcttccacctcaggagccggtgacactggcttcaacgtcaccgacagaatagaggtcctccatgaagcaccgggagctttaaacgcttcacttttcatgtcaaagcctaagtatgactacttctactgtggctcttctctctatgggaacttaaaccctcagagggtgagggagtggatcgcttaccacgtgaggttcttcgggccaaagtcgcatttcgtgattcatgatgctggtggggtgcatgaggaggtgcttgaggtgctgaagccgtggatggaactagggtttgtgacattgcaggatattagggaccaagagaggtttgatggatactatcataaccagttcatggtggtcaatgattgtcttcatagatacaagttcatggccaagtggatgttctttttcgatgttgatgagtacatttatgtgcctcctaagactactatcaagtccgtgcttcactcactttcggaatacgaccagttcaccattgaacagatgcctatgagcagcaagatttgcctctctgaggattacggcaaaacttacaggatcttgagtggttggacactttttatttcttatgaggagagggatgacaggaaattgcattattgcgggtgcatgcatttggaattattagcccatccctttagcattcattctgtttttcctagtgatcctggacagttggtcttacagcacttgggaataatgctctacaaagggaaatggggttttgaaaagcttgtgtatagagactcaattacaggaattcgtagagatcgaaaatatgcagtgcaaccacggagtttgtatgcaacaggggtgcacatgtcaatggatctatcaggaaagacaacacacaaaactgaaggtaggatcaaatacttccactatcatggaaccatatcagaaaggagagaaacatgtaaaatactcgtcaacacaacacaagtcacccagaacaaaattccttatgtgatggacaccacaatgagggacactgctggggtaatcaagaaatttgagctcaagatgattggaacaaggttgcagaagacaaggcaataa

SEQ ID NO: 620 - DNA, 321 bp, Glycine max
  Peptide Sequence Number=SeqID_117398
atgcatactaaaagtcctcgagatagtgatcatatggattcagttgattgggaagcagtgcacaagtcagtgaagttgctaaagccatcgaatctcgtggacaacacaacattattgcaggaaggatacagttatatgcttccagataaacatcccctattagcagagtgcattccaagagaactagatgatccttccccttaccttctggttgaatggacaacaggtttgtcaatgatgcgaattcgtgattgcttttggagtggtttcatttgtgtgagagcaatggatgcaaagacaaaagcttccaggcctatataa

SEQ ID NO: 621 - DNA, 3396 bp, Glycine max
  Peptide Sequence Number=SeqID_117399
atggccactaatggccaactcacctcctggcctgctttcatccaagcccttcagacccgtttcgctccttctcactatgatgaccccactggtaacctcttcaagctcacccagcgtggctcagaattggctaaccgcatcgtggggcttcctcctcagtttctcctcagttgcttcatttcgggccttactcccgaaattcgtcgcgaggtgcaatcgttgcagcccctgactttggtgcaggccgcgggtcttgctcgtctccaggaggagaatctcctcgacacgcgctccacctttcgcaaccgcactccgccggtgctttccatccctcaacctcggccgattccaatgcctgccctcctccaagatccttcttctcctgctccgtcatcacggccccctccgtcggtgaagcgtctgtcgccggctgagatagcttctcgccgtgaacgcgggttgtgttttacctgcgaggagaagtaccatagaggtcaccgatgtgcctctagggttttcctcctggtagctgctgaggatgacaaccctgacccttatatagaggacttggacccgggacccgacccacccgacagcccaaacccgactgcagcccaaattagttttaattcacttgcaagtaacttggcacccgaaactctacgtttgttgggcctggcctccggccaccacgtcgttgtcctcgtcgatgggggcagcacccataacttcattcaggaagatttggatactactccattacgggtcttagttggtaatggacaacacttagcttgctctcggtggtgcccgcgtgtcactcttaccattgtggacttcacctgtgacgtggacctttatgtattaccaattgtaggtgccaacattgttctcggtgtacaatggttaaagaccttgggacctgtgctcactgattactccctaatgactatgaaattcttttatgaccaacgcttaattgagcttcgcgacgacaatgatctcaccatcaacatgctaacaccacctcagctccgtcaattcttgaaacacaatgagcatgcctcatgctaccacattgcgggcctgattcgacctagcaccagtcccttctcatctccggtgctccttgttcgcaagcatgatgacttgtggaggttttgcatggactaccgggccctcaacgccattaccattcgcaataggttccccattcccataattgatgaattgttggatgaattgggccaagcttgttggtttttgaaacttgatctgctgcagggttatcaccaaatccacatgcattcttcggacattgctaaaacgacctttcgcacgcatcacggtcactatgaattcaaggttatgcccttcgggctatgcaatgctccctccacttttcaggcgacgatgaacatgcttttccggccattccttcgccggtttctcattatcttctttgatgacattttaatctatagcatcacctttaatgatcatgttcttcatttacaacaagcttttcagcgaggagtggaacccgtctcttccaaggtggatgttgtgcgacaatggcccacaccgcattccgccaaagccctctgtagcttcttgggtctcgccggattctacagaaggtttattaaagggtatgccaccattgcgacccctttagttgtggcaaccattactgatccttttcagtggactaccccagcacaattggcattcgaacaattgaaacaagctctgtcggaagctcccgtgctcactctccctgattttcagctgccatttacggtcgagactgatgcatccggcatcgggattcacgacgacgaccaagaagtggcgccagtatcttcttggccaccgcttcacgatcatcacggaccaccgcagcttgaaggatttcgttccggcaccactaatcaagccgcggatgcgttgtcacgtcttcccgatgaggagtcgtccctctcccacatcttgtctgccattcaaaccactcccgccaaatttcctgacttcaacatttcaaacaatctcattctacgcaaaggtcgcatatggcttccccctctcctacctctgattactaccctcctcactgagtaccatgccaccccaaccggcggacatcttggaatagctaagaccatagctcgattaatggaaaatttttactgggatgggttgcgagaagatgtagcaaagtttgtttctaattgcttggactgtcagcattctaaatatgaaactaaacgcgtcgtcggtctcctgtgtcctctgccgattccacaccgtccatggaaggacctctccttggacttcatcactggtttacctgcctttcaggggaataccaccatccttgtggtcgtggataggttctctaaaggcattcatttgggaatgcttcccacttcacacactgcttacacagttgcagctttattcatgaacattgtcgacaaaattcacggtctccctcgtagcatgatttctgatcgtgatcccctattccttagtcggttttggcaagaattatttcatctcagtggcacccacttacgaatgagttcttcataccatcctcaaagcgatggtcagacagaagctttgaaccgtgccattgaacagtaccttagggcttttgttcaccggagaccaagttcatggggtaagctattgatgtgggtggaatggtcccacaatacttcatggaatgcagctactggatccaccccgtacgaaatcacatttggtagaaagccctttaattaccctgaataccttgccagggattctaagctcgaagctgttgatgatatgctcacaaaccgtgaagacactttccgcctgatccgaaagaagctcctcaaagctcaggaattgatgaagaagtgcgcggatggtaaacgcagagacgtggagtatcaggccccatcgtcaaacctcggcaagcctcaatcctccatttccaggaaactttcgaaacgcttttatggaccattcgagatcactgagcgcattggcccggtggcctatcgtttaaagcttcccgagggtgcacgtattcaccctgtgtttcactgttccatcttgaaaccattcaaagggccgccgacaccagcaaattctgtttccctccctgcccaatttgctcacgaccagcccatcatttctccattagccattctggactaccgtcgtaactccgacattccagggtcaccgtgggaagtattggtgcagtggtcgggcctggctcctgatgagatgtcctgggaatcctggtcgcagctgagtcgtgactatcaccttgaggacaagcaagtaacagaggtgcaacaagcaattgaaggacatggtgcaaacatcaacaaagag

SEQ ID NO: 622 - DNA, 294 bp, Glycine max
  Peptide Sequence Number=SeqID_117400
atggtgcctttggaggttgcaccttgtggggagacattctcgaaatgctttccacaagaaatcgataacttttggtgggattttcaggtggctcaagctcaagctctcttccctaaagccatggatctcctcaatatcactagcttggaaagaatgattgagtatttcactgaagctttacatagcgagatcggcctaagctccttcatcggcgatggattatcgcacttcagaatgagagtgatgtttgttcagttaaagccttgtttacctcatctgaaatacacggtttga

SEQ ID NO: 623 - DNA, 786 bp, Glycine max
  Peptide Sequence Number=SeqID_117401
atgcatagtgtttgtatatgtgtcaaatttcaagctaatcccaaggaaactcatttagtgcttgttaagaggattcttaagtacattaaagatacattaaaagtgggattttggtatcctaaaggtgcatctattagcttagttaggtattccaattcaaattatgcaaggtgtaaagttgataggaagagtactagtcgtacatgtcatcttcttagtagtgctttggttttttggcactctaaaaagcaagtttgcatggctctatccacatctgaggctgagtatcttgttgttggtagttgttgtgctaagatcccttggatgaaacaacaaatagaagattttgtttatcgcttgaagtcaatttcgaaaccagaaaggttagcatataaagtcctactagacacatttagcaattgcctactttatctttactgtttgatagagttgaacttattgagggaagctttggttggtttacctggtgttagtggtctttccaccgaacaacgcaagagactaactataacaattgaggtagtgggtagtccctccataatattcatggatgagccaacatctgggttaaatgccagaactgctacaatagttatgaggacagttagaagcatagtggacacaggaagaacaattgtttgtaccatccatcaaccaagcatagatgtatttgaagcttttgatgaggtaagtgctgttgttgatcatatgatactgcattttctgacttttcttattggacttgccaattgccatactacttga

SEQ ID NO: 624 - DNA, 380 bp, Glycine max
  Peptide Sequence Number=SeqID_117402
ttaaactatttcctgaacacaatcttttcactacacatggtggtagcttttcttgtggccgttatcttggacattactgtgcctggcagcaagcaggaacgtggagacaacgtttggcagaacctgaggttgctagaagggagcctgctgttgctaatgactatgagttgcccttgagagttggtgttagtgcaagatggtcccatttcccgcgaagtaacagcatggtagagttagcaaaggagaacccacttctacaacagttttttctgaaagcagttattacaattaatgtgaggctcaactcagtggaagagaaagcttcaagtgatataataaaaccaattatccggggtttcaaaggcatgacaactaactga

SEQ ID NO: 625 - DNA, 165 bp, Glycine max
  Peptide Sequence Number=SeqID_117403
atgggtgccaagcacctcacgaggaccaaagaatggtcgcacgtcatcgagcaaaggcccccggacgaaattagggcaccacatacaccagttagccctttgtccattaagcatgaacgcaagttaggctcagaggcaattaatcgaacacgaagcgtgcactaa

SEQ ID NO: 626 - DNA, 315 bp, Glycine max
  Peptide Sequence Number=SeqID_117404
atggtggaaagggagaaatttgatcatataaaggagaggttgagggctattgaaggaggcggagattatgcgtttgctaacataacaaaactgggcctagtgcccgatgttgttatccctccgaagtttagggtgtcagatttcaataaatacaaggggactacttgccccaagaatcacctgaagatgtacaacagcaaaatgggggcatactcaaaaaacgaaagattgttgatgcatttcttccaggaaagtgttactggggcagccgtcacctggtatactaatctggaaccttcccgagtccattcttag

SEQ ID NO: 627 - DNA, 282 bp, Glycine max
  Peptide Sequence Number=SeqID_117405
atggttgtgagcaataccaagggccccgcaaagtgtttgccaagggtacaccacaaaacgcctacccctcagtggcatatccgagattgggaatgttggctctcaatgggtatgggagcagagttgtacgttcttgtcgcaacctacccttcggtgggagggcgacgcgtgactcgcgggtgcgtgttccgagaaaggaatacgtgcggagtcgccaccaacgtttatttgaggaaaacgtcggaaaaatcgaaaaagacatggtctacgaacttcaagtga

SEQ ID NO: 628 - DNA, 564 bp, Glycine max
  Peptide Sequence Number=SeqID_117406
atgcggagacaccttacggttatctgcacctcgtcattcagagacccaagttcgattgacaaacagaggccaatgtggtcatctgcaccctttccggagatgtcagcatcttccggatacgtaggagcaaaagcgtcgcttttgtcgaccgccccaccttttgctatcgtgacctgtgagtccgatgacatgcggagatacccaagcggttatccgtacaaatggtttctgttaatcctgacccgtgaagtcaggcggagatacccaagtggttatccgtataaacactctttcgctatccgtcagactcaaagtccgatacccaagcggttattcgtacaaacgatttctgttaaccctgacccgagaagtcaggtggcaggcgggggtaccatatggttatctgcacctttcatcaaccaggggcaaacgagcccgttgacgcgcagagacaaacgtcgtcttctgcaccttttgtcatccagggacagcgagtcaggtggcaggcgaagataccttatggttgtctgcacctttcgtcaaccaaggcaaaagagtttgacg

SEQ ID NO: 629 - DNA, 276 bp, Glycine max
  Peptide Sequence Number=SeqID_117407
atgtggccccacatgccaccggtctcttgggacacggtaacaaaaagtggggtggtcgacaaaagcagggcttttgctcctacgtatcctcaatttgtgatgaggaactcagacctacgtagttcttcctactgtgagactaaaaatagtctcggtgctttcttcactaaaatgcgaacatgctttagtaaagagacaaaacttctaactgatcagagcaacatatgctttttggatgaaaaacaatgtgtctatcggggaaggagagtatgctga

SEQ ID NO: 630 - DNA, 135 bp, Glycine max
  Peptide Sequence Number=SeqID_117408
atggttatgccatttggtttgactaatgcacctggtaccttgatgagctcaaatagaataagtgcagatgaagaaaaggtaaaggcaatcagggaatggcctgtacctaagaatgctaatgaggggctgtactga

SEQ ID NO: 631 - DNA, 2019 bp, Glycine max
  Peptide Sequence Number=SeqID_117409
atgtccgattccgttcccaaaacgcgaaaccgtccggggccgtggccgccggcgccggacgccaaggcaatgccgcctgcttcctgggctaagaaaacaggcttcaagcccaagttctccggcgaggccaatgccagcgactctggccagataagcctgcagcccaagcctagggagcccgacgctaacgtggatctcgaagcgggccggcctggggctccggcgaacggcgtgacccaccaaaataaggctccgccgcttccaccttccaaggatcaggtcgtaaagaagcgaaaggactccgacggactgcccaagagctctgttcccatcaccaatggccaggcggtgacggctccgcctccgccgccgccgccgcctccacggaggacggcgaggcatgaggaagtcgtggacgcgccgccgcaggaagacgacggtttcgtgtcgaggcattcgcatatgaagtatgagctcagagattcgcccggtttagttcccattggtgtgtacggtattcaacattacttttcgatattgggttcgttgattctcattccgctcgttatagttccggcgatgggaggctctcatgaggatacttctgcggtggcatcaactgtgctctttgtttcgggagtgactacactgttgcatacaagttttgggtcgaggttgcccttgatacaagggccttcttttgtttatctggccccggtgttggcgatcatcaactcccccgagtttcaaggattaaatgcaaatttatttgtgagatgtcatgggcttttgtattatgtatattgtgaggtttttgatgggaaattcaaacatataatgaaggagctgcagggggctataattattggatcggcttttcaaacttttattggatattctggacttatgtcactgttagtaagtatggtgatattcacctctgaatacccccgagtcccagatgtatccactttatggttgatcaatcctgtggttgtatccccaactattgctgcagtaggactttcattttacagctatggttttccactagttggtacatgtctggagattggtgccgtgcagatattagtggttattgttttttctctttatcttcgtaaaatatctgttcttggacaccgcatatttctaatatatgcagttcctttgggtctggcaattacgtgggctgttgctttcttgttgactgaagctggagtctacaactacaaaggatgtgacataaatatacctgcctcgaatatggtttcggagcactgcagaaagcatgtctcaaggatgaagcattgtcgagttgatacttctaatgcattgaaatcatccccgtggtttagatttccttatccattacaatggggtactcctatctttcactggaaaatggctcttgtgatgtgcgtggtttccttgatctcatctgtagattcggttggttcgtatcatgcttcttcattattggtagcatccagacctccaactcctggagttcttagtcgaggaattggtttggaaggtctttctagtgtcttggctggtctctggggaactggaacaggttctactaccttaactgaaaatgttcatacaattgctgtcactaaaatgggaagccgcagagcagttcaattgggtgcatgctttctgattgtgttgtctctcgtgggttttagaaggatattttggtggggtaaggttggagggttcattgcttcaattcctgaagtcatggttgctggtctcctatgctttatgtgggctatgcttgcagcattgggcttgtccaatctacgttatagtgaggctggaagctctcgcaacatcatcataattgggttatcattgtttttctctctttccatacctgcctactttcaacaatatggcatctctccaaattccaacttgtcagttccaagttatttccaaccctacattgtggcttctcatgggccattccacagcaaatatggaggggtataccttttactattgtga

SEQ ID NO: 632 - DNA, 810 bp, Glycine max
  Peptide Sequence Number=SeqID_117410
atgaattttgagatcgaatccccgttttcatttccaattcaatcttcctctcccatttcccaatcatcaccatgcacagctcctaataataaccctaacctaatttcacaactaccgtcgctttcacaactagtatcacacaaaaggaaaggtggaagaaaaaagttcaaggaaactcggcacccaatttataggggtgtccgacaaaggaagggaaagtgggtttgtgaacttagggaaccaaagaaaactacaaggatttggttagggacataccctacacctgaaatggcagctagagcacatgatgtgggtgccctagccattaggggcacctcagcaattctaaactttccaaactcagtttcccttcttccaatcgctaactcattatcttcacgtaaagatattcgagcagctgcagtagaagccgctgagagtctcagaccaatctccaattctcatcacaagaaaattagccgcaaaagtaagtctacgagagctaagaaggttccatcattagaggaaacaacaaaggaaacggtgttggactcgtccttgcacttgaagagcatgcatagtttgctggatcgtgaaaaatgtgatgtgatcaacagtactagtggcacagagaaaaacaatttggatttgtcttcaaccatgttcttcgatgaggaggcgttgtttaacacgccgggtctcttggatagaatggctgagagtttggatattttcccactactaccatcaatggattattattgggatgatcatgcttactgcacagacttcaatttatggacggattaa

SEQ ID NO: 633 - DNA, 564 bp, Glycine max
  Peptide Sequence Number=SeqID_117411
atggatggctcacttatcatagtagtgcctcctttaccatttgaccatatttatccatctcaatcacttcccactttttatgaagcattggctacaccttcctttattctctcctctcaaacctttcacttcaagcttcaagttttcaagctacccacccactgctcatactcacacccaatgaagatccagtgcgacgtgtgcaacaaacacgaggcctccgtcttctgcacagccgacgaagccgccctctgcgacggctgcgaccaccgtgtccaccatgccaacaaactcgcctccaaacaccaacgcttctctcttctccgcccttctcataaacaacaccctctctgcgatatttgccaggagagaagagccttcacgttctgtcagcaagacagagcgattctctgcaaagagtgtgacgtgtcaattcactctgccaacgaacacacccttaagcacgataggttccttctcactggtgttaaactcgcagcttctgccatgcttcgttcatcacaaactacctctgattcaaactcaaccccttctcttcttaac

SEQ ID NO: 634 - DNA, 372 bp, Glycine max
  Peptide Sequence Number=SeqID_117412
atgagcaaaaaggaaacaacaacagtccatacgattcttatcggcaaccaaggtgcccacatcgacaaccaaggtggccctcgctttcggcaaagaatccttattctttatcgatccaatcaaatgcacccaaaatatatacatcttgactttaagaaaattaatcccggcatgtggacacagtctgacatgtatgtgctatgctcgtacgcatctggacaatatatatggtggatggggaagtggtgttacaaatccatgaaccagtttagcaacattcctattcccagagcaatgaaggagccacaggataaaatcggcttcgtgatgtttgaagggtcgttgaataagtttttctataaacatttttaa

SEQ ID NO: 635 - DNA, 302 bp, Glycine max
  Peptide Sequence Number=SeqID_117413
ccgatgaaactccaattctaatagaagaacaacacggaacaacatcaaaaaatgatgaagtgttgccacggttggatgctgacgtggaggggcatatgggttcgttttcaaccgagaacatggggatctgggttcctcaagcgccaccacctcttgtgtgttcttcacaaatggatcgggtgatagttcaaagtgagaccaacatcaaaggtagcagcatatcgaggttgaaggatgatactttcactgttccacagattagtcctccctccaattccaagagagccagatttctatggtag

SEQ ID NO: 636 - DNA, 798 bp, Glycine max
  Peptide Sequence Number=SeqID_117414
ggtggtagcaattcacccttagctgctgctgcagccatagcaaaaattggagctgaggctactgctgtcattagccaggtccaggctagtgtaataaatgcattgaaaaaggcatttcctgttggttctgaagatcaaattgtgaaacatcaagtaaatggtgtgaacgaggattttggcttttctgaaagtgagaatcctctgatattgtcagatcaggattctccagtcaatgctgagatcatgtgtgctggtgttgtaattggactggtaactttggttggtttaaagtttttacctactaggaatggctcacccattcttcgtaaaatgactggttccgcaatggtgtcagatactatcaacttaggttccttgggagatgaagaaaaagtagagcagctaccaaaaatggatgcaagggttgccgaggctctagttcgcaagtggcaaagtgtaaaatccgaagcttttggacctgaccattgcttgggaaggttgcatgaggttttggacggtgagatgttgaagatatggacagatcgtgcagctgagattgcagagcgtggttggtcctatgactacaccttggaggacctcaacatcgatagtgtgaccatatcacagaatgggcgccgtgcagtggtggaaacaactctgaaagagtctactcacctgaatgccgtaggtcatccgcaacacgatgcttctaatagcagaacctacacaacaagatatgagatgtcttttacaggcgcagagtggaaaattgttgaaggagctgtccttgagtcctaa

SEQ ID NO: 637 - DNA, 333 bp, Glycine max
  Peptide Sequence Number=SeqID_117415
atggccaaaattgcttacaagtggctcactagagctcgttctacccatggtgctactgcggttaatggaacttgggtgtggtctctccaattactagaaaatattaaacactacctttggctcttagaccataagagtatcctgactaacctcttccgacttcgtcggcatatttgttttgattgctcttgttgcaggtgtggtgatccagaggaatctattcttcgtttactactgattgcttcaggttcttctaagtggtttcatgatcttattggggactgggtccttgaagcttactggtcgagatttttaattgtaccccgaaattga

SEQ ID NO: 638 - DNA, 570 bp, Glycine max
  Peptide Sequence Number=SeqID_117416
atggtggccttgagaaattttcggcttctatgcttcatccttgtggtgacaattgttgagcttaaagctgaagagctgaaaaatgtcacaaatcatagtcaaggaaatgccactttagcaagtctctcacatcaaggtgaaaagcatgaattaaaaggaaaacacaatgttttcaagaatgaagttttgttcaacacaagcaaagatagttggtattatagaggaggtggaggtggtgggggaggaggaggagggtttagatggggtggtggaggaggaggaggtggtggcggtggcgccggaggaggaggaagtggatggggatggggaggtggaggtggtggatggtggaaatgggggtgtagaagggaagcaagacatggtaaagggaaacaaagagtgaggcattatcacacatcaactaatgaagactataggatgggggagtttgcacaatgcatggcaagaacaaggtgccgtggcttgaggttggattgtcctcttcattgtggtggaccttgtttctatgattgccaccatatgtgcaaggctcattgtcgtcgaccgtga

SEQ ID NO: 639 - DNA, 615 bp, Glycine max
  Peptide Sequence Number=SeqID_117417
atggaagctggagagacggagcttgtgcttgagattgggcagggtttgcttagggagaggttgccgaagacgtttaagcaggatgttgtgttggctatggcactcgcatttgttgacgtgtcaagggatgctatggccttgtctccaccggatttcattgcggcctgtgagatgctcgagagggcgttgaagcttttgcaggaagaaggggcaaccagcctagctccagatttacaagcacaaatagatgagacgctagaagagataaccccacgttgtgttttggaacttttagccttgcctcttgatgacgaacatcgagcgcggagggaggaaggtcttcttggtgtccgtaacattttgtgggcggttggtggagggggtgcagcagcaattgccgggggtttcacccgtgaagacttcatgaatgaggcattcttacacatgacagcggctgaacagccacaccaagtactattccagctgaaagttttgaagcatatggagttgcacttgcactggttgcacaagcttttgtgggtaaaaagccgcatcttattcaagatgctgataacttgttccaacaacttcaacagactaagattacaactgtga

SEQ ID NO: 640 - DNA, 216 bp, Glycine max
  Peptide Sequence Number=SeqID_117418
atgggggagaagcttgccacccagctcgcccaggcgagcaaggttgcttcctccagaagcaacagccttctggaggaatcttctggagggcccaagtgggcctgctttcgaagaagttatggaaactcagggattgctcaaaaacacctcttttcgacttccgccaccttacggaatttcacggatcgcgcaagcctgcttccttttgatttctga

SEQ ID NO: 641 - DNA, 222 bp, Glycine max
  Peptide Sequence Number=SeqID_117419
atgttgcttggcgacgatgccataaagcatcatattcatctgtgcttggtttggattcttttcgtcatcaagacttggctttgctccgtctttcatcggcgacgacgtccgccaccacacccgccaccacatccaccaccaccaccgaagccaccacatccaaaatacaccctcaccatgttccacggctccatgttacaacctcaccattctttgtcatag

SEQ ID NO: 642 - DNA, 258 bp, Glycine max
  Peptide Sequence Number=SeqID_117420
atgtaccctcccttgttctctttgaacctagtggatgtaccctccactagaactgatccacaagagatgtaccttctcttgttctcagtcaacaacccaagtagatgtaccctctacttgtacgacaaaggatgtaccctccaatgtgttaagacaaagatctcaggcgggagaagagagacacaaaaagaattcaggcagttagtccttgacgaattctttttggcaaagggagaagggaatgaaaaagacaaatag

SEQ ID NO: 643 - DNA, 381 bp, Glycine max
  Peptide Sequence Number=SeqID_117421
atggaggaaagaagaggaagcttgaacatgaaaataggaggagtggaaatgattgagattaatagcttcattcaaaacatggaacttgaagatataccacttgtggggaggagatggaaaattcaaatcctttgtgtaggaatcttggagaggactaaggaatccattatgcatcaaaatgctgaatgtaagtggttgaaggaatggaacgaaaacattagattttttcatgcaatggtggaaggtggaaggaaaaggaattctttgagaggactacatgtagagggggtgtgggaagaagatccaacaaaggtgaaaagatgtaaagagattttttcaagaaagattcatagaagaagaatgaagaagaccacaacttga

SEQ ID NO: 644 - DNA, 330 bp, Glycine max
  Peptide Sequence Number=SeqID_117422
atgcagagttcacaacgcgatgtctatcttggagcctacctaaatgggccagacaactaccttaaggggattattaatagtgcgttaaaaggtcttgatgatgctccacagcctaaatcaaaggcttctgctaggtggattgtcgtcaaggcacgaagtactgagtgcggctactatgtgatgcactggatgtccatcatcattttaggaacttttaggaataattgggaagcgtattttaacgatcctagaccattggagccagagagattaaaggcattgtggatccagtgggcacagttttatctccgagttagagaccaggcctag

SEQ ID NO: 645 - DNA, 340 bp, Glycine max
  Peptide Sequence Number=SeqID_117423
cgccgccccccgtgggctaagcgctattacttgcggcatgcataaggctaagccagtgctgctcgctaagccattggttgaaatggcatccaggaagaggaagagcactacttctaggcctgtagctcagtatgataccagaaatggaagtaactcctctaggctcgaatttccagccttgatcactgccctctacagagctagaggagttacctctgacagggcaaggaaggcaagggctcggccaactaatgttccttcttcttctactccaccagctccttccatttctgttactcctacaccagctactccaggcccatctacccaggacttttag

SEQ ID NO: 646 - DNA, 600 bp, Glycine max
  Peptide Sequence Number=SeqID_117424
atgttgagtcaacatcccaatatcttaaacaacattgactctgtgaagaagagagaatctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacacctgatcaaaagactctcagacagtggcattgatgatggagaagcagctgaggaagaagaagaagcagctgaggaagaagaagatgcagcagatgatacagagtcagatgatgatgattctgatgccacccccatgaccatcagacccttattctggcttttacttttactactgatagaagatgccgcagtgaactgcttcacagcagtaggagcatggagacagggggagcagaaagctgatgtcacaattttgctgtcgccactacagataccgctgtgcttgattactctgataatgaaagttgctgatcccacttgcataactgctcgtacctgctcaggaagtgtctaa

SEQ ID NO: 647 - DNA, 117 bp, Glycine max
  Peptide Sequence Number=SeqID_117425
atggaggtgaaaaagaggctaagtcatgaagtgctaaaagtgacatttgagcttagctcattagttaggctaagcgcgcatccaccgttaagcgcagcttcagcgcacttagcgtga

SEQ ID NO: 648 - DNA, 177 bp, Glycine max
  Peptide Sequence Number=SeqID_117426
atggctacagccaggtgggcactcaagcatcctgtttatggcattgtgatactatggttgggaatttacacagacagacccaacgtttccaagacaacgttcctaaatgaaaaattctacgcgatttcggaatttcaacagacactattgacaacaacgaaacaagtaccgacgtaa

SEQ ID NO: 649 - DNA, 1025 bp, Glycine max
  Peptide Sequence Number=SeqID_117427
atgaagatcaccgtgatcaccagcgagatcgccacgccgcgccgcagaccccggcgcatcagcagggtcaccagcggattaagcacaatcgccaggaagctggcgagtaagaagggcaccagaatatctgacgcggcacgaatgcccgccagaataatcactaacatcgccagcttgaccaggatgttctggccaattttctcctgtggcttttcgttcattccctctcctgaatggtggttcgctgtggaaagtgtagttgaacgccaccgctttcgtctgaatttacagattctctccatcgtgaagttcaacttcgccacctatctcaccattggcctgccgctggcggtgctgccgggctttgtccatgacggcctgggctacagcgctttctgggccggcgtggtgatcagcctgcaatatgtcgccacgctgctgagccgtccgcatgccggtcgctatgccgacagctggggacccaaaaaagtggtggtccttgggctgtttggcagcctggtgagcggactgtgtattttgctgtcggcgctgatagaggagcaggaggtgctcagcctcgcgctgctgtgcctcgggcgcgtgctgctgggcgtcgggcagagtttctgcggcaccggcacctcgctgtggggcgtggcgaaagtcggctcgctgcatattggccgggtgatctcctggaacggcattgtcacctatggtgcgatggcgattggcgcaccgcttggggtgatgatctttcgcagcggcggcctgctgctgctctccagcgtgattatcgccatcagcgtgctggcgatagtgctggcgctgccccgtgcgccggtgaaaggcagcaaggccaaaccgctgccgttccgcgcggtgctcggcaaggtgtacggttttggcctgctgctggcgatgggctcggcgggctttggcgtgatcgccacctttatcaccctgttttatcaggagcagggctgggatggtgctgccttcgcgctgacgctgttcagcgctgc

SEQ ID NO: 650 - DNA, 789 bp, Glycine max
  Peptide Sequence Number=SeqID_117428
atgggtgtacccgggttccgatctctaaatggatctgctatagctactcgatctcgatcaaatggctttggatctgtctctacatctggaatatctgtaacaggatatggaactcaatatcgatctgaaactggaagggcgatggctattcatttaagtcttcgggtagcaccattagatcttcaacaaggtggaaattctcgtattctgtatgtacatgttcctgcggctcggatgagtattcttgtttatatcgctacggctataaacactttcttattcctattaacaaaacatcccctttttcttcgctcttccggaaccggtacagaaatgggtgctttttttacgttgtttaccttagttactggggggtttcggggaagacctatgtggggcaccttttgggtgtgggatgctcgtttaacctctgtattcatctcgtttctgatttacctgggtgcactgcgttttcaaaagcttcctgtcgaaccggctcctatttcaatccgtgctggaccgatcgatataccaataatcaagtcttcagtcaactggtggaatacattacatcaacctgggagcattagccgatctggtacatcaatacatgttcctatgcccattccaatcttgtctaactttgctaacttccccctctcaacccgtatcttgtttgttctggaaacacgtcttcctattctatcttttcccgaatctcctttaagggatgaaatagaagctcgagaaggaatagcaaaacctagtttacttcccagctcaaactga

SEQ ID NO: 651 - DNA, 397 bp, Glycine max
  Peptide Sequence Number=SeqID_117429
atggaacgtgtattggctgatgtacttagagatcaaaggaatttgggcaacaagggtgacagaggttggaaaaggttagcattgaatgctgcagccgcagtgttgtctacaagcttcattgttaatgtcacatcagttaatgtcaaaaaaccgtatcaaattatggagatcgtgtcgcataaatcggctaaaccgtttcgattcaaggtgcttcaaaattgggatgatatagtggatttgtgtgctaaagatagagtcaccggtcatggagctgaaactgctatggatgctgatgaagcgatgagtagagaaacaaatgaagtggaattcatggggttaggtgctactgccatagatttagaagaaccaagctctaatacaaaaggaaaaagacaag

SEQ ID NO: 652 - DNA, 360 bp, Glycine max
  Peptide Sequence Number=SeqID_117430
atgttagagaccgagccgaagagcaaaaagataaaacgcattcatggcggcgtcgatgaggacttgagcaataagcaccctttgcaccacgacgtgcggatgcggaactgggggaaatgggtgtcagaaatccgcgagccgtggaagaagtcgcggatatggctaggcacattcccaacgccagaaatggcggtgtgggcgcacaacgtggcggctcttagcatcaaaggctccgccgccattctcaacttccttcactttgccaactcgctcccttgcccaacttatctcacgccgcaagacgttcaagccgcgacggccaaagtggtgcacatggacccttcttccctctcctccctc

SEQ ID NO: 653 - DNA, 276 bp, Glycine max
  Peptide Sequence Number=SeqID_117431
atggagaaccaaatgagggcgcggaggaagaagggaataagccaatatcgaggaagaagaagcacgaatggagattgctgggtgcacggggaagaagaaacaagcgcggaagcaaggggaagaagaaataggcgcggaagaagaagttattttgggtacttccttgaattgctgggtgcaccagcaattttgctgggtgcacctagcaacacccttaataaaggggtcgggacagataataatgggcttgaagttaggatagtccaaattgactaa

SEQ ID NO: 654 - DNA, 360 bp, Glycine max
  Peptide Sequence Number=SeqID_117432
atgtctgagtggttcactggaaagcattgtattttttacccagcagtggtaaaatttaattacgctaaggataatgaaacgaaagacaaaagcattgcaggaaggaaggaactttcaagaaagaaggatatggggtatatgaacagtgcaacaatagtgaaaattggagggtggttaaaaaaatataagaatgaagtaaatacaatatacgcaacagcagttagcaaacataacataagagaaggttcgtggcagtggcaagtgaagaagctatatgcctgtgaccccaggaaaaagaaaagaaaagaaaaacttcacttcacttgcatgcaaaatgagaacaacctcttcctagaataa

SEQ ID NO: 655 - DNA, 118 bp, Glycine max
  Peptide Sequence Number=SeqID_117433
atgaagagatgcatgatgcgatcaaggtacaagccagagcgagcttgctttgtgcccttaaatcaggaacctaatggaaaaggatccagcagtccacttctagtgacaactcccaagg

SEQ ID NO: 656 - DNA, 312 bp, Glycine max
  Peptide Sequence Number=SeqID_117434
atgaaggtttcttctgctgttgatattacaactacggaagatgtcttccgcgagactccacggaagaaggtttcatccactgttgacattacaactgcggaagactgcttcttccatggaatctcgcggaagacactttccgcgagactccacggaagaagccgtcttccgcagttgtcattacaactgcggaagaatacttcttccatggaatctcgcgaaaaatgtcttccacgagactccaaggatgaagttttttctttcgcaatagtaatgtcatcggcagaagaaaatttcttgcgtcgaatctga

SEQ ID NO: 657 - DNA, 240 bp, Glycine max
  Peptide Sequence Number=SeqID_117435
atgtggggaaaagcaatttccagttttaaagaagttgcccaacccggtaatacttatatacgtatgcagaaggacatgaaaatcatggtgacaaaactaggcctcctaagtgtgagaaaagatacaatgcttgtgggcactgtcaagcaaatcaagtaccggttatgcctcaaattcaaagcaatagaaagcattaataattttttcacaactacaaaaagaagcttctacatcggttga

SEQ ID NO: 658 - DNA, 150 bp, Glycine max
  Peptide Sequence Number=SeqID_117436
atgagtggtttagcctctcattgtcatgagaggcctaactatacaaaaaaggatgaaaatgtgtggaggaatggaaggaagatgggtgtggaagtatttgtagtacccgttttcctttttgattctcaattaaaaaccatcctggtctga

SEQ ID NO: 659 - DNA, 846 bp, Glycine max
  Peptide Sequence Number=SeqID_117437
atgcagaagggtagagaagttcgagacaataacatttttgaaccaagacggtttgaagattttggcgactttggatttcatagaagtaggatgccaagtctttttggtggcagggatccatttgatgatccctttttcacagacccgtttgatagcttgtttggtccaagttctgcatcaagagcaatgcagaagacaaacagagaaaaaggaatagttatagaagaaatagactctgatgatgagggggctgataatggccctgaaactggagagaaagattttgataagaaaaaatctaaatcgaccatggaaccgtcaattgagtatccagatgatgatgttaatggtatttccgaggttttaaattgcggttgtgatcgtgattttgttgcattcaatgagaggaagaacagtgatgtaacttacaagaatgaccattgcatggctgaacccaaggctcgcaagttttcttttcagacaagcagagtaacatatggcggaatagatggtgcatactatacatctactagaatcagaaggatgggggctaatggggaggtaatggaggaaaacaaagaagctgacacaacaacaggccaggcatcacataggaggatcaccagaggaatccatgacaagggtcattcagttttgaggaagctcgactcagatggtaaggttgataccacacaaacactccacaatcttaatgaagatgagcttgcaggatttgaagaagcatggaaaggaaataatatggcacaattgcccggatttgatgtgcataggaaggaggtgttagttcaacttcagaagtttcttgacaaatttcttgttcgctag

SEQ ID NO: 660 - DNA, 696 bp, Glycine max
  Peptide Sequence Number=SeqID_117438
atgtcctctctctttccttatctctttctacctgagagtgtgcttctttcacaagtgagcaatactgataccaatacagaaggcaatcacaaggaaacaggggactacgcaataacaagcagtaggccaaatagggctatcgtgaagcctacttacctgcaggactatatttactttctctttatctctctcagtcctctatcaactggtccgaccatgcccgagcaccacactcgtcaagtcacaacggacaaattggaagaagctatcagccgcctcagccttggccataccaacctcaacactagagttgaatccattcataccactcttaccacgaaaatcaattctcttatcgaacgttttgcttccatacctaccgcgaaaattgactcccttatcgaacgatttgcttccataccaatgcctccacatttgctgtctccgtcaccatttccgccactttctccagctcaccgccaccacatgaagctcgatgtgtcgcgctttgacagcaacgatccccttggttggatattcaaaatatcccaatttttcgattaccaaggaatacccgaccacgagcgcctcactatcgcgtccttttacatggacgaccccgcgttgtcctggtatcagtggatgttgataccaatgcagaaggcaatcacaaggaaacaggggacaacacagtaa

SEQ ID NO: 661 - DNA, 531 bp, Glycine max
  Peptide Sequence Number=SeqID_117439
agaattcaagggactaaccgcctaaaaattctttgtcctaacacattggatggtacatcctttgtggcacaagtagagggtacatctacttgggttgttatactgagaacaagagagggtacatctcttgtgaatcaattcaagtggagggtacatccacttggttgttcaaagagaacaagggagggtacatcccttgtggatctttggcttgtaaaggattttacaaggttgaaagaaatctcaagaaccgttggttgcttggggactgggtgtaggcacgagttgtggccgaaccaacaatactccatttttcacatgctaccacacatatttgtggaagcaatgtcttccaaggttattttgataatgccaaagaatcaagagttaagcaagttccaaagattcaagaatcaagtttcaagaatcaagattcaagattcaagaatcaagtttcaagattcaagattcaagaataatcaagatcaagattcaagaatcaagagaagactcaatcaagataagtactaa

SEQ ID NO: 662 - DNA, 555 bp, Glycine max
  Peptide Sequence Number=SeqID_117440
atggatgaattcattggctctctaaaggttcatgaacaaaagcttatggatgagatacaactacttaaagaaaaagtcatagctctcaagacttctcagaaaaccaagacaaggcatcaatctaaagcactaaactcagtagcaacttctaatgttaagaatagtgatgatgagttttctgaagaagatgaagagaaactagcatttctaaataaaaaattccaaaggttgctcaaaatgaaaaaaagagtcaagaagaaatttatgaagaaaagattttcagcaaggagaaagctccaggcaagcaatgatggctacatggatggcacaaactcatcatcttctgagaaagatgaggaacatgcagtcaatatatgtctcattgcagattctgacaaggaagagctaagttctgcttctcatctcaaggaggtgagcttagctattagagagattctcaaggaagttttctcaaagaagcttctcaaggaagttttctcaagaaagcttctcaaggaagttttctcaagaaagcttctcaaggaagatacctag

SEQ ID NO: 663 - DNA, 258 bp, Glycine max
  Peptide Sequence Number=SeqID_117441
atgaggacaatgatagtagacacattaccagtattctactatgaaaagatggtgggctacacaccttcaagctttgcggatttggtcttcgccgggtttcctcaacctccatttttccaaggatacgacttgaacacaacatgtgcatatcatggaggagccctggggcattccattgagcactgtatgaccctaaagcataaggtgcaaagtccaattgatgcgggccggctgaaatttgaggagaatcgcgtgtaa

SEQ ID NO: 664 - DNA, 597 bp, Glycine max
  Peptide Sequence Number=SeqID_117442
atgcagaagaagcggctggccttcgaccagctgtatgacatccgtgcggtgcgcgtgatggtcgacgacgtcgccgcctgctacgccgcgctgggcgtggtgcacgcgctgtgggcgccggtaccaagcgagttcgatgattacatcgcacgcccgaaggccaacgactatcgctcgctgcataccgccgtggtcggcccggaaggccgagctgggcgtggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 665 - DNA, 310 bp, Glycine max
  Peptide Sequence Number=SeqID_117443
ccatgctctgaggttcacgctctcccttcccttaattgtcacatgtccacctcatgttgttgcctcgaggcctccaaatcgacctccatttttctgtaattgttccatctattcaaattcccatattactgatgtctcagctcgtgtggagcatgcagacgaactgggattgcctttccttgctcctaccatcttgcgaccaaaggaaaaattttccttgactccacagtgggccccaaattttcctactgaattccggcaagctctaaacaagttgcctaattctcctcattctcagcagagtctctga

SEQ ID NO: 666 - DNA, 358 bp, Glycine max
  Peptide Sequence Number=SeqID_117444
atgcggctccgttctcgcaggcgcacgaagaagaggctccgtgcgcggaatcgtcaggggcggatgacgccgccgacggctgcggagcaggacgtgcgaaacgcggacgggagagtcaacgcgagagcgcagggagtcgcgacgcagcggtggcggcgtcgttactatcgtcggacatcgccatcaccgcctttcgggactcttcgggtcacgcgacccgacacgccagcatactcctgcttcctgggtggggcgtctgcgggcgacggggtcggtcggagccgtcggtcagactcgccgtcgccgtgcgaaccggatgaggagaacggccgcaccgagcgtcagcagcacccctccg

SEQ ID NO: 667 - DNA, 720 bp, Glycine max
  Peptide Sequence Number=SeqID_117445
atggcgctcatcgacaacggcgtgtacgtccacggacgtcgcgtggagacccccaagaacctggacgagacctaccggatgctggacgcggccggtggcatcgcctggatcggcctgtaccggccgagccccgaggaagtgacctcggtcgcgcgcgagttcgacctgcacccgctcgcggtggaggacgcgctctccgggcaccagcgctcgaaggtggagcgctacggcgacaccctgttcgccgtgcttcggcctgcgcggtaccgcgacaaggaggagtcgatcgagttcggcgagctgcacctgttcgtcggccccgacttcgtggtgacgatccggcacgcggagtcgccgaacctggcagcggtgcgggcgcggatggaagccaaccccgagctgctcgcgatgggtccggaggcggtgctgtacgccatcctcgatgaggtcgtcgacggctatgagcccatcgtcgccggtctgctgaacgacatcgacgagatcgaggaccagctcttcggcgacggagcggacgacagcgcgctctcgcgccgcatctacgagctctcccgcgaggtcatcaacttccagcgtgccgtgcacccgttgaacgggatgctggagtggctgcggcgcgggtcggcgaagtaccgcatcgacgaggagctgcagcggtcgttgcgcgacgtgctcgaccacacgatccgcgtcaacgagcgg

SEQ ID NO: 668 - DNA, 630 bp, Glycine max
  Peptide Sequence Number=SeqID_117446
atggatacgctggtgcgctgggccactcagatggacattcccgtcgagcaggtagagctggcggcgcatattgtgaccatgactgaaaaaagcctgcgtgaactgggggtgaagtgggcgctcgccgatgccaccgacgcgggaaaggtgggacagctcacgacgcttggcagcgatctgtccgttgccagcgccaccagccacgtagggtttaatatcgggcggatcaacggtcggctgctggatctggaactgtctgcgctggagcaaaaacagcaggtcgatattattgccagcccgcgactgctggcctcgcatatgcagccggccagtatcaaacaggggagcgagatcccctatcaggtctccagcggggaaagcggcgccacctccgttgagttcaaagaggccgtactggggatggaagtgacgccggtggtattgccggggggacgcgtgcgcctgaaattgcacatcagcgaaaatatgccgggacaggtcctgcagcaggctgacggcgaaacgctggctatcgacaaacaagagatagagacgcaggttgaggtaaaaagtggagaaacgctggcattgggcggaattttttcgcagaagaacaaaaaccggcagtga

SEQ ID NO: 669 - DNA, 285 bp, Glycine max
  Peptide Sequence Number=SeqID_117447
atggtgctgacagcggctattgcagccgcattgacctccatttatcttcttcatgctcatcatggcctccatcattgtgaccatttgctctttcatggcctctatgtcggccttcttatgctcttacgcctcctctacttcacccattactctagctctagcacgggttcggacatggggttgaatccatttagatttttcaacatggtccgtgacatctttgtcaaggcgaaactagaagtaacaaggacatcaacaatcctaaatgtgtttggcagtagatga

SEQ ID NO: 670 - DNA, 544 bp, Glycine max
  Peptide Sequence Number=SeqID_117448
atgggcctagttttgtcagacccgcagagacccctcgtgggagaacagaagctgatggttgagaaaacaaagaaaaaactggaggaagctactcagttcggaagcactgagggtgtcattgaccctccatctcccataagacgacatgagaagtggaagatggcttgcaccaagaaaactgggcagatgacgtctgaggcaactaaggaaattgttgagaagattataagtcattttcaattaagaattggtttgcttgtcccccatgcacgtcaccatgcacatcaggatctcctgactgctgccattggacgaccagaacaccctggccgtgtgcgtgctgctggagccggtatcaccataaagcaattctttggattggctccacaaacctcccgcagttcttcctccatggctcccgaagaactggagcagctgactcaacaaatcagggaccagctggaggagtcaatcacaaaaaacggacttgcactgcctctggagcctgaggttggtccctcagctgctcgtgtcaacacaaagg

SEQ ID NO: 671 - DNA, 357 bp, Glycine max
  Peptide Sequence Number=SeqID_117449
atgactactaagttttgtcgtggagttattggagaaacatgctacaatttcttgaatctccatgagtttcacttgatcatggatgaaagacttttttacaatccatatgatattgtcatgtttatgaagcattgcccacttcaagagaaactattcatcaatgtgcaaagttcaattttgtgggttcatgatgaacaacttagtgagaaggtccactatgaatttgaaatggtctttcacgaaggcctttcttgcttttgctttgagactagaagccataaaagagacagggagaggaaaagaggatttagaacaaggagattcatgagaatggagcaaagggagttttgtgcgtga

SEQ ID NO: 672 - DNA, 528 bp, Glycine max
  Peptide Sequence Number=SeqID_117450
atgaggaactgcactaagcccactattctgttaggggatagccatagtgctccttcaattctgttacaacagaattattccccacctgttcatctctaccaacacctcttggctgatgtcatggacccgtttgatagcttgtttggtccaagttctgcatcaagagcaatgcagaagacaaacagagaaaaaggaatagttatagaagaattagacactgatgatgagggggctgataatggccctgaaactggagaaaaagattttgataagaaaacaaagaagctgacacaacaactggccaggcaacacatagggtcactagaggaatccatgacaaggaggcttgactcagatggtaacgttgataccacacaaacactccacaatcttaatgaagatgagcttgtaggatttgaagaagcatggaaaggaaataatatggcacaatttcccggatttaatgtgcataggaaggaggtgttagttcaacttcagaagtttcttgacaaatatcttgtttgctaa

SEQ ID NO: 673 - DNA, 321 bp, Glycine max
  Peptide Sequence Number=SeqID_117451
atggaggagggtactggctggggtggtaagaataagtgttcaacagaggagctggcaacggcggtggcggtggtggctgcaccgaagaaagctaatgagatcgagtttgaaaagcatggagacttggattgtggcaaaacaaagttgagatgcatggagatcggaatccatggaagtttaggctatggcgaggttgccttgggttgcggtgaggttggccatggcggcctccaggcgatccaggctggcggaggaaggttcaacatctgccatttaagagcggtagagaaggggcaggcttacattgctattgatacttaa

SEQ ID NO: 674 - DNA, 861 bp, Glycine max
  Peptide Sequence Number=SeqID_117452
atggcatccaggaagaggaaaagcactgcttccagacctcaagctcagtatgataccaggcggttccattctttggacgcttggaatagatataccgataacattcttggctggaatatccttccggagagaaatgtgcagatttatcatactgagtttgacgagtttaaagtggaattggagaggcgtaatctacacaaaggccttgccaatctccaagatggaagtatagatgtagctgtggtgaaggagttttatgctaatttatacaccacagaggagcaagcacccaagcaagccaaaattgaagctaggctctgtattccccgtaaggggtttgttttgaatgctgagggccagccatggaagcttcttagaaaagatttgatgacactggcccagacatggagtgtcttcttttactccaacctagctcccacatcccacacctcagatctaaatatggatagagctaggttggtctatggcttggtgactaagatggatatgaacatcggagcccttatctcaggtcagatttcttttattgctcagagtaactccactaggctcagatttccagccttgatcactgccttatgcagagttagaggagttacctctgacagtctgacctatgagaacctgagcccgaccattaacttggcctacattaagaaaaactgttggaatgtggatgatctaacagttaacttcagaggggtgaggaaggcaagggtaagaccagctgatgttccttcttctactactctaccagctccttccacttctgctactcctacaccagctcctccaagctcatctactcaggactctcagtgttatgaagccatgctttag

SEQ ID NO: 675 - DNA, 276 bp, Glycine max
  Peptide Sequence Number=SeqID_117453
atgctgaaggccttggtaacaattattgtattcttgatgattatgtgtgttcaagatggtctgagtgaagaggactatcttggcggcgaggagactattgtgcgtgattataattggatgaatgatagcattcctgtgtatctccattgtcaatcgaaggacgatgatcttggccagcaggttcttgtcgttggagagcaccaagagtggtccttcaaagatcaagtagcggaaattaaaaatattacgagcgcacctccagccattgcaaattga

SEQ ID NO: 676 - DNA, 681 bp, Glycine max
  Peptide Sequence Number=SeqID_117454
atggcgtggaacgtgttcaagttctgcactgctctgcgtggattgggctcgatcatgattctgttggttcttggggtcgttggtgtcacttactatgctgttgttttgaccaattatggccctgctttgtatgctgggggacttgattctcttgttgccttggcagtgttgattttgtttcatagcttggaattcattttgacttcagccttttgtcggatgctggagcgtggtttaaagttatatagttggtttgatggattgatgagttacttctctgttgtttttaccgatccgggcagtgtccctccaaactggaagcctatgattgatgaggaaagaggagaggctgatccgttggttgggacagagtttagtaatgtgctgtctgatcccaatcaacggttctacacttttcttgagacgactctagtgactgcatccttgctgccacatttcataacattctttagcgatggagaaattcctggaacacctggctctcttgctacaacttttcttgcttttgttttaaacctagcctttgcactgagcgtcttaggatttctcatcatgcacatatctttggtggctgctaatacaaccactattgaggcatatgagaagaaaactactccaaaatggcgttatgaccttggtcgtcgaaaaaattttgagcag

SEQ ID NO: 677 - DNA, 312 bp, Glycine max
  Peptide Sequence Number=SeqID_117455
atgaagaagatgagttttattcattctgccccttttgattacatagtaattgctttatataggcctaacagaaaaaagattcacgaagattccattctaacagaattacaaagctcgtgggataattcccttatggaccactctatgccacgtcagcttcctttccctttagacaataaagtccttcagaactcgtcacaaccggatgttgcggcggcgcatcggacgacacggcgggatcgtagtggcttcgacgaggctgaaattggagagagcgggtcgaacgaaagagggaaagcacagaaggagtag

SEQ ID NO: 678 - DNA, 1389 bp, Glycine max
  Peptide Sequence Number=SeqID_117456
atggttaggactggaggcctaggtcctgtcttaagtagggttagtggcagaggtctagggagaggggatcgtgatgattctgacgatgctcccctgcagcgaaggcctaccacatccgaacgcaggcaacgagtacctgttattgttgtgaacactgagccagtggtacctgcgactgaggctgacgtagctgtggctgaggctgacatagctgcggctgaggttgatgtagctgtagatgagccgatgatagaagctgacgtacaggacattggtgtagacactgttgcagacaccagtgcacaggctgctacagatgagcctgagggatttccggctggcgtatggacgggagaggagcgtcctgagttgaagttatcctcccatgggaggaaggtgcataatttaggtaggcctgtccctgccattaaggtgctagttgttgggacaggactaagtcctttgatcgcgtgttcagtagacaccgacgatcgaggacttctatcctcgtttgtcgagaggtggcaccgggagacttctagtttccatcttcctgtgggggaggtcacgatcacgctggacgatgtcgcgtctcttcttcatctgcccgtcgttggcgacttacatacctttcagcctctgcacgtgaacgaggcggctggacattggacagctgcagctcgtgcgtatcttctccatcttctaggttgcactctttttgctaacaagagtgtaacccatgttcatgtcgtgttcttggacgccttgtgtgacctcagtcagactaggaggtatgcatggggagctgctgtcctggtgcatatgtatgaccacctaaatgatgcttgcatcagcaccagtcgacagcttgctgtcgtggagtgcaacgctggtccggactatgatgaggcgtcaccatgtgcctgtaggtggattactacgaagaagactgtgaagagcatatatacagggacgtatgggcagcgcttggaccgagttaggattcctgattttggatacgtccagagtattcctgctccgcctgtcaattcatggtgtgctcccgactacatcgactggttcttccgcatttctcatctattcatgaccgtggtccaaccatcatatcctccgccagatgcacctgctatgcagcccagacatgtccatcaagtccccgagccaggtatccctcaggtcccgaagccagcagcaccatcgacatttgtcaggtctaatgtggacgagcccagacatgcagtggaggcttgcgatgcaatttccaaaaggttggagcatcatctcaacataggggtagtcatgccaggcacatcgacacatgaggcgatgcacggatcaaccatagtttctttacacatttcatattga

SEQ ID NO: 679 - DNA, 261 bp, Glycine max
  Peptide Sequence Number=SeqID_117457
atggagaacgagcaatttctgattgaacagacttggagatcaactcaagagcccaggccgcatcaattagactttgcaccttatgtttcaaggtcatacaatgctcaatggaatgccccgagactcctccatgatgagttcatgttgcattcgagttgtatcctcgaaaaatggaggcttctttgctggaaaattctttccctggttggtgttttaggggtggcctttgtggatgattgggtgttcttggttgataggatg

SEQ ID NO: 680 - DNA, 409 bp, Glycine max
  Peptide Sequence Number=SeqID_117458
ccctacaaaggtgaaggcacatgaccctttgacggcgaggacgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggcgaggacgtgtagtcctttcaacggtgagggacgtgtagtcctctcaaggcgaggacgtgtagtcctctcaacggtgagggtaactagtacccaagtcctctcactggtgagggtagtgagggcgtgtttccctctcaaggcgaggacgtgtagtcctctgaaggtgagggcgtgcagccctctgaaggtgaggacgttcagtcctctgagggcgagccaatag

SEQ ID NO: 681 - DNA, 267 bp, Glycine max
  Peptide Sequence Number=SeqID_117459
atgggaagcttccttgagaagcaaggaagggtaccctacaaacctaaaattaggcaaaatacaaggcccaaaagaaggaaaacctattctaatatttataaagaaaagtggacccaaccttggcttatgggctcggaaatctaccctgagattcaaaagaaccctagggccttgtttagcatctctagctcaatcctcttggagtctcttgctcgtggctctggtaactggtccattcctagggaggattacatcaagatcccttaa

SEQ ID NO: 682 - DNA, 312 bp, Glycine max
  Peptide Sequence Number=SeqID_117460
atgtcaattcaggcaatagatggcgtactgcagcagctgcagctgacgtcactgcaggccagtggcaaaccgaccgagtccgccagtcagctcgattttggtgccaccatgaaagccgcgctggataaaatcagcgccacccagaccgctgcgcgcagtcaggcgcaggattttgagctgggtaaaccgggcatccagttgaatgatgtgatggtcgatctgcagaaatcgtcgatttcgatgcagatgggaattcaggtgcgtaacaagctggtgaatgcctacagcgagatcatgagcatgcaggtctag

SEQ ID NO: 683 - DNA, 318 bp, Glycine max
  Peptide Sequence Number=SeqID_117461
atggatacgggtttttactgggtaggcagcagcacaactgagcctgaggtatggtactgggatgctggacgcggtttttatcgcccgatggagccgataccgctttctctgcctcgttttaaatctgccggttttaaacttctcagtggcaaactgatgccaccggaagagcgcggcgcagaacagccagaagtctggtttttctcaaccagtggagaaggtgcctggtttgaacccaccaaaaacgatgccatcagcaagcaacgcttcgctgaacagggctacaggacgatcagcgaaaaactgtcactgccctga

SEQ ID NO: 684 - DNA, 285 bp, Glycine max
  Peptide Sequence Number=SeqID_117462
atggaggaatccaagtgggaaaataacaaagatcacatttcccagtcaagagggtccgctcttgacggtgaagaacacattggagaatggaggaatccaatcgggaaaataacaaagatcacatttcccagtcaagagggtccgctcttgacggtgaagaacacatttggagaatataggaatcctatcgggaaaataacaaagatcacatttcccagtcaagagggtcctctcttgacggtgaagaacacattggagaatggaggatttcaatcgggaaaataa

SEQ ID NO: 685 - DNA, 864 bp, Glycine max
  Peptide Sequence Number=SeqID_117463
agggctacactccctcagcttcagaggactacatgtcctcgccttcaaagggctacatgcccccaccttcagaggggtacacgccctcaccttcaaaggattacacgtcctcgccatcagagggctgcacgccctcgccatcagaggactacacgtcctcaccttcagagggctacgcgccctcaccttcaaaggactacatgtcctcgccttcagaggactgcacgtcctcttcttcagaggactacatgtcctcgccttgagagggctgcacgccctcgccttttgaggactaaatgtcctccccttcagaggactacacgtcctcaccttcagaggactacacgtcctcaccttcagagggcaacacctcctcaccttagagggctacatgccctccccttgagaagactacacgtcctcacctttagaggactacacgtcctcgccttcagagtgctgcatgccctcaccttcagagggctacacaccctcaccttcaggggactacacgtcctcgccatcagagggcttcacaccctctccatcagaggactacacgtcctcgccatcaaagggctgcacgccctcaccttcagaggactacacgtcctcgactttagagggcaacacgtcctcccatgcagaggactacacgccctcgccttcagagagctacacgtcctcaccttcagaggactacacgtcctcgccttcagtggaccatacgtccttacctttcagagggttgaacgtcctcaccttgagagagtagcactccctcgccttcatagggctagacgccctcaccttcagagggaaaaatgccctcgctttcaggggactacatttccttatatttag

SEQ ID NO: 686 - DNA, 1330 bp, Glycine max
  Peptide Sequence Number=SeqID_117464
atgactagcctaatgatgtactctcgatctgctgtgtccatgttgttcttgggtcggcaagggaaagtagagctagcaggaggctcactagcacttggatttgccaacatcactgcaaattcagtcctcaaaggcctcactatgggaatggacccaatttgttgccaagcatatggtgcaaagagatggtcagttctcaaccaaacctttctcagaactctatgtctcctcctacttgttgccataccaatttcagttttatggctaaacatggaaccaatccttcaaatgctaggtcaagaccctgaagtcacaaaagttgcccaagtttacatggtcttctctattccagagttgctagctcaggctcatcttaatccattgaggtctttccttagaactcaaggcttaaccaccccagttactatagctgcttcttgtgcagcactcttgcaccttcctattaactatttcttggccacatacttaaacttgggggtaaagggtattgcattagccactggtttgaactcaataaacatgactttgggtttgttgctatatattttgttctcaaagaaaccacttaagccttggcaaggtgctacacttctctcagcctttcatggatggaaaccactgctgagtttggcattgcctagttgcatctcagtgtgcttggagtggtggtggtatgagataatgttatttctgtgcggcttgctgagcaatccacaagccacagttgctaccatggggatcctcattcaaacactagggttcttgtatgtgttcccattttcactaagcatagcattgacaacaagaattggtcactcactaggtgcagggcaagcatccaaggcccaaagcacagccatgatagggtttttcacagcattcaccttggggatcactgccttcattttgctgttttttgtgaggaaatcatggggtaaacttttcactaatgagacacaaattattgagttggtcaccaccatacttcccattctagggttgtgtgaggttagcaattggccccaaacagtttcatgtgggattttgtcaggcactgctaggccttatttgggtgcaagaataaacttgtgtgcattttatctagttggattgccagtttctgtttttgctacattcatatacaagtatgaattggtgggtttgtggtctggaatggtggctgcacaggcttcatgtctttgtatgatggtttacacattgattcaaacagattgggggcaacaatgtaagagggctttggagctagctcagaaagcaacagagcaggaaaataaaaatgatgaggaaa

SEQ ID NO: 687 - DNA, 216 bp, Glycine max
  Peptide Sequence Number=SeqID_117465
atgtgcactggtgctgaatctcgaggagatataaatggtgatcctgtgatttcaaaggttggaggaggagactatgaggatagaatgagaaccatagaattggaaggtggtggagaagaaagagcttgcaactgtggcacatttgttcaagggcttcttcaaggcatacaccatcatctcactgcccttaatctccctaccctttctgcttctgag

SEQ ID NO: 688 - DNA, 2270 bp, Glycine max
  Peptide Sequence Number=SeqID_117466
atggcggaagatgacatacataaaatggcttttcgaacccacctaggtcattacgaatttagagtcatgccttttggcttgtgtaacgctccgtcaatgttccaatctgccatgaatgataccctcctcccttacttgaggaagtatgtcgcagtctttttcgatgacatactcgtttatagctccgatttggcttcacatgtcacacatctggagtcagtgctagctaccttatcggaaatgcagtttcttctccaacaatcaaagtgcctattcgccccaaaccaactcaattatttgggtcacatcatttcggctagcggtatagcccctgaccctgacaagatttccgccatgctcgcttggccgataccatcgtctccgacggcccttcgcggcatcctgggactaacaggtttctaccgtaaattcatcaaagggtacgcagccattgcttctcctctcacatcccttcttcgcaaggacaagttttgctggtcaccagaagctcacatagccttcaccactctccaacaggcgatggtaagtgcccaagttttgtctaatcccaatttctctttgcctttcacaatagaaacagacgcatcggtggcggcaatgggagccgtgttactccaggaagatcatcctattgctttttatagcaaagtcttgtgcccacgcttgcaaaaggcttcggcctacatccgggaactccacgccattacttcctctgttcggaaatggcgacattacctattaggcacctcgttcacaatcctcacggaccataggagcctgaaggatctcatgacgcaaatcattcagactccggagcaacaaacatatttgtctaaacttcttggatttgattacactatcaaatacaagcttggcaccattaatgttgttgctgacgctctatctcgcatcgtgccgacagacgccacttgcctcgctttgactatgccgcatttcactttcctaaaccagttacgacattcactattacaggatgcacggtatgtcaaccttttgaaggacattcaggcaaagccgaagaaccattctggtcttggtcttcaccaggaccttattgttcgacaggggtgcatctggattccttttccttgcttctttatagagaacttcgactggccaacagtccatgctgacgttcatcgattcgtggctcaatgcctagtatgccaacaaacaaagtacgaaaccaggaaacccgcaggcttgattcaaccccttccaattccgctgactatctgggaagatttggcgctggattttatcacaggccttccctcctcacatgggttcaccattataatggtcgtcgttgaccgttactccaaggcagcacattttggtgctcttccaacgcattattctgcgtataaagtcgccatccttttccttgacaccatatgcaagctacatggctttcctcgtagccttgtttcggatcgcgacccgatttttgttagcaatttttggcgcgaattgttcaaattgtccggcaccaagctcagaatgagcaccgcttaccatccgcagaccgacggtcaaacgaagggctctttttccgtcgaggctgttgatcacttattggcttctcggcagaccatgcatgagtctctccaacgtcgccttcgcaaggtccaggagtcaatgaagctcacggcggacaaacatcgtcgggatctttcctttgttgttggtgattgggtttacgtgcgcctccggccatatcgtcaaacctcgctggccccttcatatagcaagctgggtaaacgtttctacgagccctttgaagtgatcgaacgtattgggctggtggcatacaagttacttttgcccgagtcttcgtgcatccatcctgtctttcatatttccctcctcaaactccacaaggggcccctaccagagatttcgatgactcttccggttgcgtccacagataatcacccactccctacaccacttcacattctggactggaaacgtgatcattctatctcaccgccagtcacacaggcgctcgttcagtgggaaggccttgctccggaagaatccacatcggagcgttgggacgagctccgtcgtatccacaaccttgaggacaaggttgcttttggggatgggtgtgttgatagcaatgctaggctagataaagatcagaaaacggggaacatggcattagctagcagcagtaacaggccaaggagagtcataagaaaacccacatacctgcagga

SEQ ID NO: 689 - DNA, 507 bp, Glycine max
  Peptide Sequence Number=SeqID_117467
atgaacgattaccacggcggtgatccaacattttatcttcttgtaatcgtgcgagttcagtcgcctggggtaaggagagtggccggagagcctgaacctcgcggcgcagctccgcccgagagtcctatttgtgagtctctcgaattccgtgaggacggagaaaatcgtgattctagtgcctacaacatcgtcgaccaggaatggaagaaatcgtttcgagccatccactggtaccaagacagcaccggtccgtccatcacgttgtggccatcgaagcgtggcacgtcgagcttcatgtggtggcggtgcgctagtggaggaggtggaacaggtgacgacgacgacgattgtgtaggtactggtatggcggagaatcgctcgatgagggaatcaaattttgcgattagcaggtgttcaggcatggcggatgtggtggttgtaacgatggcgattggaggatgtggtggtggtggcaggtcggaccagttgatagaggactgggattag

SEQ ID NO: 690 - DNA, 273 bp, Glycine max
  Peptide Sequence Number=SeqID_117468
gcctacaagctccacatggagctacatcaggtagcggctctacaagcggaaagggaagcaagagagagggtgatagaatcattgcatggggaagtcatgaaatggatggatagattcactctcactctgaatgggagtcaagaacttccaaggcttttagccagagccaaggcaatgtcggatgtgtacccagctcccgaggaagttcatgggcttctctattattgccaacacatggtcgagctgatgtcccacataattaggaactgttga

SEQ ID NO: 691 - DNA, 123 bp, Glycine max
  Peptide Sequence Number=SeqID_117469
atggtagctttcaccttgacatggcagaggtttgagcaactaaagaatcctaggaaaaagagtgtgccacatactagtaattcaatgattaacaatgaagatcttttaaccatatacatatag

SEQ ID NO: 692 - DNA, 610 bp, Glycine max
  Peptide Sequence Number=SeqID_117470
atgacggaagggtgtggtgaagggttttgccttgcaaaccttcccggtgatgcttttagtctatgggggaacttctttgaggcaaagaaacaaatgatggctgatgctaagtttgtggggctgcttggtcttggcaagccgttggttgaaattttgccccctggtcaagttcgtggtttttgcccgttgttggcttggctagggttgatggtgctgggttatggccccgtgctaagtttcggattggttggtcccctcctcccccccgtgatcagttttgccaggattttgccaactttggcttgcgccccgttggctaagtctgcaaaagggggaggagtggcttggtcgtccgtccgcccgggcacacgtgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctacttcacaatgataggaagagccgacatcgaaagatcaaaaagcaacgtcgctatgaacgcttggctgccacaagccagttatccatgtg

SEQ ID NO: 693 - DNA, 890 bp, Glycine max
  Peptide Sequence Number=SeqID_117471
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatcgcgcacgatcctcttcgacggtcagtcgctcggcttcctgcgcgacctcgaggggatgccggcgtccgacctgtcgcgcgacgacgtctcgttccacgccctcctcgagtaccagcccggcgacgacctgcgtcacgtgcactggaagtcgaccgcccgcaccggcaccatgatggtgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 694 - DNA, 417 bp, Glycine max
  Peptide Sequence Number=SeqID_117472
atgtcttcagtcatttacactttcaaagactacaatgtcttcagtcatttacgctttttaaagacttcaatgtcttcagtcttttacatttcaaagattacaatgtcttcagtcttttatattttcaaagactacaatgtctttagtcatttatgctttcaaagactacaatgtcttcagtcatttacgctttcaaagactacaatgtcttcagtcatttacacttttaaagattacaatgtcttcagtcatttacactttcaaagactacaatgtcttcagtcatttacgctttcaaagactacaatatcttcagtcatttacatttcaaagattacaatgtcttcagtcatttacgctttcaaagattacaatgtcttcagtcatttacgctttcaaagactacaatgtctttag

SEQ ID NO: 695 - DNA, 698 bp, Glycine max
  Peptide Sequence Number=SeqID_117473
aagaagcaacaacaaacatacattcacatagaggactacacgtcctcaccttcataatgctacacgccctcacctttagaggactacatgtcctcaccttcaaagggctgcacgccctcgcctttagaggactacacttcctcaccgtcatagggctacacgccctcacctttagaggactacacgtcctcgccttaagagggctatacgccctcgccttccgaggactacacgtccccaccttcagaggactacaggtcttcgcctttagaggattacacctcctcaccttcagaggactacacgtcctccccttcagaggactacacgtcctcgccttcaaagggttgcacgccctcgccttcatagggctggacgccctcgccttcataggactccatatctgcgccttcaaagaattcaagtcccttggtcatccccctgatctcggaggagggccaactggtgcctgtcccccccagcaagggatcacgcccgtaagacacccagtggacccggagaagtccaacagggtcctggggtttccagctctgattacgggcctttgtcagttctatggagtgcccgtcgcctccagcaagggcgagacaccacagcagcaaggggatggccaacagcgggcaacaaacgcaccaccgccacctcccaagcccctcagctcatctacaaaggcttga

SEQ ID NO: 696 - DNA, 201 bp, Glycine max
  Peptide Sequence Number=SeqID_117474
atgattatgaggggccaagaaatttatagtagccaagatgaggctactacttcaccttcctctagtgaaagtgaagaagaaaaaggggaagaatctagaattaatgaagcattgggcttgaatccagaattgggcttgggcttgaatccagaattgggcttggacttgaagagggcagactattttattctacagaattag

SEQ ID NO: 697 - DNA, 876 bp, Glycine max
  Peptide Sequence Number=SeqID_117475
atgttgttggatcaaaagggagtctctaaggataaggagcagaggaggtttggatctctcgtgagacaacaacaatcatcatgtcattgtggttttcttgagtttaagaatcaggaatctactcaatttcaatgtgttggtcccagaataccgagtggtggtggtggtggtggtgctagataccggtttccaaaggaacctagccaaggcttttgctctgactatggcataacccttcaatcccgaagagaccctagatgcaagttctgggaaattgctaacaatgcctctctgcatttatcctcaaagaggtccattggtaatgtgctatgtacttcctcacatgcaccttctgtgaacaatggcgagaagccttactccagagaacaatgccatcataataataataataataataataataataataataataataataataataagaactatgagagagagagttcttcaatgaagaggcgaattgatgatttactaagtactccctctcatgcatgttctatgaacactagggagaagcttaactttagagaacaatgccatgataataataagaagaattatgagaggaagggttctttgggctggaaaccacttaataaagggaacaatacttctgaaaggttttattctcgaagcacagtaaatggtagggacaggaacatgaatatagtggaaagcagtgccaacagtgtgactgaagagacaaggaagaggccgaggctaagttggggtgaaggacttgctaagtttgagaaaaagaaaactgagggtgatggtgtaagtgctgctactactgctactcctgcttcttgtgcatgcaattccttctcaggagtaagtcagttttaa

SEQ ID NO: 698 - DNA, 393 bp, Glycine max
  Peptide Sequence Number=SeqID_117476
atggctgcgaaatcgacatgggtatggctggaaaatgaggacttgagagcgttgaatgtggatttgatggaagcaagcggcgtggcggagggagtggtgggtgtagtggttgagagaggattcgagggtttcgatgcggtggaggagggaggacatggtggaatgaggttggcgttgagggtgatggttttgagtgggaaggttgagattttggtgggtgtagtgttgttgggagggaatgggaatgggaatagggtgtggtgtaagaagggtggtggggtggagggggggtgtggtggtggtgatggtggtgagaggccattcagtgtgtgtcctgttgagcccaccagcaccactgtgaaggaaaaagggtttttggttttggtcttgtga

SEQ ID NO: 699 - DNA, 330 bp, Glycine max
  Peptide Sequence Number=SeqID_117477
atgtgggataaatttgtcacattaaaaaataccggttttaattggaacttcccgagtctaaaacctcatgaaagggaagttgaagacattgttggagaggttgaggaatcaatggccgaagtagaggttggagaggaatggaggagaccaaaccaagaacaatgggtaatggaggtattccgagagaatggggtgttgtcagtaatggttgctctgatttttacaaaaatggtggtgccaaaaagtgtatttcatgtgaattgttcattgtctaccatgcatgttcttccatcgtgggaatggttgaaagaacggacaatgaatctttag

SEQ ID NO: 700 - DNA, 807 bp, Glycine max
  Peptide Sequence Number=SeqID_117478
atgaacttgctcctcgagctcgattccattcagggttgtgatccaatgattgtggatgggaaaaggtcgattagcagagatttggttcagtttttggactcagttgaagaggttgctttgaaaaaacatgtactttatgttaaagcagcaaagcctgtgaggtctggtggtaagaaagtccaaaagcacagaaattcagatgatgatgagaggaggaagctgttgcagaatttgagaggtagggttgagaagcttagtaaattgtgtaaggtttctgctaatgatgaagaagattctgagtctgaggagggcattcatgataatggggtaaccaatgttttgattggtggaaggaatgaggtgccccaaaacaaaaatggggtgttccttcctaggcaaggagctcaacctggagtgaagaagagtgtgaggtttgctaagaataggaatatttgtgaggtttatagtggggatgtggcatgttcagatggtagctgttcatctagtgatgagctaggagatgttttggagaatgtgagtggtgcagttgaagatgacagtgtgggttcttctcagggtgctgaggatgacgaggaagtgctggtggtggagagtggaggatcgccgcgtagcagtgatgatggggagaggaacactagaagggttcttgttaatgatggcagaaatgtggtgaaagagcagcttcaagcacaccgagagaagcttctgttctctgctcctttgccacttaaaatggaaaacagaagtggttcaaggaacagtaaaggggtgaaaattttgacgtga

SEQ ID NO: 701 - DNA, 516 bp, Glycine max
  Peptide Sequence Number=SeqID_117479
atcgataaaatctctctcttctccaccgcaaagactaacaccaccaccattgaactcgcctccatcacctccccaatccttagtctcaccaccagaacatgtgcaacacctcctggttccatcatatctccctcctggttccatcatatccatgcgttggctcgagaaatccttcatgggatgtgcaagctcttgtgtggccttctcgttgcaaggattctggacaaggaagcgtggggagatgacacgctacaaggcattgaggagacgaatctcgtagacgagctcggcaccgccagtctcgaaggcggcaaggagatcgtggttggccttggagtggacgagggagttgtggacctgcacgtcgacgatgaggcagttctactcgacgccgaaaatgcaggtggttgcttcgattgtcagactaagggtgtcgaatggccaggggagggacatcaggggatggcgaaagggctggtagacttgatgttaacgaaggctgctgggacttcttga

SEQ ID NO: 702 - DNA, 1014 bp, Glycine max
  Peptide Sequence Number=SeqID_117480
atggaatacagcaattgggctgaatcgcttcaaaccgaaaccccactcccctctttcccacaaccctcatcctcatatcctcctacctattacccctcttaccctcaaaaccctaacccctcttcttcttcttcttcttcttctcttcccatcaaccctcccggggttgatccccaaacaccattgaaccctattagctatgcggctcatgaacccgttcccgctttgatctacgctcagagacttgttggggataattcgtcttctgggtattgcttggaccagaattgggctgctagagatgctgttaggcaatttggtactgaccctactctctatgcacctggtagagctcataaccgtgcttgtgaaattggtcccctcggcaattcctgctgtcctggtggcggagaccccaaagtccttgaaaatacggccaaaattgcggtgggcatctctttgccatccaatggctcagaacagttggctatggcaaatcctagtagctctctgtggtggacaaataccacaactctacctcatgtcaatggaatactgaagaaaaaccaaaagaaagctaaaactaagattgtgcaacctgcattttgtgaagtttgcaagatagaatgcaccagcaaggacgttttggaccagcataaattaggaaagaagcacaagaagaacgtggagaaattaagggaatcattgacacctacccaagttcaaccatctgtgtcatctaagcctttaataggaccccaattaccggatgataagagcaagtccacaagtgggaataagagtaagagaaaaaaagttgaaactgcagaggatttggagaaaaagaaaatgaaagttcttgagggtggggcagcagcttcagcagttaagatatgtgctatatgtaacgtggtgtgtaatagtgagacagtttataactatcatcttgcaggacaaaagcatgctgctatgctgaagaaagcatcgggccatatgcaatccagtgccagttga

SEQ ID NO: 703 - DNA, 294 bp, Glycine max
  Peptide Sequence Number=SeqID_117481
atggaagaagaacgacgtaaagtcgtcaaaaaagaagtcgacaagctccttcatgcaaacttcatcaaagagggtgtgccccaaagatgcatacctctacccagcatcgatagactagtcgatagaacgtccgggttccaagtgctaagcttcatggacgcgtactctggatatgaccagatcaagatgcatcctccagatgaggaaaaaatggcattcatcactgaagatgccaacttttgctacagtgtcatgcctttcggcctaaaaaacacaagcgctacataccaatga

SEQ ID NO: 704 - DNA, 692 bp, Glycine max
  Peptide Sequence Number=SeqID_117482
atggtgctaccttcaggctctttgcatagcactgtacaagatatttgtggaactgccctggtcgatgagaaccctgaacaccacgaaatttgcaatgatgataaagacaaccataaggtcgtcttggttgacggggttgatgccattgaagttgtcacttacgctgctattgctggtgtctttatctacctcgatcttctgctcttcttctatctgccttctggttcctgtgctgctcctcttgatgtcttccgggttgttcaccatgttgctcatgtttctccccctatctctaacacttggtggttgtctggcctcttaacaaactgggctaagtacccatatttggctgcgtctaaccccgtcctaggaggttttgtctgggggagccggatgggtacctccagattgaatgcttcctcgagaatcatggagcatggaatgcaacgcttcctcgaggttaagattttggatttagacgattgtctgcccaaatctatccatgaattttttgagggactcgttgtctgcttgtcacaaactggccaaggtggccaaggtcatgcggtgagacctattggcggcatactacgcacaaaatcgttcgacagaggtgttgaagctgtctatggacctaggttcgcctgtgtgaggaaggcatccagatactcgtctggatctattgtcccatt

SEQ ID NO: 705 - DNA, 654 bp, Glycine max
  Peptide Sequence Number=SeqID_117483
gccagtttttgttggtggattgggttcttgagaattgccaactgggtcagattcttgaagtggttgatcctaagctaggttctgcttatgatgaggaggaaatggagttggtgctgaaattgggtctcttgtgttcacaatacaaagctgagtatagaccttctatgaaacaagtggctaggtacctaaactttgatgactctcttcctgatatctctgattggagatactatgattctcaaagcagcacaaatagcttaagtttcttagaagccatgtctacgggaaagattgcatcttcatacagtttatcttccattggcagcagaagtacactgccaataaaaaccgttccagtgactcaaaagcaaaccttaggcagatacaaagcatgcacggagggcgtgatgacctgcaagaaccgctccagattactcaaccggttcgccaccgattcacacgaaggaaccacgccgctcttatttgcctcatccgacccgacccgatttgtctccgacggagcgagacgcggtgacatcactgtggaccctacgaagcttgtcattctccatggtgtgaagcgctcggcgagccttcgccggagaatagaatcgatcctcgcagtcgccgcgagcgcgcccgaagttcaagcca

SEQ ID NO: 706 - DNA, 330 bp, Glycine max
  Peptide Sequence Number=SeqID_117484
atggcaagtccgatgacatgcgggggtactgcatggttatccgcaccttttgtcaaccaggggcaaacgagcccgttgacgcgggcaaacgagcccgttgacgcgcagagactaacatcgtcttcctcaccttttgtcatccagggacaacaagtcaggtggcaggcagagataccctatggtgattcgcacctttcatcaaccaggggcatcaagcccgttgacgcgcagggactaacgtcgttctctgcacctttcgtcaaccatgggagaagcaagcctgttgacccgcaaagactaacatcatcttctgcaccttttgtcatctag

SEQ ID NO: 707 - DNA, 918 bp, Glycine max
  Peptide Sequence Number=SeqID_117485
atggggaagattccatctcagattgggaatctctccaatttgctctatctcggccttggaggtcattctagtcttgaacctctgtttgttgaaaatgtagaatgggtatcaagtatgtggaagcttgaatatctttatctgagtaatgcaaacctatccaaagcatttcattggctacacactctccaatctcttccttctttgacccacctatatttttcagaatgcacactccctcactataatgaaccatccttgctcaacttctcatctctgcaaactctccatctttacaataccagttattcccctgccatttcttttgtccccaagtggatattcaaattgaagaaacttgtttctcttcaattacagggtaatgaaatccaaggtccgattcctggtggtattcgaaacctctcacttcttcaaaatcttgacttgtctgaaaattcattttcatcttctatacctaattgcttatacggtcttcatcgactcaagttcctggacctaaggctcaacaacttgcatgggactatttctgatgccctgggaaatttgacttctcttgtcgaacttcatttgtcatctaatcaacttgaaggaaccattccaacttctttgggaaatttgacttctcttgttgaacttgatttatcacgtaatcaacttgaaggaacaattccgacttttttgggtaatctccgcaacttaagggagatagatttaaaatatctctatctctctattaataaattcagcggaaatccatttgaaagtcttggatcactctctaaattgtcaacgcttcttattgatggcaataattttcaaggagttgtcaacgaagatgatcttgcaaatcttacaagtttgaaggagtttgatgcatcagggaacaatttcactttaaaa

SEQ ID NO: 708 - DNA, 693 bp, Glycine max
  Peptide Sequence Number=SeqID_117486
atgacaactgagagggacgggcttgccaagataattgttgatttagaggctaagcttaaggagttagagtctaggttggaggagtctaacctgcgggctaccaagtacagggaatccagtaaggagcctgaggaagagctacttctgtacaagaaggagaccgtggagtatcatgaaaaggttgatgaggaagacattgctgtggaggagaaggttgttgatgaatggcaaggtgttgcggagcaaggcgatgatgcttgtgtctatgttgcctttgtttttatcttcttttcttctttctcaggatttgaccatttaaaggtcttatcacccatttggtggggcttccattgtgctttgcggagcttctcccctgatggttatagagagttatgtttgacttgcccctggttgaaggtcttgccaaccagtcggggaaggggtggacagataacggttaggaataaagaatattgtcaagggcatacttgtgtaccttcagttcctgtggagatggagcttagtaaaagaaagggctcaccaaggatgaaccttggatttgacgagacttggactcgagacgtgtttgccttgggttttgtcaagccttcggagctatgtcgaggcttaccaatgaggggtgttggattttgtgaacctgtgagtattaccaagtgtggagctttggtttaa

SEQ ID NO: 709 - DNA, 207 bp, Glycine max
  Peptide Sequence Number=SeqID_117487
atgagacatcatatcaagcaccatccttttgttcaacctagctttgaggatctaagacctggccaatcatggccaactgaactaaatgttactattgctaaaacagggaagaaacaacaaaaagctggacatgagacacatcaaaaacaagaaatgggagtgtcagaactttacctgggaagaagaacgatgaatccctttgactaa

SEQ ID NO: 710 - DNA, 1668 bp, Glycine max
  Peptide Sequence Number=SeqID_117488
atggtgaagatttgctgcattggtgctggatatgtggggggtcctactatggcagtcattgcacttaagtgcccatccattgaagtcgctgttgttgatatctctaaatcccgcattgcagcctggaacagcgaccagcttcctatctatgaacctggccttgatggtgttgtgaagcaatgccgtggcaagaacctcttcttcagcactgatgttgaaaagcatgtctttgaggctgacatagtgtttgtctctgtcaacaccccaaccaaaactcagggtcttggagctggcaaagcagcagatttgacatattgggagagtgcagctcgcatgattgctgatgtctcgaagtctgacaagatcgtggtggagaaatccacagtccctgtcaaaactgctgaagccatagagaagattctgacccacaatagcaagggaatcaaattccagattctatcaaaccctgaattccttgcagagggaactgcaatcaaagatctctttaacccagaccgtgttcttattggaggcagggaaaccccagagggccaaaaagctattcaaacattgaaggatgtttatgctcaatgggtccccgaagaaagaatactgaccacaaatctttggtcggcagaactgtctaagcttgctgctaatgccttcttagcacaaaggatttcatctgtcaatgccatgtcagcactttgtgaggctactggggcaaacgttcaacaggtgtcctattctgttggtacagactcaaggattggacccaagtttctcaatgccagtgttggttttggtggatcctgcttccagaaggatatcttgaaccttgtttacatctgtgagtgcaatggccttccagaggtggctgagtattggaaacaagtgatcaagatcaatgattatcagaagagccgatttgtgaaccgtgttgttgcatcaatgttcaacacagtttcaaacaaaaagattgctattctgggatttgccttcaagaaagacactggtgacacaagggagactcctgccattgatgtatgccaggggctactaggtgataaggccaacctgagcatatacgacccgcaagtaaccgaggaccaaatccagagggatctatccatgaacaagtttgattgggatcatcctatccacttgcagcccacaagtcctactactgtgaagaaggtcagtgttgtttgggatgcctatgaagcaacaaaggatgcacatggcctttgcattctaaccgagtgggatgagttcaagactcttgattaccagaagatatttgacaacatgcaaaaaccagcatttgtttttgatggcagaaacattgtggatgctgataagttgcgtgagattggcttcatagtttactcaattgaccttacatgtcggcttggagaggcgcctttgataggaggagagacctgcaaaacaaaagactttgatgctcaagggactgttatagcttttgtagataattcttggcttgtagatagtagccgggaacttatagataatgttaaaggatgtcacatgtattttgtggctcctgtacagtacataagccccccaagttctgagccggcttgcggccaaaaaaggttgtccaatgctgaacgaatttgtcctgtgtcgagggagtctgtctga

SEQ ID NO: 711 - DNA, 273 bp, Glycine max
  Peptide Sequence Number=SeqID_117489
atggagcaaagaagcatggcaggaagaacaagcaccacaggaggaagaagattcactaacctcgaaaacgggagaagaagaggccacaacagtgaggaagaagttacaaaaccgacgaagaagaagaggccgcaacatacagtggagagttcacgggaggaagaagaagaggaggcagtgcagatgaggagaagaattctcggaagaagaagctttctctcggaggaagaagaagaagcgttttcgaaaatgaacagtgactcgtacgaatga

SEQ ID NO: 712 - DNA, 907 bp, Glycine max
  Peptide Sequence Number=SeqID_117490
taataaagtcaagtacttctcccctcagaacaagatccggcagagaaagttcttggtcgcaaagaagaagaaagagacgaagaaggaagaaaaagagggttcgggtgctgctgactcttgcaagtgcaaagcaactggtgcaaatgccaacaagaaccacaagtgtgtctgtgtggcttataacaacctaaggaagtcccaggaagagttcttcaagaacaaagatgatggtgttgttgaagaagggggttttgagagtgagactgagagtgtggttgttgaagaagaaaaagaaggagaatcattattggggaatggtttggttgtgaagcgtaggagggagaggttgatggaagaagcgaggaagagtgttccacaaagtgggtctgggaaagttatgcatttggtgaaggcatttgagaagcttctctcaattcccaaaaccgaggaagaagaagatgaggaggagggatctaaatatcaagagaaggatgataacaagatggtggggaaatgggcactgccagggttgcagcaacacgattctgaggtttcattttgcccaccaaactgtgtcctcacattgcaaaacctcggcttggatcctggggcatcagtttcggcttcgtgggatagcagccgtgcaagtgtgtctagcaggacttctactgggggtcgaagaagcaggagaaatagcctggaatcatcaagtacttttgggagaagaaggttgaaaaagaagcagcagaaagtgactagccagaagccattcaagctaagaactgagcaaaggggcaagttaaaagaagaagaatttgtaaagaagatacaagagatggcagcagtagaagagaagcaaaggatacctgttgcacagggtcttccttggacaacagatgaaccagag

SEQ ID NO: 713 - DNA, 600 bp, Glycine max
  Peptide Sequence Number=SeqID_117491
atgctttttagaatccataatctcctatggcctatgggaggtacaaaatcaagactcgatggatacaactttagaatcttgaaggagttttgggggctgttgaagggggatataattgaatttcttggggatttccatgcttccgaaaaatttccaagaggagctagtgcatcatttattgctcttattcccaaaatttatgagccacaaggggaacttcatggtgtgattgatggaagacaaagcgttttcttggggggaagaaaccttttgcacaatgtcttgatagcaaatgaagtagtggatgaagttaggaggaagaagaggaaatgtttgttatttaaagttaactacgaaaagacatatgattcgctcggtatcggtacttgtgaatgtaaccccacaaaagaatttatgttgcaaatggagttaaggtatggagatccacttgctcctttccttttcactattatggcggagggattaagtgacttgatgagggaagcagtctctagaaatctatatagaggctttaatgtagggactatgaaagtggaggaaattggtgaagattcaaaggaggtttttgtggggttgtga

SEQ ID NO: 714 - DNA, 2829 bp, Glycine max
  Peptide Sequence Number=SeqID_117492
atgggtttcagacaattcggagaaattcctcacctttcaccgttcgctgtgaagcttcaagtggaaggtttatttacaattttgaatgtttgtggatttgggttgtatggtggttgttggagattgtggggtgcagtgattacgcagcaagagttcacagagatggcgtggcaggcaatagtttcgtcgccggaggtggccaaagagaacaagcatcagatagtagagacagagcacttgatgaaggctttgttggagcagaagaatgggcttgctcgcaggatcttttcgaaggttggggtggataacactcgccttctagaagctactgataagtacattcagcggcaacccaaggttctaggggaatcatctggttcaatgttgggccgtgatttggaggcattgattcagagagctagggaccacaagaaaaagtatggggattcatttgtttcagttgagcacttggttcttgcttttacccaagatcaacgatttgggaagcaattctttagagattttcaaatatctgagcctgctctaaaatctgcaatagagtctgttaggggacgtcagtcagttattgatcaagatcctgaagggaagtatgaagccttggaaaaatatggaaaagatttgaccgcaatggcaaaagctggaaaactcgacccagtcataggaagagatgatgaaatacgaaggtgcatccaaattctctccaggaggacaaagaacaatcccgtgctaattggtgaacctggtgttggaaagactgctatttctgaaggactggctcagagaatagtgcacggagatgttcctcaagctttgatgaaccgtaggcttatatctctcgatatgggagcacttattgctggagcgaagtaccggggagaattcgaggataggctgaaagctgtactaaaagaagtgacagaatctgatggtcagactatccttttcattgacgagattcatacagttgttggggcaggagctacaaatggtgctatggatgctggtaatctcttaaaacctatgcttggtcggggtgagttgcgatgtattggtgcaacaacactggacgagtatcggaagtatattgagaaggacccagcactagaacgccgtttccagcaagtttatgttgaccaacctacagttgaagatacaatttcaatactaaggggactgcgggaaaggtatgaactacatcatggagtccgaatttctgacagtgcacttgtggaagctgcaattctctcagatagatatatcagtggaagatttttgcctgacaaagctattgacctggttgatgaggcggctgcaaaactgaaaatggaaatcacttctaaacctactgcacttgatgagatcaacagatcagtcctgaaactagagatggagagactctctctcatgaatgatacagataaggcttctaaagataggctgaatcgtcttgaggcagagctttctctcttaaaagagaaacaggctgagctgactgaacagtgggagcatgaaaagtctgtaatgactcgtattcaatcaatcaaagaagagatagacagagtgaatcttgagatccaacaggctgagcgggagtatgatcttaatcgtgctgctgaattaaagtatggcagtcttaactccttgcaacggcaacttgaaagtgcagagaaggagttagacgaatatatgaactctgggaagtctatgctgagagaggaagttacgggaaatgatattgctgaaattgtaagcaagtggactggtatccctgtttcaaaacttcaacaatcagagagggagaagttgttgtatttagaggaagtgcttcataagcgtgttgttggccaagaccctgtagttaaggcagttgctgaggctatccaacgttcaagagcaggtctttcagatcctcatcgtccaattgccagcttcatgtttatgggacctacaggtgtaggaaagacggagctggctaaggcacttgcagcctacttgttcaacactgaagaagctcttgtacgaattgatatgagtgagtacatggaaaaacatgctgtttcaagattgattggggctccacctggatatgttgggtacgaagaaggagggcaacttactgagatagttcgccgcagaccatatgctgttattttgtttgatgagattgagaaggcacatgctgatgtcttcaatgtattccttcaaattttggatgatggaagagtaaccgactcacaaggtcgcacagtaagttttaccaacactgttatcattatgacctcaaatgttggatcacagtacatcttgaacacagatgatgacaccacgccgaaagagttggcttatgaaaccataaaacagcgcgtaatggatgctgcaagatccatctttcgccctgagtttatgaatagagttgacgaatatattgttttccagcctctagaccgtgaacaaataagtagcattgtcagattacagctggagcgtgtgcaaaagagaattgcagatcgcaagatgaaaatccaagtgacggatgctgctgttcaacttcttggaagtttagggtatgaccccaactatggcgctaggccagtcaagcgagtgattcagcagaatgtggagaatgaactcgccaagggtattctcagaggagagtttaaggaagaggatgcaattctaatagacactgaactcacagcatttaccaacggccaacttccccagcaaaagcttgtttttaagaaacttgcagctgattcagaatctacccctcaaggcaccttggaacccttcccacaggccccatga

SEQ ID NO: 715 - DNA, 249 bp, Glycine max
  Peptide Sequence Number=SeqID_117493
atggggacagggatgggaggagcattgttgatcctgcaagatcaatcattgaagacaatgattgagatttgtgtgaggtgcttggttaaagagctagcatataggtcttctataaaggatgttttgaggaacttgcagtttgcatctcaagtacaagatgcatggagagggattctcaaagtagtgaaggatcagttggctcagaatctcgagggctacccttccaagttaatacttaagtttacataa

SEQ ID NO: 716 - DNA, 582 bp, Glycine max
  Peptide Sequence Number=SeqID_117494
atggatagtggaagagtcagggaaaaggatgaagatgcattgtgtgaactggtcaagtcacctcaattcaatgttgggggaagccacaaagttggtgaaactttggactcattgaagctccatggcattagattaggccttagaccttacaacccttctttggagaatgctacacttgtggaagcctttgatgctgtgattgatgagtttgggagacaagggatgatggtgttggctgataaccatgttagtgaccctaaatggtgttgtggcgacaatgatgggaatggcttctttggagatgaacacttcaaccctgaggaatggctacaaggcctctccatgatagccaatcgtgtcaaaggaaaatctcagcatcccgggtttcttatgaggggtcagaatcctggtgcattggtgatgagtgagtttgggatgaacatgaccaaaagggatgagaagaacaacagattcatgtcatgcatgttggcctacctagcaagggtggatttggattgggcattgtggactgcacagggtggctactatgtcaaagagcaagataggattttgggtgtatga

SEQ ID NO: 717 - DNA, 756 bp, Glycine max
  Peptide Sequence Number=SeqID_117495
atggctgggaatcaagatcagttcgagatcaagtttcggttgactgatggttctgatattggccccaaaagttttcctgcagctactagtattgcaacattaaaagagagtgttcttgctcagtggccaaaagacaaggagaatggcccaaagaccataaaagatgtgaagttaattagcgcaggaaaaattttggagaacaacagaacagttggggaatgccagagcccgttatgtgatacccctgatactgttacgacgatgcatgtggttgtgcaacatcctgctacggagaaagttgcttcaggggccaaagattacttacatagagaagaaagctgccaacaaagcaacacagaacaaatgcatcctttgtgctcctattctattgtgcgtgaacttcataggtctcatatgagtgaggatgcaccgaatagagaaactatatttcctgacctttcactctcccttcaccttcaacccgaactactcttccctcttagccaccccatcaccactcctcccttcaaactccaacttcgtcattgcgaacaagcatcaccaccgctgcatctaagagtcttgtcctggatctggtacatgggtttaggattggtgggtttttttcaaggcgattcagatctctccatggcatccgaaaacagcaagagagggcatgtcactaggacattcttcctgacgatagcattcatgaaagttgccgctcccagctttaaagattatccgcgcaggtga

SEQ ID NO: 718 - DNA, 499 bp, Glycine max
  Peptide Sequence Number=SeqID_117496
atgttgcgcaagatattgaatgaagaagttgattcccatgcctatcaacaagacaaaaatagcatggagggaagtgggttagaattcagtgaaacaaatgctagttcttgggcaagaaaggtggaactacccagctttgatagaagcatagaagggggaattgaattgaagggtagcaattttgagtgggacagtgacccgatgcagttcttgaaatcagaaaatagaagtaaagttatgaaggaagaagttgatccatcgataaagagggagaagcacaaggaaaatggagtgatgaatgtgggctgcgaagacgattttcttgataacctaattacagatttgatcaagaaagaagccgaagttggtgattcaaccaagccacattgttttcaagatttagatttccataaaaagattgttatggtgaaacaaaaatcattcatgaaggtggttggaacaacaatggagttgaaatcttggaatgtcaacttgttgg

SEQ ID NO: 719 - DNA, 735 bp, Glycine max
  Peptide Sequence Number=SeqID_117497
atggttctctttgtaccagccttgtcacatggcagtcgtcatcgaagaagtggatggcatctagcccatgcaactttctatggagacatgcaaggtggagacaccatgcagggtgcttgtggctatggtgatctctaccagcaaggttatgggctagaaaccacagccctaagcacagctctattcaacaatgggctcacttgtggtgcatgttttgagatcatgtgtgtgaacgagccccaatggtgcattcccaacgcaggctcaatcaaagtgaccgcaacaaatttctgcccccctaattacaacccacctaatttcgaccattggtgcaaccctccacaagaacacttcgacttgtccatgaaaatgttcaccaaaattgccatatacagagcagggatcatcccagtcatgtatcgccgtgtcccatgcaacaaaagtggcggtgtcaagtttgagatgaaagggaacccttattggttgttggttttgttgtacaatgttgccagtgctggtgatgttactcaagtgagcatcaaagggtcttcaaacactggctggaaatctatgtcacgtgtttggggacagaattgggttactgggtctaatttggtaggacaagccttgtcatttcaggtcactactagtgatggtaaaatgatggagtttgataatgttgctccttctaattggcaatttggacagagctacgagacctaccaaaacttttag

SEQ ID NO: 720 - DNA, 318 bp, Glycine max
  Peptide Sequence Number=SeqID_117498
atggttcattccacctacgtttgccttctccttcaaatcgacctaaattcttcatcaccaacttcaaaccgacatccaagacggtgttcacggtcaagaccaataggcgtaacttcaaccattcgcgaacacgatgaaggtggagccgttcgatgcgaacaacgtcattttgcggcagcggtctcagaagatgaagcggtatcgcactgcagcgacaatgtagtgttgtccacgatggtgcggcggaagacgtggtttcagttcttttgggtttcggttgttgtgatttccaatggagtgacgaaggacatcgactaa

SEQ ID NO: 721 - DNA, 753 bp, Glycine max
  Peptide Sequence Number=SeqID_117499
atgaggaagccattgcccagctgttgtgcacaccggggcaggatttcaccctggaccactgcagggaggcgggtgcggatcatgcacactagcatgaccaccttgacccaaacatggatgacacttctgcttagcaatgtcttgcctagcgatcacaactccgatctccctctgcctaagtgccagcaggtgtatgccatcctgacacggataagcgtccacgtggcccaggtgattgctgacgccatttatttgtttgcaggtatggcgcctactaggcatcctctggacccaaataagtccaacagggccctagggttttcggcgctgatcacgggcctctgccaatcctacgaagttcccgtcacccctagtaaagtaattcgaccgccgatcacccgagccttcatcgagaagtattgcacgcctaggcaggcgcagggtgatgcagatcaggctgcagacgcgccgccaccacctcggcaggccgatccagttgggtcactgggcatggagcgtcatctacaacgtttggtttgccagcaggcggccaaccaccatgagcagggttccaccccttttgtatgccctaccccggagcagtttggggctgaggtcgcatggcctggagactggcccaatgcccaggcagggcaggagcctgcaggatcccccggtgaggcagatgaatcccatatggatgaagatatgactgacctgctcggtttcttgggagggagcagagccacgtga

SEQ ID NO: 722 - DNA, 1596 bp, Glycine max
  Peptide Sequence Number=SeqID_117500
atgctagaggcttatggggatattttgttttgggcatggccagctgcgcaaggggattcgaggactgagattaagaatgggttcttgcaggaaatgattgaggctgccatacacgctagtttcggagcttttgcttcatatattatgagggttttggaagcttttattaaccacaggaccaccgatggggttgagaaaatcctttatcgactcgccgagcctgtcatatttaggtctctacaggctacttacagatatgattgtctggaagtgagaacaattgttgttgagggttcttgtcgcatccttcatctgttttgggaagttattccttcactaatcataacaaagatgataacaaaaatagttgatgatatatcacacgatggatgcaatgagacttcggcacctaatgttggacaaagtcctagcaatacgagttgctgcagtggatctcttactccatctaaaggatgttcgagattttcagttcaacaaggcggtggagctagatgtgctattgtctgtgcttacaaggctccaatggctggcgcaagatttttccagtttgctatcttggaaagagcatctaaatctcatcttatggaactggtcaaagtatttctgagtttaattttgtcaccagataagctagatgcaaatcagattaacggtttccttgttgctactagctatgtttgtgatagcttggcttgtgagccatgctataaaaatgctctcaaagagttactcgatggagagaaaatgaaagaaccagaacacaatggaacttggaaggcagctggaaggggagccttgacaacatacaaaaacataccaaacttagcaattggttttgaggaaggacttcaagccaaagcaatggaaaaggacgagacgtttgaaactggtccggcaagtttccggtggccggagggcgatgcgtggacttcacgcactggaaacgaggcattgcagtggcgacgcgtggctgcgctgttggtcacacgacttgcaggggtggattgcgctcctcgaggcacacccaaccctgatgatgttgctagacttcttgaagaatgcatgggtgttgtcacaaactgcagtggtttacccgaggatgttgatcgacaaattgaaatcaggtctgcacacaagttgttgctttcactgggtggttttgatgacttgattgaggccttaacggcctccttgcataaggttgcctatcgttgccacattaaatttggtgtagacatgccatctcatagtgtttcatttgctaaaagaaagaaatctaagtcctctggaaaattttcaattaaatcaaagataattaacagaaaacaatcttttgaggatgattatttagtagctgttggggtgacatggcaagttagagatttgcttctgcaagaagataccagaaaagctattttggaatctccgagtttagagatgtcgtttgtttctcttaaggtgatttctgaggtcagcattatgcattgcgggcaccacgaatacatagacatatgtcctgttttggcatatgttgcctttgctgtccaaatgactgttgataattggcagaagtag

SEQ ID NO: 723 - DNA, 600 bp, Glycine max
  Peptide Sequence Number=SeqID_117501
atgggaaagactgttattgtggcaacaaatatgctagacaacatgattgttcacccgactctaaccagaatagaggtatcaaatttagtaattgttgttcaagaaggttctaacggaataatgttgtctagagaaacagcttatgaaaagttcccactaaaagttgtgcaagtaaggcacatagtagcattgcaaacaaaagccactataccaagtggtaaaatgccacctaacattggtcaagtgttgaagaaccacatgagtgagatgtttgcctaccatgcaaccatgatgtctaacacccttggaacctcaattattgtctccactggaacgggtttcatgactcaagtggtgtttcttgaccacatacttattgtaaaagacagagagaaaaccgcagaaaatgtgaagggtttgaacttggtgcttagttggcagcttgacaataactatcaccttgaagacaagatgtttttcaatggcataagggatgttaggaagggaataatggctcaacaagatactataggcataggcatgaatgataggcccaaaaggaagatcaatccaccaaggcatctaaaggatttcatttaa

SEQ ID NO: 724 - DNA, 549 bp, Glycine max
  Peptide Sequence Number=SeqID_117502
atgaagatgaaagcaagcaaaacaagaaatgaattgaaagcctcggattcgagcacttaccggatgaagaccgaagaagggacgaagaacgctgaaatgcatagcataggggtcagaaaccctttgaaacagttacggaagaattacggaagcgtagcagacttgattttcttattatttctcttcctcttcacgaatcctaagttaaatatgctttcccagggttacgggaatttcacgaaaacactacggaagccccggatgccatttttcaacaaaatgggggaggtggttgccgcccagctctcccatgcgagcttaactcgcccaggagagctagattgcttccacctgaaggaagaaaaagtccagaatcctctagatgggcctagatttggaagtttctatttagactcccatcttgataagttcaccccttatttttgtgtttttttggctgttttctttccgaaacctcatggaaccttacggattccacggagatgggtgttaagccttccgaagcgatcaaaaatggtccttggataa

SEQ ID NO: 725 - DNA, 603 bp, Glycine max
  Peptide Sequence Number=SeqID_117503
atgagggttcataccactaaggcacttaaatatgctctgggcaaaggagccgttgattatgaggattttctccagagtggagatccagaatatgcatggaaacccccagaggatgagtggcagagcaattcattgggttacacatccggtaccactgctagtccgaagggtgtggttttacatcaccgtggagcctatctcatgtctctgagtggagctcttatttggggaatgactgaaggagctgtgtatctttggacacttcccatgtttcattgcaatggttggtgttacacttggatacttgcagctctgtgtgtgctaattcaacacacaaaaatcgagtacttcccagagccagagaaatttgatccgagtagatatgaaaggattgggccagcttatacttgtgtgccatttggtggagggccaaggatgtgccatggaaaagagtatgcgcgaatggaactattggtgttcatgcacaacttagtgaagaggttcaaatgcgaaaattttattcctaatgggaaaatcacttataatcccatgcctattcctgccaatggccttcctgatcgtcttattcctcaccgatcttga

SEQ ID NO: 726 - DNA, 627 bp, Glycine max
  Peptide Sequence Number=SeqID_117504
atgtgcaccgatttcgaagtagttgcggttccacactgcctccagcagcgtattgacaaagcgcagcgcgatcaggttaagcactgccgccttgcccaggtagtggtcgaggcggaacacgcggtcctcgtcgatccactggccgatggtagagatgatctcctcggcgctctcgctgtcgctgccgatcggcttctccagcatcaggcgtgccggtgcggcaagtgcgccgcccttggccaggccttcgcaggtggagatgtacagacccggcgggatggccaggtagctgacgcacttgcggtgcaccaggtcggagaccgcggcggcaaccgagtcgacgtcgcgcaggtccaccgaacggtagtcgatgcggcgcagcagggcactgatgtcgtcctgcgtggccatcggcatggcctgctgcaggcgcgggcgcaggatgtcatggaaggcttcggtgtcatgcccggacagggccagtgcgcggatgcggaagtcctccggcagcaggccgtcgccaagcaggcgaagcagcgaagggaacaggtagcgctgggccagatcacctgtggcaccgaacaggaagagggtgtcgtgcatcgctcgagtttcagatccgggtga

SEQ ID NO: 727 - DNA, 294 bp, Glycine max
  Peptide Sequence Number=SeqID_117505
atggttgtaggaaatgcaactatagaaaaacctaaggaacaatgggatgaagaagaaagaaaaagggtacaatataacttaaaggccaaaaacgtaattacatctgcattaggcatggatgaatactttagagtaacaaattgtaggaatgcaaaagaaacgtgggatacattacaagaacacgaaatggaacttatgagactaaatcaacatgaagaaaatgacaagaaaaagaaaggaatcacacttaaagtctcacttcaattcaagaagaaagtgacaaagaggacttga

SEQ ID NO: 728 - DNA, 354 bp, Glycine max
  Peptide Sequence Number=SeqID_117506
atgaggcttcactataatccagcaagtcggggaccttgcatgaccacatatcgacctccactccctatggctaacacaaacccagggtgtgttacccttgctcctacatatccccaggggaagctcacccaggcgaattggtttcttaagcttgaaggtatcagctcacccagtcaagctggttgcttaaggctgaagctttcccatggtccaagcgagtttagatctaaagagttccaaaaaatgatcattttgtccctttccttgtggctttttgttttcggatctggcaatcaaacatcaaccttgagcgaccccgtgtccttgcggtgcaatgggtgccaaacaccgtag

SEQ ID NO: 729 - DNA, 426 bp, Glycine max
  Peptide Sequence Number=SeqID_117507
atggcagcatttcggaaggctttgccagagaaccagccagatgcggttggaaatattgtagtaggagcgactgattgggcatcattagtaactcttgcaataaggttgttaggtacaatatcatggacggtggataatagactaatagtgatttgggttacaagaatctgcaattctatgactcaaaaggcttatattgatgagaagtgccgggatcttcagctgcaaaatttgaatattatagttgctgatattagcacgtttgaaatggaggcttcttatgacagaatattttccatagaaatgtttgagcatatgaagaactataaagatcctctcaagaagatatccaaatggatgaaaaaggatggcctttatttgttcattacttttgccacaaagcatttgtctacctctttgaggtga

SEQ ID NO: 730 - DNA, 339 bp, Glycine max
  Peptide Sequence Number=SeqID_117508
atgggtatcccacattttcttgctataccttacccaatcctagggcacatgaaccctcttctgcagttcgctctggttttggcccaatatggatgcagaatcaccttcttgagttcagatgagaactatgataaattgaagagtgcaagtggtggtgggaatggcaaagtcatcatggactcacacataaagttggtgtctctccctgatgttggacaccaattgggaattaaaggggctctattctggccagcctcaacaacttctttggcatcctttaactccattcagaggcttattaatgagggtgccaaagattccaaaaatggtaagaattaa

SEQ ID NO: 731 - DNA, 360 bp, Glycine max
  Peptide Sequence Number=SeqID_117509
atgtggttcatgttcaccatgaaactattatccatcgcgcctaaggcaacgactctgcggcgacgacatcctcccagatggaattggtggtatgtgtcgtcggaggtggaatttgtgggcccaaacgtcgttggctacgaaatcgacgcgacgctggtcgtcgaacatcttcaattgcattttggaggaatccctagcgcgaaccttggaacctacaatgaggaaccaaatggcgtcgttttcattgtcttagtctttgagaaaggcgtaagaggtgcatttgtcggagaggatccatttagcgttgggagtgttgtcgccgatgtgaaggtagaggttaacagcgttttggggaagtga

SEQ ID NO: 732 - DNA, 405 bp, Glycine max
  Peptide Sequence Number=SeqID_117510
atggatttagttgactggaaacaaattgtaagtggtagccttggctatgatcctccaccttgtggtgatgaggctaactctgttttggaattgcttggtgaggcaacaacaaatgctggctatgttaaggaaggctctaaaactaatttgcttgtttctgcaatgcattgttccatacggaggcactgtatagactttgagatggccaatgtgcaaaggaagaactccgatgagaattcaaatatcggtctggtacatctgagtctaatgagaagaatgtttataatgaaaagcaatttcttcttgcaaaacgcaatgaggatttacagaggggaatttgcaaggaattggtctacacttgaatgcacttgctgccttaaaagaatacaagggcatacaaattga

SEQ ID NO: 733 - DNA, 786 bp, Glycine max
  Peptide Sequence Number=SeqID_117511
atgacagtgagcacgaatcctgatattaatagtcatggagtttctacggttgctcctctgccaaaaaaaaagaatgaagaggaagggatagctgaagatgttaaggggaatctacttccaaagagggaggaacttgttggtagagggtggcagggagcatttggattgaagtacgagatcacaaaaaatgagcaccaacagcagcagcaagtaggcgtggaggaaaacatctgcaatttgacttctgcatctggtgaagcaagtgctgcttcctcaggtaacaaaactgaaattggaaccaattacatggctccaccaccatctcaaactcaacaaccaaagaaaaagagaaacctacttggcaacccggatatatatgctgaggtaatagccttgtcccccaagagtcttcttgccacaaacagggcacaattttccctggaaactgaagtagagaacaagcaaagaggtgaggaagaagaaagcacggtgagaagaagtgcaaatgtcactagtgctccaagaagtatgccgttcaatcagattggaaagctcactccaaatcctgtggcactagggagtacacatgtgactgtcaaacccacttctcaagtgccaagaaggttgtcactttctgacattaagtatactacaatggagttcaatcgagataggcttgttggggagggtgcatctgcaaaagtgtataaagggtttaaagatgaagatggtaactcttcaaccggaatgggtgtcaatcttccagttgatattgtagatcaaaat

SEQ ID NO: 734 - DNA, 2061 bp, Glycine max
  Peptide Sequence Number=SeqID_117512
atgattgacagttcctcagccaccagcgatgatcaaaataaggagaagaagattgtcacccccaatctatcctcagccaccagcgatgatcaaaataaggagaagaagattgtcacccccaatctatccagttgtatatttgtggcagaggaaaactcggatacctcaatggaggacattagcaaaaattacatgtgctattccacagccaaagagctatgggatagtgtcacagaaatgtattctgaccttgggaataaatctcagatttatgaactcaccttgcaagccaaagaaattcggcaaggaggtaataatgtgacaaaatacttccactctttgaagcaggtttggcaggaccttgatctcttcaacacttacaagtggaactcagcaaaggatgccaaacaccatcaacagacaatggaagaaggtagaatatttcaatttctagcaggtctgaatgaggagctagatgaagttcgtggcaggatcattgggagagcaaccttaccttcattgggtgaggtctttgctgaagtcagaagagaggaaactaggagaagcgtgatgataggaaagatcaaaattgttctacctcctcctgagaccaatgttcttgctacagaaactactacccttaagagttcaactaaccagaagaatttttcaaacctctggtgtgaccactgcaacaaaccacttcatgaggcagaaaatacttctttgagaaaggaacaagttaaggaactcataaggttgttaaattctaattttttatctggttcccctagtggttctgtggcacaaacagggaaaagggatattaccttatctaaaaacattgacttaaaaaatgttttacatgatcgaacttcggggaagatgattggcagtgcaaagataatggatggactttactactttgagaataatttcaaaaataaagaagctcagggtctaagtggtatgagttatgtacctggaaagaaataccacaatcaaataaagagtgtcgtgtttatactcagaaatatcctaaaaggatcaaagaacaatccatcatctcagcaccaaaccaagcataatttctggaggaaggccaaggagaaataccaagagaaagttgagtgcaaggctgatgggagtgtagaaaggtacaaggcgagattagtagcaaagggattcacccaaacttacggagtagactatcaggagacttttgctccagttgctaaacttaactctgttcgaatttttctatcccttgttgcaaattgcaactggcctttacatcaattggatgtaaagaatgcttttttgaatggggaactagaggaagaagtgtttatgagccttcccccaggatttgaagaagaacttggaagaaataaggtgtgtagactaaagaagtcattatatgggctgaaacaatctccaagagcatggtttgaaaggtttggaacagtggtaaaagggcttggatatatccaaagccaagctgatcacacattgttctataaacattcaacaaataataagattgtcatcttgattgtttatgttgatgatattattctaataggtgatgatagtttggaactcaaaaatttgagggagaaacttgctaaagtttttgatatcaaggaacttggcccattgaaatacttccttggacttgaatttgcaagatcaaaggaaggtatctttatgaaccagcgaaagtatattctggatcttttaaaagaaacaggattacttggatgcaaggttgcagaaacacccatggagcccaacttaaaactacaaccagctgaaatagaaaatatggtggacaaaggaagatatcagcgactagtggggaggttaatacatctatctcacacgcgtccagacatgcctttgctgggacttctttataaaaaccatggacatcttcaggtagaaggctacactgatgcagactgggttgggagtgtgacagaccgaagatcaacatcaggctattgcacctttgttggaggaaacttagttggagaagcaaaaaatagagtgttgtag

SEQ ID NO: 735 - DNA, 1113 bp, Glycine max
  Peptide Sequence Number=SeqID_117513
cctgaaggacacgccgatcttcccggtgtcgatgaaaaaacacctgccggtgtggccggaagggcgcgagggcggcaagctggatcaggaaggcatgcgctatgcgggcctgatcgccgacgagatggccaatccgccggccgattggctggtgatgtcgcgccgctacaccacgcagtcgatcgacacctcggcgctggagccggacaacgccaacggctggttcgacgccgagacgcaaacgctgcatctggtggtgccgacccagtcgccgcaggaagtggccgacgagatgccgcgcatgctggccaagcgcaacccgccggtgaaacagctgatcctgcacccgtgctacaccgtgggctacggctcgaaagatcactacaacttcccgtattacggcgcggtggcggcgatgtacggcgacggccacccggtgcgcctggccaacgatcgcttcgagcagttccagacggcgctgaagcgccacgcgttcgacatgaattaccgcatcgcggtgaataagcagaccggcgtcatgcagtcgttcctcggcgacatgaccgcggacggcggcggccgcagcaactttaccccttcggtggtgatggtcggcgcgaccgccgcccagtcgatttactacttcccgaaaagcgatctgtcttcggtcgggctggcctcacgcgccatcgacgccggctcggcgcgcggttacggcacgctgcagagcatggccgccaccgagatgatggtggatgagctggccgccgagctgaagatcgacccgatcgagttccgcctgcgcaacgtgctgaaatccggcatgaaaaacacccagggggcgatcccggccggtgcgatccgcgccgatgaagtgctggagaaggcggcgaagcatgagatgtggctcaagcgcgccgaacgcaaggccgagtttgagagccgccatcccggcaagcgctatggcgttggcttcggctgcgtgcagaaagacttcggcaccggggcggaaacctcgttcgcccgggtggagctgagcgaagacggtcgcatcacgctgcatcacagcggcgcggagatgggtaccggcatgtcgacctcgcaatctgtgct

SEQ ID NO: 736 - DNA, 222 bp, Glycine max
  Peptide Sequence Number=SeqID_117514
atggataagagcttgaaggtaggagaagatgagtggagggagagggagaaaaggggcacgaaatttatgcctcaaatgagtaacataaatgagataagggaagagagaaatgaaatctcgatttatactggttcgaccacttcctgtgcctacgttcaatcctcaagcaacccacttgagatttttcactatctttgtaaaagtcctttttacaacttctga

SEQ ID NO: 737 - DNA, 426 bp, Glycine max
  Peptide Sequence Number=SeqID_117515
atggtggtgagcttgttcttgactcatcttctccttgaagtggcgtctccaatcacctttactccttctctattccactgccatgatcttaaagaagcaaaggactccattgatgaagaagatccaaggcctacaagctccacatggagctacatcactcttcttaggggaatagaacaccaaatagacattagtatggactttttcctcgggctttctagaaccaaaagaggtctaaactttatttttgtggtggtggataggtttagcaagatggcacactttataccatgccacaaggtagaagatgcttcttacatctcaaaactcttcttcagggatgttgtgagactccatggtttgactaggatcattgtgtcagatagagatgctaaagaacttagccacttctggaaaaccttatga

SEQ ID NO: 738 - DNA, 256 bp, Glycine max
  Peptide Sequence Number=SeqID_117516
atgggtgatgaggttgaacagggatgggatgggaccgtcgaaacggttgcatttaaggctgaggctgtggagctgggtgagggaggtgaggtggagaatggagttggtgaggttgaggtcttcaaggatgaggcaggaaacatggtggtggttgtggttgtagaagtgggagacattgtgtcggggttgttggcggtgcagcggacgacatgcttcttaggtttcatctcccttaaggtgttggtgttggctaatg

SEQ ID NO: 739 - DNA, 682 bp, Glycine max
  Peptide Sequence Number=SeqID_117517
gatttgtgatgaaatcactcttattttgcaccacaatggtaaattgatacaaaatgcaaacgaggcactagatggtttacaaaggctagaaaatgactatgatgtgttatctctctgcaaaattgggcttgctaatccaaaaaaaaaagtgcatgtatacttagaacatgttgagccagaggggggtctggttattgaaattgggctagagattgaaatagatgtgttgcctctaaattgcaatgcagagaaagtggttgttcttgaggactctactcagaatgttattgaagatatggatgttgatggtgctaacaatgtgggtaaaggtggtctagatggtgaaactggagttgttggagttgaaactcaagttgatgtgcaagatgctaaaactaaagttgttggagttgaaactcaagttaataatggtgtagatgatgatgaagttaaagaacatgataaggatgctaactttttttatcattctgaaagtgacctagactatatgcttgcaatcaaggattcaaggttggttgcaaaccttttattggtcttgatggttgtttttttgaaaggctactatggcggtcatttgcttgcagcaatgggacaagatgcaaataatgtaatttttgtgattgcatatgcaatagtaaatgctgaagatgaagataactag

SEQ ID NO: 740 - DNA, 1413 bp, Glycine max
  Peptide Sequence Number=SeqID_117518
atgattggttctgctcattttgattgtttaggtaggcggttgggaccgaggcttcttggtagggttgacgattcagggagactggttagagatttttacaagatccttaacgaagtgaaggctggggaaattccacctgatctaaagctgccggattcttttgatcaactggtttctgatatgaagaacaatcagtatgatgcaaaaacttttgcattcatgctaaggggaatgatggaaaaacttgagagagaaatcagagagtctaaatttgcagagctgatgaataaacacttcgcagcaagttctatccctaaagggattcattgtctgtctttacgtctgactgatgaatattcatcaaatgcccatgcacgcaaacaattgcctcctcccgagttacttcctttactgtctgacaactcttaccaccattttattctgtcaactgataacatattggctgcttcagtagttgttgcttcaactgtccagtcatctctgaaacctgagaagattgtcttccatgtgatcacggataaaaaaacatatgcgggtatgcactcatggtttgcactgaatccagtcacccctgccatagttgaaataaaaagcattcaccaatttgactggttgactagagagaatgtcccagtgcttgaagccgtagaaaatcaaaatgggattaggaattactaccatgggaatcatattgcaggaaccaatctcagtgacaccagtccacgtaaatttgcatctaaattgcaggccagaagtccaaaatacatatctttactcaaccatctccgcatatacttaccagagcttttcccaaaccttgacaaggtggtttttttggatgatgatgtggtgattcagcgtgacttgtctccactttgggaaattgatctggaaggaaaagttaatggagctgtggaaacttgcagaggtgaagatgagtgggtaatgtctaagcgttttaggaactacttcaatttttcccatcctctcattgcaagaaatttggaccctgatgagtgtgcatgggcttatggaatgaatatctttgatctgcatgcatggagaagaactaatataagagagatatatcattcttggctgaaagagaatctgaagtcaaatctgacaatgtggaagcttggaaccctgcctcctgctttgattgcatttaaaggacttgttcatccgattgatccctcttggcacatgcttggattgggttatcagaataataccaatattgagagtgtgaaaaaggctgctgttattcactacaatggccagtcaaaaccttggttgcaaattggctttgaacatcttcggccattttggaccaagtatgtcaattattctaatgattttttgaggaactgtaacatcctggaatcatag

SEQ ID NO: 741 - DNA, 375 bp, Glycine max
  Peptide Sequence Number=SeqID_117519
atggttttcttgaccagacatgaagagtctataaaaattcaaaggactaaccgcctgagaattctttgtcctaacacattggagggtacaacctttgtggcacaagtagaggatacatctacttgggttgttatactgagaacaagagagggtacatctcttgtggatcagttcaagtggagggtacatccagttggttgttcaaagagaacaagggagggtacatcccttgttgatctttggcttgtaaaggattttacaaggttgaaagaaatctcaagaaccgttggttccttgggaactggatgtaggcatgggttgttgtcgaaccagtataaatcttgtgtttgtcttcttcttccctacactctttaa

SEQ ID NO: 742 - DNA, 249 bp, Glycine max
  Peptide Sequence Number=SeqID_117520
atggggctcgtgattagatttgaggttggaggatggatgaaaagcgctaggcaatttatttctggggctccatactcgatggtacaacgcttggcaatcaattcgtggggctccagactcggtggtggaggatgcatgaatgataatcaattcatggggctcgggctaagatttgtgggtggaggatacacgaacagcgctagggaatcagttcgtggggctccagaatcgatggtggaggatgcatga

SEQ ID NO: 743 - DNA, 1081 bp, Glycine max
  Peptide Sequence Number=SeqID_117521
atgacaacatcacctgcaacccatccgtggctgatccgcctcggcattccgcccgcgctggcctggggctatctggcggtcctgctgtttatgattggcgacggcgtcgagtccaactatctcgcgccctatctgcacgaaaacggcttttccctgaatatcgctgcatgggtaatcgccttttacggcgtcaccgtcacgctgggctcatggctggccggttcgctgtcaacgctgattggcccgcgtaaagtgatgctggcgggcggcctgatctggattgtgtttgaagtgctgttcctggccgtggcgctgccgtcgcacagcgtgctgctgctggcactaacctatggcctgcgcggcgtggcttatccgatgtttgcctacgcctttctggtgtggattcaatcggcggccccggcggagatgcgcggctccgccaccggctggttctggctggcgtttaccggcgggctgccgacgctcggttcgctggtagcgatcttctctatccgcctggtgggcgaatacgccaccttctggctgtcgctgggtctggtggcgatcggtttgctggtgatgctgctggcgctgaaagagcgcagcggttatcagtcgctgctggatgccgaacatcgtcagcagggcacgctgcgcacgctaatgggcggcatcgatattctgtggcgtgagccgcgcatcgctgccgcggcagtggtgcgcatcatcaacaccacgccctacttcggcttctttatttttctgccgggctttttcaccgaacagattggcttttcccagaccgaatacctcagcctaatcaccatcatgggactggtgggcatgagctttaatcccatcgtcggcaagctgagcgaccgcatcggctggcgcaaagtgctgacggtgttcggcggcctcggttccggcgtctcgatgctgctgatgtactttgtgccgcagtggagccacggcagctttgtgctcagcgtcatctgcgcctgcctgtacggcatcacactgtgcggctacgtgcccgccgccgcactgttctcctcgctgtgccaaccgaaggacaaag

SEQ ID NO: 744 - DNA, 279 bp, Glycine max
  Peptide Sequence Number=SeqID_117522
atgggatttttggtccctgtctttgtacctatttcgcaaattagtccctatctttttgaaatcaaattagtcccaaatgacgctgtgtattgcttttgcagcattctttcagtctcttcttcttctcatacattcaaaggtggagtagttgaagccgctggtggggagggagctagaaattgcaatggcaactcgaaggctgcagcattcaaaggtggatcagttgaagacgcggttacagcattctttcagtctcttcttcttctcatccagttttaa

SEQ ID NO: 745 - DNA, 1359 bp, Glycine max
  Peptide Sequence Number=SeqID_117523
atgcgtatgtccgtgaaagatatgttgttagccctgtgcgtcgtggtggcgtggggcgtaaattttgtggtgattaagctgggtttgcagggcatgccgccctttttgctggcgggactgcgttttacgctggtggcgtttccggcgatctttttcgtgcgtcgtccggcaattccgctgcgctggctggtggtgtatggcatgaccatcagctttggtcagttcgcgtttcttttcctcgccatcaagcttggcatgccagccgggctggcttcgctggtgctgcaggcgcaggcatttttcaccctgctgctcggtgcgctgctgctggccgagaagctgcgctggaaccacatcgccggcattctggtcgccacgctcggcatgtttatgctggcaaccgccggtatggagggccagacaaccgcgggcatcacgctgaccaccatgatgctgacgctggcggcggcgctgtcgtgggggctgggcaatatcactaacaagattatcctgcgcaaccgcaaggtgccggtgatgtcgctggtggtgtggagcgcgctggtgccgattgcaccgttctttgcctgttcgtggtggttcgagggcgaatccgccattgtcaccagcctgctggatatttcgctgcagacggtgctggcactgctctatctggcgtttttcgccaccatcattggctacgccatctggggcaatctgctcagccgctacgaaacctggcgcgtggcgccgctgtcgctgctggtgccggtggtcggtattctcagcgccgcgctgatcctcggcgaaactctgtcggcacaggagattctcggcgcgtcggtgatcattctcgggctgctggtgaatgtgtttggcggtatggtgagccagcgcctgctggatttcaatccggcgtggtttcgcctcttccgggacgatgcgttccagatcgatactcagcaggcccagttcgagacgcgcatcgcgcaccacgatgtgatcggccagctggaatttgcgttcgaagttacgttctgcgatgccctgcatgttgtcatgggcggtgatatccagttcgctctgcgcaaagccggcgacggcaatggtgatgcgatagtggttttcgtctaccagctcgacgttgtacggagggtagccgccgttagcctggttttggttggactcaagcaggttaaacagacggtcgaaaccaatagcagaacgataaagcggagagagatcaaagttacgcataataagactcctgataatcagcaagttttggcaaccttccaccatggacaggttgtccggcccgtcggtgtccctgtcggcgaccgcgtcgtgaccgtagcttaa

SEQ ID NO: 746 - DNA, 555 bp, Glycine max
  Peptide Sequence Number=SeqID_117524
ccagcggacagtgtacgcgccttacagcgcgcagcgcgcaaccgccgggcggcgacgcggtggtgtggtcgccggacgggaagcagatcgcctacatgcgcgaggttgacggctggcgacagctgttctgcgtcagtgcgattccgccggcatagccgccgcagtggccaggctggcctgggtgccagccatcttctcgctctgcagcacgcgttcgcgcggcgaatctttggttttatcgtcgtcggcgcggaagtaatcccacggcagcagcagcgtatccatcaccgccgagaagggcagatcgatcagcgccagcggtttaatcgcccagctggtattgtcatcggtcagcatctctgcgctggcgcgcgtgccggggtagtaaccctggctggcaccggtatgcgacatcacgctggagcagcctgctgtggcacaggcgcagcagaccagcaggccagtgagcggaaagcgtttcatcattttcatcatcatcatccctacagtcatggcatggccctggctggagtgtgtcacctgacatccgcataa

SEQ ID NO: 747 - DNA, 762 bp, Glycine max
  Peptide Sequence Number=SeqID_117525
atgttcgtcgaaagcacctggctggatgacatcgtcaccgcgcgcgtgccgctgctggtgctgcgcaatttcctcacgccagaggtgcgcaatgcggtggtggctgatctgcagcagtgccgcgagcaggtacgggtttctcactatccaaatggcgcgctgaccacgctcggcccgtatctggcgaagcacaccgccgcgccggaaaactatttcaccgaactgcgcgacatccagccggcgctgcctgcctcgctgcacgccctgcgcgcgcagatttaccactgggtgcaacatgcgctgcgccttgagagtctgcaaaccgccaccgaaccggcactgggtgattacgccggctcgattgtgcgtttccacgctgacggcgtcgctaatccgctgcataacgacaacatcgtgcgcgatgccgctggcagcggtctggcggtgacgcacattctgcatcagctgagctgcgtggtgtgcctgcaggagtgcaacgctggcggcgcgctgcgcatcttcaataagaaatggcagccggaagacgagcgctttaaaacgcccggcgagctgggctaccagagcggcgtcatcgccggcagcgagacctgcgagttcgcgccgcgcagtggcgatatctatctgtttaatcccgcgttttatcatgaaatcgatcgcgtagagggcgacacgcgcatcaccatgggctttttcttcggcctgaccgacaaaaaaatgaagcacgccattgcctggagttaa

SEQ ID NO: 748 - DNA, 423 bp, Glycine max
  Peptide Sequence Number=SeqID_117526
atggcgatcgaagggacgaatctgcagcccgtcggtcaccaggcactcggtgaacgcgtcgtcatggatacgcagcgcacgatagacgcgatcgatgttttccatcacgctatcgttcatggcggcatggcggttagtgctgatgcgcagctgaaacgccaccatatagctgctgtctttgccgccgccataggccagcaggacgcggttacgttcgggatggtcgggatcgggcagggcggcgagcagtcgctgagcacagtgctgggcggaatcgagaatcgcgggcgtcaggtattcttcaatttcactcatcatcgcggacagattattcatttttcacttcatcctttggctaataaaatcgccgctgccgtgcgggcgacaacgggctggaaaacgggccacgaaggtgctgcgtga

SEQ ID NO: 749 - DNA, 1263 bp, Glycine max
  Peptide Sequence Number=SeqID_117527
atgaagccgagcgcgattctgatcaacgccggacgcggtccggtggtcgatgagcaggcgctgaccgccgcactgaaagacggcactattcacgccgccgggctggatgtgtttgaagtcgagccggtgccggccgatgcggaaatcctcacgctgccgaacgtggtcgcgctgccgcacatcggctccgccacgcatgaaacgcgctacggcatggcgcgcgatgcggtcgacaacctgatcgccgcactgagcggtaaagtggagaaaaactgcgttaacccgcagttcggcgacaaatttacgcaacattccggcatctctcgtctgatggaagatatgggcgaagggctgcgcacgcctggcacgatcatgctgggcggcggtaatccggcgcagattccggccatcaatgattatttcagtcagctgctgctgcagatgcatcaggacggcaagctgaacgaagcgctgtgcaactacgacggcccgcgcggcaaagcgctgctgctggaggcgctggctacgctgctgcgcgaggagctcggctggccggaggatctgttcatctccgccaaacccaatattgaactgctgccggaaggccagttcaaataccacgtcgacttcgaccatctgccgctgaatgatgagactggcctgatttgcgtgtcgcgtccgaccaatccaaccggcaacgtcatcaccgatgacgaactgctgcagctggatgcgctggcacagcagcacggcgtcccgctgctgatcgataacgcctacggcgtgccgttccccggcatcatcttcagtgaggcacgtccgctgtggaaccccaacaccattctgtgcatgagtctgtcgaagctgggcctgccgggcgcacgttgcgggattatcgttgccgatgagagcacgatcagtgccattggtaacatgaacggtattatcagtctggcgccaggcagcatcggtccggcgattgccaccgagatgattgtgcgtggcgatctactgcgcctgtcgcaggaagtgattaaaccgttctatcaggccaagcgaagatcgctgcctgatccacaaaccggaaggcgccatcttcctgtggctgtggttccgcgacctgccgatcagcaccgaagcgctgtatcagcgtctgaaagcgcgcggcgtgctgatggtgccgggccacttcttcttcccggggctggaacaggcctggccgcacacccatcagtgcatgcgcatgaattacgtaccggatag

SEQ ID NO: 750 - DNA, 1446 bp, Glycine max
  Peptide Sequence Number=SeqID_117528
atggcgggtgaaacgcaggaacaggagagtcagagcagtcgttaccgtcagatcgctgagcagataaaacaggccattcacagcggatcgctgccgcccgacagccgtttgccgtcggtgcgcacgctggcgacgcagtatcgcgtcagcatgaccactgcgctgaaaacattacgcacgctggaggatgagcactacgcagtggcgcggccgaagtctggcttttttgtcgcaccgcgtcccacagagaaaaaagtgccggcggtattcagcgagcagccgcgcgaagtggcgccgctggatgagcaaaccgaactgcacctggcgatgctgggatcggactgccgcgtgcggctcgatctggccaacggcgacatctcgctctatccggtgaaaaaaattggtctgctgatgcggcagatgggttacagcaaaccggcgctgctcggtaatacggtgaaaggcaccggctatgcgccgctcaaggcggaaattgcccggcgcgcggtggattatggctgcaatatcagcgccgatgacatcctggtcactaacggctgcattgaggcgatttcgctggcgctgcgagccaccacgcggccgggcgatatcgtggcggtggagtcgccatgctacttcgtgctgctacagatgttgcacaacctcaacctgcgcgtcattgaagtggaagccgggccggagggttacgttaatgtcgcgaaactcaccgggctgttccggcgtaaagcggtgcaggcctatctcaccatcaacaacatcaataatccgctgggcaaaagcatccccaacgagcacaaggcgtatatcgcgcgccaggccgatgagaatgatgtggtgatcattgaggacgatatctttggcgatacggctttcggcgagcgccggccgtttccgatgcgcgccttcagccccaatgccatcctgtgcagcggcttttccaaaaccgtggcgcccggcatccgtattggctgggtgcacagcaccaagtacatgcgcaaaatcgcctcgctgaagtacaccaccagcatgggcacgtcggtgctgtcgcaggcggcgattgccgaactgctgcgcagcggcggttacgatgcgcacctgcgcaagctgcggcgcgagctgaaaaatcagattcaccatatgcgccaggcggtgctgcgctacttcccggcgggcacgcgtgtgtcggagccggagggcggttacgtgctgtgggtggagatgccgcaacaggcgctgaacgtgcgcgcgctgtttctcaaggcgcgcaacgcgggcatcggcatcgcgcccgggcacatcttcgccaccgatcaccgctacgatcactgcttccggctcaacgccggttttggctggaatgctgaagtcgaacaggcgattcagcagctggcgcagtggtgccagctgtcgttaagcgcggattaa

SEQ ID NO: 751 - DNA, 1077 bp, Glycine max
  Peptide Sequence Number=SeqID_117529
atgccgcagagcgtgcgtcagcagaaccgcgacgatgtgctgatgaatggtcaccgcttccgtgccgacgcgcgctccaccttctgcaacgcctgcaacctgagcatggtgaattcgtttggcctggcggcgcactacgatggtggcgtcgatgtgatcatcaccggcgattcgccgcaggaacagaccgcttaccttgcgtgggcgcgccacctgtcaaaactgtttgatgcgccgatggccgataagtcgcgcggcttcagcggctttctgcacacgctggacggcgtggcggcgcgctacttcgccgacatttacggcgctgaccaggtcacgccggcacatcgcattacctggcagctggcgcgcgacccgctgttcttcaacatctatcaggacaccgcttatgaggctggcgcgcactgggcgctgctgaccgaattcatgcatttccgcttcgatgagctgatgttcagcttctccgagtcggactgcggcaacccgacgttaatggcacatattcgcggtctgcgtgcggagacgctgttgcagcgcagctacgccgaaggcattcgcgaatatgtgcgctttgcgctcggcctgatggtgcagaaggactttccgccgcagctgatcgatgagatggccgcgcgctatcaggatgatgccgcgattgcccgcgcacgtcagcgcgccgcgcagttcgcactcgacgctttcggcctcagtgaaacccagctggtatgcatgatctattcaccgtttatcgccgccggccagcagctgaaagcctggctgctgcagttgccggccgcgccggaagaagccgcggtgcgcgccttgctgagcggagagagcgaggatgtggcgctggcgcagcagctcacgcagctgtctggcctcagcgtggcgcagatgcggcactgctggcgcagcgcggcggtgagttcgctgctggacggcgcgcgcggcgatgcgctgtcgcgcgtgttgcgtttcgacccgcacaaagcggtgattcaggttaacaacggtgcgttacaggacatcgttactgaagtgatttccgggcgttaa

SEQ ID NO: 752 - DNA, 210 bp, Glycine max
  Peptide Sequence Number=SeqID_117530
atgcccctatcccgccagctccaaaggcgggactgcccacgtaggcatgtcccgccaggagaaatggcggtacacgttttgccccttacctgtcccgctgttgcgactggcggtatccactatcccgccattggcactggtggttcaagcttcccgccagtgtcaatggcgaaacagattcctagagttggaggactaggggcctcctaa

SEQ ID NO: 753 - DNA, 222 bp, Glycine max
  Peptide Sequence Number=SeqID_117531
atggtggtgagcttcttcttgactcatcttctccttaaagtagcgtctccgatcatctctttcttccttcttcatttcgctgtcattcatcttcaagaagcaaaggactccattgatgaagaggatccaaggcttacaagctccaatggagctacatcatgtggtattagagcatcttcatctaggttctatcatttttcagtcataatcttcttgtactga

SEQ ID NO: 754 - DNA, 285 bp, Glycine max
  Peptide Sequence Number=SeqID_117532
atgaaaggtgaggaaaaagcacaacaatgggaagagtacttacaacaagatatgcaacaagaaagtatgctccaaatcaatacccttcctcatcaattgattgtcaagaagcaaaggcaaggagagcaaaagagagcattaagtgtctttctcttccggatcaccaacccctctcctataatgagttggcacacacttccaaaatacgtcaagttcatggaattcctagctaaaaggtggaactgtaaggatgatgtgttctttgtgaccttcatgccaccttga

SEQ ID NO: 755 - DNA, 933 bp, Glycine max
  Peptide Sequence Number=SeqID_117533
atggaggggtctcacatggggttgttgctcttcttttcttccatgctttttgctgccttcccttctgcctcctccagaaacttgcccgtcataccctttgatgaaggctacgcgcccttgtttggggacagcaacttggtcatccatagggatggcaaatcggtccatctttcactcgatgagagaacaggttcaggatttgtgtcgcatgatctttaccttcacgggtatttcagcgcttctattaagttgccttctgattacactgcaggagttgttgttgccttctatatgtcaaatggtgacatgttccagaataaccatgatgaaatcgactttgagtttttggggaacattagaggcaaagactggaggattcagaccaatgtttatggcaatggtagcaccaacattggcagagaggaaagatatggtctctggtttgaccctgcagatgatttccatcagtacactattgtctggacagactctcagatcatattttatgtggacaatgttcctattagagaagtgacgcgaacagaatctatgggaggagatttcccttctaagccaatgactttgtatgcaacaatatgggatgcatctgattgggctaccaatggaggcaaatacagggttaactacaagtatgcaccctatgttgctgaattctctgaccttgtccctgcacggttgtgcacacaaagaatcaaaatggagaatttcaggaagaagcacatgacatactcctactgctatgacaaagtcagatacaaagtccctccttcagagtgtgtcatcaattcccaagaagctgagaggctgaggaggtttgatcccgtcacgttcggtggtggccgccgtcaccatggaaaacgacaccgtcgcagcagaggaagccagacagaaacttctgcttcatcattttaa

SEQ ID NO: 756 - DNA, 553 bp, Glycine max
  Peptide Sequence Number=SeqID_117534
cccgaaatggatggcgctaaagcgcgcgacctataccggccgtcggggcaaggaccaagcccgatgagtaggagggcgcggcggtcgctgcaaaaccagggcgcgagcccgggcggagcggtcgtcggtgcagatcttggtggtagtagcaaatattcaaatgagaactttgaaaggccgaagaggggaaagggaatcgggttaaaattcctgaaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccggtcgggggacggattgggaacgggccttcggggcctcttccccgggcgtcgaacagtcaactcagaactg

SEQ ID NO: 757 - DNA, 300 bp, Glycine max
  Peptide Sequence Number=SeqID_117535
atggggatcttcactcactggatcccaagatgcatgattctgtggaaatctcgagggtcatcaatcttggccgttcatcttcaaacaaaaatcttctctctgaagattgtgcatgcagaagtctcagttcttgaagataaagccaaacaaagggtcttaagggcatgtttggctgagggggtccaaccaacacgcatatccgccacgtcatcaggtcactctcgcggatcgcggcatctttatagctattattatatttgtggtttcatttattcccatccattcaagacaaatctataa

SEQ ID NO: 758 - DNA, 153 bp, Glycine max
  Peptide Sequence Number=SeqID_117536
atggtggggggtggcaattccaaatccgatatctcctttgctggcacttacgctagcagtgctttcgctgcatgtttcgccgagacccgttatttgttgttacgtatagtaacgggtccaactacagtgttcactgcaatggactttgtttga

SEQ ID NO: 759 - DNA, 102 bp, Glycine max
  Peptide Sequence Number=SeqID_117537
atgattatgatgttcgaagtcgacaaaacctggaggctggcaatacgtgaaattctgcaacattctggaagtcgaaaggaagcattgttgcgcaatccataa

SEQ ID NO: 760 - DNA, 336 bp, Glycine max
  Peptide Sequence Number=SeqID_117538
atgtccattatgggagagttgaacttcttccttggacttcaagtcaaacaaatagaacatggaaccttcctatatcaaaccaaatactgtgcagaactaattaagaaatttagcatggaagagtgcaaagaaacatcaacaccaatgtcaacatccacttatcttgacttagatgaaaaaggatgcaagctagataggaaaagcacaagcgagacatgccatctcttagccagctctcttgtatcttggaattgtaagaaagaagcttgtgtagcactatccactgtagaagcagaatacattgcaactggaagttgttgtgctcaaagtctctag

SEQ ID NO: 761 - DNA, 636 bp, Glycine max
  Peptide Sequence Number=SeqID_117539
atgattgttctgattggctcgcaaaaaggcggcgtcggcaaatcgacgaaagcggtgaatatcgccgggtatctgattcttaagcaaggcaagacggcgatcatcgtcgatgccgacgaccagaaatcgatcatgacctggtacaacgaccgtcagaacgtcgaggggctgccgcacattccggtggtggccgcgtcgggcaaaatcaaggaaacgctgctggagctggatcgccattacgactacgtaatcgtcgacaccgccggccgcgacagcgccgaactgcgctccgggctgctggccgccgatctgttcctctcgccgctgcgcccttcgcagatggatctcgacaccatcggctatctgtcggagatgttctccaccgcgcaggaatacaacgagaaggtcaaaggctacatcgtgctgaacatgtgcccgaccaatatctttatcaacgaagccaacgaagcggcgcaggtgctgagcgaatacccggagtttacgctggtgagtaaccgcctgtgcgaccgcaagatttaccgcgacgcctggggcgaagccatcaccgtgcatgaggcgaacaacgaaaaggcgcagagcgaaattgaatgcctggtgaaagaggtgatcctgtga

SEQ ID NO: 762 - DNA, 288 bp, Glycine max
  Peptide Sequence Number=SeqID_117540
atgggaaagctaactggttgccatgaattgcatgatgatggtggcctcataatcgagtatgtcatctgcattaagccaggcattgaaaatttagaagatgaaatgttgtggttgaaggtaaaggtatggcgaaaagatggtgagatgaagtttgcaggggaacataggctttttgggaacggtgcaaactcagtggttgcctctaaagcgccaaaattagtgggtatatcagcagttgtgaagggtttgtatgattggactttagtggtagaggttgatgattatcac

SEQ ID NO: 763 - DNA, 690 bp, Glycine max
  Peptide Sequence Number=SeqID_117541
atggtagccatgacttaccaaacctcccatgaatgttcagaagaaaccattatagatatcttagtggcaggattttctggacaactgaaaggatggtgggataattatctcactaacgaagaaaagtcaaaaatttacagtgcagttaagacggatctcaatggaaaagtcattactaatgacgatgataaagagattcctgacgctgttaacacattaatttttacaatagcccaacatttcattggagacccatccttgtggaaagataggtctgcagaattattatcaaatcttaagtgtagaaccttagcatattttaggtggtacagagatactttcctaactagggtttacacaagagaagatagtcaacaacctttttggaaagaaaaatttctagccggtcttcccagatcattaggagacaaggttagagataaaatccgaagtcaatctgccaatggagatattccatatgaaagtttaagttatggccaattaatttcttacgttcaaaaggtagtcttaaaaatttgtcaggatgacaaaattcagaggcaattagccaaagaaaaggctcaaacaaagaaagatttaggttctttctgcgaacaatttggtctacctgcctgtccaaagcaaaagaaaaaacaatcttcaagaaaagaaattcatgagaataaaccg

SEQ ID NO: 764 - DNA, 330 bp, Glycine max
  Peptide Sequence Number=SeqID_117542
atgctagccgacgtcggccaggaaaagatgacagatcgaggtcttaaaaagaagcatgaccggatgactccgatcgaacatttccaaatcgacatcgtccaagtattattcaggggtggaatagaaaaaacagtagccagcatcggtagtgaaacagccccaactgatgtttttcagccgacattgcgcaatttttttacaagcgctggccgacaacgttttttcaccgttcggctaggtttcttcgtgcgagctcaaccgaagttgtatttcggccgaagccggcattttgtcggtcaggaaaactttagcccacctcggccaatgtaa

SEQ ID NO: 765 - DNA, 312 bp, Glycine max
  Peptide Sequence Number=SeqID_117543
atgagtatcaagcatcaagtatgggtccccaatcaccctcttccaaaaatatttgaaaggtcttccaaagttacatgcgaattagaaaccaatacagtttcacctattattgacatttcactgagtcgaaagagtttccctaaagagttcatctttggggtgggatcttcctcgtaccagttcgaaggtgcagcaaaggaaggtggcagagaagcaagtgtatgggataccttcacccataattatccaggaaaggtcatggaaagaagcaacggagacatggccattgatatttgtaagaaaataaaatga

SEQ ID NO: 766 - DNA, 279 bp, Glycine max
  Peptide Sequence Number=SeqID_117544
atgagatactctcagtttaaatttcatgagccatattcaaaatttgtgacaacctatttctcgctattccaccagttatctgctagtactcaaaagcttgaagagttggctcttaagcaatctaggttattaatccccgtgacaccatccacaccaagatccctgatgatgtcattcttctctttactttgtaaggggaagtatgtgacaccagatacaacaggcttttacaactatcgtgaagttatgaaattgatagttgtagtctacatgacctaa

SEQ ID NO: 767 - DNA, 158 bp, Glycine max
  Peptide Sequence Number=SeqID_117545
atggagaaaaaggaatcttatgaagataatacaaatggaggcttcaatcccttctccgtctctccgacgtttgggaactctatcggagcagtcgaaggaaaaaactggaggaatctcaaggaaccgctagagatgctgctatcgctggccgaagacac

SEQ ID NO: 768 - DNA, 135 bp, Glycine max
  Peptide Sequence Number=SeqID_117546
atggttgcgcttctcgaggcacaccaaaccctactgtcgccagagaaaaatggcagcggacgacggcggcgtagacaacggcatgggggtgaacctggctctgatgccaagttgaagctagagatatttaagtga

SEQ ID NO: 769 - DNA, 534 bp, Glycine max
  Peptide Sequence Number=SeqID_117547
atgtttaactcaagaactttagttgttgaagaatctaatcgtgttaagttaaatgatggtcaaacaactagtagtaagctatcagatcttgaggatgattctctagatatgcacattggtctatctgttgcactcaagattagagattcatctagccaaaaacttcaaatggaggacttgaaatttattaagtgccaccctcaagatcagatcattggagatcagattgacaaaaggaagaactccaccagaaatgatgtctggacacttgttcctaagcctaagaacaaaatcatcattagaacaagatgggtattcagaagtaaggtggacgaacaaggtaaagtagtaagaaacaaggctaggttggtagcttatggctataaccagcaagaaggtgatattatatttggagctactaacgaatctctatgtaaggatttctcttatatgatgaaatgtgagtttgaaatgagcatggtcggagaacttaagttccaaagaagttcaagatggaaggtgccaaaccaatga

SEQ ID NO: 770 - DNA, 384 bp, Glycine max
  Peptide Sequence Number=SeqID_117548
atggtttgcccatggactagggagtttcatgttgtttctgatcgctccttctcctttgtgatgttctatccttactccagattcactttcactcatcatgtgaaacccatcattcaagaagtggattttgatgttgacactacaattgatcctgatgctttagctattgaagtatatgatcctccacccttaagggagtatgttcatttggtagaggttgagctattaaataagagggaagcactttctcaagctttggaagatcgtgcttatgttgagaaagaggctagaaagtgtgatgagtttctaaggaagcttgatgaagaagttgccaacaaaaaaaggagagaaaaagtaaaagctaaagctaacaacatcatatga

SEQ ID NO: 771 - DNA, 897 bp, Glycine max
  Peptide Sequence Number=SeqID_117549
atgatgagagctgagatggatgaattggatagagtccaatttgtagtagaacttacaattgagatcctgtctatagatgatgctaaaagacaagaaaagatggaagccatcattgttcttgaagacatggatcttgcagagaagggagatcttgaagaggcaatgcttcagtctgttattgaagcctctcttgcaaaaataaaagatgacattgttgaaacagacactggaactgtactagttcgcccaaggctagtgtttgatgctaatgaacaactcattgatgttgttcagtctaataaaatagatggcaacatacatagacacttagaggagatatatagagcaccaaaatctgtctctatagaggtcatgattgagcatttggagcaaaggaagatcatgccatctattcagaaggaaccagatgtcactattcaccccagtcttaacataagactgtataatgggttaagaggctacatagtcttaaagtggcaaacttgcaacaaagtttggaaggagaaagatgatattggctctcatattcttcacccagagatgcaacaattggagcttgataagctcaatctcaccaagctatggaaggaaggattccttcaactatccttcattggaaactctggagaagcaaacaagcagagcttttttgggatgcccttctccactccactagatcttcaacaactcttaggtctaatgtggatgatgaatatggtgtttccacgggatcgtacatcctcatgtgagacctttcaaactaaggacatcaccttagaagaacctgaagccaacccaagtttccaagattgggagaaatcaaattatgaccttaagctcagaatgaagttgtctgcctatagagaagagatctaa

SEQ ID NO: 772 - DNA, 555 bp, Glycine max
  Peptide Sequence Number=SeqID_117550
atgttaacatctaacatgatcaagcaactaaagacacttattccctcaaattcccaaaattttgtatccctgaaaggaactaaatggagaccattaaacgaaattgagttgaagtatgaaagagatactaaaaagcagagaaactcaccaattgaggcccaggaaactgaccattcaccttcaagaggcatagaacatcaagttgatctcctcctcggagcttcattgcctaacaagccaacttacaaaagcaatccccaaaagactcaacgtaaggatgcacatgccaaagttgagtttgtgaaaagattgtatgaccaagtgaaggtgcaaattgcaaagaagaatgaaagcaatgccaagcaagccaacaagaaaaggaaggaagtggtacttgaacccggtgatgatcctggacatttgaggacaaatgttttccaagaaggagggaatgatgagaatcatgaaactggccaaatacaggctaaaggcccaagtggagaaggacaaaggcctaagtggagaaggacaaagcccccgagtggagaaggatga

SEQ ID NO: 773 - DNA, 1401 bp, Glycine max
  Peptide Sequence Number=SeqID_117551
atggaaaggaatggtatcaagcaaaggaaaaactcttggcaagatggggtattgggaacaaattgcccaattcgtccaaactcaaattacacatacaagtttcaggcaaaggatcagattggaacctacacatactttccatcaacttcactgcataaagcagctggagggtttggaggactccatgtctaccatagatctgtcatcccagttccttatccataccctgatggagatttcactttactcattggtgattggtacaaaaccaaccacaaggtattaagggagtctttggattctggaaaatctcttgcctttcctgatggtctccttatcaatggccaggctcatactaccataaatggggaccagggtcagtctttcaaaaatgatatatataatccaacctccttttgcaatttccaagtgatcaatttcaactttatcaaatttgtttctccaaacactattcatgctttagccttttcactttcaggaaagacctatatgttcaggatctcaaatgtgggcctgtcaacatcaatcaacttcagaatccagggtcataccctgaagctagttgagattgaaggatcacacattgtccagaacacgtacgacacccttgatgtgcatgttgggcaatcagctgctatgttggtaaccttaaatcagcctccaaaggactactacattgttgcctcaacaaggttttccagaaaagtacgcgtagcaactgcagtgttgcattattcaaactctaaatccccagcttctggacctttgcctagttcccctatttaccaatatcactggtctgtgaagcaagctagaacctacagatggaatctgacagcaaatgctgcaaggcctaatccacaagggtcataccattatggaaaaataactcctacaaagacaattgtgttgtccaattcagcacctttgattaatggaaaactttgttatgctgtcaacaaggtttcctatgttaaccctgatacccctctcaagcttgctgattacttcaacattcccggaatctacagtgttgattcaatccaaagcattccttctgataatactcccacatccatagccacctccgtagtgccaacttctctccatgatttcattgaggtcatttttcagaacaacgaaaacaccatgcaatcttggcatcttgacggttatgacttctgggtcgtgggttatggttttggccagtggaccccagccaaaagaagaacctataatctagttgatgccctgaccaggcacactgctcaggtatacccaaatggttggactacaatactggtgtccttggacaaccaaggtatatggaatttgaggtctgcaatatgggaaaggcagtatcttgggcagcagatataa

SEQ ID NO: 774 - DNA, 384 bp, Glycine max
  Peptide Sequence Number=SeqID_117552
atggagaattggcgaacagcgctaggcaatcgattcgcggggctccagactcgttggtggaggatgcatgaacgacaatcaattcatggggctccgaataaaagtggagaatggagaattgcactaggcaatcactttgcgtggctccagactcattggtggaggatgcataaacgacaatcaattcatggggctccgaataaaagtggagaatggagaattgcgctaggcaatcacttcgcgtggctccagacacattggtggaggatgcatgaacgacaatcaattcatggggctccgaataaaatttgttggcagaaccgattggtccaccgggttttttccacctataaaggcaaacatgctttttgcaaagaaaaataa

SEQ ID NO: 775 - DNA, 297 bp, Glycine max
  Peptide Sequence Number=SeqID_117553
atggtgtggtgtctcctctctcttcctttctccattccgctaccattcatcttccaagaagcaaaggaatccattgatgaagaagatcctatgcctacaagctccaatggaatggactgtgaggttaaaaagaggctaagtcatgaagtgctaaaagtgacagttgagctcagctcatcaattgggctaagcgagcatccatcgctaagcgtaacttcagcgtgcttagcgcgacagaaaaatctggcaaagcatcaatatcaaggttgcgcgctaagcgcgagatcagtgcgttaa

SEQ ID NO: 776 - DNA, 477 bp, Glycine max
  Peptide Sequence Number=SeqID_117554
atggatgagaccgcaggaacatcagaggatgaattaagttgggagaaggtggaagcagttgaaggtcaccaatcttttggcccacgtccaggtgatcaagagcttaaagaaatgcttcttcataagtatggtgattaccttagcagcttgagaaaggaatttctaaagaaaaggaaaaagggtaagctaccaaaggatgcaaggatgatactcatggactggtggaacacacactataggtgtctttatcctacgcaaaaagcatctattcatatgaatgtaatcatggagggaaaattagccagtgagctagaaattgctgtgaggagaccttcgaagaactcggatcaaggaatgagcgagttcgtaaatgaattatcagaaattctatgcgtatggacaatcaaagcttgctacattttacatgccaatgaactagcaagacgtcttaagttggttattgatagctacaattga

SEQ ID NO: 777 - DNA, 741 bp, Glycine max
  Peptide Sequence Number=SeqID_117555
atggctccaaagaaactctccacgaagaggtctagaagagacgccacaggagaaggatccagtgctgccttagagtttgctagtcatcgtttccggagtgccgagcaccagcagcgctgcgaggccatcaggggatggtcattccacaaggagaggcgtgtccagctcagggaagatgagtacacagacttccaggaggagatagctcatgccctcagccagttcctgggcgacccgctgattttggagaatggccagcagtgtgagtttagccagaggaggagtcaggcagacggtttcgatgaggaagccatcgcccaactactgtgcataccggggcaggatttcgccaggaccgctgcagggaggcgggtgtggatcatgcgcaccagcatgactaccttgacccagatatggatgacactgctgctcagcaatgtcttgcctagcgaccacaactccaacctccctctgcctaagtgccagttggtgtatgtcatcttgacacggatgagcgttcacgtggcccaggtgattgttgatgccatttatttgtttgcaggtatggagcctactaggcaccctctggacccagagaagtcctacaaggccctagggtttccagctctgatcacaggcctttgccagtcctacgaagttcctgtcacccccagcaaggtaatccaaccgtcgatcacccgagccttcatcgagaagtactgcacgcctaggcaggcgtag

SEQ ID NO: 778 - DNA, 369 bp, Glycine max
  Peptide Sequence Number=SeqID_117556
atggaggagaaagggcacacacaaaaattgaagaagaaagggcagcacactggaggagaaaggagaagctcgggaacttggggagcagaagtttgcaaccctagcctacatcttcagaaaacactgaaaccctactccatcaaaacactgcaaccctactccagctggtctgaaggtgtctcgccaatgggagaggcgagaccttcttcacgtggcgtgtctcgccaatggcagcaacgacaccccctccacgtcagctgtctcgccattggtgatggcggcaccgctatctcgccattgcttccgacggcacccctacaaaaacagaccccctttgcaaatagtttgaaaatggaccatgtttggtaa

SEQ ID NO: 779 - DNA, 366 bp, Glycine max
  Peptide Sequence Number=SeqID_117557
atgcgaggtaagtttcttgtagataaattgttatttgatccagaaattaccaagactgaaaggaagaacaggaaggaaaagaaacaagtgaccactaagccacaaagtgaatcttctattgattctccttcaccaaaaaagccacttcaacaaggtaaatcaagagtacaagcttccaacgagaaagccttcttgggaagaagaaagaaacaacaagctccattggagcttgtaggcctaggatcttcttcatcaatggattcctttgcttcttggaagatgaatggcagcggaatggaaaaggaagagagagaggagatgccacttcaaggagaagatgagtctagaagaagctcaacaccatag

SEQ ID NO: 780 - DNA, 486 bp, Glycine max
  Peptide Sequence Number=SeqID_117558
atgaagaaaaaaggaagagataaaaggaactttcagaagaagagcacaaagaaaattgactccactcctacaacccatagatgctttgagtacgggaagctaggtcacataaaagaggattgtccaacctacctcaagaaacaacaaagaggtgataagaagcaaaagaagccctttaagcagagaagaagatgcatagcatgtgatgataatgatgctagttctttaagtgactcaagtgaggaagaagaagaagcaaacttgtgtctcatagccgacattgatgaggatgagaccaaaagcaatgtgagtgtctcttcttccaaatctaacacaaactatgacaatctacttgacgcattggaagagttacatgaagaagcacaaagactcacctttgtgaacaagactgtaaaaggccaacttagatggcatattgagaagtttgttggaataatcgggaatctaaaagggagagttgaatag

SEQ ID NO: 781 - DNA, 243 bp, Glycine max
  Peptide Sequence Number=SeqID_117559
atggaaaatgataaactatcattatcatttatggctgctgaggtggatcttcatttcgtggtgattttggatgtggatgttaaggttgatcatgttcaacttgttcgaaggttgctgaagcttagacaagttcatgaattgttgagtaatggaggcttccatggcttgttcaatgaatactctcagaggtcaacttggagtttttcatcatgtctctggagtgttacactccatttttcgtaa

SEQ ID NO: 782 - DNA, 2304 bp, Glycine max
  Peptide Sequence Number=SeqID_117560
atggaagacaccgcacaacaaatcaagcgtccttttggtgttcctgaaggaccagaattcactgttgggttggatgtacctttgagcgagttgaaggtggagcttcttaaagaaggtgtgtccatcattatgctgactggtttaggtggatcaggaaaaaccactttggctacaaagctttgttgggatgaacaagtcataggtaaattcaaggaaaatattttatttgtcaccttctcaaaaaagcctaagttgaagattattgtagaaagactatttgaacattgtggatatcaagtgcctgagtttcaaagcgatgaagatgcagtcaatcaattgggacttttgctgaggaaaattgatgcaagtcctatgttgctggtcctggatgatgtctggcctggctcagaagccttagttgagaaatttaaagttcagatatcagattataaaattttggtgacttcaagaatagcattccatagatttggcactccattcatcttaaaacctcttgttcacaatgatgcaataacccttttccgtcaccacgctctcttagaaaaaaacagttcaaacattcccgacgaagatcttgtccaaaaggttgtgagacattgcaagggtttaccgcttgccattaaagtgattggtagatcactaagtaatcgatcttatgagatgtggcaaaagatggtggaggaattttcacatggtcatactatacttgattctaacattgaattaattacttccctccaaaagatcttagatgtcttggaagataatcacatcatcaaagagtgcttcatggacttagctttatttcctgaaggccaaagaattcctgttgctgctcttgttgatatgtgggtagagttgtatggactagataatgatggcatagcaacggccattgtcaaaaaattagcttccatgaatctggctaatgtcttagtgacaaggaaaaatacaagtgatacagacagttactattacaataaccatttcatcattctccatgatattttaagagacttcgcaatttatcaaagcaaccaggaacaagttgaacagagaaaaagactgatgattgacataacagaaaataaacctaaatggtggcccagagaaaaacagcaaggcttgatgatccgcgtactgtcaaatatttttggatggcgtgttgaacaaaaaccccaacagatccctgcacgggcattgtctatatcgaccgatgaaacttgcacatcatattggtcccacctgcaaccagttcaagctgaggttctgattttaaactttcaaactaatcagtacacctttccaaagttcctgaaagaaatgagtaaactaaaagttctgacagtcatacatcatggtttccatccttctaaaatgaacaattttgagttacttggctcattatccaacctaaaacgaatcagattagagaggattttggttcctccctttgtcacattgaagaatctaaaaaagttatccctcttcttgtgtaatacaagacaggcttttgaaaatggaaacatgctaatttcagatgcttttccaaatctagaagatttgaatattgactattgcaaagatctgatagaattgcctaagggggtctgtgatatcacctccctgaagatgctcagcattactaattgccataagctttctgcattgcctcaacaatttggaaacttggagaatttgaaacttctaaggctaagttcctgtactgatttgcaagagataccaaattctattggaagactttcgaatctaagacatatggacatctcaaactgcattaaccttccaaatttaccagaggactttggtaatctttgtaatctaagaaatctgtacatgacaagttgtccaaggtgtgaattgccacccttaatcatcaatcttgagaatttaaaagaggtggtatgtgatgaagagacggctgcttcatgggaagcttttaaacctatgcttcccaatctaaagatagatgttcctcaacttgattggctttcgggtttgattagcaatcttaggtttccacaggaaaaggccatcattttctgtgacaatctgagtgcaatctgtttagccaaggatcaagtccatcatgagaggactaagcacattgacattagataccacttcatccattttgagaaaagggtcaaagtccagaaagttgatacgagggagaatccaacagatatgttcacgaagccggttctaagaaacaagttcatgcattatctggatctacttactgtagattgctggaaatga

SEQ ID NO: 783 - DNA, 354 bp, Glycine max
  Peptide Sequence Number=SeqID_117561
atgaaatggatatttgcaaggctaaagagcaagagatttccttcaattaaatatcccctaccctcaaaaggaacaacactaagtgaggcagagcaagaacagagcaagcatgctttaacagtggtcattgcctcagcagcagttgctgaagctgctgttactgctgctcatcgcctcactgggcaacgcaagaaaaactcaaaagaatatcaacatgttaaaactaggaatgatgctccacaatccacataccagtgccagagggagattaaagaatctactgccgccatacaagacgaacaattttctgcactaagcttggaaacgatgaaagggatttctccttacaactaa

SEQ ID NO: 784 - DNA, 312 bp, Glycine max
  misc_feature (218)..(218): n is a, c, g, or t
  Peptide Sequence Number=SeqID_117562
atgggatcggcgaccaacgttagtcacgtcgtttactcctccacgacatcaaaacgcaccacttgtctacagggtgaaatcgctgaaacactgcattttatggtgtcgcctgttgggagaagggtttgtacttttgacgatttactgccatgtattgagaagatcactcttttgtctgacgaagaggataggatacttgaggcacatgaagatgctcncccttctcagccacaatttgaacatcaacagtttaatatactacagcgaagtgcggagactcgaggcttagcggtgacgtcagaaaactgttga

SEQ ID NO: 785 - DNA, 204 bp, Glycine max
  Peptide Sequence Number=SeqID_117563
atggcgcatgttcaccactatgcccataaaatgatgaaggtttggcgaaggaaaaacgaggagagaatgaggaacatggtggaaggtgtttcattggaggggggagagtggggatacaaggaaagaaagattgatccacttggacgaattctgaaaatagatgtgctcaatgatgttagagctaaaaatattgttgagtcatag

SEQ ID NO: 786 - DNA, 2427 bp, Glycine max
  Peptide Sequence Number=SeqID_117564
atggaagagactacagagcgtgttgctcttcaagagagattgaggatgatgtcttcggaaattgtggaaaagggtcaaagcagtgaaagcaacaagcaaatactgaggtcaacacttaaggataacgctcccgtggtgctagagatcaagcaatacaacgaacacttgaatccacccagagaagaaatcaacacccttataggagaaaaagatgcaaaagaaaaatttgtttgtaaatgcttctccaagtgtctatctttgtttctctgcagatttgggcagaagaggggtcattcatttgctggtggtgagaagcaagctcttgtggcaaaagatattgaagagaacctttacaaaatgagagaaattcttgagcttcttagcaaagggagttttgagaagaatcttggtggtgttggaggaccaatgaagtgtccttttggtgttcctcaaaaaccagaattcactgttgggttggatgaaccgttgagtaagttgaaggtggaggttcttagagatggtgtgtccgttgttctgctaactggtttgggtggaacgggtaaaaccaccttggctactaagctatgctgggatgaacaagtcaagggtaaatttagtgaaaatattatatttgtcactttctcaaaaacgccccagttgaagattattgtggagagattatttgaacactgtggatgtcaagtgcctgattttcaaagtgatgaagatgccgttaatcaattgggacttttgctgaggcaaattggtagaagttcagtgttgttggttctggatgatgtttggcctggctcagaagctcttgtcgagaaatttaaagtccagataccagaatataaaattttggtgacttctagggttgcattttctagttttggcacacagtgtatcttaaaaccactcgttcatgaagatgcagtaacccttttccgtcattatgctctcttagaagaacatggttcaagcattcctgacgaagaacttgtccaaaaggttgttcgaatctgcaagggtttaccacttgccgtcaaagtaattgggagatcactcagtcatcagccttctgagttgtggctaaagatggtggaagaattgtcacagcattctatacttgattctaatactgaactacttacatgcctccaaaagatcttgaatgttttggaagatgatcctgtcatcaaggagtgcttcatggacctagggttatttcctgaagaccaaagaattcctgttacctctctcattgatatgtgggcagagtcgcatagtctagatgatgatggcccagaggcaatggccattatcaacaaattagacttcatgaatctggctaatgtcttggtagcaaggaaaaatgctagtgacacagacaattactactacaataaccatttcatcgtccttcatgaccttctgagagaacttgcaatttatcaaagcactcaggaaccaacggaagagggaaaaagattgattattgagataaatcaaaataaacctcgttggtggcttggggagaagtcaacactgcttaagcaccaacaggccactgcccaaacattgtctatattaactgatgaaaattgcacttcagattggccccaaatgcaactagctgaagttgaggttctgatttttaatattcgaactaaacagtatttctttccggatttcatagaagaaatgaacaaactcaaagttcttatagtcacaaattacagtttctatccttctgtaatgaacaactttgagctgattggctctttatctaataacctgaaaagaatcagattagagcggatttctgttccttcctttgttgcaatgaagaatcttaaaaagttatccctctacctgtgtaatatgaaacgggcgtttgaaaacaatgacatgctaatttcatatgcttttccaagtcttgaagagttgaatattgactatagcaaagacatggtgggattgcctaaggagctctgtgatattatctccctgaagaagctcagtattactaattgccacaaactctctgcactgccgcaagaaattggaaagttggagaatttggaactcctaaggctcagttcctgtactgatttggaagggttaccagattctattggaaggctttcaaagctacgacttcttgatatctcaaattgcataagccttcctaatttgccagaggactttggtaatctgtctaatctacaaaatctctacatgacaagttgtgcaaggtgtgaagtgccaccctcaatcgccaatcttgagaatttaaaggaggtggtatgtgatgaagagacggctgcttcatgggaagatttcaaacctctacttcccaatctaaagatagatgttcctcaagttgatgttaacttgaattggcttcatacaatttcctcgtaa

SEQ ID NO: 787 - DNA, 486 bp, Glycine max
  Peptide Sequence Number=SeqID_117565
atggcgccaagaacttgttcggcttctggcaagtacaccggatcgcacaagactttagagtcagaccagtttccactgttgaatgaccctaacaaagcatgcatctacgtgatcaagctttccataccaggaagccttcttaacaacaaagagaagaacaagatgaaagattgcaaaaatacaagtggtgaggatgtctccttcacctctaggatcttacaatcactcagaaactcatctcaagctctcaaattggctcctgcttcaagctctggtggccttgttcatgctcatgcgcttagtgcacgtatggaccgcttagcgcacattagtgatttttggcttagtgtgcctttctcgcggatgctcgctaagccagcagattggcttagcgagaaggctagcagccagcgcgcctgggctaaagatcttagtttagccttaagcaagcaactcgcctgggcaagtggaagtctgcaagagtaa

SEQ ID NO: 788 - DNA, 420 bp, Glycine max
  Peptide Sequence Number=SeqID_117566
atgactaacgttgcggccagaaaagaggaagagcgtacagagattgaaacacatcaagaaagcatttgtcaagttacctcaatccatcatcaattgaccaatgaagaggaaacgcctgaagtctccagtactccagaatatccctacatggctactgctagctatgttggagggaaagataaaggtaggttggaactcagcatagacgatcaaaatatctcttttgatctctttgaggccatgaaacacccagatatgggtgatgcctgttttgaagaagaagaggtggagcaggaaataacattatcggccgcaaccatgatactacagtctcccttggaaaaagaacctggctatgggagagattgcttagcttgtgatgaagagcttgatgattcaaaagacagttgtgttgaccag

SEQ ID NO: 789 - DNA, 555 bp, Glycine max
  Peptide Sequence Number=SeqID_117567
atgacaaccttgttgtcaccaccacagatccaaaccatcgtcgctacctcctttattaacctgaacccccacaaagacctcgtcgccaccatgataccaaatcccctaccacgaccttgtcacccttaccaatccaaacccatgactattgttgttagggatttatcgtgtggtcagcgaaattcgttggatttgagatggttggaagcaaattctagtaagtgcaaagcaaaaggaaagaaatgtaaatggaagaacaacaaaggttcgattcttttggggttcgtagttattgccatttttaagatcatataccattttagacagaaagaagaggaccaagcaagggtgaagaagttcttagaggaatacagggcagaaaagcctgcaagatttactaatgctgatgtgaaaagaatcactggtggttttaaagagaagttaggggaaggagctcatggggttgtattaagaggaaaattttcaattgagattctggtggctgtgaagatcctcaataatacagagggaagaagggaaagagttcatcaatga

SEQ ID NO: 790 - DNA, 312 bp, Glycine max
  Peptide Sequence Number=SeqID_117568
atggatttttcttttaaaaacataattagcaaatacaatgaggatcttgacgttgacacaaaaagcatcgtggttgtggtcgcggatctagcaatgtcggcaccagtggcatcccagatgtggaggggttttcaagtggtggtacgacttgaaggtttggttgctctactgctcgtggttgttctcatcattgccaccacgttgaatggtagaccctcgcgcctgtaccaaagtcatgaggtaaacaccgcagtggtcactcacgaagagggaatgttagtgattgaaaaactaaggattctctgtgagtag

SEQ ID NO: 791 - DNA, 612 bp, Glycine max
  Peptide Sequence Number=SeqID_117569
atggtgttgatactcatttggcctattagaaatattcaagctcacttggtctcgcgtcatggcctcactaccgcctccctacagctcgtgtcgtcgactctgtcgcgactttgcctcatggcaagaccaaagcggcgcgccactaagttcatccccaaccgcaccaccctccaccaccccccggtggtagcgccgatcagtgtggtggaccactgcctcccctacaagaagcacaacctctacgatgtcaccttcaacaacaccgtccttcgcgaccaccaccactgcgtcttcaccctcttctgggcaatggttgtcatgcgcaagtggtttaacatggggagctatgagtctgatttcagagctgatcgaagtccacgagtgcttttgcgagattatctctatggcaggacgagaaccaaaaaccaaacgaagaagaaaaagctaccattttgtgcatatgcacacacaagttctattgcaaaagcaggaactgaagaagctattcggaaatccaagatttctgagtcccaatttgagaaaggactgacatatatgatctttgatattataaagggtgccagttatgtgatggggatctgggttcaatga

SEQ ID NO: 792 - DNA, 681 bp, Glycine max
  Peptide Sequence Number=SeqID_117570
atgcacgcggcgctcattgacatcattgataagcttgctattgaagcacctgacctgaatgattctgaagttaccaatacttatcaaaagtatatggaacaaacccttagtgccaaatgcattattttggcatcaagttatttagaactacaaaggcaacatgaggatatggatccacatgaaatcatcaatcatcttaagaagatgtatggtggtcagagcaggactgcaagatatcagttatctaaggctttgttcaaatgcacaatgcctgcaaatgctcaagttcgaccacacgtccttaagatgattgatctgatagagcaacttgagaagtcaaaatgtaaaattgggaaagagctttctcaagacttgattctgcagtttccccttgataccttttcacaatttactgtgaatttcaacatgaacaaaatggattgtaacttgcatgagatgctgaatttgttgattgattatgaaaatcaaattgcttctcaagagagaaaaagaactgtcatggtagttggaaagaactccaaaaagaaaggtaagggaaaatatgcacaaaaaagaaagccttttggacctaagggtggtgtgaccaaacctatgcacaacaaggtcaagattgaccaaagtgatgctgagtgtttcttctgtaaggagaaaggagactga

SEQ ID NO: 793 - DNA, 513 bp, Glycine max
  Peptide Sequence Number=SeqID_117571
atggaatattatttttaccatccttttgaccataaattgtttatggtaaggggaattatttttttagaatgggaattccttgtaggaggaagtcatgttaccacaaagttcatcacctccagcaattgtggttcaagagctatctatagttcaagattagtcctagatgacacatcggatgaggtttatcatgatgatgatgatccaagaagctatgaagaggctatacgaagtttggatagtaagaaatggcaagaagctatggaatctgaaataaaatcaatgaagatcaacaaagtatggactttagttgaagcttcaaaggatataaaaccaattggttgtaaatgggtttacaagaaaaaggttggagcaaatgggaaggttgagacctacaaagctcgccctgttgccaagggatatcgtcaaaagaaaggtacaggttatgatgaaaccttttctcccatggcaatgctcaaatcaattcagattcttcttgttatagcaatatag

SEQ ID NO: 794 - DNA, 186 bp, Glycine max
  Peptide Sequence Number=SeqID_117572
atgaaagcctcagcaaaaacagcaccttctccgttgcaatccacctcaagcttatccctaaaagagatgcttcacatcaagaagccgtggatcaatcttagcagggggcttatcctatgccttcaagccattagaaacaacaaccactactcaaagcaaatgaacaaagttattttgaagttctaa

SEQ ID NO: 795 - DNA, 261 bp, Glycine max
  Peptide Sequence Number=SeqID_117573
atgacgggagatgcatcaaagttcacacatatctctcccaagaaaagcgggcatgtaacctatggtgacaacaacaaaggtagaattattggagttggaaaaataggtacaaattcttcaacctccattgaaaatgttctacttgttgaaggtcttaagcacagtctgcttagttttagtcaattgtgtgataaaggctatctgataatgatccatggctatggcataaaagaattgctcacattaacatggaacacttaa

SEQ ID NO: 796 - DNA, 341 bp, Glycine max
  Peptide Sequence Number=SeqID_117574
atggaaagggagatgatcaccatgatagtggacacactcccaatgttctactatgagaagttagtaggctacatgccctctagctttgtggatctagtattcacgagtgagaggatcgaggtaggcataacaagggggaagttcgactatgtcgcccctgccagcacaagcaatagaagatccaggtcgactggggcaaagaggaaagaaggggacgcgcatgccatgaccacgactcctacttggccaaaacctcaatcaacccctcacaatactcatcaatatgccgagcaccattcgagcttttcggcccgcgccggaaaccctccaactcaacaccc

SEQ ID NO: 797 - DNA, 666 bp, Glycine max
  Peptide Sequence Number=SeqID_117575
atgagatcgcggttcgacagcaccgcgtcggacaccgcgcccagcaatggcggcgcgatgcagatgtcgatatcgcgggcctcgtccagcaccaggtcggcctgcacggtgatgcggccgtcgtccaggctgacctggcgcgtggcggccagcgtgcgcaccgtgaagcgtgccggccgcccctgcgcggccaggtattcgttggccaccagaaagccgtgccgggcggtttccagcgaagcgatattggcgccgctgggcagcaggaacgcgatgtttttcatgccgccaagcatacgcctgcggcctgtcgcaatccaccctcaagaatgtcgcaaacgcctatctgaaagcgccgccgatcccgatacagtgacatctgccggcatcgctgccgacatggcccgcgcggactggcgggttccgcgccggggcccacaacaacaccaaatcaaggagcatcagatggaacagtacatagacggttacctgttgagcgtccccaaggccaacctcgaggcctaccgcaagatggccgatctggccggctcgatctggctggagaacggcgcgctggaatatcgcgaatgcgtggcggacgacatcgacggcgaaggcttcggctcgttcagcgccgcggccagcgcgcgcgaaggcgagacggtg

SEQ ID NO: 798 - DNA, 813 bp, Glycine max
  Peptide Sequence Number=SeqID_117576
atgaaaattgtcatcgcaccggattcatacaaagagagtttgtccgccctggaagtggctaccgcgatagaagcgggatttcgcgaaattttccccgccgctgactatgtcaaaataccggtcgccgacggcggagaaggcacggttgaagcaatggtggcggcaacccagggcaacatcgtcagactgacggtgaccgggccgctcggcgagccggtcgacgcgttttacggattatccggtgatgcgcgtaccgcctttattgagatggcggcggccagcgggctggagctggtgcctgcggcacagcgcgatccgctgatcaccacctcctacggtaccggtgaactgatcaaaaacgcgctggatcgcggcgtcgatcacatcatcatcggcatcggcggcagcgccaccaacgacggcggtgccggcatggtgcaggcgctcggtgcccggctgctggacagcgacggcagcgggattggctatggcggcggggcactgccgcagctggcgaagattgagatcgccgatctggatccgcgcctgctgcagtgccgcattgaagtggcgtgtgacgtgaccaatccgctgattggcgaagagggggcgtcggcgatttttggcccgcagaaaggggccacgccgcagctggtgcagcagctggatgccgcgctcggccattacgccgcgattattcagcgcgacctggatattgatgtgctgcacatcgccggcggtggcgctgccggcggcatgggcgcggcgctgcatgcgttttgccacgcggaactgcggcgcggcattgagatt

SEQ ID NO: 799 - DNA, 489 bp, Glycine max
  Peptide Sequence Number=SeqID_117577
atggtttcagtgagcattgtcttttttcatcggcttagtcactgttgtcgtttaatgcagctacaagtgaagtatgactacaacaaatgtaggccaattttgggacctttttcccagaattcctatttaggggtgaaagttggatattgtcccgcgtgtcaatcgaaaggaccattctctatcaatattgatcagacaacttataggaatttccacaagcttactcttcaagagggccctagaatagttcccgctggtcgagttccaagaaacaaggaagtgatattagtgaatgatcggattgactatgctcgcatagggaagaaattgtatcatggagaacataaaactgtatatgctagtggcaaaggagcttctgtcatgggtcccacagatgcagttcataaggatctagtgataacagtggataaacaccaaggagatttacacaacactttaatccaaaaccttaaagactcaggtttataa

SEQ ID NO: 800 - DNA, 2187 bp, Glycine max
  Peptide Sequence Number=SeqID_117578
atggcttcctttgttcttgggactactttccttccactcttttattctcatgataagtacagctgctccccaagtatttcaaatataaccaccaatccacaaaggatgaaccaagtgatagctgctggaggagacaatttttgtgaggagatgaatagcacaattatgaagaaaagctacgaacctaatcaacagttgcggagatctctaaacttctcaggagagaagccatccacaccagtattggacaccattaactacccaatacacatgaaaaatctatccattcaggaacttgaggagctagctgatgaactccgtgaagagattgtttatacattgtcaaagactggggggcatttaagttcaagtttaggtgtggcagagttaactgtggcacttcaccatgtattcaacactcctcaagacaagatcgtttgggacgttggtcatcggacctatgctcataagattttaacgggaagaagatccaaaatgcacacaattcgacaaactggtggacttgcaggatttcccaagagagatgagagtcttcacgatgcctttggtgtgggtcacagttctactagcatttcagcttccttaggtatggcagttgcaagagacttgattggaaaggataaccatgtgatttcagtgatcggcgacggagccatgacgggtggacaagcgtacgaggcaatgaacaacgctggttttcttgacaccaatcttattataatcttaaacgacaatgaacaagtttcccttcccactgcaaccattgatggaccagctccaccggttggagctcttagtagagccctcgccaggctaaatactagttctaagttccatcaactacgcgacctcgcaaagggaatcacgaagcaaattggaagccgagcatatgaatttacatctaaattggactcctaccttagagggatggtaggtggtgctggtgcatgtttatttgaagagcttgggttattctacattggcccagtagatggccatgacatagaagaccttgtgcacatcctgaaaagtgtcaagggtatgccgacacttggacctgttctcattcatgtaatcactgagaaaggaaaaggttatcatccagctgaagttgctcctgacaagatgcacggtgttgtgaaatttgatcctaagtcagggaagcaattgaaatccaaagctagtacgcggtcttacacgcagtattttgcagaatctttgacagcagaagcagaagttgatgagaaaattgttgccatccatgctgcaatgggagggggcacggggcttaacttgtttcaaaagcgcttccccgaacgatgttttgatgttgggatagcagaacaacatgctgtaacttttgctgcaggcctagctgctgagggcctcaaacccttttgcgcaatttactcttcctttctacaaagaggttatgatcaggtagcacatgatgtggatcttcaaaagcttccagttagatttgcgttagacagagctggcttagttggtgctgatggtccaactcactgtggagcatttgacacaacattcatggcttgtttgccaaacatggtggtcatggctccatcagatgagactgaattgatgcacatgatagccacagctgcagccatagatgataggcctagttgctttaggtacccaagagggaatggcataggtaccattcttccacccaacaataagggcacgccattggaggtcggtaaaggaagggtattaaaggagggaagtagggttgctcttgttggttatggaacaatggtccaaagttgtatggaagcagctaaggttcttgaagctcatggcatctcaacaactgtggttgatgcaagattttgtaagcctctagatggagatttgatgaggagactcgctagagagcatgagattcttatcacagttgaagagggatccattggaggatttggttctcatgtttctcattttctaggcttgaatggtcttctagatggtaatctcaagtggcgagccttgacattgcctgacagatatataaaccatgggtctcagacagatcaaattcaaatggcaggactgagttcaaaccatattgcagttactgctttgtcattgaccaatgtgcattgggatagtcgtttgcttctcagcctacagatatga

SEQ ID NO: 801 - DNA, 405 bp, Glycine max
  Peptide Sequence Number=SeqID_117579
atgatgatgatactaatgtcaacagcaacgacaatgatagaaatattagtgatagttgtgatggatggtggtggagtggcattggtagtggtggtgatgcggatggtggttgcaatggcaatgtgttggtgtggtggtggtgtttgccgcaacattgatggtggttatggtgacgatgacagagatagtattgttagtaacgatagtagtaacaatgacactagtagaggcattgatggtgtagcaatgccgtgtggttgtgacactaatggtggcattggtgatgtctgtggcgatagtggtggtattagtcaattatatgactgtgacaacgatgataatggtgacggtgggagcaatgatgaaagtgatattgatgttcatggtgatgacaatcagcaatga

SEQ ID NO: 802 - DNA, 189 bp, Glycine max
  Peptide Sequence Number=SeqID_117580
atgaagggcactgaccatttgcatttctttttttggaacggaaaaagacaatatttggctacgaaagtggggtattctgaatttttggtgcttttggtacaaacattgaaatcgttatccattttacttggccaagacaagaaccatgccagcaaattcgcctccaatgataacaagttaatggtgtaa

SEQ ID NO: 803 - DNA, 201 bp, Glycine max
  Peptide Sequence Number=SeqID_117581
atgaggaagagagagagggagagactgaatcgaaaatgggaccagttacagtttgcaattcatgggccatattggaggtgttactttccaaatacccaagcaataatctatgttgttgattcaagtgacgttgataggcttgtgatagctaaggaggagttccatgcaattctggagcttcagcaattgctaagaggatga

SEQ ID NO: 804 - DNA, 153 bp, Glycine max
  Peptide Sequence Number=SeqID_117582
atggaggccgcggaagctagagctctacaactcgctataaactggttagctgatcaggatcatgactccattattattgagaccgattgcaggcaaatcgtagactcctttctgcaaaaacatttccaatgtattgaaattattacccagtag

SEQ ID NO: 805 - DNA, 1098 bp, Glycine max
  Peptide Sequence Number=SeqID_117583
atgggtagagctccatgctgtgacaagaacaacgtgaagaaaggaccatggtctcctgaagaggatgctacactcaaaacctatattgaaaagaatggaactggtggcaattggattgctcttcctcagaaaattgggctcaagaggtgtggaaagagttgcagacttaggtggttaaattacttgagacctaatatcaaacatggtggatttactgaagaagaagacaacatcatctgcagcctttacattagcattggaagcaggtggtccataattgctgctcagttacctggaaggacagataacgacatcaagaactattggaacactagattgaagaagaaactgctcgggaggcgcaaacaatctaacttcagctcaaaagacacaaacaatggaatagaggagaattcttattcaaatgcccttagtacttcagctcttgaaagactccaactgcacatgcaacttcaaagcctccaaaaccctttctctttctacaataaccctgcgctgtggcctaagttgcatcctatccaagaaaagatgatccatagcctacaatctttgaatgatggctctaaccctgtgatgcaaaatgctttgcctaattccccacatgatgaacaaggacaaaagggtgagttttacaagcctcaacatgatggtgcaaagatcaataaccctgatcaggttcatcttttggagaatattcctttgagtaacagtggagttccctttgttgcttctgggagtagtactaatccaatgcactcaagtcttgcaccaagatctgaggctattcatgtgcagactaacaataatgtgggatttcagcaacttggtgcactgcaaaatgaactagatgagattctcaacaacagaacaatgggttatgtgccacaggaagatcatgatatggcttcagggtttgattgtttcagagagatgaatgactcaaaggatagcttgatttggtggtccaatgattctgataccaaatcagcatcctcaaattcctgggaatcatctgctactccggctcttctaacacaagggatgttccaagattatgaactgggttacagcctgtag

SEQ ID NO: 806 - DNA, 1005 bp, Glycine max
  Peptide Sequence Number=SeqID_117584
atggtggttcaatacaagtgcatagtgtgtaaccctaaccctagccaccatgactgtctgccctaccgacgacaggcatgtggccgtgttggcgtttccctatggcacacacgcaactccactcctcaacctcgtgcgaagagtagcagcagaggctccccaagtcacattctcgttttcagcaccaagaagtccaatgcctctgtcttcgctggcctcaacaaggagcaactttttaacataaagccttatgacgtggatgatggattgccagataattatgtgccttcagggaaccccaaagatgccgtcgcattctttgtcaaggccatgccggcgaactataggaccgccttggatgaagccgtcgcgaagacggggaggcacatcacttgcttggtttctgatgcattttttttggtttttgtgttgacatggctgaagaaatgcatgcaaatccgtgaaaacaaagaagtcgatttccttactggtttctctggggtaaaggcttctgacttgcctgaaggattagtcgaagagccacaagaccctttttcaatcatgttagaaaaattgggagaagcgttgccgcgagcaaccgcagttgccataaactccttcgctacagtgcaccttcctattgcacacgagctagaatccaagttgcacaagctactgaacgttggtcaattcattttgacaacgccacaagctttgtcgtctccagatgaggatgggtgcttaccgtggttgaacaagcaagaggaagggtcagtagtgtaccttagctttggaagttcgataatgccaccaccccatgagttggctgcaattgcagaagccctagaagaaggtaaatatccgtttatttgggcgtttagaggaaatcctgagaaacaattgccacaagggttcttggaaaggacaaagacacaagggaaggttttgttgcgtgggccccacaaatgcaaatcccaaaacattcagcggtttgtgtgtgcatga

SEQ ID NO: 807 - DNA, 3312 bp, Glycine max
  Peptide Sequence Number=SeqID_117585
atggaaggtgtggtggtcacatgcagtagagagcggtttcaatgcttgagccagtgtgagagtgtaattgatcataggcaaggattcatcatggatagtccaattcgatcgccggccaccggttcaggttccggttccggtgaagataaccggcgtgttaagttcttgtgcagcttcctgggaagcataatgcctcgcccccaagatgggaagctgcgttatgttggcggcgagacgcgaattgttagtgttccgagggatattagctatgaggagttgatggggaggatgagagagctgtatgatggggctgctgtgttgaagtaccagcagcctgatgaggatcttgatgctcttgtctctgttgtcaatgatgatgatgtggttaacatgatggaggagtatgacaagttagggtcaggagatggattcactaggctcaggatttttctcttttcgcaatccgaacaggatggttcctctcatttcattgatggggatgattctgagaggaggtatgttgatgcattgaatagtttaaacgatggttctaattctgactttaggaggttgcaacaaggtgagttttctatgatgagtcctgttgaggatattcatgtggctgctgatcagttctataatccaatcaatgtggaaagtgggattcatagtcagagaagtggggacctatctatgtcgccttataatatgcatcatctcactgtccagcacccgcaagctttaggccagaggtacaatgaaatggatgctccttggaatcctgcctattactctcctaggcatcatggcctccatgactttccatcttctccttcgggtacaaggtatcgcgtgccatttcccgagttaccagataagtgcattgatagagtgccggaagagtatgcgcgacatcacgtaaatcatcatcctgtgtacgacaatcagccgcaatattctgaaaatgttatgtggatgccagcacatggcgaaaagtcggcttttccaggcaatattattcatagtcctcatgttgttgatgagaacagtatatgtgagcagtgtcgcatgggttttcatagaggccaaccacatctggagcattctaatataagtaatggagtttcacaggttggtaatctatgtgcagaatgccccccaccaaatagggatacttttgctgctgatgcaaagttacactcggcaatctatcccaatgaacccagtaatgatcataggtctgtttttaatgatactcagaatcacgagagaggatggggcttgcagcatccaactgctcgggttgaggaatcaagagtgcatgtctctcttgggcatggtagtgtgactgatgctcataacttgccttccaattatgttcagcagcaggctggacctgaattggggaccgaactgttccctgaacaaaccgtgactcctgtacctcctatacaatttcctccactggaagattgcaatgtgcggtatggaaattcagcttctccttatggagtagatagtaattacgctgtgccgcgtggacttccacctggtttctggagaaacactccagttcctgttcatattggaccatcttatgaggctgctacttcacctcagccggtgaatggtttgatgaatgcagcaggattaatccgaggagaggccagtccagggtttttcattggaccagatagtcaaaatcattgggttgattcctcacagaaattaacaggacatgatggtacagccatcccagaatatccttatgcacatgctctgaatccattgccccttggtcaagaaaatcaacacccggttattgtagatttcattcatcccccacaggacatgaatgctggtacctgcttgaaacccttgcagctgccaaaatcatcttttaatatggttcccaatcaacaggttttaagagacgatactcatttgactgaagcaaagagttttgaatctaatggtttgattggtgaaggaatagtggtaaaaattgaggacaatgttcaaaaccctggcacccagactatatctttttcagtgcaaaataaaattgctgagaatgcatgcgaagctgctgctgcttcttctgttgagtctaacaatttaaagtcaaaacctgaagcagactgcgtgcatgttgagaaactggctgataaggacccttctgttccagaagattctaaacatttagttgatcaattcagtttcttgcctgagttgattgcttctgtaaaaaaggctgcattagaagatgctgtgcagttgaaagctgcagtcgatgagcatgctgattctccgaatcacaattcagataccaaagatgaaacaacaaatgaagtagaaccagcgaatgctcatggtgatttagaattggactctgaaaatgaccatgtagatactaataaaattgagcctacaagggctgaggaagaagcaattgctaagggattacagactattaaaaatgatgatttggaggagatccgtgagcttggttctggaacctatggagctgtttatcatgggaaatggaaaggttccgacgttgccattaagagaataaaagccagttgttttgctggaaggccatctgaaagagcaagattgatcgcagacttctggaaggaggcattgatgttgagttcattgcatcatccaaatgttgtctccttttatggcattgttcgtgatggccccgatggttctttagcaacagtcacagagttcatgattaatggatctttgaaacagttcttgcataagaaagatagaacaatagatcgtcgtaagaggctcattatagccatggatgctgcatttgggatggagtatttgcatggaaaaaacattgtgcattttgatttgaaatgtgagaatctattggtcaatatgagagatcctcaacggcctatctgcaagattggtgatttgggtttatcaaaggttaaacagcacactctagtgtctggtggagtacgggggaccttgccttggatggctcctgaacttcttagtgggaaaagcaatatggtgtcagagaagattgatgtctactcattcggtatagtcatgtgggaattactcacagggaatgaaccctatgctgatatgcattgtgcttcaataataggaggaattgtgaacaacactttacgtcctcaaatcccaacttggtgtgatcctgagtggaaatctctaatggaaagttgttgggcttctgatcctgtagaaagaccatctttttcagaaatttccaagaagctgaggagtatggctgcttcaatgaatttgaaatag

SEQ ID NO: 808 - DNA, 1572 bp, Glycine max
  Peptide Sequence Number=SeqID_117586
atggccgcttcttcttcctctcccgacgagccttctcgctccgtcttcctcggcgtcgacgtcggcaccggcagcgctcgtgcaggtctatttgacgaggaaggaaagcttcttggttcatctagcagctcaatacaaatatggaaagacggtgcctgtgttgagcaatcctctacagatatatggcttgcagtttgtgcagctgtaaaagcagcttgctctaaagctgaagttgcaccaacagaagtaaagggtatgggatttgctgctacttgttctcttgttgctgtggattccgacagctcacctgtttcagtttcttggagtggtgattcaagaagaaatgtgattgtatggatggatcatagagctgtagaacaagccgaaaggatcaattcctctaaatcacctgtattggagtactgtggtggagctgtttcacctgaaatggagccaccaaagcttctatgggttaaagaaaatttgcaagaatcttggtcaatggttttcaggtggatggacttaagcgattggttgtcatacagggcaaccggtgatgatactcgcagtctatgcaccacagtttgtaaatggacatatctgggtcatgcacacatgcagcatgtcaatgataaagagtctcgagacatggaagcttgtggatgggatgatgatttttgggaggaaattggtttgggtgatcttattgaaggacatcatgcgaagataggtattcatcttattaacattggccttgaactgggtctggtaccaggaattcctgttgggacatcattaattgatgctcatgctggtggcgtgggggtaattgaaagtgtgccaccatcagaagctgaagaacatgacatggaagcaatttgcaaccgtatggtgttagtttgtggaacttctacatgccatatggctgtatcgcggagcaaattgttcatacctggggtttggggtccattttggtcagctccattcatgtatgtctttgtaaagatatctgtgtggctacttgtgattagttcctttttgtggaacattgatattgggataaaaccactcatcactgcttctcttgtatcttctatgttgtggtgcattttttctctatccgaactttcagcaatggtaccagaatattggctaacggaaggtgggcagagtgctactggtgcattattggatcatataattgaaaaccatgctgcttctgcacgccttgcaaatcaagctgctacccaaaagatttcattgtttgagcttctgaacaagatgttggaaacaatgatagttgagctgaacctatcctttattgctgccttgactgaagatgtacatgttcttcctgacttccatgggaataggtcacccattgcagatccaaaagcaaaaggagtcatctatggtttgacacttgacacaagtgacaaacagttggctcttctttacctggctactgtgcagggcattgcatatggcacacgtcacattgtagagcattgcaatgctcatggtcacaaagtaaggatctgccagaagtatgttgcacactggttgtactga

SEQ ID NO: 809 - DNA, 972 bp, Glycine max
  Peptide Sequence Number=SeqID_117587
atggcggtggaatgtaacctccttaaaattttagctggaaaagtgtgtggcttggttgtcacttggcggtgtctaccaaaggcgaaggtgatggttgcctttgctggtgacttaaacaaagactttgacatcacttggggagatggccgcgccaagatactaaacaatggagagttactcactctttcattggacaaagcatctggttcaggttttcaatcaaagaatgagtatctctttgggaagattgacatgcagctcaagctcgtccctggaaactctgctggtaccgtcactgcctattatttatcttcaaaaggatctacttgggatgagatagactatgagtttcttggaaacttgagtggtgatccatacatccttcacacaaacgttttcagccaaggcaaaggggacagggaacaacaattctatctgtggtttgaccccactgctgatttccacacttactctatcacgtggaacccccagaggattatattctctgttgatggcactcccattagagagttcaagaacttagagcctattggggtccccttcccaaagaatcagccaatgaggatgtactctagtttgtggaatgctgatgactgggccacaagaggtggccttgtgaagacagattggacacaagctccattcacagcttcctacagaaacttcaatgctgagacttgcatatggtcttctggagcatcttcttgtgctaaaacttcttctacttccaccactagcagtggttcatggctttcacaggaactggactctgcaggccatcagaggttgaagtgggtgcagaagaactacatgatttacaattattgcacagacactaagcgtttcccacagggccttcctccagaatgcaacatctctggagagaaaaacaaagcaacgcattcctcttatattttctatgatcagaatgtcataccaatattagtttaa

SEQ ID NO: 810 - DNA, 1827 bp, Glycine max
  Peptide Sequence Number=SeqID_117588
atgaagaaaccaacaaccgacgcaattagtatggggaaaaggagcctggagggtggagaagatgaccagcctgaacgaaagaggcctgctcttgccagtaatactgatgtgaaacaggtcagtgaagaagtggagcgtgctttggcaaagttaggtcctgcaagacttagtggaaggtctcctcctaaaatgattgaaggccctgatggtagaagcttgcagctgaaatttaggtcccggttgtctcttcccctattcacaggaggaaaagtggaaggcgagcagggggctccaatacatgttgttctgattgatgccaatagtggaagcattgtaacatctggacctgaatcctgtgttaaacttgatgttgttgtccttgaaggtgattttaacaatgaagatgatgaagattggactcaggaggattttgaaagccatgtggtaaaagaacgtgaaggaaagagacctttgttaactggggacctgcaagtgacactcaaggaaggagttgggacattaggggaactgacatttacagataattccagctggataaggagtcggaaattcaggcttggcttgaaggttgcatcaggtttttgcgagtccatacgcattcgtgaagctaagacagtggctttcatagttaaagatcatagaggagaattatataagaagcattatccacctgcattgactgatgaagtgtggagattggagaagataggcaaggatgggtcatttcataagaagctgaatagtgcaggaatagtcacagttgaagactttcttcggcttgtggttaaagatcaacaaagattgcggaatatccttgggagtggtatgtcaaacaagatgtgggaggctcttttagaccatgcaaaaacatgtgttctaagtgggaagctctatgtttattatccagaagatgcaagaaatgttggcgttatttttaacaacatctatgagctgcgtggccttatatcaggagaccaattctattctgctgattctctcactgatagccagaaggtttatgtagattcattggtgaagaaagcatatgaaaattgggatcaggttgtggattatgatggcaaatcactcgtgaatgctaaaatttcttctgaaaatgaacttcatgtggagtcaattgattatggtagtggtttagatcatcaactgcaactgccggtccttccagtgtctgttccttctgaacagcaaatcaattcagggatacctgttggaggttacaacgataataatatagtaacacgatatccaacccagtcattgattccaaactccagctcccggaatcagttcgatagctcattatatgtgtcgaatgaccaattaatcagcaatgctcaccaaacccaaagcactagtaatgatcatggcaccgttgggttagctcttggtcctcctcaatcatcgacatcagggttccatgctggcagctcttctgctataaatccttttgatgattggtcccacaacagggacaagggggctgatgaattcttttcggaagaagaaatccgcttcagaagtcacgagatgctagagaatgaagatatgcagcagttgcttcgcctcttcagcatgggaggtcatggctccatgagtgctgaggatggcttttcattcccatcattcatgccatctcccagtataccgaactatgatgaggatcgctctcgcccaggcagagctgttgtgggatggctgaagatcaaggcagcaatgaggtggggcttctttatcaggaagatagccgctgagaagcgggcacagatagaggagttagatgaataa

SEQ ID NO: 811 - DNA, 885 bp, Glycine max
  Peptide Sequence Number=SeqID_117589
atggcggagaccaacaacaacgttgccgtcgaggtccttgaaaaagaggatcttgccgtgtccctggccaaatacgtcgccgatctctccaacaaattcacttccgaaagaggggctttcactgtttgcctgtctggcggctctttgatcaactatctccggaagctgctggaaccgccttatgttgatactcttgaatggtccaaatggcacgtgttttgggtggatgagagagtcgtgcccaagactcacgaagatagcaactacaagcttgctttggatggacttctctccaagtacatgtgtgaggataggaaccccattttggaattggataaaaaatggtatatgaacatgttttcgttcaagcaacccgcagtcccaaataatcaatctatcccaaacaagcataaggtgccaattcccccgggcaatgtttatgcaatcaatgatgccctttcagccgagggagcggccaatgattacgagacatgtctcagacacttggtcaagaacagtattatagcttcatcgccagccaatggatttccaaaatttgatctaatgctgctgggcatgggccctgatggccacatagcttctttgttcccaggccatcctcttgtggaggaaaaacaaagatgggttaccttcattaaggactcccctaaaccacccccagagagaataactttcaccttaccagtgattaatacttctgcttatgcagcgcttgtggtgactggcaagggtaaagcagatgcagttcactctgtgttaggcaaatctcaaaattttgctaagcttcctgttggattggtttcacctgaaggagagttgaaatggttcttagacaaaggtgcagcctcaaagctggcagcttag

SEQ ID NO: 812 - DNA, 1185 bp, Glycine max
  Peptide Sequence Number=SeqID_117590
atggcactctcagtttgcagcatgaacattaaccccatagcattagcagcgccatctttctcattcaagtctctcaaattcccttccttctggccaacacaaaaggtgaagatgggtcctctgagtgtgtctcccatgggatttggaacatgggcatgggggaatcagcttctgtgggggtaccaggaatccatggataatgagctccaacaaatcttcaacttggctatggacaacggcatcaatctctttgacactgctgattcttatggcacgggaaggttaaatggtcagagcgagaagcttctggggaggttcattcgagaatttcaaggtttcatcacgcattgctttctcactttcattgaattttgtatatattcttctgtagattgcagtgcagagcaaaaggggagccaacgtgaaatagtcattgctactaagtttgcagcatacccatggcgccttacaccagggcagtttgtgagtgcttgcagggcatcactagatagaatgcaaattgagcaaattgggataggacaacttcattggtcaactgcaaattatgctcctttgcaggaatttgctctttgggatggtttagtggcaatgtatgagaaggatttagttaaagcagttggagtaagtaattacggaccaaagcagcttttaaagatacatgattatctgaaagaccgtggagtccccttgtgttcagcccaggtgcaattttccctgttgagcacggggaaggatcaactagagatcaagagtatatgtgacagtctgggtattcgtatgattgcttatagtcctctgggacttggaatgcttactgggaaatattcatcatccaaacttccaagtgggccgagggcgttgctgtttaagcaaattcttccgggactggatcctttgttgagttcgctgagagagattgcaaataaacgacggaaaaccatgtcacaagttgctataaattggtgcatatgcaaaggtacggttccaattcctggagttaaaacaattaaacaagcagaggaaaatttaggtgctcttggttggcgcctctcctcagacgagttgcttcagttggaggatgcagcaaacgaatcacctcgcaggatgatccaaaacattttccaaaccaggcagagagcaaacaaccttgaccaggagaattga

SEQ ID NO: 813 - DNA, 309 bp, Glycine max
  Peptide Sequence Number=SeqID_117591
atgctcacttttactcactcgaaccccaccaacgacactcacttcgtcgccggcgccgccaggttcttctccatggccgcggcggcggttactccggcggtgctcttcacggccctcgccggccttgctgtcgtcgccctcgtcttctgcggtgccagtagacgaagtcacaattcgcaatcgtcgtcttcgaattcctctccttcgtcgtcgtcgtcgtcttcctcctcgtcgtggatccatttgcgatcggttctattcgttgtcacttcttcctcaccagcttcttgttcgtcctctgatcggtga

SEQ ID NO: 814 - DNA, 2076 bp, Glycine max
  Peptide Sequence Number=SeqID_117592
atgggaactagtaccgtaagcgacgaagaactcaaagagattgagaatctcggaagagaggacattgaagaggctccaattgtgcctgaggatgtgagcagaatagcaccatggataagacagattacacttcgggggctagtagctagcttcctgattgggataatttatagtgtgattgtgatgaagctgaacctcacaactgggttagtccccaatctcaatgtctcagctgctctccttggctttgtgctcattagagcttggactaaggttcttgcaaaggccaagattgtttcgactccgttcactagacaggagaacaccatcatccagacttgcgcggtcgcttgctatagcatcgcggtaggaggtggtttcggttcttatctcctgggtttgaataggaggacttatgagcaagcaggggttggcacagaggggaataatccgggtagtaccaaggagcctggaattggatggatgacagcctttctctttgtgaccagctttgttggattgttggcgttggttcccattcgaaagattatgataatagactacaaattaacttatccaagtggaactgctactgctgttcttattaacgggttccatactcctaaaggagatgtgatggccaagaagcaggttcatggtttcttgaaattcttctcagccagtttcctctgggctttctttcaatggttttattcgggtggagataactgtggatttgttcagtttcccacttttggattgaaagcatggaaaaactccatgacttatgtcggagcaggaatgatttgttcccatcttgtaaatttatcattgcttcttggtgctgtgatttcatggggcattatgtggcccttaatcaggggactaaaaggggaatggtttcctgcaagcataccagaaagtagcatgaagagtcttaatggttataaggtttttatttctattgctttgattcttggtgatgggctttacaattttgtcaaagtcctctatttcactgccacgaatattcatgccaccgtgaaaaggaagaaccccgaaacatataaccagaaaccactccctcttgatgatcttagacggaatgaagtgtttgcaagagaaagcattcctatatggttggcatgtactggatacatattattctccatcgtttctatcattgtaatccctttgatgttcccacagttgaagtggtattacgtggtgtttgcctatcttttcgcaccctctcttggcttctgcaatgcttatggtgcaggtttaaccgacatgaacatggcctataactatgggaaagtggctctctttgtgctttcagccttggccggaaaaaatgatggtgtagttgctggacttgtggggtgtggcctgataaaatccattgtttcaatttcatctgatttgatgcatgatttcaagactggccatctcactttcacttcccctcgttcgatgcttctaagccaagcaattgggacagcaataggttgtgtagttgctcctctcacattcttccttttttacaaggcttttgatgtggggaacccagatggggactacaaggctccgtatgccatcatatatagaaacatggcaattcttggtgtggaaggcttttctgcccttccccatcattgcttgcagctttgttacggatttttcacatttgccatagcggccaacttggtcagagatcttggccccaaaaagattgggaaatggattccacttccaatggcaatggctgtccccttcctagttggtggttactttgccattgacatgtgcatgggtagtttggttgtgtttttgtggcacacacttaacagaaatgaggctggtttgatggtccctgcagttgcttctggtttgatttgtggagatggattatggattctcccttcatccattcttgctttgttgaaaattcgtcccccgatctgcatgagcttcctgtcagccagtgccaaggcaccaccgttgcgcggagaggacactccaaatgaagctgaagctgctgggagtaggtggactgggtgcaaggcgatttag

SEQ ID NO: 815 - DNA, 1128 bp, Glycine max
  Peptide Sequence Number=SeqID_117593
atggctgatagtattgttacctccagcaattcttctacgtcctcgctgaaccctactcggataatctgtcactctcatagtctccgttgcactgaatccttcatgaaagaaaatgtagttcaggaacttcaccaaatgcagcccgatgaacaaactaaaaataagatgttggacatactgaaaagatttcattcacaagaggaaatggatgagaattattcaactttatccgaggagacaatggaaaattttttgtctggacaggaaatcagctttgatgatttatcacttgaagaaaagaaacggtttcacagagcaattgcttatggggaactgagcaagatgatcaaaccatgggatccatggtggtcaaagccttctgccagaaacatctgtctcagtaaggaaggaactcagcttgttcaacctcttccagatcaggaattgctagatgatgatattggaagtgatgaattcagcaaagttcctcttgggcctgaaactccacttcctcctctaagcaggcttagttccaaggagccatcaccccttttaacagttcacctagtcgatattctgtatagctattgcttcactcttcgtctctacaatggagattggaggtcagatgccttagggtcagtcatggttgtattgagcgtgtcctcggtgttgggtcaaggtgcacagccggagacagtactagaagccctttctcattgcttggagcaggtatgctgtccagcttacagacacattggaggattgcaatttggtttgggtgtcattgatgatgtgatcagtctgcttggtttgggaactcctgcattggtttgtgcactttgtgatatgcatcggtggattcaagaaggcgaaaaggaggccaaatcagaaaggccaagaaagtcacagagaggtgggactagaagtgctattaagctggcagaaaggaagatatatttcatcatgtgttgggttcgtgagcagccagaggaagtctggtcttctttagcagccattgcaagagcagaaaagacatcggccatggaatttcaacagagcaatagatctgaagatttgaacaataaggcagaggccaaaggcaaaagtttaattcaggagatttaa

SEQ ID NO: 816 - DNA, 601 bp, Glycine max
  Peptide Sequence Number=SeqID_117594
atggaacaatatgcttttgagcagctaagctctaatgttgaccttaaatataacttctgctactgttattgtcttccactcttcctggaggataaggatgtaatagcctgtgacgttataaatcctgatcacatcaatgtggagttcaactctattgggggactggaaacaatcaagcaagctttgtttgagcttgttattctgcctctaaaaagaccagacttgttttcacatggcaagcttcttggaccacaaaagggggtcctgttgtatggaccgcccggcactggaaaaaccatgcttgccaaagctattgccaaggagtccagagcagtttttattaacgtgagaatatcaaacctgatgagcaagtggtttggggatgcccaaaagcttgtagattggccagtaggagataggacaattaagagcttagttacagttgctgctgtatttagcttggcttataagcttcagcctgccatcatattcattgatgaagtagacagttttttgggtcagcgtcgtggaacagatcacgaggctatgttaaacatgaaaactgaattcatggctctgtgggatggatttacaacagatc

SEQ ID NO: 817 - DNA, 564 bp, Glycine max
  Peptide Sequence Number=SeqID_117595
atggcttcagatcggaaacttcacacttttgaggaggtggcaaagcacaaccagaccaaggattgctggctcatcatttctggcaaggtgtatgatgtcacccctttcatggaggatcatcccggaggtgatgaggttttgttatctgcaacagggaaagatgcaaccaatgactttgaagatgtggggcacagtgattctgctagagatatgatggaaaaatactacattggtgagattgatgcatcaaccgtcccactaaaacggacctacattccacctcagcaagctcagtacaatcctgataagactccagaatttgtgatcaagattttgcagttcctggtccctctcctgatcttgggcttggcctttgttgtgcgacactacaccaagaaagagaaaggtggagatggagatggaagaggagaaacgttaaacatcaatcaaaacaatgaatgtggggtagcaagtttcatggagcatgggccaggctctgaagctagcaatgttgtttctgagtacagatggcagcctagtggaaagactagccgatgttcatga

SEQ ID NO: 818 - DNA, 1602 bp, Glycine max
  Peptide Sequence Number=SeqID_117596
atgtacgtgaactccggcgccggcgagtggggctcggcgccgttcacgcatccggccagcttcgagacggtggcgatggacgcggagctgaagaacaaggtgaagtccgatctggaacagttcgtgaagtcgaagcagtactaccaccggctaggccgcgtttggaagcggagctacctcctctacggcgcgccaggcaccggaaaatcctccttcgtcgccgcgatggcgaagttcctctgctacgacgtctacgacgtcgacgtttcgaagttcaccgacggcgccgattggaaggtgatgctgatgcaaacgacggcgaagtctctgatcgttatcgaggacctcgatcgcttgctcacggagaagtcaaagtcaaacgcaacgagcttatcgagcgtgttgaacttcatggacggaatcgtatcgtgctgcggagaagaacgcgtgatggttttcacgatgaacgaaactaaggacgaagttgatcaagcggttctgaggcctgggagagttgacgttcacatacactttcccttatgtgatttctccacctttaagattctcgcgagtagttacttagggttgaaggagcacaagcttttccctcaggtggaggaggtttttcagaccggggcccggctcagcccggccgaggtccattcagagggacagaggttgagccaaagcgggtcgggtcggaatagcgatgataacgaaccgggtgcggttatatgtagggagagtgttcacacggtgagggagttccggaagctgtatgggcttttgcgtttgggaagtaggaggaaagaggagtcctattcggggcccatagagaaagaggctccactaggagatttcgagacagcattttcctccatcccgtttgttgcgccagggacagacaaagcagaggcacttccaaaaccaaaaatgatcaaactcgcgggaccgtgcatcgtgtttctcgacgcgtgtgggcacacacaaacggaaccttccactgcgacgaggccctcgcctgcttcatgcttcgcctctccaaacgcttcaccggcgctcacattgtccgaaccagggaccccaaccttctccaatccctcgacgcagtcgtcgacgttggaggcgcgtacgacccgtttcgaccatcaccaaaagggcttccaccaagtcttcggacacggcttacacaccaaactcagcagcgcttgtctacaacgtataattgcgaatgtgctgaagcttgatgaagaccatcctgatgtgcaccagttgtatcctactatatacagaaacgttgtggaggcaattgatgctgtggataacggagtcaatcaatatgaccttgatgtccctccgaaatatgaaattaacacgatcctgtcctctagaataaaacgcttgaatttgagctggatggattctgaccagtcttctgatagagaaaacgaggcttttcttcatgcaatcgtgctggccggtgctgaatttttggagaatgtgaactattatgcaaagtcatggttaccggcacggtctactgttatggagagtcttgcagcaaggggaagtgctgattcaagtggagaaattatactgtaa

SEQ ID NO: 819 - DNA, 309 bp, Glycine max
  Peptide Sequence Number=SeqID_117597
atgattagtagaattggatcaaacactgacatgcccaacaactttaacagagtaaagcttaagactcatcaagatgatgcagtgtgtcaagttgccaacagccatcaatcattgagacctcggagaaataactgccattggattgggttcggcagggttataattttaagcagtggtgaagaactgagcacatcggtattgcaaaatgcaaggagtggctgtgaagtcttcagtaggttgcaagttgcaactatgcatcttcatgagcagagtgattgcctatggttgtgtcaggaagcaattttgtag

SEQ ID NO: 820 - DNA, 489 bp, Glycine max
  Peptide Sequence Number=SeqID_117598
atgaatttccataaccccaatacttctcttcacctaagccaacacgatgatgagaaccatctcaacctagatcttcttcttgagccatcttcttcttcttcatcttcaccttcacctatttgttccatggagccacggatattctcatgcaactattgccagagaaagttctatagctctcaagcactagggggtcaccaaaatgcccacaagcttgaaaggacactggccaagaagagcagggaactgagtttgaacatgcaatcttatggagcagcggagcaaagatcaaactttggtgcttcacaccatcttggtcatcgtgctcttggggttgtggataaccaaggacaaagttatgtgaggcttggtggaaggaaagagttcagttatggttccaaggaaggggtaggggtggcttcctggtcaagggcttctgaacatgttcaggaggatatgggccaacttgacttgtcgttaaggctttga

SEQ ID NO: 821 - DNA, 261 bp, Glycine max
  Peptide Sequence Number=SeqID_117599
atgactaatataaccggtgttggtggtttcagcatgaaagatgaagctgcaggggaaattccagttgcatttgttgtaaggtcaaatggttctgagatcgccgaggatgaaatcaagaaatacatttcacaacaggtggttttttacaagagaataggtagagttttcttcacggactctattcctaaagcaccctcaggcaaaattctgcgaaaggtattaactgcaagacttaacgaaggtttggtggtggccaattag

SEQ ID NO: 822 - DNA, 732 bp, Glycine max
  Peptide Sequence Number=SeqID_117600
atgctacaagttggtgaaacaagcaagttcataaagcaagatcgggctaatgagatatataaacgagttgaagatcagaagtctagtagaggaagaaatcaggatgcattattggctgcttgcctgtacattgcttgtcgacaagaagacaagccacgcactgtaaaggaaatttgctctgttgccaatggagccacaaagaaggaaattggccgagcgaaagaatacatagtaaaacaactgggattggaacagggccaatctgtagagatgggaacaatacatgctggggactttatgagacgtttttgttctaatctcggaatgactaatcaagctgttaaagctgctcaggaagctgtccagaaatcagaagaatttgatataagattagctttagatttaatgctattgctgtttgagtacaagggtgtcattatggataagaaatctttgagtttctcgagatgtgtgctgcacttatgggggaagtggagactatgggaacatggggcatgttggaggagtcccatatcaattgctgcagcagttatatacatcataactcagctttctgatgataaaaaacctctcaaagatatatcagttgccacaggagttgcagaaggaaccattaggaactcatacaaggatctttatccccatgtttcaaaaataataccaagctggtatgcaaaagaagatgatttgaagaacctgtgcagtccttaa

SEQ ID NO: 823 - DNA, 345 bp, Glycine max
  Peptide Sequence Number=SeqID_117601
atggagcattttcttgagcaagtagcctggcctgaagctcaacttctattggtgagacccaacgaggctgctcagcctaaacccacacctgtgcaggtcaatccagagccagctaacccacaatctccagtggtgaatccaccttcttcacctgagcttgaagcagttccgccatctcctcctctgattgtcatttctgacgcatcatcaaatgaagcagctgcccctcctgattcaccaattacagaaacaactgacccccatgtttccccaattggaggaattgttgatctttctaattcgtcatctagagaagttgttgctctcaccgaatccccagtttaa

SEQ ID NO: 824 - DNA, 408 bp, Glycine max
  Peptide Sequence Number=SeqID_117602
cgcggcgtccaccagcatggcttcgtcgcgctgctgcgacagccgcgtcttgcggatgcggttgatccccgccacgaagtaggccgcggccccgaacaagggcgagaacagcgtcaacccgacccagccgatggccgagcgcacgtcctgcttggtcatggcggcatgcaccgccgcgcccgtgcccgccaccacgctgatgccgaacaccatgtgcggccaggtgattcgagcgccaaggatagcaaggccggcgggcgtggcaagaggatggaattgccctggctgatccggacatgtcagcggttttacacggccagaaaaaacatgctagaattcggcctctttgcagttgagcacgaaatgctatgtgccagcagcgaagaaaaccgtcagtggtggctgtag

SEQ ID NO: 825 - DNA, 570 bp, Glycine max
  Peptide Sequence Number=SeqID_117603
atgcaggtgttcgattacggcgcgccggtgggctggcgtctcgcagtggcgcaaccgtcgcgcatcaccgccatcatttcgcagaacggcaacgcgtacgaggaaggcttgggacaaggctgggccccgatccagcgctattggaacgcgccgtcacaggccaaccgcgacgcgctgcgcgaattcgccacgccggcgtccatcgcctggcaatacctggaaggcgtgccggacaagaccctggtcgcgcccgacgcaatcgcgctggaaagccagttggtgtcccggcccggcaatgccgaggtccagctcgacctgctgctggactatgcgtccaacgtggcgaagtatccgcagttccaggcttatttccgcgagcatcgaccgccgctgctggccgtgtggggcaagaacgatcccttcttcctgccggcgggcgcccaggcgtggaagcgggatattcctgacgcgcaggtgcggttctatgacaccgggcacctggcgctggaaacgcatggggtggagatcggcggggtcatccgggagtttctggatgggaatgtgaagtag

SEQ ID NO: 826 - DNA, 165 bp, Glycine max
  Peptide Sequence Number=SeqID_117604
atgggatctcggaaccctgtcatgggatggcattgtaaagttcctagtcaaagtaaccatgactttcatccatcattcaggaaggcctcaaagggcaggttgaagaggagaaagaagggtggaatcatggtcagtgataccatattcggagtgatagcgatgtga

SEQ ID NO: 827 - DNA, 1509 bp, Glycine max
  Peptide Sequence Number=SeqID_117605
atggaagagcaacaagctcaccacgacttcattttccattccaaactccccgacatttacatcccatcgcacctccctctccacacctacattttccaaaacctttcccaattcaaacaccgtccctgcctcatcaacgggaccaccggcgagaccttctcctaccacgccatccaactcaccgcccgcagagtcgcctccggtctcaacaaactcggcatccaaaaaggcgacgtcatcctcctcctcctccagaactgcccccaattcgtcctcgcattcctcggcgcctcctaccgcggtgccactgtcaccaccgccaatcccttctacactccggcggaggtagcgaaacaagccacagcgtccaactccaaactcatcataacgcaagcatcttacgtggataaagtcaaggatttcgcgagagaaaacgacgtcaaagtgatatgcgttgactcggcgccggaaggataccttcccttctcggagttaacggaggccgacgagggagacattcccgccgttaaaatatctcaagatgacgtggttgcgctgccgtactcgtctggcacgacggggcttccgaagggagtgatgctaacgcacaagggactcgttacgagcgtggctcaacaggttgacggagagaaccctaatttgtattttcggagcagcgatgtggttttgtgcttgcttccacttttccacatttatgctctcaactctgttttgctgtgttcccttcgagtaggggcttccgttttgatcgtgccgaaatttgagatcattacgttgctggagttgatccagaaacacaaggtgagcatcgcgccgtttgtgccgcccatcgtattgaccgttgcaaagagtcccgatttggagcgatacgacttgtcgtcgattcgaatgattatgtcgggtgcggcacctatgggcaaagaacttgaggattctctcagggccaaacttcccaacgccatactcggacagggttacgggatgacagaggcagggccagtgctatcaatgtgcttagcgtttgcgaaggagccaatgcaggtgaaatcaggtgcctgcgggactgtcgtaagaaatgcggagatgaagatcgttgaccctcgaactggtgcttcgcttcatagaaatcaagctggtgagatttgcatcagaggcaaccagatcatgaaaggttacctaaatgatcaagaggccacacaaagaactatagacaaggaaggatggttgcataccggcgatattggatacattgacgatgatgatgagcttttcgtagttgatcggttaaaggatcttatcaaatacaaaggatttcaagtggctccagctgagctcgaagccattttaattgctcacccaagcatttctgatgctgctgttgtgtccatgaaggatgaagttgcgggagaggttcctattgcatttcttgtacgatcaaatggttctaaggtcaccgaggatgaaatcatgcgatacatctcaaagcag

SEQ ID NO: 828 - DNA, 132 bp, Glycine max
  Peptide Sequence Number=SeqID_117606
atgaggctcagcccaacagtggcgctaagcgcacataaggcgctaagcgagcaaccaaatgcaggcgctaagggatgcgctaagcctggctacgcgcccagcgcgcccagaagctcacttcagcaactataa

SEQ ID NO: 829 - DNA, 759 bp, Glycine max
  Peptide Sequence Number=SeqID_117607
atggaaaaaacatcaaaagaaaacgctttacaagatgaagaatatacctacgctataggaagtagcacagggccagagaattggtggcgtatcaaccaaaaatggaaaacatgtggggatggaaaactacaatctcccattgatctgcttgaccaaagggttcaagagcttcctcaattgggtaaacttaagaaagcttacaaatcagctcctgctgtcctaaagaataggggtcatgacatcgtgctggaatggaaaggagatgcaggccagcttaacataaatgaaacttactataatctgattcaatgtcattggcatacaccttcagagcacacgttgaatggaacaaagtttgacttggaactgcatgcagtccatacaacctctaaaggagagtttgctgttattggaatattgtataaaattggttctccagatccctttttttcaaagctgctcaatgacataaaatcaagtgtggacaaggatatagatgtaggactaatcaactcaagagagatcaagtttaaaagcagaccgtactacagatatgttggttctcttacaactccagcatgcactgaaggtgttgtttggacaattgtgaagaaggtcaggacagtctcaagcgagcaattaagtgccttgaaaggagctgttcatcatggatatgaggaaaatgcaaggccaacgcaggaacttggtggaagacaagtttggttatatggacctatggagaatgaaaagcctacttaa

SEQ ID NO: 830 - DNA, 834 bp, Glycine max
  Peptide Sequence Number=SeqID_117608
atggctcagaaaatcaaagatgtcagcaagaggctagacaaggttgcagctgataggcacaagtttggtctccgaacaattgatgttgacacacgtgttgtgcataggagagacacgagtcgcatgacacactcccgtgtgagtgactcagatgtgataggaagggaacatgataaagaaaagatcatagagcttttgatgcagcagaatcccaatgatgatgataaaagtctctctgttatccccattgtggggattggaggcttgggaaaaactacacttgcaaagtttgtgtttaatgataagaggatagacgggtgtttcccattaaagatgtgggtgtgtgtttctgatgactttgacattaaccaactcattatcaaaatcatcaattctgcgaatgttgctgatgctcctcttcgccaacaaaatttagacatggtcgatctggagcaattacaaaatcaattgagaagcagacttgccggtcaaaaattcttacttgtcttggatgacgtatggaatgatgaccgtgttagatgggttgagctgaggaatttaataaaggtaggggttgctgcaggaagtaaaattctagttactacacgtattgattccattgcttccatgatggggactgttgcctcttacaagttacaaagcctttctccgaagaattcattgtctctttttgtcaaatgggcatttaaaaacgaaggcgaagaggaaaagcatcctcatttggtaaatatcggaaaagaaattgtgaacaaatgcaaaggggttccattggctgtgagaacattggggagtttactattttcaaagtttgag

SEQ ID NO: 831 - DNA, 459 bp, Glycine max
  Peptide Sequence Number=SeqID_117609
atgcaagtagggttacgggatgacagaggcaggaccagtgctgtcaatgtgcttagcgtttgccaaagaaggcaatgcgcgcaggagaggttcctgttgcatttgtggcaaatttcccaacgaggagttgttttacaaacatattctcagattagggctatttcgaaagtatttttcagggggtgctgtttttgcatgtccccagcatgggatgcgccagtactgctggcgacttcgtgcatggcggacacgtgtcaaggggggaaggaagcgtcattactgctggcgatttcagcccacgtgaagtgggaaacgccaattggcgccacaatggaagcgccagtgctcttggcgattcagcctagggtaggcaacttttctacagcagctagggcagctttgcagcaagtgtgtgcagtgcctttgcagatggtggcgctactccttttggtgatttag

SEQ ID NO: 832 - DNA, 1554 bp, Glycine max
  Peptide Sequence Number=SeqID_117610
atggaaaagcaacaacctacacagcctcagcctcaccacgacttcattttccgttccaaactccccgacatttacatcccaacgcacctccctctccacacttaccttttccaaaacctctcacaattcaaagaccttccatgcctcatcaatgccgccaccggcgagactttcacctacgccgccgtcgaactcaccgcccgcaaagttgcctccggtttcaacaaactcggcatccaaaaaggcgacgtcatcctccttctcctccagaactgcccccaattcgtcttcgcattcctcggcgcctcctaccgcggtgccaccgtcaccgccgccaatcctttctacactccggcggaggtagcgaaacaagccacagcgtccaactccaaactcatcataacgcaagcatcttacgtggataaagccgacgagggagacattcccgccgttaaaatatctcaagatgacgtggttgcgctgccgtactcgtctggcacgacggggcttccgaagggagtgatgctaacgcacaagggactcgttacgagcgtggctcaacaggttgacggagagaaccctaatttgtactttcgcagcgacgatgtggtagtgtgtgttctgccacttttccacatttattcgctcaactctgttttgctgtgttcgcttcgagttggggctgccgttttgatcgttccgaagtttgagatagttgcgttgctggagttggtgcagaaacacaatgtgagcgtcgcgccgtttgtgccgccaatcgttttggccattgctaagagtcctgatgtggagcgatacgacgtgtcgtcgattcggatgatcatgtctggcgcggcacccatgggaaaggaacttgaggattctgtgagggctaagcttcccaacgccacacttggacagggttatgggatgacggaggcaggaccagtgctatcaatgtgcttagcgtttgcgaaggagccaatgcaggtcaaatcaggtgcctgcgggaccgtcgtaagaaatgcggagatgaaaattattgatcctgatactggcgcttcgcttcataggaatcaagctggtgagatttgcattagaggcaaccagatcatgaaaggttacctaaatgatcaagaggccacagaaagaactatagacaaaggaggatggttgcacacaggtgatattggatacatagatgataatgatgagctcttcatcgttgaccggttaaaggagttgattaaatataaaggatttcaagtggctccagctgagctcgaagccatgctagttgctcatcctaacatctctgatgctgccgttgtatcaatgaaggatgaagttgcaggagaggttccagttgcatttgttgtacgatcaaatggttcaatgatttctgaggatgaaataaagcaatacatctcaaagcaggttgtattttacaaaagaattagtagagttttctttgtgggctcaattccaaaggcaccctctggaaagatctttcgaaaagacctcagggcctggcttgcaaccgatcttgctatttag

SEQ ID NO: 833 - DNA, 210 bp, Glycine max
  Peptide Sequence Number=SeqID_117611
atggccatctctttcttggcccaggttattccgaaaatcttccggaacttcttccggaaactttcccggaagaaccttcttccggaagaacaaattgtgttctactggaagaaccttttttcggaagaacaaattgttgttcttgttgttcttccggaaagtttccagaagaagtttcttccggtagacaatttattcttccggaagaag

SEQ ID NO: 834 - DNA, 426 bp, Glycine max
  Peptide Sequence Number=SeqID_117612
atgcagaaaaagtcgtttctattgagccgcctcagggtggcggtgaagaagatgaagctgctactaagcgccaccgtactcagccatgcgtggcatgctgcaaccattctccgcggcgtttctatgagcaaacgacagattagtttcaacgaccgaccagggttgatgatgtgcactgcttcatcagatgaaactgattcggagggtttggtttctccagcgcatcatagccttcagaggaccataagctgtccctctgatgatgatatcgataaaagagcagagatgtttataaggaaggacctccattttgcagtctgcgatgatcgccaagagaacgtggacaaaatttgtgaaaaggattttggattgattttgaaggctaagcgattagaagggcctgggagcatatgctgtttttgttag

SEQ ID NO: 835 - DNA, 282 bp, Glycine max
  Peptide Sequence Number=SeqID_117613
atggaacatgggattagcaataaagatgggaaggccaaggttactgattttgggcttgctagagtggttgctattgtggacagtcatgctactacaaaaggggatgtctatagttttggggtgttggttatggagctggcaacaacaataagagcagtggatggaggggaagagtgtttggtggagtgcaaaatttgttgttatgggttatggacaacatcatgggttgggccgttctgtgtcgcttttgctaatgggttttgggcttgttggtcgggctaa

SEQ ID NO: 836 - DNA, 231 bp, Glycine max
  Peptide Sequence Number=SeqID_117614
atggtttcttttgctattggtttatgtgaactattttgcacatgtcttgtttctgaaaatgctcatttaagctccacctctcagaataagaaaagaaagaaaactaagggtgttgctaaagggtcttctcataaaaagaaaccaaagaaggatgaggaatttacctgctacttctgcaagaagtcaggacacatgaagaaagagtgtcccaagtacgcacatggtgtgtaa

SEQ ID NO: 837 - DNA, 210 bp, Glycine max
  Peptide Sequence Number=SeqID_117615
atgtgcaaagtcgtagaagatgcaggcgtggtggtgggagatgtgcatgccgccgccgaggctgaagaggttgacgtcaacgttgatggtggacttcttagagtcatgaccgaggacgatggagtaggtctgcatgtagttctcgaagtccttgctcaggagcttttcgaacacaacttccacgttgcggctcgctgccaccacggttga

SEQ ID NO: 838 - DNA, 901 bp, Glycine max
  Peptide Sequence Number=SeqID_117616
cacgctggtggcgatagccgccaatggcgcgaccaacgacaccacgccgcagctctccggcagcgccacggcgggcagtatcatcactgtctacgatggcgacagcacgacgccgatcggttcggtgaccgtgggcgccgatggcagctggcagtttgttaccggtacgctggacgagggcgatcacagcctgacggtaacggtgactgatgcggcgggtaacgtcagcgatccttccgcgccgattagctttaccgtggataccacggcgccggacgcggtcgtcgatctgctgctggtgaacaacaatgtcgatccggccacgccaatcacctcaggcagcaacaccaatgacagcacgccgctgctcagcggaacggcagagccaaatagcaccatcatcgtctatgacggacagacgcctatcggcacggcgacggcaggtaacgacggcgcatggaccttctcacctgaactgaccgatggctcgcacagcctcagcgtgacggtcaccgacgtcgccggcaatgtcagtgcaccgagcgccagtgtggcgatcaccgtcgataccgtagcaccgtcggcggtcacccagctgagcgtcgccagcgacaatggcaacggcgatccggtcaccatcccgaacggcggcttaaccagtgacaacacgccggtgctgagcggcagcggcgatccgggcagcctgattgtgattacctcgcaggacggtccggtgggcagcgtcactgtcggcagcagcggcagctggagcttcacgccggccagcgcgctgagtgacggcagctacaccttaaccgttgtggcgcgcgacgcggcgggcaacgtcagcgcgccggtcacggcacagttggtgattacgccaccgctccggatcaggtga

SEQ ID NO: 839 - DNA, 465 bp, Glycine max
  Peptide Sequence Number=SeqID_117617
atgtcgatctctccctgcagaaggatcgcgcccacaaggcacctagtagacctgaaggagtccgatagggccctggggtttccagctctggttactggcctctgtcattcctacagggtgctcgtccccccagcaaggtcatgtcatcgtgacataggtaagggtcgcacccacaagacacctagtggacccggagaagtccaacaggaccctagggtttccagctctggttacgagcctctgttagtcctacaaagtgcctatcccccagcaaggtcatgccatcgtgacataggggtcgcacccacaagacacctagtggacctggagaagtccaatagggccctggggtttccaactctggttacgggcctctgtcagtcctacaaagtgtccgtcccccccagcaagggatcgcgcccgcaagacacccagtggacccggagaagtccaacagggtcttag

SEQ ID NO: 840 - DNA, 739 bp, Glycine max
  Peptide Sequence Number=SeqID_117618
atgagagaatattggacctcgttggcttcagttttgggtgtgtttgccttctgccaaaccatcctccaagcagtgttcccaccggagctgcgcttcgcttccgtgaagctcttccaccgggtcttccactgcttctccacctactgctacttcgacataacggagatcgacggtgtgaacaccaacgagctctacaacgccgtccagctgtacctgagctcctccgtctccatcaccggcaaccggctgagcctcacacgcgccgtgaactcgtccgggttcaccttcggcctcgcgaacaatgacagcatcgtggacaccttcaacggcgtgaacgtgctgtgggagcacgtggtgacccagcggcaggcccagaccttctcgtggcggccactccccgacgagaagcgtggtttcacgctccgcataaaaaaaaaggacaagtccttcatactaaactcctacttggattacattatggagaaagccagcgacattcggaggaagaatcaggatcggctcctctacaccaattccaggggtggctccctggactcgcggggccacccttgggaatctgtgcctttcaagcacccaagcacgtttgacacattggccatggaccctcacaagaagaagcagatcatggaggatcttcaggacttcgccaatgggcaatctttttaccataaaaccggtagggcttggaagagaggctaccttctctatggccctccag

SEQ ID NO: 841 - DNA, 177 bp, Glycine max
  Peptide Sequence Number=SeqID_117619
atgatgactccaaacttgaatctggaactagaagatgattttaaagtcctcagccaagtcgatcctgacccaggtcctgtttctctggacttgtccctcaacttcaataccagtgatgaagagttgaaagttacaagtgacactaactgtgaagtaggacatgaaactcatgcttag

SEQ ID NO: 842 - DNA, 354 bp, Glycine max
  Peptide Sequence Number=SeqID_117620
atggccaatggtccagcaccgttttctgagattgggaaaagggcaaaagaccttttatacaaggattacaacttcgatcacaagtttagcctctcaattccaaactccactggattggggcttatagcaacaggattgaagaaggataaactttttgttggtgacataagtacactctacaagagtggaaatactacagtggatgtgaaagttgatacatactctaatatatatacaaaggtgactgtgaatgatatcttgcatggtacaaaagctgctttgagcttcaacatacctgatcacaagtcaggaaaggtgggaaaatctagctttcccagtgtgagacaatgttaa

SEQ ID NO: 843 - DNA, 978 bp, Glycine max
  Peptide Sequence Number=SeqID_117621
atgtcgcacagcgataccataccccttcacccatcttcccaatccgacattgacgagatcgagaacctcatcaatgccagcgttcaccaatcagtcccttcggcgagacctcccagtcccccacgcgcctccatccccgtctccgtctccgccgccccttcccccttcatctcctccaacctccctccaccgccacccctccctaaatcctccgtctccgccgtccctccgccccctcccccgccgcgcgccgacatctcctcctccgggttcggctccgcccccaacacgctcactgagcccgtctgggacaccgtgaagcgcgatctctcgagaatcgtgagcaatctgaagctcgttgtgttccccaaccctttccgcgaggaccccggtaaggccctcagggattgggatctgtggggccctttcttcttcattgtcttcctcggcctcaccctctcttggtctgcctctgtcaaaaagggttatgaattccgtcatctcttctctgatccactaacagcaagtgcagccatgagtggaacagaaggtgtagaactgcagtgtgactctgaggtttttgctgttgcatttgctttacttgctgctggcgctgtaattttgacattgaacggtggtgtacctaaccattctcaacagtatactttgatgaatgagggcaaatatttgactgtcttcatctcttcaaaatttcagggtggacacattattttctttcagagtctgagtctgttgggttattgcttgttccctctggacgtcggtgcattaatttgtatgttgaaggacaatgtcatagtgaaagtggttgttgtgtgtgtgacattggcttggagctcttgggctgcatatcctttcatgagttctgcagtcaaccccaggagaaaagctcttgcactctacccagtttttctcatgtatgtatctgttggttttctcatcattgccattgactaa

SEQ ID NO: 844 - DNA, 171 bp, Glycine max
  Peptide Sequence Number=SeqID_117622
atggcggtcacaggtcacaaacaacggtcacagggtcttacgggtgaaagggagaagaggaaggtagtgctagcaatagtggataacgctaatggcctgaaagtcaaggtcgacgacgctgccataacaaactactggctgctacaatttcactttatgcgtactccttaa

SEQ ID NO: 845 - DNA, 975 bp, Glycine max
  Peptide Sequence Number=SeqID_117623
atgattgccgctatggccaattttctcggctatgatatttacgatttggagttgactgaggttcataacaactctgaactcaggaagcttctcatgaaaaccagctccaaatcgattattgttattgaagacattgactgctctatcaatctcaccaacagaaagaacaataacagctcgagttccgtttctgcttcgacaggttactatgattcggagatacgcggtggcggcggtggttgtgctgaggagggtggtaacaatattactctttctgggttgttgaattttactgatggattgtggtcttgttgtggaagtgagaggatttttgtgtttactaccaaccacattgagaagcttgaccctgctctgctgcggagtgggagaatggatatgcatatcttcatgagttactgttctttccccgcgctgaagattctgctgaagaattacttggggtgtgaagagtgtgagcttgaggagccgattttgaagcggctggaggaggttgtcgacgtggcccggatgactccggcggatataagcgaggttttgatcaagaacagacgcaagagagagaaggcggtggaggagttgttggagactttgaagctgcgagcggagatgaatgaaaaaaatggagttctgagggtgactaatggggttgaagaggaggaagagcaagagaagagggctttagacagtgagagtcctaagcaggagtcagagattgaggacaattgcaaggaggaggaggaagaagaagagaagatcaaggctttacaccctgacatgcttggggagccagctgagatgttggtgaacacctgggtgcacatggcatgggaaaggctatcaggttgtcaagctaagagtagtgctgtgtactttaagaaaaagggaatgtaccaaaaacaaaaggctatagagaagggtttggctcaagggaaagtggtaagtgccgacaagtga

SEQ ID NO: 846 - DNA, 597 bp, Glycine max
  Peptide Sequence Number=SeqID_117624
atggagagactcctttctgtcatcattgtcaagagaaatcagcaggttcacaatgattctttcattagaccagtgagaccttggcaatttatctatcatcaatggcagctgtttaaggaacctgagacttcattttggaagggtactgctgttcctaagattcaaattgtggttacttggttgcctccttctcagggatggactaaattaaatactgatggctcagtgcaaggacctcagaatgtgactcttgtggggattattagagatgagaaaggatgttggatatctggtttttcaaaaaaggtgggaattgctttttcttttgctgtagacttatggggagtctatgaagggttatgccttgccaggaagattgggttagttgttgtggaagttaacattgattgtcaagctgttgtggatagcttatgtgggagtaaaacaggttgtgctgtgggttgtagattgatcaattctatcagaagtatgatcaatactagttggctggtggtgttcaagcattcttaccaagagactaacaagtgtgttgatgctcttgctagaaatgctttggttgtgttcaagcattcttag

SEQ ID NO: 847 - DNA, 1404 bp, Glycine max
  Peptide Sequence Number=SeqID_117625
ttgtctaagtgcttctttgctcagtctcaggtggagtaccttgggaacctcgtctcgcacaagggggtagaaccagtggcttcaaaggttcatcaaaagttatgcgacaattgcaacccctttagtccaggcgaccacagtggaccccttccaatggatggctcaagctcaaacagccttcgatcatctaaaggaagctttatcaacaacttcggccaccccatagctttcttcagcaaacccttcagccccaagcttctaagtgcctcaacatacgtgtgtgagctgtgtgcggttacgtcggtggtaaagaaatggtgccaatacctgcttggtcaccatttcacgattattaccgaccaccatagcctcaaagaattgttgagccagacaatccaaacactgaaacaacacatgtacttggtacgattgatgggctacaattataatattaagtaccgttccagcgtgcacaatcaagctgttgatgccttgtcgagattgcccaagcagaactcctccatgaccatgatcctctcggttccatgcttaacctttttggaggaattacgtcaccaacttgataaccattctggatacatacaccaatgccgagccattttggaatctctggctacccatccagagttctcaatttccttgaaccttgttctccacaaaggtcgcatttggttacctcgtgaattgccaatgatctccaccttgctcactgaatatcacaccaccccaactggagggcatactggggttgccaagacgataactcgtctatcggagaatttttattggttagggctcagagaagatgtaacacagtttgtagccaactgggtggagtgccaacttacaaagtacgaaaccaagaagcttgctggattgctatgccatttgccggttccatattgcctatgggagaatctttcgttggatttcattgtagggctcccgtcgtaccatgggaattcatctgggaatgttacccccgctcatagtgctctcatggtggcttcgttgttcatgaatatagtggtgaaaatccatggccttcctcagagcttggtttctgatcgagaccccctgtcttccaaaattgatgttgtggaagaaatgctatgtaacatggaagagacttttcaaactatacacaagaagcttgtgaaggctcaagagaccatgaagaactatgcagatttcgaacgcatagaggtagtttatcaacctggtgattgggtcttacttaaactatggccccatcgacaaacaactaccaaaggacctcaagcgagctcgggcaagcttgccaagtggttttatggaccctttcaggacttagaatgcattggcaaagtggcctatcacctgcaattacctgaagaagcttga

SEQ ID NO: 848 - DNA, 201 bp, Glycine max
  Peptide Sequence Number=SeqID_117626
atgtcctataacggattatcacggaagaaaggcttagctgaggcttcatcttcgttcaagcaattacttttcatttgtcctgctgaagagttgaaagatccttggtttcttttgcaggccaaagtaaagccacaacattcagagaagagcaacaacaaatctcatatgaatttgataccaagttggatacagttcctgtag

SEQ ID NO: 849 - DNA, 1137 bp, Glycine max
  Peptide Sequence Number=SeqID_117627
atggctccattaccacaacaattcatcaattatcaacccttagtttctcctctggctatcctcaattatcgtcgggtacctggtacacctaatgctccatgggaggtgttagtccaatggcagggtctgtctccagatgagacctcttgggaagattggtcccaactatgccaaaattatcaccttgaggacaagggaactttggttggaagaactcactcatatcgtgattcccttaatcaagcaagggccgtgaggagacccacatcacctgtcagatctcaatggtttcttgaaggagaccggaacacaaggtactaccatgataaaacagtgaatcggcgaagaagaaacaagattagcattctccgtgatagtgaaggtcattgggtggatgaggaggattttattgaggagctagtgaatattgcttatcaaaacttatttgctgaagacatgcctcaaggttcgtggagggataccccttattcctttcactttattaagcctgaaaatttcactatgcttgcggcccctttgcagcataaggaaattaaaatggctttgtttaacatgaaaccgtggaaaggccctggtcctgatggctttccagcgggttttttacagaatgcttggtctattgttggtggggatctttgtaatttaattcaagagtggtgggatcgaccggaggagattatggaagctaatgccaaaaacatttttctgattcctaaggtggaacaaccagaatttcagactggcttcatcccttcaaggagcattcatgacaatattgtagtagcacaagaaatgatgcattccatgaggcgtatgcaaggcaaagtggggtacttcattatcaaggtggacctcccaaaggcctatgacagaatgtgtttgtcttttgtggcgaagattcttaaagaggataagagagatttaaggcagggtgatcctctttcgccttatcttttttttctttgcatggataagttgtctcacatcatttccaaagctgttgatgatgggcattggaaacctatgaagatgggtagacaaggaccccaaatttctcatttaatgtttgcagatgatctgttgttgtgtgctcatgcgaatctggttcagatgtag

SEQ ID NO: 850 - DNA, 1666 bp, Glycine max
  Peptide Sequence Number=SeqID_117628
atatggtgatggtgagccaactgataatgccgcgagattttataaatggtttacagaggggggtgagaaaggagaagggtggcttcagaatcttcactatggtgtgtttggccttggaaacaggcagtatgagcattttaacaaggtggcgaaggtagtggatgacatgctcgttgagcaaggtattctattccttcctctatccctttcggtgaatattacttcaattatctggatctggatctcacatgaggatcccactgatgggttatttttgcgagagtcagacggaaaaggggggaagcgccttgtgccagtgggtctaggtgatgatgatcaatgcattgaggatgactttactgcatggaaagaagaactgtggccagcattggatgaattgcttagagatgaggacgatgcaactgtgtctacaccttatactgctgcagttttggagtaccgggttgttattcatgatccattggaagcatctgtcgacgaaaagaagtggcataatgtaaatggtcacgccattgtggatgctcaacatccagtcagggcaaatgtggctgtgagaaaggagcttcatactcctgcatctgatcgatcttgcactcatttggaatttgacatttcaggcactggagttacatatgaaactggggaccatgttggtgtttactgtgagaatttgtctgaaactgtggaagaggcaataaggttaataggtttgtcaccagatacctatttctcaatccatactgatgatgaagatggcaaaccacgtagcggaagctccttgccacctacattcccaccctgtactctaagaacagcacttacacgatatgcagatgttttgagttcacccaaaaagtctgccttgcttgccttagctgctcatgcatctgatccatctgaagctgatcgactaagacatcttgcctcacctgctggaaaggatgaatattcagagtgggtgattgcctctcagagaagtctccttgaggtcatggctgaatttccatcagccaaacctccaattggtgtcttttttgcagcagttgctcctcgcctgcagcctagattttattcgatctcctcatctccaaggacctccaactttagactcccttctgataataaagtgcctataatcatgattggtcctggcactggattggctcctttcagaggtttcttgcaggaaagattagctctgaaagaaggaggagctgaactcggcccctcagttttattctttggatgcaggaaccgtcaaatggactacatctatgaagacgagttgagtcacttcgttaatactggcgcacttgatgagctcattcttgccttctctcgagagggacccaccaaggagtatgtacaacataaaatgatggagaaggcttcagaaatttggagcatgatatcacaaggagcttacatttatgtgtgtggtgatgccaagggcatggccagggatgtacaccgcgccctgcacacaattttgcaagagcaggttgtctcttctgtgagggcacaagggttttggtcttctgtaatatttttcactatgagttttccatttccacaagaccttttgcttgcttacttagtgaattttttaaaaaatgaatctgtggctaatcaagttcctttgtga

SEQ ID NO: 851 - DNA, 456 bp, Glycine max
  Peptide Sequence Number=SeqID_117629
atgaagtcgatgagaacattgaaaaataaaactgtcggtaagggtaattttagaaaagaaaagttaaaaagaggtgcagaagtaaaatgcccagtgggcttctcaaaaaacccgaatcatatcccaaatcccggtcttggggtacaaaaccctaataattaccgcttcgagatctcgcagcgtcccaagttccagactataccagttaatcccaagcctttcttgaacaatttgactgggaagcctgtaattgtgaaactgaagtggggaatggagtacaagggctatctcgtttccgttgattcctatatgaacttgcagctggccaacaccgaggagtacattgagggacaatttactggaaatttgggagagattttaatcagatgtaacaatgttctctaccttcgaggagtaccggaggatgaggaaatcgaagatgctgctgaagactag

SEQ ID NO: 852 - DNA, 893 bp, Glycine max
  Peptide Sequence Number=SeqID_117630
atggaagaagagcaagcacacataatgaaagaatcagatgatgtggaatcccaagaagaagaagaagaacgagaggaggcactctcgctttgcgatcttccacttaaccgcaattcgagaactccaagcttggacgacacgtcgtttaagaaaattctccgaccgtcctcattacccgatcacgcctgcgagattttcaacggcttcagcagcagcagcagctccgacatgtgccccgccgacgacatcattttctgcggcaaactcgttcccttcaaggccgaagagccgctgaaaaatttcatcgtcgaggaggaaaaatctccctcgcgccgccgcagatcggagtcactctcctccgtgacgcgatcgaacagtgtgagcacgtgcaccggttctcgccaactcatgatgaggaacagcaagagcttggatcatagcaggttgcgagagtcttcggcgccagaggagcttcgtgccggcggaggcagcggcgaagaaggcgacgaagccgcgctggtactctctgatgttcgggacgatgaagattccgccggagatggagctcagcgacatgaagaaccggcaggttcgccggaatccatccgcaacgatgtttgtcgcgacggaatccggcgggaaggttgccgtcaatcgcagccccgggaaggtgtcgtggagaatactgaaggcactgagttgcaaggatcacagcagcgtcgccgtaacgacgtcgttttcgttgccgcaagcatcgtaggtttgaagtcacgtgaggtggacgtgacgagagggttttattgttatgttgacgcaattgccctgtggtttgggaggaaaagttggatatggaagggtgggggacgcatagtgaaggatcatggttcctccaa

SEQ ID NO: 853 - DNA, 405 bp, Glycine max
  Peptide Sequence Number=SeqID_117631
atgacttttgaggttatacctacatcaactgattataggcacatgttctatgaagttttatctacatcacgtagttgtaggaaaaaggcgtccaagaactgttggaatctagatgatccaaccgtgacatttagagggccaaggaaggccaggggagcccaaccttctccttctggagggggtggggcctccacagcccaagagcctgagccagaggagccagcagtagcagagggggaggatgagctcacccctcctgagcccttttattttgatgcaggtgtacacatggctcaggaggaggagacttccacagaccagatcccagagccatccccagtacctatacctgatgatgccataccatttgcaccatcatctgagctagagcagcctatcccttag

SEQ ID NO: 854 - DNA, 399 bp, Glycine max
  Peptide Sequence Number=SeqID_117632
atgacatcccaaccagattggtggcatccgatgtccaacttatcatctgtagcacaaggccggcttaaggcccaagcagcccaagcaaggagtaatgctggagagaatagtgagagagtcgagaaacgacaccgtttcggcaacaagggaggtgtggttgatgtatttgaggccgatctagcagtcgtattgatagccgaggggggcgttcatccaggtgcaggtgaacttgacagcaccgcgatgaggggtgaggtggtcgtgagggaggtgtccatgatggactgcaccttggattgcacgaggaggaggttggaggttgagggtgaggaaagagtgagcgagaacgcgaagaacacaagctcaagagagagaatgagagctagggtaccagtgtga

SEQ ID NO: 855 - DNA, 480 bp, Glycine max
  Peptide Sequence Number=SeqID_117633
atggcaagttcaacatgctttcaacaaatttcttcacaaataactatcatgaagcagaaacctagcaaaactgcccatcatatctcccaaaacccaatacccacgaaaatcaaagatgcgcttcacaactccgaaaatgccttcctttcgcgatttggagcagaaatgatgaccaaaggttggagctttgttggagcttcaatggaggatgagaggggagaagaaagctacctatgccacatgtctccatttgagtggagcaaaaagggcccactttttccccttgatgtgactcatactcagtcacaaaaagggaaaaatcttacctttgcaacgctaaaaaaaaaatcctacatcggtttgcatgccgtttctctggttcctgttcctcgcgttcctctgcgtccgtcggggccagttttcgaaagtaggcaatatatatatcaaaacgctcagaatgaaaccccgagcgtggtttag

SEQ ID NO: 856 - DNA, 174 bp, Glycine max
  Peptide Sequence Number=SeqID_117634
atgtattcgagtccaagccagttcgacggaaatgcagccttctccggtggtggattcatgccttctcagaccactcagggccccgactcttcgttggttccttccaagaatcgcgacgctcagtccttgcttcctctgacagtgaagcagatatacgatgcagtcaagcgatga

SEQ ID NO: 857 - DNA, 387 bp, Glycine max
  Peptide Sequence Number=SeqID_117635
atgtctgatgacttcttgtttacttgcaggcttcatgaagctgttgatacaaatgaagcagaggctatcttgcctgtgactgactttaatgagattgctagtcatttcagcgattgcatatatgtgcatctctacaattccagattaaggtctagtgtccctaatcagcagcattcctcaccaattcctcccacaatagtttatcaagcacaagctgttccgccaacaaatcagttctctgatcaacatatcaatggtcagaagggtgttactgttgaagccatggtcttagattttttgcatcatcccacaaacaggttaacgtcctcagtgagaacaaatggaaaggaccatgttgcatatattttggtaattagagaaccataa

SEQ ID NO: 858 - DNA, 558 bp, Glycine max
  Peptide Sequence Number=SeqID_117636
atgatggattttgagtatcagaagatgtcatcaacgagcaaaattctctcaaggagatcctcaatggagtgctcctctcgcatctcttattataggagcagtgaaggggttccattcaaatgggaaatgcaacctgggattgcaaagggacaacaaccaagagaagttcttcctccactgagtcctccaccagcacttctcagcctagggctacccaagccatgcattccagaccccaaaccttcaacaaggtcaaggttaaggttttggaagaaaagggtaaaacgtggaaaaagcaaaaagtcaccctcatcgtcccatgattgttttcatgaagatgatgttattggtttggacatattagattgcagctctgattctgagtctaactctatggcatcacctcgtggttctagtttctcttcttggtcgtctatgtcgtcattcatgaaaagtcctactaatactatcagagaggtatgtggaaggccttcgaccttaggttgcttccccatgcatgttagcagagttttcgtttccattgcaaggcgtgattga

SEQ ID NO: 859 - DNA, 336 bp, Glycine max
  Peptide Sequence Number=SeqID_117637
atgactggtctcccaatgattttacctagtgagagtgatcggacttaccaatgtgtgtatgtgaatgatgtgaaaatgtgtgagacgtgtcaggtggatggctatgaagaacttcatgcatcaatgaggtccttcaatggtgattttccaccatggagatgcagcggaagacaaaggagaagaggtgagaggaggcgccatccactagggaataagccatggaagaaggagcttcaccacctagaatgtgccttggataagaagcttagagaggatgcttcaatggaggaaaagaaagagagaaggggggagcacgaaattgaaggaataaaatag

SEQ ID NO: 860 - DNA, 1380 bp, Glycine max
  Peptide Sequence Number=SeqID_117638
atggggaattcagaagtaggacacatgaatcttggagcaggaagagtggtttaccagaatctagtaaaactgaatatggcagtagaaaatgggaccctgggggaagaaaaagtcattcaggaagctttcgaatatgctaaaagggaaaataaaaaagtacattttatcggattggtttccaatggaggtgtacattcccatatcaatcacttaaaaggtcttttaactgcggctaaaaatttcggattgaatgaaaatgtttttgtccacgcttttacggacggtagagactgcgatccgcattcaggattgggattcatcaaagaacttgatgaacatatgcttgctacgaccgggaaactggcaactattgtcggaagatattacgccatggacagggataagagatgggaaagagtaaaattagcttatgatgcgctaacagaaggagtaggacttcaaacaactgatgcattggcagcaatccagcagtcatatgataataatgttaccgatgagtttttaaagccgattatccttatgaatactacggaaacaggtaatgtggttcctgtagctaaaattgtggataatgatgtggttatttgctttaacttccgtaccgaccggggaagagagatcacagaagttctgtctcagaaagattttccggaattctttatgcgtaagctgaatctgtattatgttacccttaccaactatgacaagacctttaataatgtaaaggtagtttttgatgaagaagttttacaggaaacgatgggggaaatcatcgaaaaaaatggtaaaacgcagatccggattgcagaaacagaaaaatatcctcacgttacctttttcttttccggtggtagagagaaagaatttgtaggggaaaaaagattgctttgtccaagccctaaagatgttcctacttatgatcttaagcctgaaatgtctgcctatgatattaccaatgctattgttccggaactggaaaatgaaactgcggattttgtttgcctgaactttgcgaatacggatatggtaggacatacgggagtatttgaagctgctgtaaaagctgccgaaacggtagataagtgcattgagaaagtggctactacagcttatgaacatggttatgccgtctttatccttgcagatcacgggaactcagatgtcatgatcaatcctgatgggacaccaaatacacagcattccacgaatctggtaccgcttattataatggataaggaccgtacatggaatttaaaaccggggaaatccggaaaactgggcgatgtagctccgactattttaaaaataatgggaatagacattccggaaagtatgacaggagatgttttagtaaactaa

SEQ ID NO: 861 - DNA, 312 bp, Glycine max
  Peptide Sequence Number=SeqID_117639
atggtctttgtacttgatggtgctcacgttcatacgtcgtatgttgtgtatgttcatggggggtgcattgaccttgtcgaatgtccgtggtgggggaaaatagagtggttaaagagtttaaacatctctgaggggatgtttaggatctttaattcatccatgttccttgtgaggaggactacttgtactagggggggtgtcactcggtttgggaactcccttgtggctcaagctgatcaccatggagggggggggggttacggtgcacgacagggtggcctcgacacttactacatagtttccctaagtgag

SEQ ID NO: 862 - DNA, 408 bp, Glycine max
  Peptide Sequence Number=SeqID_117640
atgtctaatagctataggctaaaggctatagctagaaagaaggagatgaagctaaagcaacttgatgagaaaacaacttttctccatggaaagttggaggaagaaattattatgaaacaaccaaaaggttttgaggtgcaaggaaaggaagattcagcttataggttgaaaaggtaccttaagggtacaactgatattggacttatctaccaaggtgacatattgtgtgcacttgctggatatttggattctagctatgctgcagatttagatgtagggcgatctgtgacaagttatgctttcacaatgtccaattccattgggaatgaaagtatttggttaaagggtcttatcaacaatcttggatttcctgaggataaaactatcattttatgtgatagtttgagt

SEQ ID NO: 863 - DNA, 204 bp, Glycine max
  Peptide Sequence Number=SeqID_117641
atggcggtttgtgaaagagcttggaacattggaaatggttttggaagaaagaaaggagaagaaatggcatttttccgaagctacttgaactacaaggctcaaaacgcacaagtgactaaggctctcggaaacagaaacgtcgcacatactcgagacatcttctcaaagatcccaacggtcagatcgtggaaaagtgttctgtga

SEQ ID NO: 864 - DNA, 243 bp, Glycine max
  Peptide Sequence Number=SeqID_117642
atgggagccgatgatgaagaatggtggaggccaattcggttgcgggcgtggatgaatgagatggtggagtcggggacattggagttgttgacaacgatagtggaggtggaggtggatttgttggtggaagctcgtagtaggatgctctggcaagcgacggtgatggaacgagggatggagagtgaggagaagtgtgtgagagaaggaatgaaactgaagagacttgaatcccaaatggagtga

SEQ ID NO: 865 - DNA, 267 bp, Glycine max
  Peptide Sequence Number=SeqID_117643
atggatcaacaaaaggtgacagtgactgggtatgtggagaaagggaaggtattaaggattgttagaagaacaggaagaaaggcagaatattggccattcccttatgatagtgaatactacccatatgcctctgaatacttggatgagtctacttttgcttcttcctataattactacaggcatggttacaatgagagtgtttatggctattttcctgatcaagcatactcaaaagaaaataaaaggggagttgatatggtgccttga

SEQ ID NO: 866 - DNA, 141 bp, Glycine max
  Peptide Sequence Number=SeqID_117644
atgactccgatgagtgtgaatctttatcaagaagaggactatttcggtgtcaaagaagctgtggagggtggaccgcagaggcgacaatggcgtggggttggtggatgttcccacgatgacgtgacattttctgaatggtga

SEQ ID NO: 867 - DNA, 401 bp, Glycine max
  Peptide Sequence Number=SeqID_117645
gtatagctgcaaggggaaatcttgttcccttgaacctagagatcaaagcagcttgcagaaggaacaaagctgcaagaagaaggagagagcaacaagaggtgcagattaatcaaggagagacagaatcttcatttgaattattttatccctcttttgtgaccagaccacatcctttctctgaagaacacatcatggcagaggaccgtccacagaggatgacgctagaggaatactctagctttgctacacctcaatacttcaccaacatagccagaccggacgtgcaagcgaccaacatctcatatccacattccctcatccagctgatccaggggaatctgtttcacaacttatcgagtgaagatctgtacgtacatctggccacatacatcaagatctag

SEQ ID NO: 868 - DNA, 300 bp, Glycine max
  Peptide Sequence Number=SeqID_117646
atggccaaaatacatcatcaagcatggcaaccaaaaacatatcatccaatgaaacataccccccctcacacttattcccaaaacaattccaaagctccaaaattccttaagggtagggtgaaatcatggctcatttggctagaggcttataagaacaaaatgcctaaatcatctcccaacatgcatgtgaagcaagaagtatcaacaagagtcaagccaaggctattgtgcaagcaatcaatggggcaaaacacaccgaataaaataaatgatgatggctcaaattctcaccaagggtaa

SEQ ID NO: 869 - DNA, 813 bp, Glycine max
  Peptide Sequence Number=SeqID_117647
atggaggacatgatgagcatgacgaagataatggaggtcaatacgattgcagttgccactaccagcatcgttgctgaggtggacccgactcccacatctggcctcaaccaaataaatcatcaaacctcggatatgaacaagcatgccttcctgccatatggtttgcctcctaactacacaccacccaatgttgcacatgctcccgatgagaatgttgacaattccgcaccaatacctgttgagagccaacaaccccaagctgatcatgtacatgtctctcaacccataggggagacacatgaagtaccccaccacaatctagctgacttcgagccttgcctcggatatgccactaaggggcaagcagttggtggtgtatccctgcctaacactttgggggggcctcaatatcacccacaaccacaacccttgcattttacgatgggaagactccctcctgctatggtggacagggagaaattggatcatatagaggaaaggctaagggccattgaaggaggtggagattatgcctttgctgacatggaagagttgtgcctagtacccgacgtggtcgttcctccgaagttcaaggtttcggacttcgataagtacaaggggactacttgccccaagaatcacctgaaaatgtatagcaagaaaatggggacatactcgaaaaatgaaaaattgttgatgcatttcttccaggaaagtcttattgggacagccgtcacctggtatactaatttggaaccttcccgagtccattcttggaaggacctaatggttgctttcattaggcagtattag

SEQ ID NO: 870 - DNA, 1719 bp, Glycine max
  Peptide Sequence Number=SeqID_117648
atggactcttcttcttcatcaccgccaaacagcaccaacaacaactccctcgctttctctctttccaatcactttcccaacccttcttcctctcccctttctctcttccactccttcacctatccatctctctctctcacaggcagcaacacggtggacgcaccgcctgagcccaccgctggagcaggaccgaccaacctctccatattcaccggcggccccaagttcgaggactttctgggcggttccgccgcaacagccaccaccgtcgcgtgtgcaccgccacagcttccgcagttctccaccgacaacaacaaccacctatacgattcggagctgaagtcaacaatagccgcgtgcttccctcgcgccttggccgccgaacaaagcaccgaaccgcaaaaaccatcccccaagaaaaccgtcgacaccttcgggcaacgcacctccatctaccgcggcgtgacccgacatagatggactgggagatacgaagctcatctatgggacaatagttgcagaagggaaggtcaaagcaggaaaggaaggcaagtgaatgggtgctgggtggtgttgttgaagattctgaccgtgctttgctttgtttctttgcgtggcttttgtacctggggaattattgctgactcgtggggatcttttgctcattatgcggtttcagtttacttgggtggttatgacaaggaggataaggcagccagagcttatgatctcgcagctctcaagtactggggtccaactaccaccactaactttcctatttccaactatgagaaggaactggaggagatgaagaacatgactaggcaagagtttgttgcttctcttcgtaggaagagcagtggtttctctagaggggcctctatatacagaggagtaacgagacaccaccagcatggccgatggcaggcgagaataggcagagttgccggaaacaaagacctctaccttggcactttcagcacccaagaagaagctgctgaggcctatgacattgctgctatcaaattcaggggattaaatgcagtaacaaactttgacatgagtcgctacgacgtgaagagcattgcaaatagtactcttcctattggtggtttatctggcaagaacaagaactccacagattctgcatctgagagcaaaagccatgagccaagccaatccgatggagatccatcatcggcttcatcggtgacctttgcatcacagcaacaaccttcaagctccaacttaagctttgccatacccattaagcaagacccttcagattactggtccatcttggggtaccataatactccccttgacaacagtggcatcaggaacactactagtactgttactacaactacttttccatcctccaacaatggcactgctagtagtttgacacccttcaacatggagttctcaagtgccccctcaagtaccggcagcgataacaatgccgcgtttttcagtggaggaggcatctttgttcagcaacaaactagtcatggtcatggaaatgcaagcagtggttcctcctcttcttctttaagctgttcaatcccattcgccacgcccatattttctctaaatagcaatactagttatgagagcagtgctggttatggaaactggattggacctaccctgcacacattccaatcccatgcaaaaccaagtctctttcaaacgccaatatttggaatggaatga

SEQ ID NO: 871 - DNA, 1041 bp, Glycine max
  Peptide Sequence Number=SeqID_117649
atgagtctgcgccacggcaccaaggtttgggtccacgatagagattccgcttggattcccgctgaagtgctcgagtcttcgggaaagaaagttaccgttgccaccgcttccggcaagaaggttgtttttcttccggagaacgtgtttcccagggatgctgatgaagaagagcacggcggagtcgaagatatgacgaggttggcttacttgaatgagccaggggtgttgtacaatctccagagaagatatgcactgaacgatatttataattctagatggacaattagcgtttcttcatgttatcactctttatttgttgatgatgagatggacacatatacagggagcattttaatagctgttaatccattcacaaagcttcctcatttgtatgatatccatatgatggagcagtataagggagctctgtttggtgagcttagtccacatgtatttgctgttgccgatgcatcttatagagcaatgatgaatggaggtcaaagccaatctatcttggtcagcggtgaaagtggtgctgggaaaactgagacaacaaaattgattatgcaatatcttacgtatgttggtgggcgtgctgctggtgatgatagaacagttgaacaacaagttcttgaatcaaatccacttttagaggcatttggaaacgcaaggactgtcaggaatgacaattcaagccgatttgggaagtttgttgaaattcagtttgattcaaatggtagaatatctggtgctgcaattagaacttacttactagaaagatcacgagtagtgcagataacagatccagaaagaaattatcactgcttttatcaattgtgtgcatctgaaaggcataaagctatgttttgcactgtgcatgtgcaggatgtagaaaagtataagttgggaaagccaagccacttccactatttgaatcaaagtaaagtctatgaattagatggcgtaagcagtgctgaagagtacatgaagacgaggagagcaatggatattgttggcataagtctaggggatcaggtttaa

SEQ ID NO: 872 - DNA, 321 bp, Glycine max
  Peptide Sequence Number=SeqID_117650
atgactggtgtcccagaaaacaaaacagtgggacccacagtagaactgacagtgggaacgatggaggaggaagatccagaaggatttgtggaggccacctcacaacaagagacagagacagaagattcgcacaaacggaaccttcaaatttcccaacctgaagaaacaccagcgttgaagagagataatgaagattcgagagtacatctgggcccggatagagttatcgtcggcggcggcggactgactgcggacggtggcaccagtgataatcaggcagagcggaatgaaaccaacttgaatgtaaccagagatgattga

SEQ ID NO: 873 - DNA, 525 bp, Glycine max
  Peptide Sequence Number=SeqID_117651
atgagatggatggttggttacttgtttgttttccttaacatgtgtgatttgaacctactgctagcaacactatgcacccgttcaatacaaacccgagaaggaaatatcatcaaagctcttgactgtaatgctgctgtcgctggtcgggatgctttggcaaaaactgtctatgctcgtttatttgattggcttgttgataagatcaatagttctgtcgggcaagatatcagttcccagaagcaaattggagttttggatatatatggttttgagtgttttaaggataatagttttgagcaattctgcatcaattttgcaaatgaaaagctccagcaacattttaatcagcatgttttcaagatggagcaggaagaatacagcaaagaagaaatcaactggagttacattgagtttatagacaaccaagatgttttagatttgattgaaaagctgagtcagaggatcagaagtattgattctactaaagcagtaagcctaactaacttgctagttacaactgactga

SEQ ID NO: 874 - DNA, 162 bp, Glycine max
  Peptide Sequence Number=SeqID_117652
atggagagtcttcttgcacatctccttcatgttcctaatccaagaaagaatgaaaattcacttgagcttactgaatcttcagcaatggtgtccaatcgaggaagaggaggtcgtggaaatcgtggacgtggaggacatggtggtggaagaaatggaacgtga

SEQ ID NO: 875 - DNA, 1542 bp, Glycine max
  Peptide Sequence Number=SeqID_117653
atgtcacttgtacctaacaagttgattatggactgtaaattttgtagtaatgtctcttataacaacctagttggtgttattccctcaagcaagaatttttccaggttttcccctgacagttttattggaaatcctggtctttgtgtcgattggctggattcgtcttgtcttgggtctcactctacagagcgagttaccttgtccaaggcagctatcctaggaattgcaataggcgcccttgcgattctttttatgatattgctagcagcttgccgaccacacaatccagcttccttctctgatgatggatcttttgacaaaccagttaattactcacctccaaagctagtgattcttcacatgaatatggcacttcatgtgtatgatgatatcatgaggatgaccgaaaacctaagtgagaagtatataattgggtatggtgcatcgagtacagtttataaatgtgttcttaagaattgcaagccggtggctatcaagaagctctattctcactatccgcaatatttgaaagagtttgagactgagcttgagacagttggcagcattaagcacaggaatctggtcagtctccaaggctactcattgtctccatacggaaatcttctcttttatgactacatggaaaatggcagtatatgggatcttctacatggacctaccaagaagaaaaagcttgattgggatcttcgtctaaaaatagcacttggatcggcccaaggactttcttatctgcaccacgattgcagtccacgtatcattcacagggatgtgaaatcatctaatattttacttgacaaagattttgagccccatctcaccgattttggcattgcaaaaagtctctgtccatctaagacccacacttcaacttacataatgggcacaattggctatatagatccagagtatgctaggacttctcgcctcactgagaagtctgatgtgtatagctatggtattgtattgcttgagctcctgactggaaggaaagctgttgacaatgaatcaaacctccaccatctgattttgtccaagacagctaatgatggtgtaatggaaaccgttgatccagatattactgctacatgcaaggacatgggagcagtaaaaaaggtttttcagcttgctcttttatgcacaaagaagcaaccagttgataggcctacaatgcatgaggtgactcgtgtgctggcaagccttgtgccatccatcactccaccaaaacaaactgaccaaacacaagtagtgctatctgattcacagccatctgctaaaatgcaatgctacaaggatgaatatgcaaatcttacaactccacaccttgtgaactgtccatccatgagcacctctgatgcccaactcttcctcaaatttggagaaatgcagcaatatttaaggaattttggaattggattgtgtcgccgagagacagaggtaatttcattaaagctagaacaagtagtttcaatggtatcccgagccctcaagatgcagaagcttttgcacttcaaaaaagcttag

SEQ ID NO: 876 - DNA, 2034 bp, Glycine max
  Peptide Sequence Number=SeqID_117654
aaacccattggtattattgctttgttagatgaagcttgcatgtttccaaaatcaacgcacgaaacattctcaaccaagttgtttaagcacttcctgtcacaccctaggttagaaaaggagaagttttctgaaacagattttaccctttctcattatgctggaaagcaacaacttcaatcactcatggaaacacttaacacaacagagcctcattacattcgatgtgtcaagccgaattctttgaatcgaccacaaaagtttgagaatactagtgtcatacaccaattacgctgtgggggtgtccttgaggctgttagaataagtctggcaggttaccccactcgaaggatttactcagagtttgtagatcgctttggattaatagctcccgaatttatggatggaagttatgatgacaaagatgtaactctgaaaatattgcaaaagctaaagcttgagaattttcagttaggtaggaccaaggtatttctcagggctggtcaaatttgcattttagactctagacgtgcagaagttttggacaatgctgcaaagtgtattcagcgtcgactgcggacatttattgcacgccgggatttcatctcaatccaagctgctgctctttctcttcaagcatgctgcaggggattcattggccgaaagttatatgcttctaaacgggaaacatcagcagctatctccattcagaaatatatccgtatgtgttggatgaggcatgcttatgtgaaattatattattcagctattattgtacagtccaatgttcgtggtttcacaactcgtcaaaggttcttgcatagaaaagaacacaaagctgccacttctattcaggcctattggaggatgtgcaaggttcggtctgccttcctaaaacatcaaaattcaattgtagttatacaatgcctttggcggtgtaaacaagcaaaaagagagcttcgcaaacttaaacatgaggctaatgaagctggagccttgcgtttagctaagaataaacttgagaaacaattggaagagcttacatggcgtttgcatcttgagaaaaaaataagggtttctaatgaagaggctaagcatgttgagatttccaagctacagaagatggtagatgctctgaatcttgaattagatgcagctaaactagcaacaattaatgagtgcgacaaaaatgcggttttgcaaaatcagttgcaattgttagtaaaggaaaaatctgctttagaaagagagctagttgcaatggatgaagtgcgaaaggaaaatgctctattaaagggttcattggatgcttttgaaaagaagagcaccgctttggagctcgagcttgtgaatgctcggaaagaccatgataaaaccattcagaaaatgagggagtttgaagataagtgttctgaacttgggcaaaatgtcaaaagtcttgaggaaaagctctcaattttagaggatgaaaatcacgtgcttcggcagaaagccttaagtgtctctcctaagagtaaccatcgaggtttgacaaagtcattatctgaaaaatactcaagcgcaatagccccctgcaccgagcagaagcccacatttgaatcgcccgcacctacaaaacttatttcccatattacacatggcggcttgtcagactctcgtcgatcaaaattaacagcagagaagcaccaggataactatgaactcctctctaggtgcatcaaagaggatttggggttcaaaaatggtaaacctctggcagctagtatcatatacaaatgtcttcatcattggcatgcatttgaatctgagcgcacagccatatttgattacatagttgatggaattaatgatgttcttaaggttagagacaatgacattgtcttgccatattggctgtccaatacatctgcacttctatgcctcttgcaaaggaacttgcatccaaatggttttttaacaaccactgctcaacgttatgccagatcatctggcttgaccagccgaatagggaatgtgagctttcaagttgaatattga

SEQ ID NO: 877 - DNA, 512 bp, Glycine max
  Peptide Sequence Number=SeqID_117655
atggaaacattgccgttgtttgagcctcaagatgataacgagcagtgttcatcttcagctacttcgtccatcggaaacgacagcgacttgtcggagacagtgcgtggtgtgatggacgtgaggggcatctcaaagttctatgatggcaagtccaagtcattcacgagtctggttgatgctggttctaccccatatatcaaagacattgcaaaatcagagaatgcttacaccagcaggggtagaaatttgatggctttcaatcacacatgggaaaagagtcaaagctaccttttaagaagcaacagtggtggcatttcaaagaaaacgacaataagctcgagccgaagtaccgtggctctcgcttttgcaatcaactatgaaagcagcagttgttgtgcgagcgaggattcatctttaagctcaaatccgaggtcacctccacctcttccgccactccatcccccaagtacagctccgtcctctcctatgcagcataatttctcatcccggag

SEQ ID NO: 878 - DNA, 249 bp, Glycine max
  Peptide Sequence Number=SeqID_117656
atgttggtgccttttatgcctgacatatctaagaataccaaggtagttagtgaaatgagggaaattgtgagcaaggacaatcagtgtttgagctctaattcattcttgttggatgatgatatgagcattcctttttctgctgaagacatagataaggcaatccctgctataaatactgttgatatcgatcttccagcatttttgtgtgaatatccctgtgcccagtttcttattttacatgagaagtaa

SEQ ID NO: 879 - DNA, 597 bp, Glycine max
  Peptide Sequence Number=SeqID_117657
atggaggatcgaaaatccctactcaagaaacaaaggcagggctcttttacttgcaaccatcgcctatattcaagatatctttatttggtgtattgttttcaaattgaaaaattcttacctctaataacatcaaatatttgttctctaacaacatcaaatcttcaatggaaatattgtatcactattataacatcaccaaatcacgattatatcttcctagaggcacaacgttcagggaagcttccttcaaataatagggtgccttggagaggagactcagcactcgatgatggcaaactcgttaatgtggaccttgttggggggatactacgatgcaggggacaatgtgaaatatggtctcccaatggctttcaccgttactacgctagcatggggggtgccattttttataagtcagaatttaaagctgcaaatgagttggataatattcacgatgccattggttggggtatcgattattttctcaaagctagttctcgacacaaaagattatacgtggagactatagaaggttgtatgagtatccatggaggtataagccaactctatggaagcataaccttgttgaacttctaa

SEQ ID NO: 880 - DNA, 189 bp, Glycine max
  Peptide Sequence Number=SeqID_117658
atggctaaaccccatcatcagatacaaagagtgaagttaaggataattaagatgcccatgagtggtaaagagaattgcaatttcaggaatggagcagaatcaatgaatcatcaagctaattatttgatgcttttgaatgctgattctctccgcacgaagcatgaaagtttagcagttgaagtaccatga

SEQ ID NO: 881 - DNA, 1173 bp, Glycine max
  Peptide Sequence Number=SeqID_117659
atgggcttagtctgcagcagaagtcgtcgttttcgtgaagctgatgctgaagaaaatgctcaggatgcagaaattgaaagaagaatcgagttagaaacaaaggctgaaaagcatattcagaaacttttactactaggtgtgttttacttggtgctggagagtctgggaagtctacaatatttaagcaggcaagaaattgcatcttctcaactgctcataaaacttttgtttcaaactggctttgatgaggctgagctaaaaagctacataccagtcgttcatgctaatgtgtatcagacaataaaagtactgcatgatgggtcgaaagagttggcgcagaatgactttgattcttcaaagtatgtaatatctaatgaaaaccaggacattggtgaaaagctctcagaaattggaggcaggctggattacccgcgtcttaccaaagagcttgcacaggaaatagagactctgtgggaggatgctgcaattcaggaaacatatgcccgtggtaatgaactccaagttccagattgtgcccattatttcatggaaaatttggagaggctgtctgatgcaaattatgttccaactaaggaggatgttttgtatgcaagagttcgtacaactggtgttgttgagatccagttcagccctgttggagaaaataagagaagtggtgaagtctatagactctttgatgttggtggccagagaaatgagagaagaaaatggatccatctttttgaaggagttacggctgtaatattctgtgctgcaattagcgagtatggtctgccatatggtaataaatgttgtgtcaggtatgatcagacactttatgaggatgaaaacaagaacagaatgatggagactaaggaactttttgagtgggtcctaaggcaaccatgttttgaggttccgctcaatgtatgtgagtggttcaaagattaccagccagtttcaacagggaaacaagagattgaacatgcgtacgagtttgtgaagaaaaagtttgaggaattgtatttccagagcactgctcctgactgtgtagatcgcgtgttcaagatctatcaggcgactgcccttgatcagaagcttgtgaagaagactttcaagcttgttgatgagactttgagacggaggaatctctttgaagctggcttattatga

SEQ ID NO: 882 - DNA, 2769 bp, Glycine max
  Peptide Sequence Number=SeqID_117660
atgtcgatcaacagcgaatctacgccgccaccggtgatcggaaaaatcgggccttacaccgtcttcatgacgccgccgtctacacccaaacccgccgacgacaaccccgttaccaccaccaagatcgcacctccgccgcctcagattcccaaagccgttccttcccccaaacccaaacctctctccgattccgacgattccgttttcggcttcttcagaaacgccgttgccaaggtccaaaccgcccactcaagtttggatgatcatttggcacgttggtttggattgaatcagtcaaagtatcaatgggctcttgatgattattatgagagcaagggagtgtatgagaaggagaaagaggaggaaaaggtgtttgttgtgacctggaccccttctcctcgctccaccgtgtccatcttcagcaccggcaccggctccctcgtttcctcgctcgaaggccacaccgcctccgtcaccgccgtcgtggtggtcccctcctccactggcctaagctactgctggaccgcttctgtcgacggtaccatccgccactgggacttctccgttcccgaatgcgtcaatattatcgacctttgcttaccaattttctctatggtggtgccttccatattgtctcctcgggaagaaaacgggaagacgccgccgaatgttattgcttacgtgtctgttcaaggtataaaagcaccaccggacaatcccaccaagcctctttatggacagatcaggaagtgtaatttgacccactttcgctctgttagcaaccttatcatgaaagagactgaacggccagaatctttaaccattagtccctcgggtaattttttgggtataaaagacaaacggaaacttcatatatgggcagttcctaaaaaggactctgattccgctgtgtccaagaagattatcctgcatcatacaaagacgttgactgttcttgcattccatccgacagagagaactgtggctgctggtgatgtaactggaagaattttaatttggcatgaatttggtgctcagaagttcttgagcagtagtggattaatcaatggaagatcaacggatcaggaaaataaggatggggttaggcaaaatgatgatgctgaatcaagcgtcacacggcattggcactcttctggagtgagttgtctatctttctcttcagatggagccttcctctactcagataatcaaatgcttatattgaagaagccttcaaagccaatggaaataatcagctgtatttctggtatcaagccccctttgtcttctcaagatatatgtgaaggtctttccagccgagttgcctttgactgcacttctggtttattggctgtacaaacagagaattatgccatccaattctacagcttgtttgctaatcgcgaagtttatgaggttcaagtctgtgaaagaaaccatcaaccagttgatgaggtcacggtggtggtgagcttggtagagctatctgttgatggctctatgatgggtacagttgatgtcaagcttcctgaagatggaataggaggttttatttgtttgaagttttgggatttggatgataacaagagattttcattatctacccttatttatgaaccacacagggatgctcatatttctgctgttgccttccatcctactcgtcctatggctgtcagcacatcttatggtggagatttcaagatatgggtctgcaaggaagaaattcagcaaaatggccagatggttcggaattctggttggaagtgtcatgctgttgggtcatacaaaaataaagccatgagagctgctgctttctcagctgatggttctgtgctggcagttgcagcggacactgttattacattgtgggatcctaataataatgtcctcattgctgttataggagaaactccaatgcctattacgagactcgtctttgctggaaagtcagattatcttctgtctgtatgtcatggttcaaaaccacagctgtctgtttggagtatgtcaaagttagctgcttcttggtcatacagactccaaatagaagctgtctcctctgcaatagacttgtcatattttgctgtccttgcgctccttcccaaatcaaatgaatgtacatttaaaggtgatgggataatcttattattcaaagtgacagatcctgttccggtggcttcctggtctgtaactaaggccaagggagggaggctggcttttatccaaggagatccatttgaacgagcagttattgatgggaaaccaacacagacactgcttgcatatataaatggagatcatgaatatgtcatctttcatccatctggcagaaaagcctgtgagcttagtatgactaagcaggatgatcttgcgtttgaagaaacaggacaatttggatacgcatcaatttatggggagctacccaagtttgatttgaaaaggaaaatggactcatcgatttcatctgctgcttctgcttccaagaggccttgggaaaccatatttagtggattatcacaatcgttgccacccctcactaaattgtgctcggaatttttggagtccctgctggagaaaaggacagcaactaggtcaagaggcctatggactggacttgaagttaagatatttgaatgttctcttcaagaatggtgtaaacactaccttctacccgctgcaggaaaagatgggacaacaaagatttcagctttaaatggttggctagatgttcttggatggggcgaaaattttgacagtaacgaatga

SEQ ID NO: 883 - DNA, 222 bp, Glycine max
  Peptide Sequence Number=SeqID_117661
atgctggaccgtgaaaaaacgatgaacattttggggcccgagaaacaaagcctcccagaagccctccctggttctgatccacgggtttgggcccgcggccacgtggcagtggtgccgcaggtgaagttcctggccccacacttcaatctggtattcttcggagggtcgcacacgaaggagcgaaatgtttcaggcaacgtcggtgggcaagctttgaggtag

SEQ ID NO: 884 - DNA, 1998 bp, Glycine max
  Peptide Sequence Number=SeqID_117662
atggagtgggacagcaattccgatctgagcggggacgaagaggaggaagggttcgtcttcaacgacgccgacgacgctggccctctcccgttccctttccccgtcgtcgaaaacctcctccaaacggcgccctgcggcttcgtcgtcaccgacgcgctcgatcctgaccaccctatcatttacgtcaacaccgtcttcgagattgtcaccggctactgcgccgaggacgtcctcggtcggaattgttttgttcatacgtgtaacttctgccccggtctgaggagtgagtcaattgggaaggtatgtggggttttcctttgggttctccaacagagtgtaagaagcatatttccatttaagacatcttcttggactaatgggaactctaaccgtttcttgcagtgtcgaggtccatttgctaagagaaggcatccgttggtggactctacagtagtttcagaaattagaagatgccttgaagaggggattgaattccaaggtgagttgctgaactttaggaaagatggatctcctctgatgaacagattgcggctgacacctatatatggagatgatgagactataacacatgttattggaatccagttcttcacagaggcaaatattgatcttggtcctgttccgggttctacaattaaggaatctgctaaatcatctgatcgatttcgttccgtgctttcctcgttgcagactcttcctgtgggggacaggaatgtatctcgtggagtttgtggaatttttcaactgagtgatgaggtactgtctctcaagatacttgctcgattaactcctagagatattgcatcagttagctctgtctgtagacgattatatgagctgacaaaaaatgaagacctctggagaatggtgtgccaaaatgcatggggcagtgagactacacgtgttttagaaactgtgcccggtgcaaggggacttggatggggtcggctggcaagggaattgaccactcttgaagcagcagcatggaggaagttgactgttggaggtgctgttgaaccctcacgctgtaattttagtgcttgtgcagttggtaacagagttgtgctttttggtggtgaaggggttaacatgcaacctatgaatgacacctttgtattggatctcaattctagtaatcctgagtggcaacacgtccatgtaagctctcctcctccaggtcgttggggccacacactttcttgtgttaatggttctcatttagttgtatttggaggctgtggaaggcagggcttgctcaatgatgtgtttgttctggacctggatgcaaagcctccaacttggcgtgaaatttctggattggcacctccacttcccagatcatggcacagctcctgtactcttgatggtactaagttgatagtttctgggggatgtgcagactctggagttctcttgagtgacactttcctccttgatttgtcaatggagaagcctgtctggagagagataccagtggcatggaccccaccatctcgtctgggccacacattgtctgtttatggtggtaggaaaatactgatgtttgggggtctggccaagagtggccctttgcgttttcgttccagtgatgtattcacaatggatttaagtgaggaagaaccttgttggagatgtgtaacggggagcggcatgcttggtgctggaaatcctgggggcacagctcctcctcctagacttgatcatgttgctgttagtcttcccggtgggagaattctaatatttggtgggtctgttgctggtcttcactctgcctctcagctttacattcttgatccaactgatgagaagcctacatggagaatcctaaatgtacctgggtgccctccgagatttgcttggggacacagtacatgtgttgttggagggacaagagctatcgtactgggtggtcaaaccggggaggaatggatgctaagcgagctccatgaactttccctggcaagttctgccatctaa

SEQ ID NO: 885 - DNA, 177 bp, Glycine max
  Peptide Sequence Number=SeqID_117663
atggatgaagcgaacggagtggtagcaatcacggcgaggccagagaaacgagtggcgcagctgcgtttcgggagtttagctaaagtggagaagagacggtgctactttcttccacatacaagtaacactgtgcgcgcgcggagagaggttgtgaggattctcacatcaccaagttga

SEQ ID NO: 886 - DNA, 144 bp, Glycine max
  Peptide Sequence Number=SeqID_117664
atggtggggaaaagaggaaggtggttgcctcctagctcgctcaggcgtgctgggatgcttccaccagaaggcaccaccttctgttggaacatcctggaaggcccgagtgggcttgattgctatttgcacacccctgtttactaa

SEQ ID NO: 887 - DNA, 209 bp, Glycine max
  Peptide Sequence Number=SeqID_117665
atgtcgcgaaaccttacggattgtgcaacaatcctttcttggacttctggaatgttgcaaaactttacggattgcgcaacaatgcttcctttcgactttcggcatgtcgcggaacttcatggattgcctaacgatgggtatcaagtacctcgaagtggtcaagcgaaggtcgcatcccaccaaacagatggtccccggacgaaattagg

SEQ ID NO: 888 - DNA, 258 bp, Glycine max
  Peptide Sequence Number=SeqID_117666
atgggcccttctagaggattctgggcatttccttgcttaaggtggaagcaaccaagctctcttgggcgagctgagctcgcctgggcgacctgggcggcaaccacctcccccgtttttgttaaaaaattgtctattggggcttccaggactcccgtaatgatttcagcattttcgaagcaggtttgcttttggaggaagccaccctgctcatctgggcaagctgggcggcaacctcctccccctttttcctataaatag

SEQ ID NO: 889 - DNA, 937 bp, Glycine max
  Peptide Sequence Number=SeqID_117667
agatgtcccagtcgcccgtcgagaagagcacttcgctgagggtgggggagtcgaccgcggtgacgctgatgtcgacgccgaggtccttccacgcggactgggcgagctctgcggctgcgttgccggcgtcgccgagctgggaggagtagatcatccgcagcgtgagcggctgtccgtccttcgccctgaccccgtcggagccggcggtccaccccgcctcgtcgagcgcggcggcggccgcgtccgcgtcgtactccggaaggtgccccgagacggtgtcggcgcggcacgggttgggagagatggtgacgaggccggtcgggaccgtggccttgccgctgccgatcacctgacgcatctgctccaggtcgagcgcctgcatcagcgcttcgcggacagcctggtcggcggtggggcgaccgtcggcctggttgaaggtgaacgagccgccgggggtctggaggtcggtgtggaacagcccggcgtcctccatgcgcgcggtatccgggccgatcaccagcgccgcgttgacctcgccggagagcagcaggttggcggcggtggtctcgttggggatgacgcggaagacgaccgtgtcgggcagtcccttctggtccgggtcccagtcgccggggccccacgtgaagtcgtcgcgtctggtcagcgtgtactggctgttcggcacgatctcggtcatggtgaacatgccggtcgccccttcgcccttggccagcgcgtccggatcgtcgatcaccgtgccgcagacgatcgagatgctgccgacgttctccagcaggaacgagtcgggacggccactggtgaccgtgaccgtgcccgcctcgtcgtcccccacggccgccgttcccggttgcacctgcagcccgatcaggggcgacccgttcgcgggatcgccgatgtgggtgatgttcgcggcgac

SEQ ID NO: 890 - DNA, 153 bp, Glycine max
  Peptide Sequence Number=SeqID_117668
atgtgggatcggcacagacttaaaggaacactcaaatcaggtgtatttacccccaaggcctacacttcgaagaatccgttagggcctctccctcctgattcagacatcgctcatgaattatacaatacttacaacttcacactcgtgttttaa

SEQ ID NO: 891 - DNA, 291 bp, Glycine max
  Peptide Sequence Number=SeqID_117669
atgtttaaggaagagtgtaaggaggtaagtgtctcctccaagagcttagctaagaagaaaaggcattttgaaataaagaaaaatactaaaaaggtttcccctcttagacaacctccacattttctcctttgtaaaaagacacttgttagcattgccacacctcttgggcttgagtttattcctcaagtaaaagagttgttgaatgaggatttggttcctaagagcttaaatccttatgcttttttcaatacaaacttaggtatgttggacaagtggcctcagatatcttaa

SEQ ID NO: 892 - DNA, 1089 bp, Glycine max
  Peptide Sequence Number=SeqID_117670
atgtctggaaaacctttggctggagaaagtaggaagttgttgaatagaaagaagacaaaaaagattgataggtctacaaatttagactcatggagtcctgagcaactaaaaacgatgagctttggaggaaacaatcgtgcacatggtttctttaagcaacatggttggactgatggtggtaaaatagaggctaaatacacatctagagctgcagatttgtataggcaaattctttcaaaggaagtagcaaaaagtatggctgaggatggaggcttgccttcatcacctgttgcttctcagtctgcccagggggttaatgggcttccagaagtcaagaccaatgaagtgccaaaagaaaacactctggagaagccagaaaagcctgagagcacttcttcacctagagcttcacattcagtaatttcaggtactgttaagaaacctatcggtgctaaaaaagcagtgaagagtggggggcttggtgctcgtaaactcactaaaaagccaagtgagtctctctatgagcagaagcctgaggaaccccctgctccagttccatcttcaacaaacagtatgcctgctgggccatctccgacatctcggtttgaatatgtagaaaatgtccaatcatctgacttgaacactggaggttctcatgttcttagtcatgtgtctccaccaaagtcatcaagcttctttgcagactttggaatggatggtggctttccaaagaaatctgggccaagttcctccaaagtgcaagaaactgacgaagcaagaaggaagttctcaaatgctaaatctatttcttcatctcaattttttggagatcagaacaaagctgcagatgtggattctcaagctactttgtctaagttttcgggttcaagtgccatctccagcgctgatctttttggtgactcaagagacaacaacatcgatcttactgctggtgacctcatcaatcgattatctttccaggcacaacaggatctctcttcccttaagaacattgcaggagagactggaaagaagctcagctcactggcctccacattgatgacagatcttcaggaccgaatcctctaa

SEQ ID NO: 893 - DNA, 213 bp, Glycine max
  Peptide Sequence Number=SeqID_117671
atggcgtccgatggcttcaccgacaagaacaccgtgttcagaaagctcaaggcgaagtccgaaaataagatgtgtttcgattgcaatgcgaagaaccctacctgggcgtccgtcacgtatgggatcttcctctgcatcgattgctccgccgttcaccgcagtctcggcgtgcacatcagcttcgtgaggcaagtttttgctgattttgtttga

SEQ ID NO: 894 - DNA, 388 bp, Glycine max
  Peptide Sequence Number=SeqID_117672
gcaattttcccttaagatagtgagtgctttgttgggaaccttaaatgagtctttattcttctcattgactaaattacccagtcaaggtgttccttttgagggcactattgttgatgactggaagttcgattactcgagtcatgatgctcaccgtatgtggattcgtaaacaagacttgcctccgcttattcttgacgaacgtaccccatctcctccaccacaaagggttgattcctcttctcttttgaccgaagtcctcacagaacttcgtggtcttcgagcttttgtaggtgaacgatttgatgtgatggatactcgccttgatgcaatggatgcacactttgatgggatggatacacgaggatcactagtctcaaagatgatataa

SEQ ID NO: 895 - DNA, 1152 bp, Glycine max
  Peptide Sequence Number=SeqID_117673
atggtcattgatactaacatccaacattttggtgctctaggttcttatgtgccaaatgcttcatggcacaataggaaaatccaaaaagaatataattttttgaggtttcggtggccaagtttgaaccatcattacaaaggcattgagggagcgtgtacatgtaaaaaatgtaatataaaatttgttgtgaaagcgacctctgaaaaatctcttgagtctgaacctcaagcttttgatccaaaaagcattttggactctgtcaagaattccttggatgctttctacaggttttccaggcctcacacagttattggcacagcattaagcataatttctgtgtctcttcttgctgttgagaaaatatcagatatatctccattattttttactggtgtgttggaggctgtggttgctgccctgtttatgaatatttatattgttggtttgaatcaattgtctgatgttgaaatagacaagataaacaagccgtatcttccattagcatctggggaatattcctttgaaactggtgtcactattgttgcatctttttcaattctggtgcctctgttgagatggaagaggtttgcagtgcttgcagcgatgtgcattctagctgttcgggcagtaatagttcaacttgcatttttccttcacatgcagactcatgtgtacaagaggccacctgtcttttcaagaccattgatttttgctactgcattcatgagcttcttctctgtagttatagcactgtttaaggatatacctgacattgaaggagataaagtatttggcatccaatctttttcagtgcgtttaggtcagaagccggtgttctggacttgtgttacccttcttgaaatagcttatggagtcgccctcctggtgggagctgcatctccttgtctttggagcaaaattttcacgttggctaatatcagcatttggcaaacttgcctcccttcttgtgctgtaattttttactgtatgtcggataatatcaagagggaaagcctcaacacaacagttcaaatcttgaaattagcctctcctcttgcaggcaagggggaggctaccttcatctaccctcccccagagcccactagagtcttgtgccatttggcaattgtctttttcacagttgtcttctga

SEQ ID NO: 896 - DNA, 429 bp, Glycine max
  Peptide Sequence Number=SeqID_117674
atgaacaaccaacttagaatccaattagaagtcggagtaagttacatacctagatatatagatggtaataacaacaaagatgactcaggtaatggcagcataaaggaggttaacataattctgaggggtggcattgtatatcagaccaagatcaattatactattaggttcaatgtcaccacctcccatagcaagagggcaagcatattgaaatgtgtttccattatccctgattggatttggagtttggagtatggtcaacgggatttttgttgtaaccaatgtagatgttatagcagctacactccaattaggtcactagacaaaaagacatttgtgtcaattctggctgaaggtttatttggaacaaaggtagccacaacattggagacaggtgccattacatcagccttcaagatcctcgggtag

SEQ ID NO: 897 - DNA, 282 bp, Glycine max
  Peptide Sequence Number=SeqID_117675
atgcgcaagaacttcttgagcattaacttggaatcttcaaaaacttttgttatgtggcattccagaatccagaggtgtaggtatcatcatctactcaaatctcttgaagaatatctggtgaagcttttggtcgtgtttctgattgtggaatttggacaagagaatcatcattatcattatctcacgagagacacagaccaccctcccactgttcaaccctcctgtcctgttctacaaccgtcttcttgtcctgtttcttgggttctttctgaacttgtttga

SEQ ID NO: 898 - DNA, 150 bp, Glycine max
  Peptide Sequence Number=SeqID_117676
atgtatatatgtggttcttgctgcatgtggcatttctattcagagaaaactgaatctgatcctgttcttgctgcaattcagactgtgtggagtatatctttactatcaaatttggaatgcttcaattggtatgcaatggaaccaggataa

SEQ ID NO: 899 - DNA, 204 bp, Glycine max
  Peptide Sequence Number=SeqID_117677
atgggtgcactgcttattgtaccacctatcgagataccactgccactcgtcctcgctaatgcttcggctcccaggtacatgtatgtttccccttcttatctatcgtcatctttggatcatatccttcctgatgtcaatgttcctattggggacttcttggagctatcttggagtaggggtagtggtgatcttgcttttgcttag

SEQ ID NO: 900 - DNA, 363 bp, Glycine max
  Peptide Sequence Number=SeqID_117678
atggatctaccatcagcagatgcaaaccaaattgccaacaatctctccaacttgggtcaaatctataatggagaagacccttcaacagatggcttgaaggaaaggggtcaagtcctaggagatggaattcgtgtacatagcatggtccttcccgaacttccttctagtacaacaattcacttctatagtccaggagaggtttactctatcaagcatgatatcatagatgtgaagtgtctcatgccaggcttgctattagccattagaaaagtagtgcacctcaagtttgttggcaaacattatgttgaaggtttgaaaagaagtaacaaaagaaaaacacatcgtccccaaactgctttttaa

SEQ ID NO: 901 - DNA, 165 bp, Glycine max
  Peptide Sequence Number=SeqID_117679
atggcatcaacaaagagcatgttcatgtccttcgccatcctcctcctcctcgctctcttctccgccaccgtgtccgctcagggctctccaacaccggctccggatgccggagcagctggatcagtctcgagctctgcctccgtcatcggtcatagggggaaataa

SEQ ID NO: 902 - DNA, 540 bp, Glycine max
  Peptide Sequence Number=SeqID_117680
atgtcccgtgaatatggtgatggctctaatgatgagttatcatctttgtcgtttggctcttcaaacaaccaacaataccaagaacaacctttagcccctggtggcttcatcaatcctcttaaggctaggcacacgaaggacacttttaccttcgtccctgcattgatgatcttcttgagcttttggtctattgcaacaaacactttcgtgttcccttttcgcttcatgaccattacgttgcaagacatagctactatcttgggtcttcctatcattggcgatgaaattccttctctatttgatcaacctgttgaagacctaggtttggatcaccatgtgctttccaatgtggctaagcagccaaaatcaactaaggaattggactgccatgccaacgatcccactttacgcaaatcccttcaaatcaaatccaccactttagttatgacccacttctttatagaggttatcttcgacatcctagacaatgtgggtgctttgtggaatcctcccattgttgatcatgtcgttcttgactga

SEQ ID NO: 903 - DNA, 183 bp, Glycine max
  Peptide Sequence Number=SeqID_117681
atgactaaagcacatcaaaaggggtacggaaaaccgaagaacgaagaagaacgaatgaagaatgatgaagaacggttgaaaatcttcgcaaaatcacccacggaaacgtcacggaagcgttacggaagcgcctcgggttggattttcttcacggaaataatttttctcactaattttaagtga

SEQ ID NO: 904 - DNA, 437 bp, Glycine max
  Peptide Sequence Number=SeqID_117682
gactggatccagaggctagtgcagcaggatcgggagtgacaggttcgagttctgttggtattgattataatggagtgccaagcactgctggagtggctagtctttcttcctgtagtaagggttggttggatatcaatgtggatcctaataccccttctagcacagtggcgtcggttgatagtcgattggcatggattcaacattattatttatacgcgcgaggtactgctggtgcgagggcaggttttgtgacacaacagttgagttttacaagtagtactgcatccaatagcatgatcgcaggatggaatcctattgctgggatgtcgactacgccttatcagttcttttttgttggagcgggagccaatttctctgatttagaagcaaaagccaaagcagaaaatgcatatcatatcattatattggtgcaatga

SEQ ID NO: 905 - DNA, 251 bp, Glycine max
  Peptide Sequence Number=SeqID_117683
atgctgccaatgaatacgcacggcagggcgaggttgctgtggcaaccaaggacgacgtagagctcttcgcggaagtgggtgatgctattcactcaaaacatgagcttcattgctctcgtggagctgcgtttgtcagctccgccaacgtagatgctgccaatgaatacgcacgacagggcgaggttgttgtggcaaccgaggacggcgtagagctcgtcgcggaagtgggtgatgctattgtgcggccgtga

SEQ ID NO: 906 - DNA, 531 bp, Glycine max
  Peptide Sequence Number=SeqID_117684
atggcagatgagtatgtggtggtgatcggtgttgggggattggggcatgttgcacttcagatcttacgggagatcagcggagctgaaattattgcatgtgatgtcacagaagataagctggcctttgccagagagcttggagcttcttacaccattaattccaaagatgctgatgctgcagaacagatcaaaaagattaccggaataaaaaaggctaaagtagtattggattttgttggagcaacttcgaccattgagttgggaactaaggttgtaagccttgacggagaccttaccattgtaggattgggaggaggacattatcaatacaatatgtccggattgccatttggggtaagtatgactaatccttactggggctcccgggtggaactgatggaggttgtaggacttgccagacaaaagaaaatccatattgaaattgaaaaatataagctcgatcaggctaatgaggtttatgaccggctaagagaaggaaaaatcaaaggcagagcggtcttgattccctga

SEQ ID NO: 907 - DNA, 747 bp, Glycine max
  Peptide Sequence Number=SeqID_117685
ggtggacccttaggtactagtaccctcaccttcagaggactacacatcctcaccttcagagggccacgtaccctcaccttcagaggactacacgtcctcgcctttagaggactacacgtcctcgcctttagaggactacacgtcctcgccttcagaggactacacgtcgttgccttcagaggactacatgtcctcgccttcagagggccacacgccctcgccttcagaggactacacatcctcaccttcagaggactacacgtcctcgccttcagagggctacacgtcctcgccttcagaggactacacgtccttgccttcagagggctacacaccctcaccttcagaggactacacgtcctcaccttcagagggctacacgcactcgccatcagaggactacacgtcctcgccttcagaggactatgcataccgggacacccagtcgacccagaggagcccaacagggccctagggtttccagctctggttatgggcctctgtcagtcctacagggtgcccgtcccccccagcaagggatcgcgcccgcaagacacccagtgggcacggagaagtccaacagggtcatggggcgcaaggcgagacaccacaacagcctggggatggtcggcagtgagcaacaaacgcacctccgccacctccaaagcccctaagctcatctacaaaaactggagcgttgcctacgacccatggtcgactagcaggcgaccaagtccaaagccaaag

SEQ ID NO: 908 - DNA, 105 bp, Glycine max
  Peptide Sequence Number=SeqID_117686
atggcatcgaagcgctcacccacaaaagctcgaaggtcacggagctctgtgggtacttcagtcagaagagaagtggaatcagccctttatggtggaggaaatggg

SEQ ID NO: 909 - DNA, 372 bp, Glycine max
  Peptide Sequence Number=SeqID_117687
atgggtgaagtagaggaggtaaaagaacatatcaaggccaacatggaggccataaaagagcaaatggccacaatgatggaggccatgatgagcatgaagaaaataatagaggtcaatgcggctgcagtcaccgctaccagcgccattgctgaggtggactcgattcctccatctggcctcaatcaaataaatcccccaacctcagatatggtagggcagggaggcaaagagttgggaacggggagagtccctccagctatggcagaaaaaggaaagttggatcaaatagaggaaaggctaagggccattgaaggaagcgaagattatggctttgttgactgtagaagcaagcttcatgatgaatcaagttga

SEQ ID NO: 910 - DNA, 426 bp, Glycine max
  Peptide Sequence Number=SeqID_117688
atggcgccagaggacatggaaaagacaaccttcgtcaccctgttggggacgttcttctacaaagtgatgtcctccgggcttaagaacgctggggcaacttaccaacgggctatggtggcattattctacaacatgatgcacaaggaaattgaggtctacatggatgatatgattgcgaagtcaaagaccgaagaagaacacctcgtcaacttacataagttgtttcagagactatgtaagtaccggttaaggttgaatccaacaaagtgcaatttcgaggtcatgttgggaaagttgtttggttttattgtaagccagaaaaggatagagatggacctagacaaggtgaaagccatccttgaaatgtctgagccacgcacagagaagcaggtccgagccttcctaggacatcttcccataccataa

SEQ ID NO: 911 - DNA, 960 bp, Glycine max
  Peptide Sequence Number=SeqID_117689
atgggctgccccttgaagatcctgaggaagaacctgaccactctcgctcagacatggagtgttctttcattctcgaacctagcccctacttctcacacttctgacatcacactggatagggccaggttgatctacggcatcatccagaagatggacatgaacttggggtatattatctcaagtcagatttctatgattgcacaacatgactcctcgaggctggatttccctacactcatcactgctttatgcaaggccaggggagtcacttcagattcactatcttttgagagtctcaacccagccattaacttggcatacgtgaagaaaaactgctggaaccttgatgacccctcagtcacttttagagggccttgcaaggccatggggaataggtcagagactctcctatcttctaagattcccccattagcagctccttctactatagttccagcttcttttgccccatctgcatctgcacccttaccagctcctattataactcctcctacaggaccatcttcctttacttcagagacattatatgctatgttgcagagcctgcacaaaggacaggtgatcatcatgaagcacttacagagctcaggcctgcagcctatgatgagcgtaaaggagttccttagccaggtggcttggcctggagtccagccttctccttcgggaggggataaggcctccgcagcccaagagcctgtgctagaggatgacgagcccgtccctcctgagccatttgtttatgagactgatccaactagtgctcaggaagaggtagcatcaccagagcccgttcctcacccatcaccagcaccagtccttgatgattcccagccatttgccccagcaccagtgcctgatcagcctcttgctcaggaccctccagctgcaccagtgttggaccttaacgagcatgcagaggatcatttgcagaatgattga

SEQ ID NO: 912 - DNA, 381 bp, Glycine max
  Peptide Sequence Number=SeqID_117690
atgaatgacttgactatagaatctgaccatagttctgtgtatgatttccttgagcctcaatccatacataatgcaaaggataaacatcatgagtgtcaagattacattacaagattgttgaagcaatcacaaagagagatctacctaggagcttacttgaataacactttgaaggaattccatggcaagtccctcaagagtaaatttgatgttgattggattgaattaaaaatccttgatgttgttctgggaggactattatcatctgactatggtcgtggtgattactatggtcatggtcaaagtaccacaaccacgatcaagtctagagtcttaaatcttcataaatttgtattgttttcaactctttcactcaattga

SEQ ID NO: 913 - DNA, 579 bp, Glycine max
  Peptide Sequence Number=SeqID_117691
atgcagctgcagctacagatgaaaacacggaatattgagagccgtcggcaaatgacaaattcaagtgccgtcggcaaaaagcaaagcagcttccgcttattatggacaaaaacaacgtctatcccactgcgttggttgtggcggtcaaatacacgatcagtatatcttacgcgttgcacccgatctggaatggcatgcggcgtgcctgaagtgccaggagtgccggcaatttctggacgaaagctgttatttggtacaaaatgtgataaatgcggcaactccttcagcaaaaacgattttgtgatgcgcgccaaaacgaaaatctttcatatcgagtgttttcgttgctcatcttgtgcgcgacaactactgccaggtgatgaattcgcgttacgggatggcggcgctttgtattgcaaagaggatcacgatatgctggagaagtcatcgcagagcagtttaacatcatcatccgtggagagcaacaacaatattagcagtagtaacaacaacaatacaaatcttagcaataataatcattccagcgaactgggctcaatgtcaggtgagaatacataa

SEQ ID NO: 914 - DNA, 630 bp, Glycine max
  Peptide Sequence Number=SeqID_117692
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatatccgatacccttatgaccaaaagaatgaagagagtggatggtactctcagcggtctctgtagaccatggagatctctcttcattcttttggtcataagggtatcggataaagggggaccattgaggaaaccctgcatcatagtcacaatggctattgatgtacatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 915 - DNA, 510 bp, Glycine max
  Peptide Sequence Number=SeqID_117693
atggacaatcacaatacaggcttaacacacactcttgctcagcgtgcaagttcacacccttatcacgaagaaggactaaacaatgaaggtgcgaattgtgttttgtatgttatagccttacagggtagggtatatcttctaagccctgggttgacatcccacttgtccagttcaagcagggttatcaagattatttctctctctaaaatcacaaattacaaaatcccttccattctctctctaccgcgcctcctatcctcctcatctccaacccccaaaccaccgcgagaaccaccagtgcaggcagcgacgccatcgagactccaacgaacaacctggccttccgcgatcatcaccctccgcggttctcccttgaaccctcttcaggccccaacaatgccgccgccaagcgacgcacctcctctgcgaagcgcgtgttcttcgtgtccgctacggtggcgtcgaaggtgtccgccccgcagcggaagaaggacccaaagaagcacgtga

SEQ ID NO: 916 - DNA, 279 bp, Glycine max
  Peptide Sequence Number=SeqID_117694
atgggatttaaaagggggggatgtgtctttttcccaaccaccaaaagggggtcagccattggaccagttgtttaccaatatgatacctttcaatgttactatgatagaatcatagtaaaagtgaccaatatgacacctttcaatgttacaattcactggcatggtgtccggcaaaggctatcatgctggtatgatgggccatccttgattacagaatgtccaattcaagcaggccagagtttcacctataattttacagttgtgcagcagaagtgttaa

SEQ ID NO: 917 - DNA, 429 bp, Glycine max
  Peptide Sequence Number=SeqID_117695
atgcaagccttccgcaagatttacggaatgatcttaaagttgtctatagcagagatatccatagaagtcattgcatcactcacccaatactacgaccagcctttgagatgcttcacgttcggagacttccaattggtaccaaccattgaagaatttgaggaaattctaggatgtcctctcaggggaaggaaaccatacctttcctccgggtgtctcccctctttgagcagaattgcaactgtggtcaaggattcagcaagaggtttggaccacataaaacagactcggaacggcatagcgggcctaccacggagatacctagaagacaaggcgaggggtatggccaatcaaggagattgggtcccgtttatggatgtatggtttggtggacctagcagcaatcgacgttttccttgcataccaccatag

SEQ ID NO: 918 - DNA, 390 bp, Glycine max
  Peptide Sequence Number=SeqID_117696
atgttcaacattctaagatggtcgtccacgaccatcgtagaaaagggaaaaaatacaaaaagagcctacccaagaacatctctaaaaaggagagtggttagggcaggagaaggagaatcaactgtacgtacaaagaggttgaaactgcctaataccaaaactgatggagtaatcatctcatctgggctccaaagaagcatgcacatagagaggataataaaaatgcatcgcttctgggatgccaccgtcggagttgcgaggatgccaatggtgtatcaagtcaaaactcactggtccactataaactacttgacaaagtggggcactacagaacttgacataaagcataaccaacttttagaggtgaagacaaacctcgatgattattga

SEQ ID NO: 919 - DNA, 1833 bp, Glycine max
  Peptide Sequence Number=SeqID_117697
atgatgctctctattaccacatcactttgctttcggataatgattcctcccccaggaacttcctctcgccatctgcaccctgctgaccaactccagtcaatgttagactataccggtaccctcattaccagaagtaggaaatcgaatctcagggctttgaatgctttgacgatgcgagacaggttccaaattccgacgattgatgagctcctcaacaagttacgggcctttcgaacccaccatggccattatgagttcaaggtgatgccatttgggttatgcaatgcgccttcctcatttcaagcaactatgaacatgatcttccgcccctacctccatcgtttcatcatcatcttcttcgattatatgctaatttatagtgtctccattgatgaacacttgaagcatttggagctcacctttcagcccttagcatcaaaggtcgccacaattcagcaatggcctgttccccgcacaacgaaggccgtgagaagtttgctcggccttgctgggttttatcgtaggttcattcagaagtatgtcactattgcggccccattggtcaaagctatgaccaaagaaccccttcaatggacatcagagacacaggaagcctttgacactttaaaacatgccttgtcaatagctccagtgttagctttgctagacttcgaccttccattcacgcgccaagttacttcgatcatcaacgtatgtgcgagagctgctcgcgattacgatgaccatcaaaaaatggcgtcaatacttacttggctcatgggctatgattaccagattcattaccgcttcggtgctcacaaccaggttgcagatgcgttatcaaggttgtcagaacaagagccgtcgatctctatgatcctctcggttccttgccaaatttggcttccatgggacctcccaatgatcactacgttgctaagagaataccatgctactcctactagaagacacgccaagatcgccaagacaattgccagaatttctgagaacttttattggcctagtcttcggagtgacgtcactcaattcatagccacgtgtctcgactgtcagtgcactaaatatgagacaaagaagcttgttggattgttgtgccccttgccgggcgtgcatttgggcatgcttcctattgcgcatactgcttacatagtggcctctctgttcttggagcttgttgtgaagatccatggggtacaagcttcaatgaaagaccaagtagacacgagacgtcgtgatgtgaactatcaccctggagagtgggtattgctgaaactacgtcctcaccgacaatccactgccaagggctcccaagcattctctggtaaactagccaaaaggttttatggtccttttcagatcattgaacgtattggcaaagtcgactatcgtctacaacttctggcagaagcaaggatccactcagtttttcactgttccatgctgaagccattccgcagggacccgaaagatacaacagccacactactaggtccaattatagatcatcaacctgtcatagctctaatggcgatcctggattatcgaagaaccacaccaccacccaacgctgcctgggaggacaatgtgtttttccaagggccgcagagtgataaggaagaggaactagctggtatagaaacatgggtagcaaaacatgcagaaataatagtagcagaggaccacccgcgatggtcggaattggatggagacatcaaattcctctcagaaaacaacgactcagttgctgctcctgcactcaaacaatcaacgatagtgggtccttatacctcagtctctcctagtcccaattaa

SEQ ID NO: 920 - DNA, 354 bp, Glycine max
  Peptide Sequence Number=SeqID_117698
atggggcagatgaagcactgggtggtggtgcagtgtgatgtttcaggtggcggtggacccgctgtggctggtggtgaaggtgatggaggagtttcagagaaaaaaaaaatcagaggaaagggacataatccagtgcatgagatccagtccataaaacaaacaaaaatcaaaagcaagcgtagacttgagatcttctgtttgcttagaaaaatagacacgaaccaccctgcactagtagtaatggaaatcttgataattaaaattacagcttatgatatccatgggcacatgcaactggcacccaaattgcttcaggaccacccgcgatggtcggagttggactggagacattaa

SEQ ID NO: 921 - DNA, 186 bp, Glycine max
  Peptide Sequence Number=SeqID_117699
atgtatgccggaaaattgaatagctttcgactaaatgtaacttcatacgatacgaaaaataaggttgcatttagcaaaagtggcacagaaaggaagaaaaaagaagaaattctgaagcaggcccaatccaataggggcgctaagcgcgcatcaggcgctaagcgagcaactaactgcaggcgctga

SEQ ID NO: 922 - DNA, 561 bp, Glycine max
  Peptide Sequence Number=SeqID_117700
atgaaggccgatatggaggccttgaaagatcaaatgacctccatgatggaagccatgttaagcatgaagcaaatgatggaaagcaatgcggacgcaattgccgccaccagtgccaccattgaggcagatccgacccatccatccgccataaaccaagcaaaccaacccatcccagacatagtggctcaaggaggagagggccagcaaccccagcctatagggggcacccatgaagaacctcaggatcatgctcaggttgactttgagccataccctgcatttgccactgagagaccgacatgtagtgtggaaggaagggagaaactcgatctcatcaaggagaaattaagggtcgtcgaaaggtttggtgattacccattcgccgacatggctgagttgtgtttggtgcccgacatcgtcgttcccttgaagttcaagagacgagaagctcttgatgcatttctttcaagaaagcttggccggagcggcggtcatctggtatacaaatctagaagcttcctaaattcactcatggaaggacttgatacctaccttcattag

SEQ ID NO: 923 - DNA, 551 bp, Glycine max
  Peptide Sequence Number=SeqID_117701
atgaggggtggaggttgcacagcagcttgcccaggtgagctacttgcttcctccagaagtaacctagcttgcccaggcgagctgctcaattcggcttgcgagaatccaaatgttggcaaacgatcatccccggacgaaattaggaaccttattaggtcagttggagtgcagaatgctatggattttgccaaggtttctaaatcgagggctattactcacactgtagccttcgctaaagttgtgaagtcgaaccatcaaccatctttcatggttggcagtgccctttccaagttgttacacaccagattggatggttatgagttattcgagcgctgcaagggcttgcagttggagaaaattgatttgattggcaaggtagaaggcattgcagtagagagggacgagcttgccaaggtggttgctgagttagaggcccacgaagtgtcatccagaaaagtgcactacttcagtacatccgctgagtgggaaaaggacgcgctaagtcgaaatccattaatgagcgctaagcggttcagaattgcgctaagcgc

SEQ ID NO: 924 - DNA, 488 bp, Glycine max
  Peptide Sequence Number=SeqID_117702
gtcgccatgataagaatgcagtctttgatggcgtgggaagcaagaccttgttgaaatggaggcaagactttggtaatgtaggaggcaaggccatgactaaggacttgtttgccctaggttttgacaagcctgtagagctgcatcaaggcttaccaaggatagaccttgggttttgtgaacctgtgagactcatcaagagcccatgtcgtactcttgcatacatgtcacttcgtggagtggtatgtactagagacatggtgtcatgcttgtgcataaatgtcatccgtggagtggtatatactagagacgtgatgcgattctcttgcatacgtgtcacttatggagtgggttgtattagagacatggtggcgtgctcttacatacatgtcacttgtggaatgacatgtaccggagacatggtcactggtggagtgggacgtattggacacaggtggcgtgctcttgcatacgtgtcacttgtgaaatga

SEQ ID NO: 925 - DNA, 377 bp, Glycine max
  Peptide Sequence Number=SeqID_117703
ggtgtgtctgtgtgtttgtgtctttgtgtgttatgagggtgtgtctgtgtgcttgtgtctttatgtgtgatgaggggggtgtgtgtgtgtgtgtgcggggtagacagttgctccatggtgttctggttgctaatgaggtagttgaggaggaatgtgtgtgtgtgtgtgtgtgggggtgcctcacatcagcctctatatctattctagtgaatggaagcccaacctctgaatttaatcctcaaagaggtttgagacaaagggatcctttggcccccctactgtttgacttggttgctgaaggcttgtcaggaatgatgaaggaagcaacaatacaagattgcttccaaagcttcttcttgggaaagaacaaggatcca

SEQ ID NO: 926 - DNA, 654 bp, Glycine max
  Peptide Sequence Number=SeqID_117704
atggaacctgccctagacacattgaaggaaattgaagcttttctatcagcaaatccaacagaaattgtcacactcatcttggaagattatgttgatgcaccaaatggtttgacaaaggtcttcactgatgccggtctgatgaagtattggtttccattaccaagcatgccaagaaatggtcaagattggcctctagtgagtgatatggttgccaaaaaccaaagattactagtgttcacttctattgcgtctaaggaacaaagtgaaggcattgcttaccagtggaatttcatggttgaaaatcagtatggagatggtggtagaaaagcaggaagttgtccaaatagggcagaatcatctccccttaacgacaaaagcaaatccttggtgttggtaaactattttcgatcaactccaattaaaccaatcacatgtgaagataactcaggagaactaattaacatgctacaaacttgttttggtgctgctggcaaccggtgggccaattttgttgctgttgattattataagaggagtgagggaggaggatcgtttcaagcagtagacactctcaatggaaagctactatgtggatgtgatgatgttcatacatgcgtgcctggatcaacatcagaagcttgctctcaatcatag

SEQ ID NO: 927 - DNA, 423 bp, Glycine max
  Peptide Sequence Number=SeqID_117705
atgcttaaccgagacttgcactcccggttaaggaccagtagtttccttttaacggttcctgggccaccccctgatattggaggagggccaagtgtgcgagcacaaccagagagggaggctatcacacagctactatgcataccgaggcaagatttcacccgtgccgctgcaaagagacgaggatcacacccacaaagacacccagtggacctgaagaagtccaacagggccctggggtttccagctctggttacgggcctctgtcagccctacagggcacccgttccccccagcaagttcatgtcgtcgtggcatagggagtgcctgtcgcccctagcaaggtcatcaggcccccctaccaatcgagctttcatcaagaagtactgcgcccccaggcaggcgcagggcgagacaccacagtag

SEQ ID NO: 928 - DNA, 219 bp, Glycine max
  Peptide Sequence Number=SeqID_117706
atggctcgaaagggagttgaggtcacgcaagagagtgacgttggtggctcaacaggtggcggtgaagggtgttggaagggtgggaaggggaaggaagattctggagttggacgggaaagggggaaaggcaagtgtggggaaggggaaggttctcattggaaaagaagaggggtgaagaagtggaaaagacaacatggaaaagggaaggttatagagtga

SEQ ID NO: 929 - DNA, 996 bp, Glycine max
  Peptide Sequence Number=SeqID_117707
atgagttctcttccgggcttgcttgtggttattcttccacttttttacaatgttgcagctgcttgttctgatggaacgtgcaagcttcttgatgagtgctcgtccgatggagattgtggcactgggctctattgcttttcctgtccatttgggtttttaggctctaggtgtgtgagatctactgtcacaaatcaattcaagctcataaataattctctgccattcaacaaatatgcatttttgacaacgcacaacgcttatgccattgatggggagccatctcacacaggcgtgccacgagtaacttttaccaatcaggaagacagtgtcacccaacagctaaatgaacctgccctagacacattgaaggaaattgaagcttttctatcagcaaatccaacagaaattgtcacactcatcttggaagattatgttcatgcaccaaatggtttgacaaaggtcttcactgatgccggtctgatgaagtattggtttccattgacaagcatgccaagaaatggtcaagattggcctctagtgagtgatatggttgccaaaaaccaaagattactagtgttcacttctattgcttctaaggaacaaagtgaaggcattgcttaccagtggaatttcatggttgaaaatcagtatggagatggtggtagaaaagcaggaagttgtccaaatagggcagaatcatctccccttaacgacaaaagcaaatccttggtgttggtaaactattttcgatcaactccaattaaaccaatcacatgtgaagataactcaggagaactaattaacatgctacaaacttgttttggtgctgctggcaaccggtgggccaattttgttgctgttgattattataagaggagtgagggaggaggatcgtttcaagcagtagacactctcaatggaaagctactatgtggatgtgatgatgttcatacatgcgtgcctggatcaacatcagaagcttgctctcaatcatag

SEQ ID NO: 930 - DNA, 2382 bp, Glycine max
  Peptide Sequence Number=SeqID_117708
atggttgaggcagttgtgtcctttgcagttgaaaggcttcacgacctacttacggaagaggccagattgttaattggggtgagtgacaaagtcaaaaggatgcaaaatgaactaaagaggatgcaatgcttcctaagagatgctgagagaaagcaggataaaaatgatactataaagaattatatttcagaggtgagaaaactagcctatgatgcagaggatgtgacagaaatatatgctattaaggttgcattaggcataagtattggaactaaaaatccactcaccaaaactaaacatcttcacaaagttggcactgagctcacatcaataaattctcgaattgatgacctcacaagaagcctacaaaactatggttttattgcaacagaagacaatgaagaggtatctgaggtgcaaagacaattgcgatggtcttattctcacatagttgaagagttcattgttggcttagataaggacatagacaaagtggtggaatggctattaaatgaaaatcatcattgtcaatttgtttatatttgtggaatgggtggtcttggtaaaactacacttgccaaaagcatttaccattacaatgctattaggcgaaactttgatggttttgcttgggcatatatatctcagaaatgcaagaaaagagatgtttgggagggaattttactgaagcttatttctcctaccaaagaggaaagggatgagattaagaatatgacagatgatgaactggcaaggaagttgtttaaagttcagcaagataaaaagtgtttgataatcctggatgacatatggagcaatgaggcatgggacatcggtaaggctgcgtacaatatccctcccccataccttcgcatagcgaagagcctctgggcaatggggtacgaagtttttctgagggcgagccctggtgcagcggtgaagttgtgccttggtgacttgttggtcatgggttcgaatccggaaacagcctctttgcatatgcaaggagaaatggttgcaaagtgtgctggtctgcctttgactatcattgttcttggagggcttttggctacaaaggagagagttagtgactgggctacaataggaggagaggacttgccttgtcaactgaaaccatgttttctctatttaagtcaattccctgaagactctgagataccaagaactaaactaattcagctatgggtagcagaaggtgttgtttcatctcaatatgagactgaacgggatgagacaatggaggatgttgcagaacgctacctagatgcaagacgaattgatgaagttcgtaggcttgctgtcttcttggatcaacgtgttgatcaattgattccacaggacaagcaagtgaatgaacacctcaggtcccttgtattttttcacgacaagaagtgtaggatggaaaattgggacctagtgaaaggtgtttttgtcgagttcaaattacttagagttctagatcttgaaggaattaaggggctgaagggacagtcattgcctaaagaagtgggaaatcttttatggttgaagtttctgagtctgaaaaggactcgcatacaaatactgccatcttccttgggaaatttggagaatttgcaattcctaaatttgcaaactgtcaataaagtgagctgggattcaaccgtggaaattccaaatgtaatatgtaagttgaaacggttgaggcatctatatcttccaaattggtgtgggaatgttactaacaacctgcaactagaaaatttgaccaatttacagacattagtaaattttcctgccagcaaatgtgatgtaaaagatctattgaagctgaaaaaactcagaaagactgacatgctttccttccctgaaaatgtagtagatgttgaaaaattggtgctgggctgtcctttcctccgaaaattgcaggtcgaagggcggatggaaaggctgccagcagcctcactgtttcctccacagctttcaaagttgactttatggggctgtagacttgtggaagacccaatggtaacattagagaagcttcctaacttgaagtttctaaatgggtgggatatgtttgttggaaagaaaatggcatgctcaccaaatggttttcctcaactgaaggttttagtacttcgcggcttgcctaatttacatcagtggacaatagaggatcaagccatgcccaatctttaccgattgagcatatctgattgcaacaatttaaagacggttcctgatggactaaaatttatcactactcttcgggagctagaaatcagatggatgcctaaatcattcaagaccaggcttggaactgctggggaggattaccacaaagtccaacatgtgccatctattgtatttttgaactaa

SEQ ID NO: 931 - DNA, 1014 bp, Glycine max
  Peptide Sequence Number=SeqID_117709
atgggtctttttccacttttgtcgtgtttctctatcaatgatccaggggaaaacagactactcgggacaacaaccttcaacatcctggaagaactttgcacccacttttcacttgcagagataaagtcagcagtgagaaacatcaagaaaccttcggtgattggagaagattcattcggggttgtgtacaaaggttatctgaaaaaaggtgctaccactgttgcaattaagtggttcaggaagggttctctttctggtctctcagagtctcagttgaagaacgaggttctcttcctttgtcagctccaccaccccaacatcatgcctttaattggattttgcattgaaagagaccacccccatctgattcttgtccatgaatacatgcttaacggtgccctcagtgatcaccttcatcctaaaagcaatcacaaagttgatccactaccgtggaaaaggaggcttcaaatttgcattggtgttgcacgtggattgcactatctacacacaggaggcaagtgttctgtcatacacaattttttcaaaacatgttacatccttttggaccaaatctgggagcctaaaatttcaggcttgttgttgtccaaaaggggaagtattgatgtcgcaaattcatctcttgttgctagaaaccatgacactttcgcatattgtgatcctgagtatttggcaaccggcatcttgactgtgaaatcaaacgtgttttcatttggggtggttctattggaagtggtgagtgcaaagcaggggaaagatttgtttttggaacgtaatcgacttatgaatgatgaaccgaaatattcgctggagttgcaaacagaaaaaatagttgatccgtttattaagtccagaattgctccagattgttggaaagcgttcgttgacattactgagaggtgtttgcataagcagggaatggaacgaccaaacatgggcgaagtggagatgcaacttgagcttgcgcttcaattgcaggaggaagcagaaacctag

SEQ ID NO: 932 - DNA, 372 bp, Glycine max
  Peptide Sequence Number=SeqID_117710
atggaagggcgtgtgaaggaggtgagcaaaaaaattggtattctgtttatactttcatgttatctttgccagttatgtggtgaaaatggtgtgaatgtcgatgatcttgagacaaatcatattgtccttgttcacggaggtggcttcggggcctggtgttggtacaaatccatagcacttctagaagaaagtggttacaaagtagctgccatagatttaactggttcgggcgtgagttcatttgatacaaacatcattacaagtctgtcacaatatgtgaagccacttactgacttccttgaaaaacttccggaaggcaaaaaggttaacttccaaggagagaagttaaggaatggatattcccatggataa

SEQ ID NO: 933 - DNA, 408 bp, Glycine max
  Peptide Sequence Number=SeqID_117711
atggagaaactagcctctgggaactcagtttgcgagaaaagttggtttcagagccattcaagatatgggatgtggttgcatgctcattaccatttcaggttactctacaagttggtgcaagttggtgtattgcaagtccagctgcttcgcagactactctacaagttgcattggactatgcttgtggctttggtggtgctgattgctcagcaattcaacctggtggaagctgttacaacccaaattccatcaggaaccatgcttcttatgcctttaataagtattatcaaaataatcattagcactgttgtcatcattagcactaacccaaaggtaacggatggaagtgaagacaatgacgatggtgacaatagtggtggtgttggtgaaatggtggtagtggaatag

SEQ ID NO: 934 - DNA, 1060 bp, Glycine max
  Peptide Sequence Number=SeqID_117712
atggcgcggccgttaaccggcaaacagcgcgtactgcactatctgatcatggtgggcctgtatcagctgctgtatacccgcgttccgccgcacgccgcgctggcagaaaccgtggccggggctgaagcactgaagcgggcaaatctgaaaggcttgcttaacggcgtgctgcgtcagttccagcgccagcaggacgcactgctggcggaggtaaatcagggcccgcagcgctactggcatccgggctggctgctgaaacggctgcagaccgcgtggccagagcagtggcagcaaattgtggaagcaaacaatcagcgaccgccaatgtggctgcgcgtgaatcgtcagcatcacagccgtgacgcctggctggcgttattaacccagcagaatcaaaatgcgtttagtgctgacgcgccggatgcgctgcgtcttgaagcaccggctccggtcagtcagctgccaggctttgaacagggctgggtgacggtgcaggatctctctgctcagcgttgcgccctgctgctggcgccggaaaacagcgaaaccattctcgacctgtgcgctgcgcccggcggcaaaaccacccatattctcgaaattgcgccgcaggcccgcgtgatggcggtggatatcgatgcgcagcgcctgtcgcgcgtgacggaaaacctgcagcgtctggggatgcaggctgacgtgcgtcagggcgatggccgcacgccagcggcctggtgcgacgagcagcaattcgaccgcatcctgctggatgcgccctgctcggccaccggcgttattcgacgccatccggatatcaaatggctacgccgcgatcgcgacatcgacgaactcgccgcgctacagcgtgagattctggcggccatctggcctcgcctgaaatcgggcggtacgctgctttatgccacctgctcagtgctgccgcaggagaaccagcagcagatcgatgctttcctcgcgacgcatgacgatgcggtgccgcaggcactgccacatgggcaacttaacggctggcaggttttccctgccatcaatggcggcgacg

SEQ ID NO: 935 - DNA, 704 bp, Glycine max
  Peptide Sequence Number=SeqID_117713
cgcaacctttaaggagcttagcgcatatccttgcgacagatgttcagcttagcgggcactgccagctaagcggaccatgtctcgctaagcagccaatggcttccagaaagagaaagagtattggtacaaggtccacaacgcagtatgacacaaggagattctcttccttagatgcttggaccaaatacacagataatgttctggggagaaacattttaccagagaagaaagttgagatatatcattccgagctagatgagtttaaggctgagttggagaggcgtaatttccataaatgcctcaccaatttagtcgatgggagcataaacctagctttggtgaaagaattctatgcaaatttatacagttctgaggataatccaccaaagcagtctagtgtcagagagggccatcctgggaagattctcaggaaggatctgactacactagctcagtctaacacttccagacttgggttccctgctctaatcactgcattatgtagagccaaaggagttgtctctgatagcctcacttttgagtgcctgagcccggtcattaacttggcctacatcaggaagaattgttggaaccccgaggatctaacaatttctattcaaggggctaggagggcgagggcaaggccagctaagctttctgcagcttctactccagcatccacttcagcagccccttctgtccca

SEQ ID NO: 936 - DNA, 195 bp, Glycine max
  Peptide Sequence Number=SeqID_117714
atgaagtcatgtgtaaaggttgccttaaggaagtcaacgctacacttgtattttgattgcaaattttttttcaaagtagatggtgttaagcttgaggtagtaggtgaaagatacaggaaattgcaactgaggaacaagaatcctctaggaaaaagaaataccagcaaaatcagctctaagcacattacaagctaa

SEQ ID NO: 937 - DNA, 231 bp, Glycine max
  Peptide Sequence Number=SeqID_117715
atgacaaaggtttcaaaactacaaaagacaactatgaaacaaggtggagtgggaattgatgtgcgaactgagataagaagacaatcaacaagggaatttgaaatcttccaagaacggtggaatcaagctatttctgaagacaaaacctgggttgatccatttaaaagtgaccaaagacgcataagaaaacaacgagacacacaacgcctttctaagcactttatatcttaa

SEQ ID NO: 938 - DNA, 1000 bp, Glycine max
  Peptide Sequence Number=SeqID_117716
atgaattcctccattatttatattcttgtctttgtccagctttggttgttaagcttaccatgcagagagagtgtgtgcatcccaagtgagcgtgagacacttttgaagtttaagaatagtctgaatgatccttcaaataggctttggtcttggaatcataatcataccaactgttgccactggtatggagtcctctgccacaaccttacttcccatcttcttcagcttcacctccacagttcaccttctgctttcgatgatggctacattgcatccgatgaggaagcttataggagatggagctttggtggagagataagtccttgtttggctgatttaaagcatttgaattacttggacttgagcggcaattatttccttgaaaaaggtatgtcaattccttctttccttgggacaatgacctccttgactcacctcaacctctcttatactggattcatgggaaagattccatctcagattggcaatctctctaagcttcgatatcttgacttgagcgtcaattatttacttggagaaggtatggcaattccttctttccttggtgcaatgagctccttgactcacctcgacctctctgatactggattcatggggaagattccatctcagattgggaatctctccaatttggtctatcttgacctcggaaattatttttccgaacctctgtttgctgaaaatgtagaatgggtatcaagtatgtggaagcttgaatatcttgatttgagttatgcaaacctatccaaagcatttcattggctacacactctccaatctcttccttctttgacccacctatatttatcaaactgcacactccctcactataatgaaccatccttgctcaacttctcatctctgcaaactctccatctttccgctactagttattcccctgccatttcttttgtccccaagtggatattcaaattgaagaaacttgtttctcttcaattaccggataatgaaatccaag

SEQ ID NO: 939 - DNA, 798 bp, Glycine max
  Peptide Sequence Number=SeqID_117717
atgtcaataatgcacgcattgttaaatgacatgtactcttgtgctgggtggtctaacttattccctcatgcatttgtttatatttgtaactatcagattgacaaaaaatcgagttcctggggagaaccaaaggtgtatcctacaacttctgggaatttgaaagggttgccacaaggtatagttcatgctaattctgatttggagttaaaaccatcatggtcgacaagtagttcaaggtcaaaggctgttttctctaaccgtaacttattggcagttccagttggtattaaacaaaagcataatgttgatgttatggtgcaaaagtttcttcaagaaaactttacaattattttattccattatgacggcgaggttgatggatggtggaatcttgactggagtagcaatgtcatacaaattgttgctcggaatcaaacaaagtggtggtttgcaaaaagatttctacatccgaatatagtctccatttatgattttatctttctttgggatgaggatctaggggtggagcatttttcaccatcaagatatattgaaattataaagcaagaaggtttggagatatctcaaccagctcttgatccacattcaacagagatacatcatagaattacaattagatctataaccaagaaatttcataggagagtctatgaacgacgcaaacgccgtgcaaggtgttcagattcaagtgaggaaccgccatgcactgggttcgtggaaggtatggctccggttttctctcgatcagcctggtactgtacttggcatcttatacag

SEQ ID NO: 940 - DNA, 696 bp, Glycine max
  Peptide Sequence Number=SeqID_117718
atggaagatcacgaaagccagagaaaactcagaatcctgtgcctccatggattcaggactagtagtgaaattctcaagcaattagtcttaagatggcctgaacctgtcttacaaaagctgaactttgtattcctcgatggccagtttctcgcacagggaagatctgatgttgaaggcatttttgaccctccttattatgaatggttccaagccaatgaggacttcactgagtataccaactttgaagaatgtttagtatacattgaagattacatgctgaaaaatggtccttttgatggtttattgggtttctctcaggaatattgtcttcagggagcagttttagcagctgcattgctaggattgcaagcacagggtgtggcacttgggaaggtgaacaagatcaagttcctgattgtgatatcaggagctaagtttggtggaagaaagtacggaatgcctaaactggctgctaatccatattcaaaacaaatggattgcccgtctcttcactttataggggagaaggattttgcgaagccagacagcattgctttgttggaagcattcaaggatcctatggtgattcaccaccctaaagggcacacagttcctagacttgatgataagggtcttcaaactatgctcggtttcattaacacaattcagactaggaagacctgttcaagactttaa

SEQ ID NO: 941 - DNA, 375 bp, Glycine max
  Peptide Sequence Number=SeqID_117719
atgggaatgaagctcaagacagtcaagccgcgcattgcaatggccggctccaggcttgcggccgcacctacgcccagcgccaagcgcgtcaccggtcgcaggttgcaagaccggcggctgcgcatctggtcagtcaatccacactgcgcccattgtggcgtgcttacggtgtatcccaacggattcgaactggaccatcgggtgcctctgcattgcggaggctcggacaccgacgacaactgccaggttctctgcgttgaggtagatgcccaggcccgggtcgctagaggaccaccagcgcgacgcggctccagccggggcgcgagggtgccgaggtctgcgatcgcgcagcagcgggcctgtggtggcccctga

SEQ ID NO: 942 - DNA, 246 bp, Glycine max
  Peptide Sequence Number=SeqID_117720
atgtcagttatagaattgtacatagaaaatgatgttactagtgggtctttagatgaagatgatattgttgatgatatatctgatacagatgatgaagtcacccatatgattgaatcacttacaattgttcaaccaagagaaggtgtagaaggaattcataatccattttggaatgatgttttgcattataacaatatcaattggggtcatcctgatgaggagaatatttgcgtaaagatgcggtaa

SEQ ID NO: 943 - DNA, 168 bp, Glycine max
  Peptide Sequence Number=SeqID_117721
atggatgcagaattcatagagagatgtgtgcctagaggcctacttgaatggggattcaatatcaatcaaggaagtaaattcaaggttgttaaatggattctagttaaatattttacttatcaaagaccattggaatcagagagaattaaggcaatttgcattcagtga

SEQ ID NO: 944 - DNA, 291 bp, Glycine max
  Peptide Sequence Number=SeqID_117722
atggatctcaatggaaaagtccttacaaatgacgataataaggagattcctgacgctgttaatatccttatttttacaatagctcaacactttatcgatgacctgtcactttggaaagatagagaggatagccaacaaccttcctggaaagaaaaatttctagtcggtcttccaagatcattaggagataagaaagtagctttaaaaatctatcaagatgacaaaatccaaagacaattagccaaagaaaaggcccaaacaaagagagatttaggatctttctgtgaataa

SEQ ID NO: 945 - DNA, 246 bp, Glycine max
  Peptide Sequence Number=SeqID_117723
atggaggagggtggacctcagaggccgaagcaaatgaaggatgtggtaacctctaggtggtttatattgagggccttgcatgaagcgggcatgatttcctttgatgggcataagggagattcttgtttgatacacccgggggcaatgcatgacatggaaacatgcccgacggtagaggagttgtttcaaggaatgatagacaagggcatgtttgaggtttatggtgcaaggaagggagagcaataa

SEQ ID NO: 946 - DNA, 654 bp, Glycine max
  Peptide Sequence Number=SeqID_117724
atgctgttggttttcgcgttgcctattgggaaaggttgtctcgctcgtttctctactccggtgatgcatgatgggcatgattatttgtggctctcgagcgaatcggtgctagtaggtgatgggaatataggcgatgcgttgctatacggcagtcggtgcttcgtgggatggctctcattcgaaaatgcggctgttggttggcatggttgcctgaatgttgcggtgctcattggaagtttcgctcgagccactactcaaggttggatattcacgaatgcatgttgtcggtgcccaccacataagtgggtggcggtgcaaataagacccgcacaagtgggtggtggtgcaaataatgctgtgctcttgcattgcttttggttggacaacgatgcgccttctcgggcattgcgtacggcagggcgcgtgagtggtgcttggtgcgcacgggcttgtcggatccctgctcgggcagcgacggcaacttgtgcgcgcctcttcaatcgtcggttcaagtgtgccttgatcggtgtcggtttcctggtgcggcgtgggatggaccatgaagcatccgtcgtgttccacatcccagacgtaactgtccccgggttgttggcgcacggcggcacgctcgatctctcggatgcggaaaattga

SEQ ID NO: 947 - DNA, 2238 bp, Glycine max
  Peptide Sequence Number=SeqID_117725
atgattcttcaaaatcttgacttgtctggaaattcattctcatcttctatacctgattgcctatacggtcttcatcgtctcaagtctttggaaattcattccagcaacttgcatgggactatttctgatgccctgggaaatttgacttctcttgttgaacttcatttgtcaaacaatcaacttgaaggaaccattccaacttctttgggaaatttgacttctctttttgcactttatttgtcatataatcaacttgaaggaacaattccgacttttttgggaaatctccgcaactcaagggagatagatttaacaattctcaatctctctattaataaattcagtggaaatccatttgaaagtcttggatcactctctaaattgtcatctctttggattgatggcaataattttcaaggagttgtcaaggaagatgatctcgcaaatcttacaagcttgacagtgtttgatgcatcagggaacaatttcactttaaaagtgggtcctaattggattcctaattttcaacttacctttttggatgtgacatcatggcagataggtcccaactttccatcgtggattcagtcacaaaacaaacttctatatgttggactgtctaacacagggattttagattctattcccacttggttctgggaagcacattctcagcttttgtatttaaacctctctcataatcatatccatggtgagcttgtgactacaataaaaaatccaatatctatccaaactgttgatctaagcacaaatcacttatgtggtaaattaccctatctttcaaatgatgtgtatgacttagacctttcaaccaattcattctctgaatccatgcaagattttttatgtaacaatcaggacaagccaatgcaattagaatttctcaatcttgcatcaaataatctgtcaggagaaatacctgattgttggattaattggccatttctagtgaaagtgaatttacaaagcaaccattttgttgggaacatccccccatccatgggttccttggcagacctgcagtctttacaaattcgtaacaacacactctccggaatatttcctaccagtttgaagaagactggccaattgatatccttggatcttggagaaaataatctttcaggatgtattccaacatgggttggagaaaagctctcaaatatgaaaatcctccgccttcgatcaaacagtttttccggtcacattcctaatgaaatatgtcagatgagtcttcttcaggttttagaccttgcaaaaaataatttttctggcaatatacccagctgtttccgtaacttgagtgccatgacactagtgaaccggagtacacatcccggtatctattctcaagcaccaaatgatacacaattctcttcggtatcaggtatagttagtgtgctactatggctaaaaggaagaggagatgagtatggaaacattctgggtttggtaacaagtattgatctgtcaagtaacaaattattaggaaaaattcctagagaaatcacagatctaaatggattgaactttttgaacttgtcccacaaccaattgattggtcctattccagaaggtattggtaatatgggatcgttacaaaccattgatttttcgaggaatcaaatttctggtgaaatccctccaaccatttctaatttgagctttttgagcatgctagacgtgtcttataatcatttgaagggaaaaattccaacaggaactcaattgcaaacctttgatgcctccagctttattggcaacaatctatgtggtccaccactgcccataaactgcagctccaatgggaaaactcatagttatgaaggaagtcatgggcatggagtgaattggttttttgttagtgcgacaattggatttattctgggattctggatagtgattgctcctttgctgatttgtagatcatggcgagggagagtagctgaacgtaaagaggggaaggataggaggtgtggggaaatgaaactaaggataaccaacaccaacacaaaaatgttatatttactagtagcagtagtgtgtttcttcccaaattgtgcaaatgctcgtcgacaaatgggtgagatcaaaagctcaggtatggtggctccaggacctgtgcactctcttcaattcacctcaatttctccacaaccttttgatgctatggagctctcagatgaacctgccgtttctccattcccgcaatactaa

SEQ ID NO: 948 - DNA, 561 bp, Glycine max
  Peptide Sequence Number=SeqID_117726
atgagtcgtgttaaaaagaaaagaaaagtgagtgggaaggacacactcgagtcgagcgggagtcaaagctggaagtccaaagtttctggaactcaaactagtagtgtgggtgtggaacaggacaagggggtttctgtgaaggactatttggtggacaaactgaggcctggtgatgaagacagggctctctctgaagtgatatcagagactctgcacaagaaggaactgcccccagtggaagttactgaagaaggtgtgagaaaggtggtttctgatgctgtgcataagagagacgatgatcctgagagaagaatggaacatcaaagaatactgggaaaggtaactgagtcagaggaagtgaagagaaggttaggaggtgaaagtgtggtgacagagaaaaagtaccaagagatgtatgtgaatagtccggggaaaggtgtggttgataagtttaaaggtatggttgggacatggtttaccaacccagcagagaatcaatcttcacaagttgattgtaagggttcgaatctggaaacagcctctttgcatatgcaagggtaa

SEQ ID NO: 949 - DNA, 909 bp, Glycine max
  Peptide Sequence Number=SeqID_117727
tccacaccttcagaggactacacgtcctcgccttcaatgggccacacgcattcaccttcgttgggctacatgccctcaccattggaggactacacattgtcgccttcatagggctacacgccctagtcttcagaggactacacatcctccccttcagaggactaagtgtcctcacctttagaggactacaggtcctcggcttcagaggactacatgtcctcaccttcaaaggacatcacgtcctcgacttcagaggacaacacgtcctcacctttagaagactacacatccttgccttgagagggccacatgccctcgccttcgtagggctacgtgtcctctcctttagaggactacacgtcctcgactttagaggactacatatcctcaccttcagaggactacacgtcctcaccttcagaggactgcacaccctcgccttcaaacggctacacgcccttgccttcagaggactccatgacctcgcctttagaagactagacatcctcgcctttagagtactagacgtcctcgccctgacgactacaaatcctcaccttcagagggctacacttcctcgccttggagggctacgcgcccttgccttcagagggctacgcgcccttgccttcagagggctacgtgcccttgccttcaatgggcaacaagtgctcacctttaggggactacacatccccccctttagagggctacacgccctcacattcggaggactacacgtcctcgccttcaaagggctacacgccctcgcctttagaggactacatgtcctcgccttcagagtgttgcaagctcttgccttcattgggctgcacgtgcttgccttcgtagggctacacgccctcgcctttagaggatcacacgttgatgcaatcctaccccccaagg

SEQ ID NO: 950 - DNA, 394 bp, Glycine max
  Peptide Sequence Number=SeqID_117728
atggccaccattgcaaccaccactatgatcatcaaccattgcccccaccaacatgactattgtaccaatagtggtggcgacgatcatctaggtgacgaggatggtgatcatgacaacaatcatggtggtgatgaggatagcggtgttggtggtggttgtagtgacaatcttgatttgttggttgtagttagcttcccttcccgagcaccgtgtggtcggctcgggtattgtattgagagagtgttttgtaggttctttctgatcactgtggtgcgtctattggaaacatcaagcatgggttggattccctgttctggatattcaggcactaagaacaaggttgagaagatggaagctcaggatagtctcgttggtcagatcaaagccacccctg

SEQ ID NO: 951 - DNA, 285 bp, Glycine max
  Peptide Sequence Number=SeqID_117729
atgttttctgggttagacctgaatcaagagggagaggccctgacgaactcttcgaagtctaggcttgggggacgtcaggacacaatacttgatgaggacatgttcaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgtgagttgtatcatggcccaaatggaggaggactaa

SEQ ID NO: 952 - DNA, 324 bp, Glycine max
  Peptide Sequence Number=SeqID_117730
atgaagaagatccaaggcctacaagctccacatggagctacatcacttgttaggcctcccgatattgtacctacatcatgtccacctccgactgaagctagaccatgttcatctcatgttaatgcacgtagaccatccccagtacctacatccacaccatcttcatcctcgattgatgcatgtggaccatcctcgatacctacatccacaccttccccatccccggctatagccaacatgcctattgatgaagatgctacaaatttggtggtcgaagccccccttaatggtcgtcctatggttacactaatcaatgaagcataa

SEQ ID NO: 953 - DNA, 216 bp, Glycine max
  Peptide Sequence Number=SeqID_117731
atgtatgatctaataatctgctattttcaactcagacattctcattctgtgacttggcaactgcaactagaaatttttgagctgaatgtcttttgggagagggaggctttggtagagtatatgccattaggatgcctggaagaccacttgcatgatattcctcctggcaagaaacaacttgactggaacactcaaatgaaaatagctgctgggtaa

SEQ ID NO: 954 - DNA, 324 bp, Glycine max
  Peptide Sequence Number=SeqID_117732
atgatgcatgaagagcttaccaacaatgattatagtggtaggtacaaggtcatcgcacgagggttaatttgggaggtagtgatgcaaggtcacaaggtcgaagtaaggaagagcgaaattttgaagtcaatttattgggctctaaaatgggcacaaatcaacaacaacaaagaaaccctacttcaactcctttcttctttccccgttacccagacctcaaaaaatcccttcactactagagaagcaagattctacatcggttatttggggcatactacattggtttatgaccgtcgtcatagggaacatcgtaaaaaggggtag

SEQ ID NO: 955 - DNA, 162 bp, Glycine max
  Peptide Sequence Number=SeqID_117733
atggagatgaaaggcttcttacgcgggacgccgggatgtatacagtttataggcgttcggaatccagacgatgtcaaatccagagaggttgagccgcaaagacaaaaagatgaggagatgaaaaaacgtgaagaacggagtctggagtgtgagatacgttag

SEQ ID NO: 956 - DNA, 414 bp, Glycine max
  Peptide Sequence Number=SeqID_117734
atgcagaaggggtcccaaactgaactgattgatgttgaaatggaagatcagttagaggatatgattcatgatcttggagaagagtcatttaagcaagaacattcttctatgtatgatacattggagagtgattcgaagaagcctttgtatctggggtgcaagaagtctttgaggctgttgtcagcggtattaagtctggtcaatgtcaaggtcaaatatgggtggagtgacgaaagtttcacttcatcgttttcagatgggagaaactacgatggaatgctccgccatccgactgaatcctccaagtggaagaagattaatcgtttgaatccaaattttggcaaagaggaacgaaatcttaggcttggacctgtcattgatggaatgaatccctatggaagtttaagcacttag

SEQ ID NO: 957 - DNA, 972 bp, Glycine max
  Peptide Sequence Number=SeqID_117735
atggatccaatctcgatcaaactgggtgatgacaattactcaacatggaaggcggaagccttaggaaaaatcgaagaacggaaccttgagaagttcttcacggagacggactttggaggaatgccacccatgttcagtgaagaatactcaagctgggaagagcaggatcaggttctttataggtggcttcttgattccttgtctacaaagcttcttcaccaattggaaagatgtaaacatgctttggaactatggatggagatagaggtttatttcttagataaacaaattgaagagctacataaaaaatatgaaagtcttaaggaagaaagattcatgctgcaactgatttgcatgaatcttagtctggagtgtccagagactagcaatgaagacaagaccatagaggaagagctgattaaggagcatggaccagaatcattagcagatatattgtccgtgaagcctggcacctctggctctgaaatggatccaatctcgatcaaactgaatgatgacaatttctcaacatggaaggctgaagccttgggaaaaatcaaagaacgcaaccttgagaagttcatcacaatgacagatttgggaggaaggccaccaatgttcagtgaagaatacaaaagctggaaggagcaggatcagggtctttgtaggtggctgctttcatccttgtctacaaagcttcttcaccgattggaaagatgtgaatatgctttggaattatggatggagataaaggtttatttcttagatctagaaattgaagagctaactaaacaacataacagtaatttggaagaaaatgccatgcttgaactgatgcgcagcaagactcatgctaacgctgaggagtgtccggagactagcaatgaaaacgaggccatagaggaagagcgtgaaacagaatcagcggcagatatattgaccatgaagcgtggcacctctggctctgcttaa

SEQ ID NO: 958 - DNA, 204 bp, Glycine max
  Peptide Sequence Number=SeqID_117736
cctaaaatttaccctaagactcatgagaaccttaggaccttctcttgtatctctggcccaatcttcttggagtcttctatcgaatgctcttgggggatatgtgttgcacttggacagtgtgcagcagactacatggagtggttctacatgatatctcatgatgtaaacttgcttgagaagcttttagggaggctggatctttga

SEQ ID NO: 959 - DNA, 318 bp, Glycine max
  Peptide Sequence Number=SeqID_117737
atgtggcgaagacctaccgcatctgctcccaagcagcgacaacaagaacgtgttgttaaggatcctcctacggctgcagaggaattgcatgaagagcggcaagaagcacctattgaggatcctcctactgatgttgagggttttctaggcagaccccgtgacacatcaattttgagagattatgaaattcacattgctctcagaatctggaatagagagttatctttccatggaaggaatatggctaagttcaggaggccggctccaaagattgaaggctttgtggctgctagtggactaagtcctcttatcgcatga

SEQ ID NO: 960 - DNA, 360 bp, Glycine max
  Peptide Sequence Number=SeqID_117738
atgaccagtaaacttcaaatgctcataacttttgctacggttgtccgtttgaggcccactatatatcaaaacgctcaaaattcaaaggagaatccagataaggggattcggctttcatccttctccactcaggggctttgtccttctccacttgggccttcgtccttctccacttggacctttagcctgtatttggccagtttcaggattctcatcactatcaccttggatgacatggcatcgttgctacattttcctatcataggagcgttccatagcttcgagcaacttcatgtcaacgatgctatcaagattttggttgaattactcgaggtcagctttgtagatgcaagagcttag

SEQ ID NO: 961 - DNA, 294 bp, Glycine max
  Peptide Sequence Number=SeqID_117739
atgagtgagatatccagaaaaatcactccatgtaatcctcatacacctgcccaggcactagacaaagctcacccacagctacttaaaggccctaaccccccgatgctcagtgtaaggcaaccagcacacatctgtgacggtcaaagcatcacaacgtgcccggtacggtgctcctgtgattcccttcatatgcgccttcgacgtcagccaccaggaagcacatggggacgtctcctgcgcggcaactccccaagcataaccaccactctgacccaggtcgcgaaaagcgtctag

SEQ ID NO: 962 - DNA, 177 bp, Glycine max
  Peptide Sequence Number=SeqID_117740
atgaaagattgcaaaaatacaagtgatcttcacacagcaaaatctctcaaaactctcaaaactctcataaccatgaggtgtctccacatgtcatcggacttgtcgtctccagatgacgaaggtgcggataaccatgaggtgtctccgcgtgctatcggacttgccgtctccgtatag

SEQ ID NO: 963 - DNA, 387 bp, Glycine max
  Peptide Sequence Number=SeqID_117741
atggcatttccttatcccctgcctttgccaatgtgtcttcaccggaaatggctcccaagaagctccccgcgaagagacgtcgacagacatcgaatcagtgcgctaagcgcagcattatcttcagcctgcctcagcgcacgactggcgctaagctcaaatccacttactcgcgctaaaagcgaaggtgacactaagcacaacattgcgtattcagagcctgttttatgcaaaattagggtaggcaaacgatttgcacagaattccagagcacaccacagtgcctatttcgggaaaagagctctggaggaaacaagaggagcaacttttgcagagatacctaggtttttctgtaatggtgggctaaacacccttgttggggatttctaa

SEQ ID NO: 964 - DNA, 378 bp, Glycine max
  Peptide Sequence Number=SeqID_117742
atgggatcaagtcaaatgccttcgcttaaaaagaggttctatcaagtcaaggtcaagagtatagggatcaccagtctaaaagagttagggcagttgatgggtcagctccagcggcaagcttttcgcaaagcttacgagaaaggaagggcgaattgggatcaactcttagcaagcaaagaaggagcatatgtcaactggttccctcgatggaaggaaggaagaaccggatttcttatttcatgcggaggatttccaaatgttcccttgatggggacgaggggttgcatcagctacaatcccgttcttgcaataagacaacttggctaccctatgagaggggcgccactaggggatgagctcgcgcctgtcatttcatga

SEQ ID NO: 965 - DNA, 635 bp, Glycine max
  Peptide Sequence Number=SeqID_117743
ccgactggtctcttcggcgcgtcaggcgatcaacgagctgaacgtcgatctgctggaggtctcatgcgttttgacaataaagtcgtggttatcaccggtgcgggcaatggcatgggggaagcggcggcgcggcggttctccgccgagggcgccatcgtggtgctggccgactgggctaaagaggcggtagacaaggttgccgcttcgctgccgaagggccgggcgatggcggtgcatatcgacgtgtccgatcacgtcgcggttgaaaaaatgatgaacgaggtggcggaaaaactgggccgcatcgacgttctgctgaacaacgccggcgtacacgtggcgggcagcgtgctggaaaccagcgtcgatgactggcggcgcatcgccggggtcgatatcgacggcgtggtgttctgctccaaattcgccttgccgcatctgctgaagaccaagggctgcatcgtcaataccgcgtcggtgtccggcctgggcggcgactggggcgcggcctattactgcgcggcgaaaggcgcggtggtcaacctgacgcgcgccatggcgctggatcacggcggtgacggcgtgcgtatcaactcggtctgcccgagcctggtgaaaaccaacatgaccaacgg

SEQ ID NO: 966 - DNA, 945 bp, Glycine max
  Peptide Sequence Number=SeqID_117744
atgattattttgtggcagaaagttcagatacattggattcaaaacatttttgtgacttgcacttatgacatgtatatatttagcatattaaagcacgcattaacctccaaatctccactaagtgatgtattcattccaaacagaaaaaaaattgagccatcgtactctttctcacccgatactggcccgagtcattggaaaggttctgtagaaatcaagctaatggtgagcaaatcaaagaacaaggttctctttgctgaagcagatggagattttgttgattttctagtcagcttcctcacaacacctcttggatctattctgaaccttatgaatggcaaatcatcgttgggaagcattgataacttgtacgcgagtgtgaagaagctcaatgcatcatggttcatagggtcatcaaacaaatccttactgaatccaagggtcgctcctcaatttggttgtgggagcaatccactaaatgcttcacaagaatacactcctacgtattggtatggcactgtggtagtgaaagataataatgaggggcgtacaatgatttcaaagaaaaaagaaatgttacaatatccagcaaaactgaaactttttgagccaagatgttatgatggagcaagagaagctgctgtgggatttatgaagaggccgtgtctatttgttgtgagcgatgatctgaaagtgaggcaattgacaactacttctagcattcagtatatgcaagagctggggaatgtcaagtttgatgatttgaaggaacatatggtggaaatcaggaagtcacatgaggcactgaacctgttgaggacgtctttgacatccaaagaagttggtttgacacggagcctattgaagaagtggaaatgccaaagatgcattccgttttgggattccattttggggtgtgttgggatggaagaaaatgagacatag

SEQ ID NO: 967 - DNA, 828 bp, Glycine max
  Peptide Sequence Number=SeqID_117745
atggcttccaaccaagaagcaacaatccctttgagatattgggtggataatgagcaaaagcgtgtagttatggcagaagcaagtggagactttgttgatgttctctttagtttcctgacccttccattgggaactatcatccggcttgggaaccaatttcaacaaccggtacagattggttgcatcaacaatctttacgagagtgtgcaaaatttgcgccctgatgttttctggaacaacatctgccagaaaatgttgcttgctccacgcaacccgttagaagcttcttaccagagactaaaagtgaaggtggatggcacagagcccacaaaaaaattgatgcgaaagaaaatggagctgctggaagagtccaaggacgaggcttctggggttgacggtgttttcgttaaaggggatgccatgttcttgatctttgatgacttgacagtgctccgaagctctccaagtgactcccttcaaacacccctcctatttggacacacagacttcagcaatatgcaagaaatgtctcaagatgtcggcccgagggagaaagttcagatacattggattcaaaacatttttgtgacttgcacttatgacttatgtatgtatatatttagcatattaaagcacgcattaacctccaaatctccactaagtgatgtattcattccaaacagaaaaaaaattgagccatcgtactctttctcacccgatactggcccgagtcattggaaaggttctgtagaaatcaagctaatggtgagcaaatcaaagaacaaggttctgtttgctgaagcagatggagatttcgttgattttcta

SEQ ID NO: 968 - DNA, 360 bp, Glycine max
  Peptide Sequence Number=SeqID_117746
atgaagatcaagaaaagaacaaaagaaaggaaagaaggattcccgatcaaagatcgaaaggaagtgaaaaggggaaaagaagcaactctcgatcaacgaaaggaagagaatagaaagtctccaaagccagattgccactcagaatcattcttgactggcaatattccaccccacatgaacaaagaggaaaaaaccgaaacacccagcttcctctccaaaaacgctgacctcgagaaaatcctattgattagccccatgtttcccctgcgtgtttgcccccccccccagaagttgacatcctacccttcattctcggttacaagaaagattacccttggcgcaagtatattgtttctctaa

SEQ ID NO: 969 - DNA, 135 bp, Glycine max
  Peptide Sequence Number=SeqID_117747
atggactcaggaaggttccacgagattggtatgctaggtgacggttgccccagtgatcttggggcaagtagtccccttgtacttattgaaatttggcaccttgagcttcggagggataacgacatcaggcactag

SEQ ID NO: 970 - DNA, 612 bp, Glycine max
  Peptide Sequence Number=SeqID_117748
atgggagaagagaaagaaatgttagacccaaatgttgttggccgtagcgtgccacaatgttgtcggtgtaatgaattggaagagagatgcaagaaagctgaagtgaggtgtgaggagttgggatttgagcttcaaaagaaaaaggagcactgtgaagaacttggggctaaagttatggcactggagggagaaaagtttgaatttgaagataaggtgaaagttttgagtaaaggacttgaaaggctgaaagaagttagtggtggagagataaaaccaattgttgatttggcagaggacaatgacaaagttttacagtgtgaaaagataagagccgagagtgaggttgaggtttggaaagacaagtacaagaaattggaatcatgggccttacaattcgggatgggaagggacggcgatgaagaaaatggaaaggagcaagaaagtaagccaataagtaatgaaggaaacttgcatcttgatacaagctttggcttctggcagaatctggagaaggttgcggctttggggaacaaaaaaattggagatattcagtcagtagaggttttgaatgactttaatcaattgttttacagaactgcaattcttagttaa

SEQ ID NO: 971 - DNA, 103 bp, Glycine max
  Peptide Sequence Number=SeqID_117749
atgggggagatgcttgccacccaactcgcccaggcgagcaaggtggcttccttcagaagcaaccgccttctggaggatcttttggagggcccaagtgggcctg

SEQ ID NO: 972 - DNA, 378 bp, Glycine max
  Peptide Sequence Number=SeqID_117750
atggggtcccttgatggtcattcactgaccggagagggtggagaatatttggaaggtgcaaaagctattgtctcgctaagccgagaccgcgcgcttagcgagtatcatccgctaagcgaagcagcagctcgcttagcaagtaagaggaatcttgaagggaatctgtcatgccagcatgcgctcaacgtgtcattagctcgcctagcgagaagtttgtctcttctggcgcttagcacacctagctcactgagccaaaatccacttactcgcgctaagcgtgaaaatggtgctaagcgcacctttgagctgaaaggtgatatcctgccatggaaggctaagcccccatcgttggggaatcctgcttggaacttgatgtaa

SEQ ID NO: 973 - DNA, 378 bp, Glycine max
  Peptide Sequence Number=SeqID_117751
atgaagaacgtcgaagaacggctgaaaatcttcgcgaaaatccccacggaaacgttacggaaaccttacggaagcgcctcggcttggattttctggaggaatcttttggaggaatcttctggaggaaccttaggcgagcaaggtggcttcctccagaagcaaccgccttctagaggaatcttctggagggcccaaaacctcacgattggtgcaacgatgcttccttttgagttccggcatgtcacggaacttcatgaattgcctaacgatgggtgccaaatacctcaaaatggtcaaatgaaagttgcatgccaccaagcaaaggtgagccttcatatgatgagtcacatgctagagatggagagacttagtctgtga

SEQ ID NO: 974 - DNA, 117 bp, Glycine max
  Peptide Sequence Number=SeqID_117752
atggtgacctcaaattctctaaatgaacgatgggcaccatatggaatcaaacacactacgttagggagtgatatatcctacaagctaccttgtcgtgcttttcgatgcctcatttaa

SEQ ID NO: 975 - DNA, 243 bp, Glycine max
  Peptide Sequence Number=SeqID_117753
atgagcggtgttagggtgctggaaattggtgagaagggagaaacatgtgagggtataagtgaggaagggagcaaaagggaagcttgtccttataaggaaaaattgttacatcttattgatggaagggttgttgttgaggatatggatactaagagtcaggaattagatatgatggaaaagttgtccttggagtctgtgaatgataccaaaggagaggaagatagaatcactactagaaaatag

SEQ ID NO: 976 - DNA, 180 bp, Glycine max
  Peptide Sequence Number=SeqID_117754
atggatgaagaacactggatgtatgatagtatcatgtctgaagaagttgatatgaaagttgaaaatgaggaagatgttggcatgaaagtagaatacgtcgattgctctaatccctttaatacttttcagttttacattgggcttgattggtggctcatgacattggatttgttgccgtga

SEQ ID NO: 977 - DNA, 786 bp, Glycine max
  Peptide Sequence Number=SeqID_117755
catgggcgtgctcataaggaggataggcatgcttacgcaactcagcatagtcatgctcaagagcacgatcatgctcacatggtcaagaaacaactgattttcactaagtatggtcatgctactcatcaaggcatgctgcttgatgaacatgatgatgagcatgagtgcattcgacaagggtttttgactgtcgttgtatccaacgttgtggaatgtcgcttcatttacgacgatggttcaaaaactgtcttagtttgcgacacactcaaagatgattgtgagtttgaaaccgtctttgaatgtgacacattcaaagatgattacaatgttggaaccgtcttagaatgtgacacattcaaagacgtaaccaatgaggtttacattgacaagtctagcctaacaattatgcaaaagggggagaagaccaacatcatttatggcatagagtttagtcagattaagatgctgaagtcgaagagactcgcaaggagaaagcatagacacttccatatcgatatctttgactcccatgcacttcacaagggaaagagagaactttattttgatgtttgtgagggcaacaataatcccggactgagtgaacctgttgtgttcctccagcatcaagctctcaagagatactacaactttggcaaatgcaaccaatccattgtcagaaacaaagcaacaccggcgaaggcacaattgcttcaggttgatgcaacccttactaatgacctctatgcttgtatcaattattcccctacaggaagtaatagtaagtaa

SEQ ID NO: 978 - DNA, 606 bp, Glycine max
  Peptide Sequence Number=SeqID_117756
atggctacgcttttagggagggttcctcatggtagggagagagagttttgggacctaggagagaaacgcctcacaaataaaagaaaacaattggggaagataggcatacccacaatcatagttcaaaaacctggtctgatcgggaccttgtggtataattgggccagtttggtaattggaccggccatgcatctggcctggtatgacctagccagacccgatcggttttgcgcaaactcgatgacccgaccgatttttaaatctcgtattgggtttttgcgtgaaaagaaagaagtggagaagaaagccctaaccagaagcccctctaacatagtctttagcttcccttcccgagcactgtgtggtcggctcgggtattgtattgagagagtgttttgtaggttctttctgatcactgtggtgcgtctattggaaacatcaagcatgggttggattccctgttctggatattcaggcactaagaacaaggttgagaagatggaagctcaggatagtctcgttggtcagatcaaagccacccctgatattcgtcctggcaagaaacaacttgactggaacacacaaatgaaaatagttgctgggtaa

SEQ ID NO: 979 - DNA, 279 bp, Glycine max
  Peptide Sequence Number=SeqID_117757
atgtcggtgccagcgatcccaatcccaatcctcatggccaccgtcgatgtggacgcaattgtcagcagcggtgttcccgagggacttccacacgaagtcctagccgctgtgtttggcactgacactacggtcgtcagaggaggcaaaggcaaggcagcggcagggggattgcgatgggaacgggaggagcaagggcgtccgttgtgcggggaacggcatgacaagcttctgcatcgggaaggcaaaagtctccgtaagtatatgtcatttttcttgtag

SEQ ID NO: 980 - DNA, 249 bp, Glycine max
  Peptide Sequence Number=SeqID_117758
atggaaaagacaaaacctgttgggattctggagtctcggcatgacaagagagtgagaggtaagggttcaagaggactacatgttatcgcaccaagtctagaagaattgcaacaaacttatttgtatatactgaataacaataatgaagttttgttgtacatagttcgtctcgaagctctagtcaaggaaaatctgaaaaagctcgcttatcaaaatgagcctttcatcatgacagaacaagctaaatag

SEQ ID NO: 981 - DNA, 243 bp, Glycine max
  Peptide Sequence Number=SeqID_117759
atggttgaaactaaccaaataaacactaaaagaggtgtgaaagataaggctcccaacacacttccaatgaaaggcctttttgttacaaaacttgaaagcaatgaagtgcttcttagtccaatagctcttaaggtggttggccccttgcttcttgactcaaattcttcaagggatggcaccaatcctccttccaattccctatatggcaacccacaaacaaggaaacaaagagacaagcaataa

SEQ ID NO: 982 - DNA, 156 bp, Glycine max
  Peptide Sequence Number=SeqID_117760
atggcgagaccccacaacagcctaggggatggccgacagcaggcaacagacgcaccgtcgccacctccagagcccttaagctcatctacaaaggctggagcgttgcctatgactcatggccgaccagcgggcgaccaagtccaaagccaaaggtag

SEQ ID NO: 983 - DNA, 114 bp, Glycine max
  Peptide Sequence Number=SeqID_117761
atgtcgtcttctgtaccttttgtcgtccagggacagttagtcaagtggcaggtttttactcttgtcgtctggagacattcaagcccgacgacgcacgagattcttctctgctag

SEQ ID NO: 984 - DNA, 1424 bp, Glycine max
  misc_feature (1421)..(1421): n is a, c, g, or t
  Peptide Sequence Number=SeqID_117762
atgccagtcatagcgcggcagcagccacgaggcggcaaaaccgccggaggccgcgccaaaggtgaagccgcagaacaccacggtgataataaacgagcgacgccgctcgggcgcgtattcagccaccagcgtgccgacgttgggcatcgccgctcccagtcccagaccggtaaggaagcggaacagcatcatctgttcgatgttttgcgccatggcggtcgccagcgtccagaggccaaaaaacagcacgctgagcagaatcatcacgcggcggccgtagcgatcggccagcgcgtcggcgcgataaagcccattagcgcgatatccatgccatccagcgccaccacgacaaagcacagcgcaattaaacgcttctgccagctgcttaacgcgctctggttgatgagctggcggacgtcaatggcttcagcgctggtcacgggcacgctgggccgcgcggcggaaaccctcaatctgagtcagccggcgctgtctaaaacgctgaatgagctggaggaactggcgggcgcacgtctgtttgagcgcggtcgccttggtgctcagctgacgacgctgggagaacagttcctgacccacgcggtgaaagtactggatgcgcttaaccacgccggacaaagtttcaactcaccggtttccggacgcccgatcgtgatccgccttggcgccctcaccaccgccgccatggggatgctgccgcagatcctggatcgcttccatgaacagcagccgaacaccacggtacaggtagccacgctgcacaataatgtgctgctggctggcctgcgcgccggggagtttgatattggcattggccgtatggcggacagcgaaatgatgaccggcctgacctacgaattgctgtttctcgaatccctcaagctggtggtgcgaccggagcacccgctgttaagtgacaacgtcacactttcccgcgctatgcagtggccggtagtgatttcgcctgaaggcaccgcgccgcgccgcattgcccagcacatgctggatgaacaaggctgctcgctgccgggcaactgtgtcgaaacctcttccacctcgctggcccgccagctggcgctgcgttatgactatgtgtggtttgtgccatccggcgcgcggccactctctctcgttaagcgcggaagtgctgatggccaccatccgcaaatttcacagttaacggctgcgtttggcgtggcgttcgcgattgtcgaggcgcgcgcgatcggttttgcgcagcccgacataaactgcgccgctgccgccgtgctgcggttgcgcgctgcagaaggtctgaacgtcgtcaaattgacgcagccagcgtgccacgtagctgcggacaatattggcgtgtgcttcatcatcccgccctttgccatgaataatcagcagattgcgcaggncct

SEQ ID NO: 985 - DNA, 240 bp, Glycine max
  Peptide Sequence Number=SeqID_117763
atggaacgagaggaaaagaggtttgtgtaccgtatacgttgttcctctgatgagaactatgatccagagggaatggaggaaggcattgagggacgcgttgtactcgattacacaaatatggtaatcgattaccagagagcaacattgcaagaaataactgcttgtaatcgattacactattatggtaatcgattaccagtggttattttagccagaaaacaaaaacagaaggctttctag

SEQ ID NO: 986 - DNA, 2365 bp, Glycine max
  Peptide Sequence Number=SeqID_117764
gcgctgatgccttcgcgcggcatcgaaccgaaaatcctgattgaagggccgccgccgcgcgcggtgccgattctgctgcgccagaccagcttcaaagcgctggaagaggcggtgcattttaatgatggcacgcctggcgcccataccgcgcgctttggtgaaattgagcagcgcggcgcggcgcttacgcctaaaggccgcgcgctgtacgaccggctgctggcgcaggccggtaccggcagcgataaccagcagcatcagcagcacctcagcgcagtgtttcgtgattttcctgatgatgaacagacgctgcgcgagcaggagctggcgtggttccgctaccgtctgacgccgcagggcgagcatcagccgccgcgcgccggggaaaccgtggcgcagctgctggccgccggacgtttacaggcggaaccgattgtctacgaagattttctgccggtgagcgcggccgggattttccagtctaatctgggcaaccagactcaggcccgcagcgccggcaatgccagtcgtgccgattttgaagccgcgctcggtgccgccgtgcaggatgagatggtgctgtatcagcagacgcaacagcgcagtctggcacgctgcggcgcgtgcgtcgcgcaccagcgtatattttccggcacccaggaacaggatggccagcgcgcccagcaggtaaagcgcttccgtttccagcgaccaggcgccgacatcggtgcgatgccagagtgcgcccattttcaccagcaacgttgcgactaccatgttaacggcaatgataaaggccgccgggcgcgtcagcaggccaacgatgaccatgatgggtgccacaatttccccgatgtaagcaccgtaagcgatgaaacctggcatgcctttgacgctgagcagatgggcgatccagccgacgccatgaatcgccttaaactcgccatgaaacagcaacagcccgccgaagacattccactgaggcctgcaaataatggaatcaggctttaccaggaacccgcaatgaaaaatgaacgacgtctgaggatcatgacggcagaaggtgaactcagaggcctgatggatgatgaactgtttacctttaaaggaataccttatgcagcgccgccggttggcgcactgcgctggcgtccgccgcagccggtggtaccgtggcaaacgctgcgcgacgccaccgcgtggggcgatgccagctggcaaaatcgtgattactgcgtggcggccggcggcggcgatccgggccgcttcagcgaagattgcctctatctgaatgtctggacgccggatgtcgaacccgctacgccgttaccggtgatggtatggctgcacggcggcggcttcagcatcggcgccggcagccttgatccctatcgcggcaaagcgctggcagcgcagggcgtggtggtggtgacactcaattaccgccttggccatttcggcttttttgcgcatccggcgctcgacgcccagtatccaccaggcaaggtggtcaataattttgcgctgctggatcagattgccgcgctgcagtggattcagcgtaacatcccggcatttggcggcgaccgccataacgtcacgctgtttggcgaatcgtccggcgcgcgcagcgtactgtcgctgtgctgctcgccgctggccgaagggctgtttcataagggcattgtgcaaagtgcctacagtctgccggacgtgccgcataagcaggcgcagcaaaccggcctgcaggtggcagcgcatttcaatctggccgcggatgccagtgcggagcagctgcgcgcactgccggccgacagtttctggccgctggagcgaccgctggcgcttgggccggtggccatcagcggcgatgcggtgctacccagaccgatgctcgacacctttatggcgggtaaacagcatcgcgtgccgttgatgattggcagcaacagcgacgaagccagcgtgctggactacttcggcgtggatgcccgcagcgtgttacaacagctgcgcagcaaaagtcgcctgagttatcgcctgctgaagtggctgtacgatatccatgatgacagcctgctgggacgcgcggtggcgcgcgacatggcgtttaccgtcatgccgttgctggtggcacagtcgcagcacagcatcggcatgcctgcatggcgttactggtttgattatgtgtcagaaaacgcgcgtcatctctacccgcacggcacctggcacggcaacgaaattccttatgtctttaatacgctcgcgacgctgccgccgccgggtgactggcattacagcgccagcgatatcgcctttgccggccgcgtcagcgcctggtgggtaacctttgcacgggatgcca

SEQ ID NO: 987 - DNA, 201 bp, Glycine max
  Peptide Sequence Number=SeqID_117765
atgcagaccgcgcgcgtggcgttcaaacagggcaaaccccagccagctctccagcgccgcaattttgcggctcaccgcgccctgagtgatgcacagttcgctggcggcgcgcgtcaggttgagatgacgggcggtgaccagaaaggcatgaatggcgttgagtggcagagcagagcgggacataacggcctcgagctatga

SEQ ID NO: 988 - DNA, 1170 bp, Glycine max
  Peptide Sequence Number=SeqID_117766
atgatgaccctgaacagcagcgtgaagctctcctccaaacagccggacgtcggcaccaccatttttagcgtgatcggccagctgtccgcacagcatcaggccgtcaatctctcccagggcgcgcccaatttcccgtgtgacccgcagctggttgagctggtcagccaggcgatgcgcgacggccataatcagtacgccgcgatgaccggtttaccggcgctgcgtgaagcgctggcggagaaagtgcaccgcctgtatggccagccgtacgatgctgccagcgaagtcctgatcaccggcagtgccagtcagggcatctacatggcgatttcggcgctggtgcatccgggtgatgaagtgatcttctttgagccagcctttgacagctacgcgccggtggtgcggttacagggcgcgacgccgatcggcctcaagctgcaggtgccggattttgcgattgactgggacgaactgcgtgccgcgatcacgccgcgtacgcgcatgattatcatcaatacgccacataacccgagcgggcaggtactgaatgccgccgatctcgatcagctggcggccctgacgcgtaataccgacatcgtggtattgtctgatgaagtctacgaacacatcgtgtttgacggccagacgcactgcggcatggccacgcacgcggaactggcacagcgtagcgtggtggtgtcctccttcggtaaaaccttccacgtcaccggctggcgcgtcggctatgcgctggcgcctgctgcgctgatggcggagatcgtcaaggtgcatcagttcatgatgtacgccgccgatacgccgatgcaggttggcttcgcgcagtatctgcagaacccgcaaaactatctgcagctgtcgtcgttttatcaggcgaagcgcgatcggctgcagacgctgctgcaggattcaccgttcaggctgttaccgagcgccggttcgttctttatgttggccagctacggacatttcagtgacgaaagcgacagtgaaatggtaaaacgtctcatcgtcgatcacggtgtggctaccattccgctgtcggcgttttatatggatggcactgacaataaattaatccgcctttcttttgctaaagacgacgcaacgctcgaagccggcgcgcaggcgctgtgccgggttaaagggtaa

SEQ ID NO: 989 - DNA, 513 bp, Glycine max
  Peptide Sequence Number=SeqID_117767
atgaacatcaccgaggcgcgagcgaaaagtatcgacttcaccaacccgatctaccgcattcccaccatgttgattgtgaagcagggcgagaaactcgagccgacggcggcgtcgctgaaaggaaaaaatatcggcgtgctgcagggctcaatccaggaaacatacgctaaaaagcactgggaatcccagggcgtgacggtgacgtcgtatcaggatcagaaccaggtatacaacgacatggtcgctggccgtcttgacggtacgctggtgatgtccgccgccggtcagtctggtttcctcgataagccgcagggcaaaggtttcgccttcgccggtaagccggtggaagacgacaccattctcggttccggcattggtttcggtctgcgcaaaggcgatagcaagctgaaaggtgaactggatgcggccatcgccaaagtccaggccgacggcaccgtgactaaactggcggcgaaattcttcccgggcattgacgtcagcgttagcaaataa

SEQ ID NO: 990 - DNA, 921 bp, Glycine max
  Peptide Sequence Number=SeqID_117768
ggcgcggatctgtgtctgaatgcgcagcaggacatctggctgcgggtggcggagcatccggaaatcctgccgtatgtcggtcaggagattgtgttcagcgacggcaccagcgtgctgggggccgacaataaagcggcagtcagcgtggtgatgacgctggtggagaacctgcgtggcgagcacggtgatgtggtggtggcgtttgtgccggatgaagagatcggcctgcgcggcgccaaggcgctggacctggagacgcgctttaacgtcgatttcgcctggaccatcgactgctgcgagctgggcgaagtggtgtatgagtgcttcaacggcgcctccgctgaaattaccttcaccggcgtaccggcgcatcccatgtcgggcaaaggcgtgctggtgaatccgctgctgatggcgcacgacttcatcgcccgcttcgaccggcttgccacgcctgagcataccgccgggcgcgaaggttatatctggttcaatgatatgcaggccaatgccagccaggcggtattgaaagcgtcgattcgcgatttcgatttaaaggggtttgatgcgaagaagcagcagctggtggaagtcgccgatcagatcgccgcgcactatcccactggtcacgtcgcgctgaagatcaatgatatctatagcaacatcagtaacgcgattggtgaggaccggcgggcaatcgatctgatttttgctgcgctgcagcaggtgggcgtggaacctaaagtgattccgatgcgcggcggcaccgatgggtctgcgctgtcggccaaagggttactgacgccgaatttcttcaccggcgcgcacaatttccattcgcgctttgaattcctgccgatcccgtcatttgtgaagtcgtatcaggtggcggaagcgctctgttatctggcagcccgataa

SEQ ID NO: 991 - DNA, 654 bp, Glycine max
  Peptide Sequence Number=SeqID_117769
atgtctgactctgttgtaacccgcctgcgcgccagtttttttgatttccccgcgctggccgaccagcccgatggcctcgccgaccaggcacgctacctcgaagatggtatgctgacgctgcgcgacggcaaagtggtgagtctggagcgctggcagccggcacatcaacacctggaatcaacgcaggtgatcgatctgcgcggcaagctgatcctgccggggtttgtggatacccatattcactatccgcagaccgaaatgatcggcgcgttcggtgaacagctgctggagtggctcaatcagtacacttttccggtcgagagccagtaccactgtgcggcgcacgcggcgcgcatgtcagcgtttttcctgcaacagctgctggccaacggcaccacgactgcgctggtgtttggtacggtgcatccgcaatcggtagacgcgctgttcagcgccgccgaacagctggagatgcggctgatcgccggcaaggtaatgatggatcgtcacgcaccgccggaactgaccgaaacgccggcgcaaagttatcagcagacgcgtgagctgattcagcgctggcaccagcgcgggcgtctcggttatgcgctgacgccgcgctttgcgccgacctcatcgccgcagttgctggagaaa

SEQ ID NO: 992 - DNA, 342 bp, Glycine max
  Peptide Sequence Number=SeqID_117770
atgacgatgaaaaaactgttttccgccctgctcgctaccacgctgaccgccagcgtgatgctgactgcgccgctggctgtcgctaagacggatcgcctgattattgaagatggcaacaacgcggccagcaacgaggcggcgcgtcagagcaaagagcagtggaacgatacgcgcaacctgcgtaacaaggtgaatacccgcgtggagaaagagttcgacaaggcagaccgggcctttgatacccgcgacgcgtgcgaaaaaagctacaacgttaatgcgtactgggaaccgaacaccctgcgctgcctcgatcgccgcaccggccgtccgctggcgccgtaa

SEQ ID NO: 993 - DNA, 420 bp, Glycine max
  Peptide Sequence Number=SeqID_117771
atggcatccttcaaccagcttcagtcacagatgcaatctcagggatctcttgagcctctggttggtcctggtccctccggtcctcgggtgagcacaaaggggagttgtgttgatccctcaggaaacgatcctgagacgggtgactctgacaggtgcggcttgtacatagaagcagatcctgcccgcctggttgccgtggggagagtttatgagggatccactcttgttcataacactcctttgtttcctggccaagtaaaggtgagtgtggacgaggttaaagatgcagatgcttcagttcctgtacccactgatgaggtttccttagtggggcaggcacttcacaccttccttgcttggctgacacatctggtcaagtctttatcacaccagctgtgtctccaccaaaaccacctctga

SEQ ID NO: 994 - DNA, 537 bp, Glycine max
  Peptide Sequence Number=SeqID_117772
atgaccggtttccttcggtttttccgacgttttccacaaataaatgttggtggcgactccgcgcattttcctcctttggaagatgcacccgtgagcctcgcctcgctcacccgcaaaaaggtaggttgcgacactcgattcttaccgttttatactacttgtgcaatccggtgcacttgccggaagccgaacaagtttttgtcgctgttgccggggaacttctttttagttgggaagaaccggtcatgtatgattaccatgaggaagaaagagcctctgatcttgaaaggaactcaatttgaaaggaaccggtcttctgcaggttatcaatgggagtcataccgacaatctgattatcacaataaagtagaaggagttcttaatatggatgatctgttaatgcaattcaaagatactatagaatcaatacaacaggcctttcgaagaactaaaactcagctaagcaagttggtggatgacatgactaacgatgtggccacgaaagaggaagagcatgcagagattgaaatacattaa

SEQ ID NO: 995 - DNA, 249 bp, Glycine max
  Peptide Sequence Number=SeqID_117773
atggctgttgtcgaaggagatgggttggatgatgaagggatgtcctcagttctcgctctctttcttgatgccatctcctcgcttagccacaaggatttcaacaggaggatgagtattcgtcctcacaagatgaactcgcttagcgtggcttggcttagcacgaggatcacaccgcttagcgagaggagcatgcgcttagctgataaggacatgcgtagggctcacattgccgcaatgaatcttgcttag

SEQ ID NO: 996 - DNA, 470 bp, Glycine max
  Peptide Sequence Number=SeqID_117774
ggcgtcaacttgactgggcacacttagtcagatatcgcatgcataaggcattgcgattaaatgctccactaccatatccacagcttgtcactctctttttccaccattttcaaattcctcttgattctgaaccttacgttccaatcaagagatcctttttaattggtgctgctgtgattgcttcttttggttaccgcaaagagcttgatggctcttgggtcaaaaagggtgctccacccgctgatgatgaaagcaaccaaccagttgaagataattcctctcttcttcgaaagcttttggaaaagttcgatggtcttcaaacttttgttggtgacaagtttgataatatggaattgcaagtcgacatgcggtttgatgccatggaatcaaggatcaccaaagttgaagaagatgtctccttcatccgtacttgttttgatccaccaccaccgcttccatcatcctcttag

SEQ ID NO: 997 - DNA, 552 bp, Glycine max
  Peptide Sequence Number=SeqID_117775
atgggtatagagtatcacaagattcatgcttgccctaatgatttcatactatacatacatgaatttgaagaaatgcacaaattccctcggtgtggggtatcatggtacaaagtcaaggatgatgatgaatgtagtagtgatgataacttaaagaaaggccccccagcgaaggtggtgtggtatcttctaatcattccatggtttaagcatctattttctaatggggatgacgcaaaagaccttacatggcatgcaaaggggagaaactgggatggaatgctccatcatccggctgattcctcccagtggaagaaaattgatcgtttgtatccaaaattcaacaaagaggcaagaaatcttaggcttggactttccattgatggaatgaacccatacggtagtttaagcactcaacacagctcgtggctagttttgctagttatttataacttatctctatggttgtgcatgaagcgaaaatacattatgttgtctatgatgatattgggcccaagccagggaatgagattgatgattatctcagtcccttga

SEQ ID NO: 998 - DNA, 855 bp, Glycine max
  Peptide Sequence Number=SeqID_117776
atgactggaaagctagctgaatttatgtggcctgcattagtggctaataagattctcaacaagcgactgggaagcagcaatttcgtagcagattatccaagtaatacagaacccttattgggtcatgatcagtcatctctgagctccaaaacaattcttaatgatcacaaggatacacaaaaatacaagatttttgtcagcacatggaacgtaggtgggattttcccagatgaaggactgaatatggaggatttgttggagacatgcaacaattcctgtgacatctatctacttgggtttcaagaaattgtacctctaaaagcatccaatgtattggggtatgaaaacaataagatatctacaaagtggaattccataatcagaaaagctctgaacaagagcacacatcacagtttcaaagatcaattaggtgatgataagagggaggatgtgaagaagaatatttgttgcaataataaggaaggtgaaaataataatcatccaggtcagctgtgtgaatccccccaagatttcgaatgtatcattagcaagcaaatggttggtatattgatatcagtatgggctaagagagaccttcgtccattcattcaacatccaagtgtctcatgtgtcggatgtggcatcatgggctgcttagggaacaagggttctgtatctgtgagatttgtgttacatgaaacaagcttttgctttgtgtgtgctcacctagcttctggagggagagggggggatgagaagcttaggaactctaatgttgctgaaatattttcaaggacaagctttcctagaggccctatgcttgatttgccaagaaagattcttgatcatgagtaa

SEQ ID NO: 999 - DNA, 4125 bp, Glycine max
  Peptide Sequence Number=SeqID_117777
gtatttccccagaaacaattatctggtgaggacaatgaacttattgatgctactggtttggggctacttaatgatgcctgtgtcctgtactgtgagaggtttatggaatttctaattgacctcttgagtcaattgccaacaaggaggtatttgaggcctcttgtggctgatgtagctgtagttgccaaatgccatttaagtgcactctataggcatgaaaaggggaaactttttgcccagctggttgatttactgcaattctatgaagggtttgagattaatgatcatactggaacacagttaacagatcacgaggttcttgaatctcattacagccgaatgcagtcattccaactacttgcatttaaaaagatggaaaagctgcgggaacttgctttgactaacattggttcgattcacaagcgtgctaatttgaccaagaaattgtctgttctttctccggaggagttgagaaattttgtttgctgtaagcttaaactggtctctaaggaagatccctggtcagagagggttgattttcttattgaagtaatgctgtcctattttgagaagcaacaatctcaaaaagaagctattaatgctcttcctctttatccaaatgagcagattatgtgggatgaaagtgttgtacccagcataaattactctggagaaggttgtttagcattgcccaagctgaacttacagttcttaacacttcatgattatcttcttcgaaattttaatctttttagacttgagtcaacatatgagatacgtgaggacattcaggaagctgttccacatcttcttgcatatattaataatgatggaggaactgcttttcgtggttggtcaagaatgggtgtgccaatcaaagaattcaaaatcactgaagttaaacaacctaacattggagaagtcaaaccatcatccgtgactgcagaagttacttatagtgtttccagttatagagcacatattagatcagaatgggatgcactcaaagagcatgatgtattgtttttactatctattcgcccattatttgagcctcttagtgccgaagaagaagacaaagctagtgttcctcagaagcttggcctacaatttgttcgaggttgtgaagttattgagattcgagatgaggaaggaaaccttatgaatgatttttctggaaagattaagcgtgatgagtggaagccaccaaagggggaactgagaacagtaactgtggctttggatacagcacaataccacatggatgtaagtaacattgctgaaaaaggggcagaagatgtttatggtacatttaatgtgttgatgaggaggaagccaaaagaaaacaattttaaagccatcttagaatcaataagggatttaatgaatgaatactgtattgttcccaagtggttggaaaacatttttcttggttatggggatccttcagctgcacagtggactaatatgcctgatgtattggagacagtagatttcaaagatacttttgttgatgctgatcacttaaaagaaagttttgtggattatgaggtgtcttttgttaattctgatggctcagaaaatttgaatccaaggcctccttttaagatcaagcttccccgaacactcaaacctaacaatggtactcttactgggcatgcaatgtctacttccggtgcaacaaatgatatcaatgtggttgatgcaaattatcagaaagaagcactagttattgagacatatactcctccagatcctggcccctatcctcaagatcagcccaaacaaaatttagttagattcacacccacacagcaatttccattgctgatatgcaaagaaattggagagtttattttggccacattggctttctgtttgtacttcctgtcagtaggtgctgttgtggagagcaaggaaaagagcacttggttcacacattttaaagaattgtgtggccttcctgttcttcctttctttctagctgcagttcaactgcaggttgaagcaatcatctctggcattcagcctggtctaactatggttgtggggccacctggtacaggaaagactgatacagctgtacaaattctaaatgttctttaccataattgtccttctcagagaaccttaataattactcattcaaatcaggctttgaatgacctgtttgagaagataatgcagtgtttattatggggaatgggaagctcttgtattgcacctctttgtaagagggcaagccttagcacaagggtaagtttgctgccttgtggcctggagctcattggttcaaatcttggaaacaacctctctgcttgcgagggtaaggctgcggacaagctctctaggcttctcttggtgggagccagagatgttcctgcacgttatcttcttcgacttggtcaaggagaacaagagctagcaactgatcttgattttagccggcaaggtcgtgttaatgcaatgcttgttagacggttagaattgctcagtgaagtggagaggctagcaagatctcttcaattgcccgaggatgtgggttacacttgtgaaactgcgggatacttttggttgcttcatgtttattcacgctgggagcagtttcttgctgcttgtgctgagaataaagagaagtcaacatttgttcgagatcgttttcccttcaaagagttcttctatgatacaccacatcctgtatttacaggtgagtcttttgagaaagacatgcaggctgctacggggtgctttcgtcatcttaagaacatgtttcaagaacttgaagagtgtcgggcattcgaattacttaagtcaacagctgatagggctaactacttaatgaccaagcaggctaagattgtggcaatgacttgcacccatgcagctctaaagaggaaagatttcctccagttaggtttcaagtatgacaacttgctaatggaagaaagtgcccaaattttagaaattgagactttcattccaatgttactccagcggcaggaggacggtcatgcacggcttaaacgctgcattctgattggtgatcatcaccagttgcctcctgttgtgaagaatatggcttttcagaagtacagccacatggatcaaagtctatttacaaggtttgtccgattgggcattccttacattgagctaaatgctcagggaagagccaggccaagtatagctaaactttacaattggagatacagagatttgggagaccttccttctgtaaaggaggaagtcgtattcaatagggcaaatgctggatttgcttatgattatcagttagtggatgttccagattaccttggtaagggggagacaactccatctccttggttttaccaaaatgagggagaagccgaatatgttgtcagtgtctatatatacatgcgtcttttagggtatcctgcaaataagatatcaattttgactacatacaatggtcagaaacttctcatccgtgatgttgtaaataggagatgcgttccatacgatttcattggtcctccaagcaaggttactacagtggataagtttcaaggtcagcaaaatgattttatattgctatctattgtgcgtactcgatttgttggtcacctacgtgatgtaagaagattggttgttgcaatgtcacgtgctcggcttggtttatatgttttttgccgtcgttccctttttgaacaatgctatgagctgcaacctacatttcagctgcttcttgaaagacctgaccaccttgcccttaatgtgaatgagattacatcatatactgaacgaaattttgaagatcctggacctggacatcatgtacatcttgtcagtggcattgaggagatgggtagtatcatagacagactgtatcaggaaaagttgagacatcaatttgatcaaaatgggccttatttgagtcatttagaaccatcagaaaatacagatgggatgcaaagtgggcagcagactatggacactgatatgcctgaacaaacagaggacgacatgccacataaaatcaaggaagctacaactgttgataatgtaactggatataacaacgtggaagatgttaccatggttgataatagtgatggtgttgcaaatgggaacccatcgccatag

SEQ ID NO: 1000 - DNA, 540 bp, Glycine max
  Peptide Sequence Number=SeqID_117778
atgtttcctcaggaaaatcatagtaacggctatcagcaggggccgggggtgggttacagtcacagagagcgagtccgtcgtggcactcgcaggtcacgtgcctccacttcctccgttagggtttacgaccagcaccaaccgcaacatcgacctccttgcactgatttcgacgtcgcctatttccattcctacgctcaccttggcatccaccaagagatgatcaaggatcgtgtgcgtactgaaacatacagggatgcaatcatgcagcatcagagttccattgcaggcaaagttgtggttgatgttggatgcggtacgggaatcctttctatattttgtgctcaggctggtgcaaaacgggtgtatgctattgatgccagtgacattgccctgcagaaatgctgccttccttctggaacttttagatatgtctatggcattacaagcccagtatttctttttttcaaaagcacacaacttagggccctaatcagcacatcaaacataagaagattggataggagaagggttgctgagtag

SEQ ID NO: 1001 - DNA, 597 bp, Glycine max
  Peptide Sequence Number=SeqID_117779
atgacgaaggtttacggcacggggttatacgatttccggcgccaccgcgtggcagagtaccccgtggcggcgccgccatcggagtcgaaagcggaagttccaaaggcaggcggcggcggcggctttccaagcagcatcactctgtcggagattcagcgcgaccggctgacgaagattgcggaggcgaactggttgaaaagcggcgatgcggctaggccgaagaaggacttcgaccctgagctagttcgcaagatctacgaaaccgaattgttagtgaaagagggttccaaacccgttcccttgcaacgtgtcatgattctggaggttagccagtatctggagaattacctgtggcctcatttcgaccctctcgctgccaccttcgagcatgttatgtccatcatcatcatggtcaacgagaagttccgagagaatgttgccgcttggacttgtttccatgagaggaaagacgctttcaaagtctttctcgagagggttcttcgcttaaaggagacaatttcggctgcaattgtggttgcagatagttcaaaaaaccttaatgttactgctgaaattgcggttgtggacgttttttaa

SEQ ID NO: 1002 - DNA, 156 bp, Glycine max
  Peptide Sequence Number=SeqID_117780
atcagtatgacccaagaggaaaaggtgacgtacaactcagggaaatttgagagtgccaagaactctcccagtaaagactacagcctccctcctaactctggccaaactcctatttatctacccccagttacaaagatagttataacagctttatga

SEQ ID NO: 1003 - DNA, 1326 bp, Glycine max
  Peptide Sequence Number=SeqID_117781
atgccgtatgcttctctaaaagcggtcccttacaagtatagtgccacgatgttggaaggtgggcaggaggtgcctttgccctctctaactcctgcgatttctgtggacaacattgctagtgacagtaaggttctgaggaatggacgtgttatccccacattgcttgcaaagaaagtgaatgatccggcagttaaacaggcgacagtgaatggccccggtacaaggaaggaagtaggccaatccaatgggactagcaagaattctgatcatgacgaaattctgaaactgatccagaagagtgagtataaagtagtagaccagctgttgcaaactccctctaagatatccattttgtctctgctattgaactcagaagcacaccgtgaggctctaatgaaggtgttggaccaagcttttgtggagagggacgtgactgttaaccaattggacagtatagtaggaaacattactgcctgcaataatttgagttttagtgatgaagaacttcctgaggaggggaggaaccacaatctggcgttacatatatcggtgaactgcaaatctgatgctctgtcgaatgtacttgtggacactggttcctcattgaatgtaatggccaaatccacattagatcaactttcttaccgggggccccccatgagaagaagcggggtggttgtcaaagcgtttgatggatcaagaaagtctgttatcggggaggttgatttgcccattacaattgggccgtttgttttccaaattacattccaggtgatggatatccaagccgcatacagttgcctcttgggtaggccgtggatccatgaagctggggccgtgacatccactttgcatcaaaagctgaagtttgtcagaaatgggagtttgatcactgtgagtggagaggaagccttgttggttagtcatttgtcagctttttcctttattggtgctgatgaaacaaaaggaacctctttccaaggcctgactgtagagggtaaaaagccagagaaaaatgaagtatcttttgctacttggaagagcgcacagaaagtggtgcaggaaggaacaggtgtaggatggggaaaagttgtgcagttgctagagagtaaaaaccgtgaaggactgggatttgcttcttctgcaggatccgcaacgaacagtgttggatcaagctccattactagcaccttttgtagcgccgggttcatcaacaactcgccagaagccaatgctgtcttggaagatgttcctgaagagatagtacttgcatttgtcacacctggaaaaattgttcgcaactgggacgcggttgacatcccttca

SEQ ID NO: 1004 - DNA, 698 bp, Glycine max
  Peptide Sequence Number=SeqID_117782
atgtcgatggggaagttgctgttgctgatcattgtattcttaacctccaaatccgcagctggaagctggccttctcatttccaagagctgaaggtggaggaagcaatcgcaggaaccaaagtgcaagcagaggagttggaagagaaggaggaagcaaaatggaaagtggagattgttcacagagacaagctcatcatcaacacggatcacaggagccgtttcaatgcacgaatcaaacgggacgtcaaaagggtagcctccctcctcctcctccggcgccatgcttacaccgtagaagaagcgtcttttggatccgatgtggtgtcgggtacggcagaagggagtggagagtacttcgtgagaataggaatcggaagccctgcaacgtaccagtacatggtcattgactccggaagcgacgtcgtatgggtccagtgccagccctgcgaccaatgctacaaccaatccgaccccatcttcaaccctgccctctccgcttccttcgccgccgtcccctgctcctccgccgtctgcgaccagctcgacgactccggctgccaccagggccgctgccgctaccaggtctcctacggcgacggctcctacaccagaggcacgctcgctctcgaaaccatcacgctgggaaaaacagtgattcggaacaccgccatcggctgcgggaacttgaaccagggcat

SEQ ID NO: 1005 - DNA, 174 bp, Glycine max
  Peptide Sequence Number=SeqID_117783
atgtggagggagaaatactcatcgcacacagacagtgaaatgaaagcttcaacctgttctccttctctcgaatgcttggaaaccctagcagagcaaccagaggaaaatcttgagaaatctcaggaaactgctagagacaccgctatcactgtcaaaatacacatggatccttag

SEQ ID NO: 1006 - DNA, 258 bp, Glycine max
  Peptide Sequence Number=SeqID_117784
atggagaaagttaagcaacaaatggcagaagacaccatcatggaaacaggcaacacaaattccatggttcagcttcaagctagtgtggaggagaagttatcgagcagcgggtcgaagagagaagaatacacaaccaacgacaagtgcaaaacaaccacctccggtctcgttgtaaatcacctcgacattggtgctaaggagatgtcaacgaaatgggagatgcaagaaaaacaggggcctcgtcgtaaatcacattga

SEQ ID NO: 1007 - DNA, 147 bp, Glycine max
  Peptide Sequence Number=SeqID_117785
atggatttggaccagtggatctccaaggtgaaggatggccagcaccttctcgaagaggagcttcaacttctttgcgaatatattttcgttttacatggtactgaccagagacaattaaacatttcaggttacagagatccttattga

SEQ ID NO: 1008 - DNA, 990 bp, Glycine max
  Peptide Sequence Number=SeqID_117786
atggataatactcccagattgcttcaatcggtttcaagcttgattctgattctaagcatttcatcattggcctcagcatctctgaaagtgggtttctatagctcaacgtgtccatctgctgaggcaatagtgagaagcgcagtagagaaagcaatatctgccaacccaggcatagctgctggtctcatcagaatgcatttccatgattgctttgtcaggggttgtgatggttctgtgttactagcatctagaccgggtaatccaatatccgaaagagacaatttggttaacaacccaagcttgcgtggcttcgaggtgattgaggaagccaaaaatcaaatagaggatgcatgtcctcaaacagtatcatgtgcagacatattggcattcgcagcacgagacagtgtttcgaaggttggtggcataaactacgacgttccatccggacgcagagatggtggcgtctcaatcggcggtgaagtgataggcaatcttccaggaccatccttcagtgctgatgaacttgttagtagtttttctcgaaaggggttgtcagcagatgaaatggtgacactctcaggagcgcattcaatcggtgtatcccattgtggctccttctcaaatcgcttatactctttcagtgacacagctacacaagatccctcattggactcttcatatgctgaaacgttgaaaggaaagtgtcccccaccaccccccacctcagacccaacagtgtctcttgaaccttccacgcctattcgtttggacagtaaatactatgaggcattaatcaaccaccgtggcttgttgacgtcggatcagacgttgtacacgagccaatccacaagggcaatggttgaaagcaacgcatacaatgctgcaagttgggctgagaaatttgccctagcaatggtgcgcatgggttctatagaagtgcttactggctccgatggtgagatcaggaagcagtgcagctttgttaattaa

SEQ ID NO: 1009 - DNA, 492 bp, Glycine max
  Peptide Sequence Number=SeqID_117787
atgggtataagggtcattgagaggaactgtgaaattcctcatgagggaccattttgtgatctgatgtggagtgatcctgaagatatcgaaacatgggcagtcagtcctcgtggagctggttggctttttggatcccgggtcacttctgagttcaataacataaacaatcttgatctggtttgtcgggcacaccaactcgttcaagaaggtcttaagtatatgttccaggataaaggccttgtaacttttaatcaagtgagaagatcaatagtggctttagtgagaaatggtcctattaacaggggcagaggaaacccacaagaggtggtacaagtggtatggtccgcacctaattactgttaccgttgtggaaatgtagcttctattcttagtttcaatgaaaatatggaaagagaagttaaatttttcactgaaacagaggagaacaaccagatgagaggccccaggacaggcgtcccatatttcttataa

SEQ ID NO: 1010 - DNA, 969 bp, Glycine max
  Peptide Sequence Number=SeqID_117788
atgtctcttttcttcgcgaacaaagctgcattcaggaagaagctcggaaacgaggattgccggaaaagagcaagcggggtttcgggttggaagaaaaggggaattagggacaaattgggaaaggttccttctcctttgttgataaagtcctttaaaacatttccatcgttcaaatgctgcagcaagagctcagatgagaagggaagtgaagatgtgaaggacacattatctggggtggtggacgagcaagttgaagagttcttgagtagaaaagagaacaaggttttgctggatggcttagagaaggcgtcgcagagggttgagatggctaagagagaacttgctctgatccgaaaacaagaatttgctgtcaagcagttgaaggattacgtcaaccagcttgaaagcaaagttttcgagattggagaatgtcaaagagacatatcagaggcaaaagccttggtggaggaagcagaacgctctctgttggtaaatgtgggaggtcctgaaaatggcagtacatccatggggatgaaaagtgaagacatcgatagagatgaagagagatgggagtcagtaaaagcagcatcaatttctgcccttgttggtactttttcagggctccccatatgcttcactcaggtcaccaacacaactcagctgcttctccctttagcaatcaacttcatttgctgtgcattgtttggagtgacttttcggtacactataaggagaaatttggatgatgttcaacttaagacaggggtagcagcagcttttggtgttgttaaaggtctcgcaaccttaggtggtggaccacttcctgaaccaaacattgaaagcttcttgtcacatgcccaggaagggacaatttatttgtctgagaatcttttgatttttgtttctgctgctgttgctctagattactgtttaaagacaaggcttttgagcccttttccaattgattga

SEQ ID NO: 1011 - DNA, 1161 bp, Glycine max
  Peptide Sequence Number=SeqID_117789
atggcttttacttcttcatgttctcttgcttctcagtttctccctcccatatatcattctgcaatcccttttcactcaacgaactgcacaaatttgtcattccccgctgttccgactccaagacaacaaccactgttgttttcttcaacctcaacttgcttagcagcagcggcggcgtcaaactcaaacagcacttcgaattccaataacaacaaccctgcttcagcttcagcttcgtcgaaagagaagaaagtagaagtggaagtggaagtggaggaggagctgccgtggattcaggaaaaggctttggacctggtcgagttcacgggctccgttacccaagccattcccgggcccagagtgggtcccacctccttgccttggattctcgctattcctctcacatatgctggccttactttcgtcattgcctttgtcaagaccgtcaggaaattctcttctcccaaagcaaaacgccgcagacaggtcagtaaaaatgcgacgctatgcaagtcgctggatgatttatttcaaaaaggaagagatgaagttaagcttgatgctctcaagcaaattgagaataagacaggttttgatttggaagaaatattgcgcaagtatatcaggtatgctctgaatgagaaaccattcaatcctgacatggtagctgatttaatccagctaaggaaagcttctatgttaaatgattcacaagttgctgagattctgaatgaaatttcacgacgaattgtgcgagacaaagtccaagatcatatgaaggtccagcctaacaaaaggagaagagaagtgtcgaagtacagtttgaggaaggatattgagtgttcctcaagttgcaaccttactggatgtaaaccttggcaagaaaaagctgttgccccttcctcagtggttcaacctcttccttcattgatagacaacatggaattgcaagtcacccctgaatctgacctagtcgccaataataatgcttcaggaaaagtacaaatgcctacttgtgaggattgtttgaaattgttcagtatcatacatcagcaattcccagaattttgcattgaggacaaggtgaatcttttggaggggagtattgttatgccccctatcaatatagtctatagtagaagctctatggggccaacttag

SEQ ID NO: 1012 - DNA, 2871 bp, Glycine max
  Peptide Sequence Number=SeqID_117790
atgtctgtccctgtctctgtttctgtctctggttcagggttacttagttttccttcaattcagcgaccacattccaaccctccacccaaacacgccgtacttccttccacttcccgtgaacccgacactgatactaaatacttgtgtctattgagcccatttcaaatcatagctagccaagagctaccttaccaaactttccctttccgaggcttaggtcaccgactcaccggacagcaccgcaccgttgtcggatggattgcaagtaatcaatatcgttatctatttgagaaaaatattgtctgtaaagtatttgatgaaatgcctaataaggatttgaatccctctacatggtttaaaggggcttttgtgattgagaaaacagtcatgtttctgctcgagaagcttttgttaggcaatctcacttatcagggcggccacacaggatggatagggatgttggtttccatgactgaggctaaggatttgaagtttgagagtctccgcaaagccatctccaggcttgacctaacaacgacatctccgctcataaagtcttcccttctcctcaaagcctgcatcaggtctggtaacttggagctgggcaaactccttcaccacaagttgattgactccggactccctctcgactccgttcttctcaactccctcattaccctctactccaaatgcggggattgggagaacgcactttcaatattccgcaacatgggccatcataagagagacttggtctcctggtctgctatcatctcctgtttcgccaataattccatggagtcccgagcccttctcacctttcttcacatgctccaatgctcaaggaatatcatttatcccaatgaatattgctttacggccttacttcgatcttgttctaatcctctattctttactactggccttgcaatctttgcctttctcttaaagaccggatactttgattctcatgtctgtgttggctgtgcattaatcgatatgtttaccaagggcggcctagatatccaatcagcacgcatggtgtttgataaaatgcagcacaaaaatcttgttacttggactttgatgattaccagatattcgcaattgggcctgctggatgatgctgttgatttattctgccgtctgttagtaagtgagtatacacctgataagtttactctgacaagtctcttatcggcttgcgttgagttggaattcttctcacttgggaagcaattacattcttgggttatcaggtctggattggcttcagatgtgtttgtcggttgtactctggtggacatgtatgcaaaatctgcagcagtagaaaactctaggaaaatatttaataccatgctgcatcataatgttatgtcttggactgctctcatctctggatatgtgcaaagcagacaagaacaggaagccatcaaattgttttgtaacatgcttcatggtcatgttacaccaaattgcttcacattctccagcgtcctcaaggcttgtgcaagtcttcctgattttggcatcggcaaacaacttcatggccagacaattaagctaggactttccactattaattgtgtggggaattctcttattaacatgtatgcaaggtctggaactatggaatgtgctcgaaaagctttcaacatcttatttgagaagaatttgatttcgtacaatacagcagctgatgcaaatgcgaaagccttggattctgatgaatcctttaaccatgaagttgagcacactggtgttggagctagtccttttacatatgcatgcctcttaagtggcgctgcttgtataggcacaattgttaagggtgagcaaatccatgccctcattgtgaagtcggggtttggaaccaatctatgcattaataatgctttaatctctatgtattccaagtgtggaaacaaagaagctgctttgcaggtctttaatgacatggggtatcgcaatgtcataacttggacatctattataagtggttttgcaaaacatggatttgctacaaaagccttagaattgttctatgaaatgcttgaaataggtgtaaagcctaatgaggtcacttatattgccgttttatcagcctgcagtcacgttggtttgattgatgaggcatggaaacacttcaattccatgcattataaccatagtatcagtccaaggatggaacattatgcatgtatggttgatttgcttggtcgatctggattgcttttagaagccattgaatttattaactcgatgccttttgatgctgatgcattggtgtggcgtacctttcttggttcttgtcgggttcatcgtaacaccaagcttggggagcatgctgcaaaaaagattcttgagagggaacctcatgatccagctacctatatattattgtcaaacttgtatgcgtcagaagggaggtgggatgatgtggcagccttaagaaaaagcatgaaacagaaaaaattaataaaagaaacaggttatagctggattgaagttgacaatcaggtgcacaaattccatgtaggggatacttcacacccccaggctcgaaagatatatgatgaacttgatgaattggctttaaaaataaagaacttgggttatatcccaaatacagattttgttcttcatgatgtggaggatgaacagaaggaacagtatctgttccaacacagtgaaaaaattgcagtggcatatgctcttattagtaccccgaaaccaaaacctattagagtatttaagaatcttcggatgcaaaccgatttcatcatatcaaggatgggaaatgctcttgcaatgattattggttattccacatattgtgctaaagtagcaatgtcaagccttgagagatga

SEQ ID NO: 1013 - DNA, 1650 bp, Glycine max
  Peptide Sequence Number=SeqID_117791
atgaatttggcattgaatcgaaagctgcgcgatgtaaggcagtggcaacggacatggaatgggtcctgcttctccacgcttccacgatcacaacatgcagagcagctgctttgtcattgcaccaatctgagccatcttcagcagacacaaggtttcatgcttaccagaggtctcgaccaagatgacatcctactcgcccgatttatatacacctccgcttctctgggcttatcctcctatgcctattctgttttcatcagtaaccaccgacccagcatctttttctacaacaacgtcatttgggctctatcttcatccaatcccacgcgtgccatttctctgttcaacgccattcgcctgcttgggatgccacccgactcttactctttcccctttgttctgaaggccgttgtttgtttatccgccgtccatgttggcaagcagattcattgccaagctattgtttctgggttggactcccatcccagtgtggtcacatccctcgttcagatgtattcttcttgcgctcacctttcttctgcccggaagctatttgatggagccactttcaaacacgctcccctctggaatgctatgctcgcaggttatgctaaggtgggtaatatgtctaatgcccgcaacttgtttgaatgtatgcctgaaaaggatagggatgttgtttcttggactacacttatttcaggatacacgcagactcatagtcccaatgaggctatcacgctcttccgcattatgctgctccagaatgtgcagccagatgagattgcaattttggctgtgctgtctgcctgtgctgatttgggtgctcttcagttgggggagtggattcacaactacattgaaaagcataataataaattgcgtaagactgtccctctttgcaactctctcatagatatgtatgccaaatcaggcgacataagtaaggcacgccaactgtttcagaatatgaagcataaaacgattataacctggacaaccgtgatttccggacttgctttacatggttttggaaaggaggcccttgatgtattttcttgcatggagaaggctcgagtcaagccaaatgaagtgaccttaatcgccgtcctttccgcatgtagccatgttggattggttgaactgggccgcaatattttcacgtctatgagatccaaatatggaattgaacccaagattgagcattacggctgcatgattgatttgcttggacgtgctggatatcttcaagaagcaatggaactagttagggtgatgccatccgaagcaaatgcagctgtatggggatcgcttctttctgcttcaaatagatatggtgatgctgcgctagcagcggaagctttgcgtcatctaagtgtgttggagccccacaattgtgggaattattcgctcttatccaatacgtatgctgcgcttggttggtggaaggaagctgctatggtaaggaaggttatgcgggatacgtgtgcggaaaaggttccaggtgtcagttttgttgagctgaacaatagagtatatgaattcattgccggagacaaattaaacatctgctttctggacgtcctacaaagcataaatgggcaactgatcgaagatgctttatctgaaaagtggaccaatgacgactga

SEQ ID NO: 1014 - DNA, 210 bp, Glycine max
  Peptide Sequence Number=SeqID_117792
atgaaagagaggctgagggacaggaaaatgcagagggtacagagaccaacaaagcatgaacagagagtgagaaacaggcatatgcggcttcacgatgcaaaaaacaagggtgaagtagtggcaatatgctgtagcaggggatgggctatgcaatttccttgtgtttatgagaagagtaggcttgaaattcctatggctcacaatgtgtga

SEQ ID NO: 1015 - DNA, 363 bp, Glycine max
  Peptide Sequence Number=SeqID_117793
atgaacgacaagttgaaggcagtggaaaaccacgggctaaaagcctcacaaaaactagtagaatccatgatgagtgaaaaagcacaaaacaaaaccaaacggtgcaaaataggggttttctcccaaaataagtttgatggagttgaaactccaggcacaaagatgcataaggtagacgatgcagtcactagaaatcacgaccagaaaaagtgtcagatgtgccgccaagcattgtcaagagaagttatttggcagcagaattggcacactggttgccaaaaaggactgctggaatggtggggtcaatggatgaaaggttgccaaagttgtggcggtggtcgaaaaagtgacgatggtcgatag

SEQ ID NO: 1016 - DNA, 654 bp, Glycine max
  Peptide Sequence Number=SeqID_117794
atgaaaacagaaggtgctagaattatcctcctgacagctcagcaccttctaacaaattctgttaaagggaatccaccaagggtttgtgcccgtagtggtgcttttgctggtcgcttggtacttctcttgggccttccatcgtgggtctcgggtctgtcttcatccatagcttgggcctcagtgaataagttcaaggaaacaagaaaggatatgagagcagaagatgcggaggggcacggagccgccagtgaagaagcggatggagagcgcccgtacgagaaacctatggatgtggaagatgacagttatcacgggaacccacaacgagagcctcgtctcctgcgtgtgaacctgcaacgacaaacgcgatggcaaccaaggttcggattcgtggattcacaacgtgctgagggggaaaagcggatggcgatgctgctgagaaccacggttggcacagtgaagggaatgacggggtgttgcgtggtgactggttctgagaaagtgggaaatggagacaatgatttttttaagaccaaaatggaaaataggtcagatatgggttcttcaactccacaagatcctcatggaagtgatgaagttagttcaaattctgctaatgagacgaatgatgaatgcaacgatgcttctcaataa

SEQ ID NO: 1017 - DNA, 558 bp, Glycine max
  Peptide Sequence Number=SeqID_117795
atgaggagtaaagctctaaacctggttcatgtccttgatagtgctgctgctgctactacaactgcacctgctctggatttcggtgccttgagcgtttctgatggagggaagcagttacttgataacatattgtgcattaatatgagtggattgactggacctattcaatttggtttagatagatctcctctaaatccatcatatggcattcttaatgtaattgctacaggttataggagaatcggctactggtctagttactctgacctttctgaaatacaacagaaaagcctcatggatggattttcccaaataacgggagttcaatacaagttcattctgtttggagatggacacaagaacccaagctactgtgatcttgtcaacatgattacttctgatgtaagtgacattgcgattgtctctgtccgaacaaagattgtggattttactcgaccatatatagagtcggggctagttgtggttgctccacagtggtgtggattcttgaacatagaacaaatgttgagtttcgagggtcaccgagggaacatatag

SEQ ID NO: 1018 - DNA, 321 bp, Glycine max
  Peptide Sequence Number=SeqID_117796
atggacacgaagaggcaaagagacgaaggcccgaacgatattccacaatctcagacggtgtttcttgaagaagacggttttggtggtattttttggtatatgattgtggtcagtggttatttggtttctggggtagttgtggttttgccactaatctttttgcggagctcttcattcgctattcagaaagggctctccatagccaagagcaaaggttatctggatatcatatgtgaattggactctaaatctgctattaatcttgtaaaggatggtgttcctgagtctcatccttatgcgactttggtcgaggatatctga

SEQ ID NO: 1019 - DNA, 505 bp, Glycine max
  Peptide Sequence Number=SeqID_117797
atggttactgatggaaccaaaaagcctcaagtttcagtacctacacgaccaccaccaccttggaaaatcaatttgcagaaatatgctgaatcccgtgctctcgaactccatagtcttcaatctatcatagaaaatagagtaaacagtgattataggtctcaacagaacaagagaatatggacaactgtgtttgataaccaaattgcaagaaaaaggtgcagaagaaagaggcagaaactgggaataattgataaagcccttgccaaatcaggtttggaggagaatcaccaaaagaagcttcctcggtgtgttcatcggagatatgaactaaagaaaaacccagagaatggtttttgcacttctggggatgtaaccaagaggctgagaactcatgtttggcatgcaaagtggggtaaaggttcgagggcgctcttgaaaaaggctcaaacaagaggggtcaggggtcaggggtcaggggtcaggggtcaggggttatgggttaggg

SEQ ID NO: 1020 - DNA, 138 bp, Glycine max
  Peptide Sequence Number=SeqID_117798
atggaagtgacaaaacatagggcaaacacgtccttggtccaaggctcgacaaacgcaagattcacccttgatgggccctttccattactaagttccatcttcataggaactcaagacggaagtataagtaagtcatga

SEQ ID NO: 1021 - DNA, 624 bp, Glycine max
  Peptide Sequence Number=SeqID_117799
atgaaacccccagatgtccaggaggatcacatatttctgaaggcttttcctcattctctggagggagtggcaaaggactggctatattaccttgctccaaggtccatcacgagctgggatgaccttaagagagtattcttggaaaaatttttccctgcttccaggaccacaaccatcaggaaagatatctcaggactcagtaatatggagagaagtatgatagatgctgccagtggtggagcccttggagacatgactcctgctgaagccaggaatttaattgagaagatggcttccaactctcagcagtttagcgccaaaaatgatgccatagtcattagaggagtgcatgaggtagctacaaactcagttgcatcatctgagactaagaagcttgaaggcaaactggatgcattggttaacttggtaacccagctggccttgaatcaaaaatctgtacctgttgcaagggtttgtggtttgtgctcctctgctgaccaccatacagacatttgcccttccatgcagcaacctggagcaatcgagcagcctgaagcttatgctgcaaatatttacaatagacctcctcaacctcagcagcaaaatcaaccacagcagaactga

SEQ ID NO: 1022 - DNA, 414 bp, Glycine max
  Peptide Sequence Number=SeqID_117800
atgttgccttttgccctgcatggatatcgaaccttggtacgaacttctactggggcaacgccgtattccttggtttatgggatggaagcggtactcccgtttgaggtggaggtcccttcccagaagatactagtggaatcgggcctagaagaatcagagtgggctcaaacacgctacaaccaactcaaccttattgaagtttgtgataacctgagccctttcgctcagttcatggggggcataatcgtcttaggcaatagtcagaggtcgagacaaggtcaaaggcagaaaccaatcaaggtacttagggacgaacgcaaggagaggctaggatcacgaccgataggtcatcatcctttgcttagcctgggacaaacggaaagcgtcgctgcgaagcagcccaatatcctttaa

SEQ ID NO: 1023 - DNA, 328 bp, Glycine max
  Peptide Sequence Number=SeqID_117801
atggatatgattaagtccctttccagtaagcctgaaaaatttacgggtgaaaattttttctgttggcaacaacaaatgaaattctggcttactgaattggatttatactctatgatttctaaaagagaaataaaaacttcaacttcctctactgatatagttcaaactgatgcaaccattaagcatgatgtttctgataaagatattttatgtcatggacgcattttaagtgctttggctgataacatatataagattttttgccataccaaaacttctgttgagttatgggaagcacttgaattgaaatatggatctgctgaaaaag

SEQ ID NO: 1024 - DNA, 501 bp, Glycine max
  Peptide Sequence Number=SeqID_117802
atgagggagacacatgaaataccccaccacaatctagccgacttcaagcctcacctcggatatgccactgaggggcaagtagttggtggtgtacccctaccaaacactttggaggaccctcaattttgcccacaagcacaacccttgcctttcatggtggggagagtccctcctgctatggtggaaaggggaaaattcaatcatatagaggaatggatgagagacattgaaggaggtggagattattcctttgctaacatggaagagttgtgcctagtacccgatgaggtcattcctccaaagttgaaggaaagtcttactggggtagccgtcacatggtacactaatctggaacctttccaagtccattcttggaaggacctaatgggttacttcattaggcagtatcagtataattctgatatggctccggataggatgcaactacagaacatgtgtaaaaaggagcacgaatctttcaaggaatacgcccaaaggtag

SEQ ID NO: 1025 - DNA, 852 bp, Glycine max
  Peptide Sequence Number=SeqID_117803
atggcacgtattgctgacaagataaaaaccatcgatggatctaaagaaactctgaaacttgctgtaaggataaccgagctctggtttgttgggacaccgggcaggtctgaacaagctgagatgatcattgttgactctaacggtgatcagatccacgtggtctgtaagcaagaccagttaaaggcatggaaaatggatttgaaggaaggttgtacttatgtgatgcacaattttagagtcaccaagaatgatgaacagtacagagtttgtgatcatccatataaattgacatttattggagttatggttgtcagacagtgtgacttagatggccttcctttaaaaaagtatagatttatagatttttcagatatcattgttggccaattacagtttgacctattagtagacatcattggtgttgttgacgaggttgtctttcgtcatatttcacccaaaataatgaattggtgtcttgcactctatgggcctattattgtgttgttgaccaatgccagaattaaagagggccagggatcctatccatgctcggttagcaattctttgaaggcttctaaattgactattaatgagccactgacaccaattgaagaattcaatcagaagctttcagaattgggcattgagatccggtcaattttgacacgtcgttcccagtggagttcacagccttcaggttctgctcagttatcatcaagggagacattcatttccaagttagaggcaaagagcatttctgagataaacaacctttgtgaagatggtgatctagatttaaatgcctcccaaaagcacttgataaactactgggtcatctgttcgccttcatag

SEQ ID NO: 1026 - DNA, 621 bp, Glycine max
  Peptide Sequence Number=SeqID_117804
atgcagaaccttctgcaagtcccattctcttttcataggcaatggatgcacagatacccaaagtatgttttattccactatgatggcaacaaacatttcattcgagtaaggaggcacggtggcaaatgtttttttgctgatggcctaaaggaattcagaagggcacacgatctaaatgagagtgtcattctccgttgtgttgcttttgacaaaaatactactttctccattcatgtcatcggacctacacaaaggcaattgcgtgtaaagcccgttatatcaaaaaggagatatatttttataactgatgtcacaaaggacatgatacagcacagcctccccttggtggatacttccagcagcagcagcttcaagatttgtccatgcttcaaagaaatttattatcgttcaacacggactggaaaatgcacccactgggacatcaccatccacaatgatgtcccatcagttgccgacccatggttccacttacttgatgaaaaaaaattgatccccgaagatgaggcagtcttctactaccggtttgattaccatgcatgggaactgctggtcaggaaagatattgaatgggacaacgaagaaatcaactttgacgactga

SEQ ID NO: 1027 - DNA, 557 bp, Glycine max
  Peptide Sequence Number=SeqID_117805
acctcaggaaaaccctaaacctcccctccaatgcgcgcgttttcgtcgtcgacagccaccgccccatccacctctgcaacctcagcgaccaaaatgacgtcgttgtggttctcttcactaaagaagacgaaggacaatccgatctttcttatgatttcgacctcaccacactcgccaatgccgccaccaccgtcaattctgatttcgattccgaatctgagttcgaatcggattccaactctggctccgagagattgagtgacgagaggtaccatgatggagtcatggagctcgagcagcacataaacagttctggtaacctggatatggttacttcggttactctcaaggatggtaccaagattcgtgccccaaattctttgcgaattacttatgagaaccagccgaggcttatgttgttgcaggagtggagcctctttgactccatgatgtgctcctcgtacattgccaccaagttgaagatgtggagtgagaacaggataaagaagctgaagcttctattcgggacgatggggtttgctcttggtgattgctag

SEQ ID NO: 1028 - DNA, 363 bp, Glycine max
  Peptide Sequence Number=SeqID_117806
atggggaacgatgacatgacagagagagtagttttcgtgaccgtagggacaacgtgcttcgatgctctcgtcagagccatcgattccgacaacgttaaaaaggccttgtttgcaaaagggtacactcaccttctcattcaaatgggtcgtggatcctatcttcctactaagtctgaaggagatgattgttcgttggctgtagactacttcactttttcttccagtattgcagaccatctcagatcagcttctctagtcattagccacgcagtctatgctggtgccgggagagttaatgatttagtgccaaatagggtttgcatactgtttgaacaccttttttctttgaaacaaactggttga

SEQ ID NO: 1029 - DNA, 459 bp, Glycine max
  Peptide Sequence Number=SeqID_117807
atgtatgagtatgccaaagatggtgatggtgacagagtcggaggagatgaagaccaggttgttccccattggggtagagggaatttatggagttggtacccctcagaatcaactcttatagaacacattttcataacaaatatgctaggattgaaggaggggcaaatgtgctcttcttggaattccatgctggaaagagataagtctactgcaaaggatgcatatgtcttcctgatcaactggttagagaggtttccatttaggaagacaccattgtatatcattctcgctcttctcaaccctggatacctactgatccagagtcagataaggctaataaaccacatggatgggacggcagaatacaatataattataagacaccaagaccatgtaacagataaaccacccggcaccagcatagacttatataacaagaagcaaaatagcatgcaatag

SEQ ID NO: 1030 - DNA, 748 bp, Glycine max
  Peptide Sequence Number=SeqID_117808
atggcaccagcgccttcaggaggcaggaagtgccaatgggaatggcgtttccctgcacctaggctgcctagccttgcacttctgctgctgcctgactggacaagaccagtcaaagcgccaacgggaatggcgtgttgcaattcaaggtcaaatcgccaatccggattgcgctttcctccagcacttgacacttgtcggccatgcatgaagtcgccagttctactggcgcttcccatgcaggcaacgtttcggtatggtagcttggatgatggagacacataccctcagtttcagctctatttggatgcaaccaaatgggctactgtgtcaatctatgatgcctcgagaatttatgtgaaggaaattatcttcagtgcaccctcaaactctattgatgtttgcatgtgttgtgctaccactggttcttccttcatatctacccttgagctcaggcccttgaatctttctgtgtatgccacagattttgaaggcagttttttcttgaaagtggctgcaagaattaactttgatgctccaagtgaggatgttgtcagctcaaatgcaactaaggcaacaaagacagtgctcacatctaagaatgcattagataagaatagcctcgcaaacccaacaaagatttctggctatgttactgttaacaagattgctggtagagctctcctttactggctcactgaagttgccctaaatcctctcaccaaacctttggtcatttggctcaatggag

SEQ ID NO: 1031 - DNA, 240 bp, Glycine max
  Peptide Sequence Number=SeqID_117809
atggaatctacatataggacatggttacatgcaacaaaagatgcttccagcatgtggaactctgatgaatatatgggagttgctacgtgcacccagcattattgctggggcacccagcaaacagtgaagtggcgaaactgcccttcagcaattatttttccggaagaaggttcttccggaaaagttccggaaataatttttccggaaagtttccggaagaatcttcttccggaagaataa

SEQ ID NO: 1032 - DNA, 468 bp, Glycine max
  Peptide Sequence Number=SeqID_117810
atgggatatgctaggtgcacccagcaatattgctggtgcacccagcaattcaatgaaagcttattctcttctctcttccccgacaagcttcttctccgcgagcttctccgacaacccttggacccatttgctttcgaggtaggtggccttcttcttagctttggttttgttatgcactacattagggtagacccgttaggggttcttccggaagttccggaagaaccttttccggaaagtttccggaagaagtgttcttccggaagtaaccaaacgtctttcgaaagaacacttcttccggaagacttccggaaaacctcttccgggaactttccggaagaagtggttcatccggaagaattccggaagacgcgcacttccggaagaactttcaaagttccggaagacctttccggaagaaccccttcttccggaatgtttccggaagaaccacttcttccggaagtg

SEQ ID NO: 1033 - DNA, 1496 bp, Glycine max
  Peptide Sequence Number=SeqID_117811
atgactactcagagagaaaggggttttgacttaatccttattcttggtcacgatgaagaatgcaagaaagtttgggagactcatgtattacttttagcctcgcttgataccaaacctatttgctttgcaagtccttatcaccctcatatagacttagaggccattaaggattggcttcccactcatgaaggcaaacaaactcttattcacaaaggtagtattaggagtgacttttggaaggataagagtgggatttgccgagttttgcccccaaaagacagaaagatttatctcacttggttaaaatgtttggaggcaaagaaagctcaacattggaagaatataaacatttatgacatgattcaactgagcaagtatgaagtgtctacatgccttagagaactaccttacgttccagtttcaccaaccttaatggatttaattgctattattggtctcaaacctttagggaaaacttattcccttggtttattcgaggatcagatagaaaggagtgaagtcaaaatcgatgggagcgccaagtcttatgagcacaaggtggatttcaaggataataggtcagtagacccagagaaatacactttcaggctaacaggaaggaagcctattagtttggaagagaaaaggaagcttggtgaagggttaggagttgtggatttaagactgtggtgcccaagactaggtagttttggtgtagtggtgcttgagagtctaagtggacttaaggctgttgattttaggcaacctgaggtgctattggtaaacaaggttcatcaatttgaggggaaaaaaaggccacttgaggcaatagcagatatgggactaaatggagagtacaatttgaaggagttaatgacattggtaagcttaggagctgcacgcacccgttctgacccaaaattaagaccaaccactagacacatagtaagcattcttggtgcgaagttatggacatttattgacaatgcaggactttttggaatcgaggatttggattttggatcatctatattaacggtaagcattcttgatggcaatgaaaaattaatcaagggaaagaacatggatagtagggaagattggagagaaacaaatacttgctctttgtcattggttaagacaactgaaggtctaggaatacaacgaaaagtagcacaaacaccaatgaaaatgaagctagtcaagctgctctttcaagaggagagcaggatccaagcaccaacaaagccctataaggaacgacataagattcaaacgcctacaaagaagactaatgctaatggaactgtggaggaaccagaaaagtgtagtaagctaagaacttccattggaaagaaatcaactgaagtttctaacagtggactccctggaaacttggtcaaagaagtaatgaaacacagagatgcagcacagatagcagcaattgaggctatgcaagagcctgctgctactgagagtttactgcaatgtctaag

SEQ ID NO: 1034 - DNA, 537 bp, Glycine max
  Peptide Sequence Number=SeqID_117812
atggctgcattgatagggttaatggaaataaaattttctttaataggtaataagggaggagaaacattacctagtcatgacaatggtgacaaggatttcacatgcatgattgccaaagatggggattgctatggggaaggcatagtgggaatgattgtgttaactatgggaagtgtgagcatgatggagaagagcacgaccaatttctacaatatgatagtggcgtctctcggcaatgccattgagaccattgagagtgtgaatgacgagatcattgtcatccatggtagtggtgacaatggcgagttcatttgcaatggatttgataccttgaaggaattcagtgacaaatatggtcccttttgtatgttgatcctatcaaatccaatagttgcaatcttgatgatcagagactgggctcatgttggtgccatcaacaaatcccatcaggttgtagcctataaggagagcattgatctagactccccaggatgggtagttcaacccagaggattggttactaaggacaactattga

SEQ ID NO: 1035 - DNA, 174 bp, Glycine max
  Peptide Sequence Number=SeqID_117813
atggaggtcacgagcagcaacaacgatgatagaaaaaatgtgaatatcaagaagccaacgatggagagtgaagtgctgtcatggcggaaacaatcggtgaggaagagtgaagcatcgtcacggtgggacaagagtgagggagctttgagaggacgcaagagtgagggttcatag

SEQ ID NO: 1036 - DNA, 594 bp, Glycine max
  Peptide Sequence Number=SeqID_117814
gcaccaccaccaccaccatcatccaacaagaaagtgaaggctcaaaggttgttccaattccaaccatccatgaaccaacttagaaagacctcaagtgaaggcttcactttccctttgttcttggcaacaaactccaccaaccccacaaaacctcatcatcaggttcatctcaacgtggttcatgaagaagaggacgcaaccccacgtgagtccttgcacatgttccaacctccaagcccccccaagtcacgtgccatggatgatgatgcagctagtgatgcaagttctgatctttttgagattgaaagcttctccactcaaactactacacttccataccccattatcacaccctccattgctcggtgccatgaatccaccgatcacgagttcttcttcgccaacgactccggcagcagcctgtggcggcggcgactgagggatacggagagagatgggtcgcttttgctcatggtgaacccatatgatatgatgaatgatttaaagcatcatgtgaggctctcaatgcttgtcttagaccataaattgctttatggagtttggaaacatgatccaggtgttgagcgtgcttga

SEQ ID NO: 1037 - DNA, 153 bp, Glycine max
  Peptide Sequence Number=SeqID_117815
atgggcatacctctcctaagcttcttgttttgcaagaaggtggggatatcatctagtgctgctgcagttaacaaagctttctacatcggtcgtaaaaggaccgtcgtagaacacgtgacaaatgaagtcgtgcttacgccaacaacgatgtag

SEQ ID NO: 1038 - DNA, 138 bp, Glycine max
  Peptide Sequence Number=SeqID_117816
atggttgatgacaatgatgaaactgctggcgtgcttcacgacgacactgctggtgtgcttcacgatgacaaccaacttacaaagacaaagcttaagggcacaaaagtacttagattattaatgaataaaagaaaataa

SEQ ID NO: 1039 - DNA, 468 bp, Glycine max
  Peptide Sequence Number=SeqID_117817
atgtcttcagtcattgcatgtcttcaaaaggcaacaatgccattgtttatgctttcaaagacgataatgtcttcatctcaaaaacttctatatcttttgtccttgtgcttcataggactcaaccttaagccaccagctttcctgggcgagctgggcggcaagctcctcctccattttttctataaatggacattggagactgagggtgatgcaatcctccctaggaagggaccagtcactataaccatgagcaagaggctccaagaagattgggctagagctgctgaagaaggccctagggttctcatgaaccttaggactcatcttctccttgaagtggcgtctcctctctctctcttcctttctccattccgctgccattcatcttccaagaagcaaaggaatccattgatgcagaagattctaggcctagaagctccaatggagcttacatcagaggggaagggg

SEQ ID NO: 1040 - DNA, 789 bp, Glycine max
  Peptide Sequence Number=SeqID_117818
atgaaggcgaggactttgagtcctctaaaggtgaggatttttgagtcctctgaaggcgaggactttgagtcctctaaaggcagggattttgagtcctctaaaggtgaggaccttaagtcctctaaaggcgaggaccttgagtcctttgaaggtgaggactttgagccctctgaaggcaaggaccttgagccctctaaaggcaaggaccttgagccctctaaaggcgaggaccttgagtcctctaaaggcgaggaccttgagtcctctaaaggtgaggactttgagtccgctgaaggcgaggactttgagtcctctaagggcaaggactttgagtcctatgaaggtgaggaccttgagtcctctgaaggcgaggacttcatctttgagtcctctgagacaagccaatcaatgggcactagtacccaacggcttaacctcatgagaaagaaagagattgactctttgagagggattctcatctttggggagaaatctatgcatttgaacatgattttttttgtggctttgtatgccacaatgcaatgcaatggaaatttgtacaatgttcatgacattctttcctatttttgtgattttgatttggttgatttttttcctttttgtagagaacacaaattgactgtttcttttttgaaagatgtgataactcatacgacctcatcctatcttttgaaaatctctttgggaacttcctcagagtgtatgttctatttgattttgtcacttgacaattttggagtgatggcagtggagccatttgacatttaa

SEQ ID NO: 1041 - DNA, 225 bp, Glycine max
  Peptide Sequence Number=SeqID_117819
atggattctatttggctgaggggtatttgttcaaagagggaaagctttggttggatttcttcggcggttgctttttgttccactttttcttcgttcagatatattcaagggaaatctgatttgttggaaagcgcaccgtatcgtcaacctagattactaaacctcgatccctcatcagaccaaatcaaaccaagcttcgtcctcagatacctcttgttggactag

SEQ ID NO: 1042 - DNA, 633 bp, Glycine max
  Peptide Sequence Number=SeqID_117820
tggtacctggagatatgtcgcgggggtcaggagaccttggggatgtcaggcgagctcctggcagtcaacagataaaaagaactaagaccacaaagcaaggaggcttgtgtggtggctggccagctgtgaatcttgtgcttaaaaagggaactggaagattgtggaggcctctggtaatcgattaccagtctgtgtattcgattacacagaggaatgggtcactggtaatcgagtaccagatcgtgatggcggcgcagctaatccatgatcgagtggagatggagtgcctagagggagcttgggagaccctcgaaggcaatacgaggtgccgatttcggggcacgattcgatttacggctacttcattggtgcatacagatgaacccgcacgcacgcttcagcgtactgtggagtggatactacccacgcctacaccataccgtctagtggagcccgtccaagtgattgaggtaacgtcatccgaggaagaccctgaggaggatctcgaggagctacctcctgagcctattgtggatgcccttgactttctagagggtgatgaggacccactccctgaggtggattctcccaaggacgtcatgtcggcatccgaggcatactctacggaggata

SEQ ID NO: 1043 - DNA, 621 bp, Glycine max
  Peptide Sequence Number=SeqID_117821
atgcacgagacatcggggtttagcagtccaggagacaacatagaacacaggaacgttgttagggttctgcgtaaaaagagagaaagtgcagctttttataggcagggacaagctgtaatcgacagcctctggctttctggtcatcgattacagtcttgtgtaatcgattacagtctgctgctctatggtaatcgattacagggagtgagacttgattcacagattctccaaaagaaaggaattattattagtgaatttcaactatggttcaggccactaatccaagatcaaatccaagattctccactaagtgtgcttaggtgtcataaggcatctgtagaagcaaggcttcaagaagatgttttgatgatgctaaaggaacacacttctcaagttttattcaatccaagaaatccaagatatatgatcaagcaaacctctagaatcttccaagttgaaacatcaaaagttggaagtggaagttattggaagttgaaagttgaaaatggaagttggaagtggaagttactggaagttgaagttggaagtgaaagttattggaagttgaaagttgaaaatggaagttggaagtggaagttactggaagtggaagttgtgtaa

SEQ ID NO: 1044 - DNA, 284 bp, Glycine max
  Peptide Sequence Number=SeqID_117822
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatatagaggaaaagaaagcaaaagcgattcccgtagtagcggcgagcgaaatgggagcagcataaaccgtgaaaacggggttgtgggagagctatacaa

SEQ ID NO: 1045 - DNA, 1128 bp, Glycine max
  Peptide Sequence Number=SeqID_117823
atggaccacctgcatctcctacagcgacactcagccctagtcacggccgaagcgaaggtcatgatctacttgcaagagcgatgcggacgtcgaacttctgagacggttcggctaaaggaagaatgcatctcgtatgacagtgccgggcaggcctacctcgagtgggatcgcgtcaagccacccttcggtcgtggcacgcgtctcccgatccacaaggatgttcacgatgcaatcaggcaatggcaagaaatcaagatcgagcacggcatcgagtctcagtggctctttcctacggaccgaggaagaaaggacgcgccgcgttcagcagcattcttgaacgcaaggatcgacgagctcgtagccgttgtgctcgacgaagctccgttcatggaagaggtggaaggcgcagacggaaactacatcaggttcgatctgacaactatcgacgcgtacgcctttcgccatgcattcgcgcaacgtcatgccgatgcgaccgaccgtgaggggcgtccgacttgcactccggaggaactgcaggagtggatgggccataagagtttcaagacgacgatgaactactttctcatcaccagcagacgaaagcggcacgcgatgtcgtcgcttccctcgcggcggctcaactggtcaggtgaagcagttactgtggatcgagagcgcgatggtttcaccaagttggctgtctctcttgggtcatgcacggagcccgctaacgtggcggccggcggtgctgcatgtgcgatggatcatgtctgcgaatcatgcccgttcttcctggtcgatcctttcgaaagagacggactgctagcaaagcgtctgtatctgcaggcacagattgagcgcgtgcgaatcatcgcgccggacagtcacatgattagtcactacgagcgcagaacacgcgactgcgaccgaattctcgccggcattgattcctacatcgataatctgcctgaaatggaaaggtcatcaatacacctagctctcgagaagatggaggacattcggcgtcgagctggcgctccccgtcgtatcgaccttcgtgctattcatggcgaattctcgcatctgtcggacatcgagcgcgccggcgcaacgaagggcatcgaatga

SEQ ID NO: 1046 - DNA, 411 bp, Glycine max
  Peptide Sequence Number=SeqID_117824
atggaaacatgtttggcagtaggggaattgttgcagcaaataatagatcaaggccaactggaagtcggtgatgaggggagggaagagcagcatatatgtatgcagtccgtggatgagaaaatttttggaaggcctaaacctttggtgatatatttcaccaagggcgcagcttcacaaaagccccaacacccctcggtagctaaacctgtccctttcccataccaaaacagccacgcagtcccgtggaggtacacacctccgaaaacaaaggaagaagaagccaccgacatcagtttgttgtcgaccaaggtaaccaatatcacggggctgagcggtgtgacctgcagcggtcgcgtgtttgcgccccccgacctaccaattcagcccatgaacgtcaaggggaaggcaaag

SEQ ID NO: 1047 - DNA, 114 bp, Glycine max
  misc_feature (94)..(94): n is a, c, g, or t
  Peptide Sequence Number=SeqID_117825
atggaggaagacgtgcgggaggtccttggagtcgctccaaagtattgcttgatcgtgacaccggctccagtagcatgtacactaccagggtgtnctagttgcctaatggtagca

SEQ ID NO: 1048 - DNA, 462 bp, Glycine max
  Peptide Sequence Number=SeqID_117826
atggcgtctgtaattgcttctggaaaggttgaagtcgctaagcaaatgaatccacgaaatgaagatagtacatcttctaatagtgacagtggtttggatcgaattcttgagcagagcacttcaaaacccaaaaagaaaccaaaggatttagatggtgaagacctatccttcgactttgaagaaaggccaaatgctttgaaagttattccattttttaccactagaaccactttgaaagaaaaatctacccaaagtcagagtgaatcttcacttgaaaaagttaaagaaattatagatttttttgaagaggatatgaggctcccaggagaaaaagtttacaacaaagatcaagtggtcaaccaacctactgctccaattgagaaaaccattgttggacagcttgaagccatgcaagttgatccctctcctcctaaagttaatgcactagaaatcgaacaataa

SEQ ID NO: 1049 - DNA, 492 bp, Glycine max
  Peptide Sequence Number=SeqID_117827
atgccttactttggagtcattgaagaaatatgggtgcttaattatgacaaattcacgatctttgttttcaagtatctttgtgatgaaaggtggtcagtggttctacacggaaaaacaattggtgttaatgttgaagatgatgattcaatcattgatacttgtctcaatcttttttccacacaaatgttgcctaacgtcaacgaagaagaagaaattgacgacgtgcatccaaatagcacatggctacaccacccagctcccctcctcctcttcttgagtcagcatcaccttttccgtctacgtcgaagaagacaagaaaaggcagttggggcgaagagaccaatggttcatgtggatcctacccctgggaacgtcgatggtccccacagaaagaaattaagaacatatttggggatcgtcgcttgtgataaggtggataattggaaacaaatccctgcatctcaaaaggatttgatatgggaggatattcat

SEQ ID NO: 1050 - DNA, 282 bp, Glycine max
  Peptide Sequence Number=SeqID_117828
atggataaagttgatatctttgtccctcatcctctcacaaacgcatgtttgcttattcaactttcatcggaatgtgggtgcaagccattggtctgtttgctcaagcgacctgcgctcctgagtgttgacttccaagactgttcaatcagagattactcgtcttgcacgttggtggggggacaacccttcccttgtgttcaagaatcccctacaacaagagacccacggtctcttaatccctttttcagaaataagaagaagagaagaagaggtctctcgtaa

SEQ ID NO: 1051 - DNA, 534 bp, Glycine max
  Peptide Sequence Number=SeqID_117829
atgtctccacaaggtcagctcaagggactccttgaatggttagagaacaggatcatggaaattacaccgtctcttaaagatatagaattgaaggatgaattaggagtcaagctccttctttttgctagaatcatgactcaagttggtgtcgacatgaacgccttctgcctggcccgcaggagccaaattgttgccaacggaggtccattccccctctcgttaaagaccctaaggggaagcataagcacaataaaaggagtcactgcgatcaccaaagtggctcggggaagcttccggtataaggatgggagctctcaagagaaaagactcaagcaatatgttatgtattcaattgaaagggtacttggcagtaaaatgataaaagtaaatcgcatgagggcagacactcgggagggaattgttaataagcttttgagtttaaccttagccgaggagggtactcgggagggaactattgataagtcgttgaagttcaaccttagttgggaagggtactcgagagggaattattga

SEQ ID NO: 1052 - DNA, 543 bp, Glycine max
  Peptide Sequence Number=SeqID_117830
atggacaaagaattctccactataccggttgccggccggagctccgacgatgtgagctttgctgatacagtttttgggttttgggattcatccaattcaagcaatgatcgcgacgacgacgacgatgacgacgacgatgatgaaaccatttgtactgcggaaaatggtaaagcattttgggaggaacaatatcaacttcttaaggcaattttgtgcaggaccagttcatatgagacaaaagttcggcaagcaacgaagggggttctaagagaactgaacatatcggagatgctttgtatttgccggagggcagaggtggctaagagttgcaggaattgcttgctgagggaaatatacactctgcggtttaaaaagcttgacatcaaaattaatcctatcggaaatggtaataacaagttcacaatccgtattctggtactcgtgggttctgctaaaaaggaagcaaattcatgggctacagatgcttcggccaatatagctactagtttagaagttgagtatgtgatggttgagcaacaatag

SEQ ID NO: 1053 - DNA, 354 bp, Glycine max
  Peptide Sequence Number=SeqID_117831
atgcctccactccctaatctctggttactctttcacgctgggctctcttcctctctctgtctcagtgtgctctcttcctctccgttctcgttgtttctcgcgtcactactgtctctcgcgcctctttctcttcctttcttctctttcatcttcgttctctcgctacctcctatgcctctagtccgttctcagctccattattccgtgtctctttctcttcgccttcccgatgttgttgcctctcgtgcctccagtccattcgcgccgccacaagtacatctcgccatccatacattgtggtttgaaggtatgaaaaagttagatatgaaaatcttctggcgtacacattgttag

SEQ ID NO: 1054 - DNA, 1431 bp, Glycine max
  Peptide Sequence Number=SeqID_117832
atggtttcgtggcagaaagcacccaacatgcttcccataacctttacgtcagatgacttcaaagagatcgacccagtacagaataactcaatggttattagtgtagagttagccaactgcataatcatgaagacccttgtagaccaagaaagcttgactggcatcttgttttggaacactttcaagcaaatggatatacctaaatctgaaatcctcttacatgatgacccatttttcaattttgctggagaacggggcaagatggaagtcgaagaggtggaggaactagatctcgatctaggaatcgatgatgacaactgtgtaaggatgatagaggagacatccaccttccaacttagtcctaaggaaggacaggtctcgagcagtacggtaggagattgccagctgatggttgcccagttcatcagagaaattgactatagcacttggctttccaatttggtaatggcgaagaaattgaatgggaagtggaggatgtgtacagacaacttatcagcgtttaatggacaaggtgttcaagggtcagcttggatgaaacctggaagcttatgtggatggcatggtgggggaaagtttctaggcttcatgctaacccaccgaggaatacatgtcaacctggacaaatgccaagccatcgtagagattaggagtcctcagaatgtaatagaagctaaaaggctagctagcatgaaagccttcttgtcaagatttttgcccagaattgctgagagggttagaccaatcatgaacctcctcaagaaaaccaacaactttgtttgggacgatgaatgcaaagaatcttttcggcacttgaaagaaacattggcaacaccactcatcttgtcaaagcctaacattaacaaaaagcttattgtctaccttttggtctcaggattgagaaacgaggtgctaactgacttcatcaatgaacttcaccctctacaatcacattttgagcaagaaaaatggatggtgcatgtggacggctcttccaacagacatggaagtggagcatggctgattttagaagaacccaatggcatagcccagattcaatctttacatttcgatttcaaggctacatgtaatcaggccgaatacgaggctctcctagcaggattaacacttgccaaagaagtcggggctcaaagacatgagacattcccaacaaacaagggaaaagccaaaaaaacgctaagagcacaagccactaggcatctacgacatgcattccgaggaaagaacaatggcctcaagagtgttgagcgccagataatattggccaactttaaggacaaattgttcgagattcatgaaaagatgcctccaatgccaaaagcatgggaatttgatacattggtcgtcccaagaactacatcctatggtttccccttggttgttcctgtttag

SEQ ID NO: 1055 - DNA, 567 bp, Glycine max
  Peptide Sequence Number=SeqID_117833
atgcggagattacaagctcgggtctcgaaaatgcaaaggcatcacgtcgaagaactcatttcctttcatcgcgagaacgcacatctgtgggaatgtcataggtcgtggaaacctgaggctaacccatctaaaggaggagaagtcgagtcaaccaccatcaatttacctagagctacaaatttcagtatacattcaaacactaatcccccatccctcaacactttaggaaaacagtttctacagttcaagaacctctttgttcccagcatcatggaggcgactcttccttctaaccggaaaaacttgaccattgagaaatatgatggtaccatagacccaaatgagcatctgaacgtatacatcatccaggtaggcatatacaccacggataatgcaatcctctgtcaggtgtgggcggatgccatttcggccaagaaagacatgataagcccaactccaacaaagctcgcgacaacgagaagagggatcgaccaccccgagaaccgtgttatgcttgctacactccccttacagccaatagatctcatatcatggatgaggccttag

SEQ ID NO: 1056 - DNA, 600 bp, Glycine max
  Peptide Sequence Number=SeqID_117834
atgaaacgctatgctgatgccaagcgcgacgacgtctccttttcggtgggacagtgggtctacgtacgcctacggcccggccgacaaacgtctgtcacaggccctcatcaccccaaactctccaaacgtttcttcggacccttcatgttcgaagatcgcattggtttcgtcgcataccgcctgcgtcttccacctgactctcaggttcaccccgttttccacagttctcttcttcgtgctcaccacggtcccccacccctttccaccgacacctggcctttgggaactctcactcaacaaccaatacggcgtccactatgcttcctcgattcaaagatggatgactcaaccgaccctccgacacagatggttctcacacagtgggttggggaacccccagaggacaccacatgggagccatggccctccctttgcaagtcctaccaccttaaggacaaggtggactttggtggaggaggtattgttagtaactcagctgctagcaacccagcccaagcacggcccagatcagttcgggtcaagtcagcacccattcacttgaaggactactacgttgaccacatgcatggatcttcatga

SEQ ID NO: 1057 - DNA, 208 bp, Glycine max
  Peptide Sequence Number=SeqID_117835
atgaacgaagcaacttacaacaatgccgagagttatctgtaccttcacccaagcgaaaacccagctactgcccttgtgtcaccagtgctagaatcgactaactatcactcatggagccgttccatgatcactgctcttagcgccaaaaacaaactggagttcgtcgacggaagcgcgccggaaccgctgaaaaccgatagaatgtacg

SEQ ID NO: 1058 - DNA, 2019 bp, Glycine max
  Peptide Sequence Number=SeqID_117836
atgtctacacttctcatctctttgcttcttttcatcatctcaaaccttacccttcttcttctaacctcagtttcatgtacagagttcatctacaacaccaacttcaactccaccaacacccttctacacggcaacgccaccatagaatcttccatcctcaccctcaccaaccgttccaccttctctgtgggccgtgctttctacccttttaagattctcacaaaaccttccaactcttcttcaacccctttaccattctcaacctcattcattttctccattacacccttcaaagaccttctccctggccatggctttgtcttcatattgacaccttctgcaggcaccactggggtgaattctgctcagcatcttggcctctttaactataccaacaatggtgatcccaacaaccatgtctttggcgttgagtttgatgtgtttgacaaccaagagtttaatgacataaatgacaaccatgtgggggtggacataaactctctttcttcttttgcttcccatgatgctggattttggggtggcggcgacaacgatgagttcgaggatttgaagcttaatgatggtgagaactatcaggtgtggattgaatatttggattctagagttaatgtcacaatggctcctgcaggccaaaaaaggcctcagaggcccttgattagtgaaattgtggatctttctgaagttcttctggatgaaatgtatgttggattttgtggggcaacagggcagcttgtggagagtcacaagattttggcttggagcttcagtaacacaaatttttccattggtgatgctttagtcactacaaatttgccttcatttgtgcattccaaagagtctattttgaggtcaacaggttttattgtagggatcattataggtgttttgtttgtcattggtggtgctgttgtgatatttgtgctttttctcagaagaaaaaggagcaaaagaaaggacgaagaacaagaagaaattgaagattgggaactagagtattggccacaccgtgttagttatgaagatatttatgctgctactaaaggattttcagaccaacatgtaattgggtttggagggaatgggaaagtctataaagggcttctgcaaggagtgcaagttgcagtgaaaagaattccttgtgacagtgaacatggaatgagagagtttttgtctgagatttcaagtttaggcaggttaaagcataagaatgtggttccattgagaggttggtgtaagaaacagaggagcttgattttaatctatgactatatggataatgggagtttagacaaaagaatatttgatggtgatgagaacacaatttttgggtgggagaagagaatcaaggtgctgaaggatgtggcacatggaatattgtacttgcatgagggttgggaggttaaggtgttgcacagagacatcaagtcaagcaatgtgttacttgataagggtatgaatgcaaggttgggggattttggactagcaagaatgcaccatcatgggcagattgctcatacctcacaagtgattggaactgttggtttcatggcacctgaacttattcacactgggagagcctcaactcagactgatgtgttcagtttcggtgtgttgattttagaggtggtgtgtgggagaagaccaaatgaagaaaacaggcctttggttacttggttatggagtctaaaggagagaggagaagagtgttctgctcttgatgaaagattaaaaaggaggggtgaatgtagcattgatgaggttaagagggttcttcatcttggtttgttgtgcactcatcatgaccctcatgttaggccaagtatgagacaggttgtgaaagtgctagaaggagagagtttagatatgagcttgcttgacaaaataaattcagcagctggatatgttgggagctttgttaacaggtttcaccccacaattgaggatatttactcctccaactgctctttcacgactctgacaatgagggcagatgagtag

SEQ ID NO: 1059 - DNA, 2013 bp, Glycine max
  Peptide Sequence Number=SeqID_117837
atggccgaccatggaaccagaaaaaccactacagactgccttgaagaggccataacgctccttaccaatagtcaagcctctctctcagatcgatacatggatctttctggcaaggttaattcgatcctcgatcaccttcgccttcacgactccggccggaatgcggccaactctgcaaaccaccacaagcctcaacgtaattccgttaagctagacattcctcggtttgatggtcatgatcctttaggctggatcttcaagatcactcaactctttcaataccaggatacaccggaggaggaacgtatcacagttgcttccctgtacctcgacggcgcagcactgagttggtatcagtggatgttctccaacggcttcattacctcctgggaaggttttcttcaggctcttgagtcacgcttcgctccaaccttttacgatgatccaaagggagctttgttcaagttgacacagaaaggctccgtcaacgagtatctaacggaatttgaacgccttgcaaaccgtgtggtaggtcttcctcccccattccttttaagttgtttcatttccggtttaaacgccgatgtccgtcgcgaggtaatgaccctacaaccaatctccctcttgcaagcaactgctctcgctaagcttcaagaagagaagcttcgagatagagtggtctcgaacactcgcaacctctaccagcctaaaccgcttcaacctctcacacccaaccccactacaaaagctaaacctccattcgtgcaacgttccccggccgagatagctttccggcgagaaaaggggctatgttacaattgtgatgagaagtggaacactaatcatcgttgtaaaggacgagtcatgctcctcatcgctgatgatcaacaacttgaccccgacgtgagcgtttcagagctcgaggaagctctccctacctccatcgataccaacaacgagccatctgcggattcaaactgctcccatattagccttcacgcgttatcaggttccccgtcaacggacactttcagaatctttggctccgtgaagaacgcacaactcaccattttggttgatagcggaagtactcacaacttccttcaaccacgcattgctcagttcctgaaacttccaattcaatccactcaacctctgcaagtgttagttggtaatggttccaccttggattgcaatcaagtctgccctaagacgttagtcacgatccagggccacccattttccgtttcgttccaccttttgcaaatcagtggagctgatgccgtcctgggagtcgactggctgaagaactttttatcagctcagtgtctgacccgtaaccacacccgaaactgccctggcccaacatcccttcccttccattcagcatcttcttctccgatacaaccatctgttccagactccctcacgactaccaccacctcgtcaagtggttcaccgcgttacactacaacccgccacagcccccatcaacgtcaggccgtacagttccagtccatattcttcactggttctcctggtaaagaagaaagacgcagctccctgtcatcccatctccaacacctagaggctatcttcgaagcactgcaaaacgctgagttctatctcaagcaatctaaatgtctatccgcgcaacaaaccattgaatatctggggcacatggtttcaggcaatggagtcacgccggaaccctcgaaaatccaagctatggtgcaatggcctaccccaacgtccgtcagggaactacgcgccttcttaggccttactggcttttatagaaaattcatacgaggttatgccgccattgcagctcccctcacaagcttactttgtaaagatgcattcacatggaccactgagtcccaagaagctttcattcagctcaagtatgccatgactaacgctctggtattagcactacccaactttgtcgaacctttcgtgatcgaaacggatgcctccgcgatggctatcggcgccgtcctcacctag

SEQ ID NO: 1060 - DNA, 3369 bp, Glycine max
  Peptide Sequence Number=SeqID_117838
atgaatgacaaatctatggacgatcaaacccagcatcatgaagcccaagattccgttcgattctcaccagagcaacataaggctctacttgctttaatccaacggccattgactggaagcacggcatcggagcaaaccaaacaggttgcttcaatattatcttgcaccactgataggcttcccaacccaggtatgtcgtcatccatcgtaagctcctggatactagattcaggagccacagatcatgtgacttgttctctgaacaatcttcattcatatgagcctatcaaccccgtcacagtgaaactccctaacggtcaccatgtacaagctacccactcagggattgtgtatctttcgaagaccataaccttgtttaatgtcttatacatacccacgttcactttcaatctcatttcaatttctaaacttgtgtcatccactgattgtgcactaattttttcttctacatcatgcatgctgcaggacacgaacactcgtatgaggattggtatagttaaggagagacatggcttgtatcatctcataccagaccaaaacgataaagttgtatactcggccattgtccaccctaaatgcaatattataccagttgatctttggcattttcgaatgggccatctatcaacagaaaggctacaatgtatgaaaccttattacccaattctgaaacatgatagaaatttcgtgtgtaatacgtgccattatgctaaacataaaaagcttcccttttcctcaagcatttcacacgcattgcataacttcgatttgcttcacatggatatctggggtccttgttcaaagatatctatgcatggtcataagtattttctaactattatagatgatcattcgaggtttacttgggtacatcttatgcactctaaggcagaaacacgtgacatcatcataaatttcatcacatctattgaaactcaatataaccagaaagttaaaattatacgcagtgataatgggtctgaatttattatgaccaatttctatgcatcaaaaggtatcgtgcatcaaacgtcatgcatagaaacacctgaacaaaacggcattgtggaacgtaaacaccaacacttaattaatgtcacacgtgccttattgtttcaagctaacatgccatctagtttctggaactatgcattattacacgcagcatacttaataaattgcatccctactccgtttttacataatatatcaccatatgaaactcttcatggacatataccaaacatatctcatcttcgcatatttggatgtctatgttatgctggtaccattaaagccaaccgaaagaaattggaacctcgagctcacccctgcatattcattgggttcaaaccaaacacgaagggatacatgctttatgatttacattcacatagcatcattacatcacgcaatgtcgtgttttatgagaatcactttccacagatcattaacacacaaccttcatgcatggaacctagcacaatcttaccagaacccttctccaataacccttgcgaaccaacagcagaaactacacaacacccagtacaagaacccatagatcaaacactgaaagccacttctccacaacctagacgctccacacgaaccaaacaaacacccacatacttacgagattatcaccgtgacctctcctcacacgataccaatgcatcaacgaaggttcgctaccctctaagctcagttctttcatattcacgcttatcacccacacacaagcatttcgttatgtcaattacttccacagttgagccttcctcctatgctgaagcatctcagcatgactgctggattaaagcaatgcaagctgaattagatgctctacaatcgaacgagacttggagattaactcctcttcctccacataaaacggccataggatgcagatggatatacaaaatcaaacaccgagcagacggttccatagaaagatacaaagctcgtctcgtggccaaaggttacacgcaaatggagggccttgactaccttgacaccttctctccagtagcaaagctaaccacagttcgctttcttcttgctattgccgctatgaacaactggcacctaagacaattagacgttaacaatgcatttttacatggagaattagacgaagaagtttatatgcaggttccgcctggcttgacaattcagaacccaaacttagtatgccgtttgcagcgctctctatacgggctcaaacaagcaagccgacaatggttcttgaagctttcaagtctcctgacaactcacgggttccaaaagtctcaattagaccattcacttttcttgcgttttactggatcaatcaccactatactactagtatacgtggatgatatcattcttactggaaatagcagctctgaaatacaggagatcattaccatccttgatcaaacctttaagatcaaggatctcggaaatttgaagtattttctcggccttgaagtcgcgcgttcctctaatggcattcacttatctcaaaggaaatataccttagatattttgtctgattcgggcatgttaggttgtcgaccaaatacgaccccgatggattactccaccaaactacataccactgcaggcactccattgtcagacgcagaatcatcctcttatcggagactagttggccggcttatatacctcaccaacacgcgtcctaacatcatgtacgcagtccaacagttgagtcaatacatgtcaagcccaaccaatatgcaccttcaagctgcctatcgggtccttcgttatcttaaaagtacacctggttctggtgtcttcttctccgctaccagcattcctcaactccgggctttcagcgactcggactgggcgggttgtcaagattccagacgctcgatcaccgggttcgtcgtatactttggttcctcccttgtttcatggcagtctaagaagcaaaacacagtttcgcgaagctcgtcggaggctgaataccgagccctagcttcgactacctgcgaactccagtggctgacttacctccttcaagattttcgcatacaattcatagaaccagctacaatttactgtgacaatcgttcagctattcaaatcgccactaatcctgtttttcatgaacgaacgaaacatatagagatcgactgtcatatcgttcgtcaacgcgtcacttcgggtcatctcaaattacttcccgtaacatcttccttgcaactcgcggatattttcacaaaagctctacctcctgccacttttcaaaccctttgcaccaagctgggaatgctcaatatccattcccagcttgagggggggatcttagcagatgctagtaagaattag

SEQ ID NO: 1061 - DNA, 102 bp, Glycine max
  Peptide Sequence Number=SeqID_117839
atggcgcgcccagcgcgcgatctgaacgcgctaagcgctaggtgtggcgctgagcgcgactacgaaggcccttgtaagccctcaatggccatgagtggctaa

SEQ ID NO: 1062 - DNA, 2088 bp, Glycine max
  Peptide Sequence Number=SeqID_117840
atgggctgcatatgttctaaggcttcagctgtagaggacagcaaggaagctgtcactgagaaatttcaatcgtatagcacaaggccttcggagttgaatgttttgcggttgaattcgactaggagggttgatgagggtggggtgaaagatgtgttaatagttggtggtcatgtgaaaggttcattgattgacaagaaggccaacggttcaggccagttgtatggtgatcatgatgcaaagaagaaattagagaagctggaattgactgttgtggatcatattggccctggaagggttccaaaggctattgaaggagagcaagttgcagctggatggccggcatggctttcttctgttgctggtgaagctattaagggatggataccacggagtgcgaatacgtttgagaggttgcataaaattgggcaaggaacttacagtactgtatataaggcacgggatgtgattaaccaaaagtttgttgcattgaagaaagtacgctttgacaatcttgatcctgagagtgtcaagtttatgacaagggaaatccatgttctgcgtaggcttgaccatccaaacataattaaattggagggcttgataacgtcacagatgtctcgcagcttgtaccttgtttttgagtatatggagcatgatcttacaggacttgcatcaaatcctgatattaagttctctgaaccgcagctgaaatgctacatgcggcaacttcttagtggattggatcattgtcatagtcatggtgtcctccatcgtgacataaagggctcaaatcttctcattgacaataatggagtcttaaagatcgctgattttggtttggcaagtttttatgaccctcagcacaatgttccattgacaagccgagtagtaactctatggtatagaccaccagaacttttacttggagccaatcattatggggttgcagtggatttgtggagcactggttgcatactgggggaactatatactggaaggcctattttgccaggaaaaacagaggttgagcagttgcatcggatttttaaactttgtggctcaccatctgacgactattggcttaaatcgcggttgtcacattccacagtattcaggccaccacaccattataggcgttgtgttgcagatacatttaaggactacccatctactgcggtaaagcttatagagaccctactttctgtagagccagcacatcgagggactgcagcagctgctctggaaagtgagttctttatgtcggagcctctgccttgtgacccatcaagtttgccaaaatatgttcccagcaaggagattgatgctaaattacgggatgaagccgtaaggcaaggagttgttggaggtagggaacaaaaagttgcctcaggagttagacaagaaaaaggacacagggcaaatgtcacagcaaaagacaatgctgacccaggcttagcagtgcagcaaggacactgttccagctcaaggaaccaaagtgaattatcaaaccctcatagaggatcggtgtctggaattctggttttccctcacaaacagtcagaaaaagaaatgaatgataatttctctgggcatctttataagaggccttcacattcaggcccattggttcctggttctgtctgggcaaaaggcaggaaagaagttgatgatgtgcctcctgtttcaaacagagtgaacctatcaaaactatctgggctagtggcatctaggactttctctgaagatcaggaggttaaaccagttcactcgaaccacagaaaaccaattgaagtaagaaaatccgtggagtccactaatggatcagagtcgagaagaaggcacgatcaaaaacagattgttgatctcaatcaaattgaaagtagaagggtcccggctgaaaaatcaactccgggtgggcgcgagtccatgggaaacaagatatacctctcaggtccattaatggtttcgtcaagcaacatggatcagatgctcaaagagcatgacagaaagatccaagagttttcaagacgagccagaattgacaagtcaagagcaagaggtgagaaagtttttgcacagcggaagtag

SEQ ID NO: 1063 - DNA, 637 bp, Glycine max
  Peptide Sequence Number=SeqID_117841
gaacaattcgatcaggtcaaaccgttgctcggcagcctggccggcgcaggctatcagggcgccatcgacgccgcgcgcaaaatattctggtgctgttcgccgccggcaacgacggcaactacaaccagccggatgtgatcagcgggctggcctacttcgtgccggacatcgcgccaaactggctgtcggtcgccagcgtggcgcaggatgcggcatcgaccaacagcgtgccttacaccatcagcagcttctcttcccgctgcggctataccgccagcttctgcgtctcgtcgccgggcacccgggtatacagctcggtgattgaaggcaccagcgtggagaatctgacgaccggctacgccaaatacagcggcacctcgatggcggcgccgcacgtggccggcagcgtcgcggtgctgatggagcgtttcccgtatctgaatggcgcgcaggtggcggaagtgctgaaaaccaccgccaccgacatgggggcgccgggcatcgacgcgctctacggctgggggatgatcaacctgggcaaagccatcaacggccctggcatgttggcgaccgtcgaggatattcccgaagaattccgcatcccggatccgacgggcgtggcctacggcccgaccca

SEQ ID NO: 1064 - DNA, 228 bp, Glycine max
  Peptide Sequence Number=SeqID_117842
atggacaagtgtcgtttgaagttgcagacaaaatttcgagaagatccaacggtcaacgaaggctgggcagcatttttaccgaggcagcttcatggtgttaccctggttgagtttagtcttacaagaggaatctgcgaacaatgcttgatcaggatttggctaaactatcataaggaatcggggtttagtatctcaggagacaccataagaacacatgagcattgttag

SEQ ID NO: 1065 - DNA, 330 bp, Glycine max
  Peptide Sequence Number=SeqID_117843
atggcaaggaaaagtgtgattcagagggagaagaagatacaaaaattggaacagaaatatcatttgattcgccgatcctcaaaaaaagaaataagcaaagttccgtcgttaagtgataaatggaaaattcatggaaaattagaatcactaccgcgtaatagtgcacctatacgtcttcatcgacgttgtttttcgaccggaagaccgcgagctaattatcgagactttggattatccggacacatacttcgtgaaatgagcaacttggtagctcgcaaggctcataaccttgaggtcacgggttcaaatcccgtctccgcaacattttga

SEQ ID NO: 1066 - DNA, 249 bp, Glycine max
  Peptide Sequence Number=SeqID_117844
gagcttgtgccagaggaggacgagctcattcctcctgagccatttgtttatgagactgatccagctagtgctcaggaggaggtagcatcaccagagctcattcctcaatcatctccaactccagttcttgatgatccacaaccatatgctctagcatcagtgcctgatcagcctattgttcaggatccaccagttgcactggtgttggatcttaatgagcatgcacaagatcattcccaggacttttaa

SEQ ID NO: 1067 - DNA, 1250 bp, Glycine max
  Peptide Sequence Number=SeqID_117845
gatccgcaacgaacagtgttggatcaagctccattactagcaccttttgtagcgccgggttcatcaacaactcgccagaagccaatgctgtcttggaagacgttcctgaagagagagtgcttgcatttgtcacacctggaaaacttgtccgcaactgggacgcggttgacatcccttcagtagttcatgcatcaaaactaggcatttatgagcccgttgaacataataaccctgcactctctcccaacttcgaatctcctgtctacgaggctgaagaggaggaggatgatgaaatcccgaaggaacttgctcggttattggaatatgaaaagaaaaccattcggcctcatgaggaggtagtagaggtgattaacttgggaaccgaggaagataagaaggaagtcaagattggggcatcgcttgaggcaactgtcaaacgaagggtgattgaattactcaaagaatacgtcgatgtgttcgcatggtcgtaccaagatatgcccggcttggatccccgtattgtggagcaccgtttgcctttgaagcccgaatgcccaccggtcaaacagaaactgagaagaactcgccctgacatggctctcaagatcaaagaggaagtacagaagcagatcgatgcaggttttcttgtcacatcagagtatccccaatggttagccaacatagtgcctgttccaaagagggacggcaaggtcaggatgtgcgttgactaccgggatttgaacaaggctagtccgaaagatgactttcctctacctcacatcgatgtattggttgacagcgctgcaaagtccaaggtcttctccttcatggacggtttctctgggtacaatcagatcaagatggcagttgaagatagagaaaagacatctttcatcacgccttggggcaccttttgttacagggtaatgccttttgggttgataaatgcaggtgccacttaccaaagaggcatgaccactctctttcatgacatgatgcacaaagagatagaagtgtacgtggatgatatgattgtcaagtcaggcactgaagaagaacatgtcgagtacttgctgaagatgtttcaacggctgagaaagtaccaacttcgactgaatcccaacaaatgtacctttggtgttagatctggaaaactcttgggtttcattgtcagtcagaaagctaccgaagtagatcctgacaaggtcaaggctattagagaaatgccggttccacaaacagagaaacaa

SEQ ID NO: 1068 - DNA, 646 bp, Glycine max
  Peptide Sequence Number=SeqID_117846
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattcacccacactctcctaacaccttttatgcaaaaaacgcatgccaagatcgtgcttcaaattcaattcacagcggtcgacgggtttgtggataatggcatggccacaggctttgattcagaccgggctggcggatgggctcgatttgggcttttattagattcaagaatatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 1069 - DNA, 534 bp, Glycine max
  Peptide Sequence Number=SeqID_117847
atggaaacgcgcgctgcaaccctggctggagccggtcgccatgccgcgctactggcgggtggtgacgacgattccgacgcgcaacagcaggacgacacgctcaccctgcgcctgctggcggctgccgacctgctgtggtttcgcggccacttcccgacgctgccgattctgccgggagtggcgcagcttgactgggtactgcactacggcctgacgcgcctggcgcctgcagccggtgccgccggatgcgcagctggagctgcagttgcagtggctgccggaaaagtcgctgctaagctgaggtcgccagcagcgggaagattcgcctgtgctgagtgcctcttttgcgccctgcgtgctgattccctgctacaaccacggtgccatgctggcgtcggtgctggcgcggctggccccgttcaacctgccggtgatcgtggtcgacgacggcagcgatgcccggacccaacagcatatcgctgcgctggatgcgccgcagctccgggtgctgacgctgccgcacaaccaaggtaa

SEQ ID NO: 1070 - DNA, 319 bp, Glycine max
  Peptide Sequence Number=SeqID_117848
atggcggccgtgacgctgaatcgccagcgcggcggcatcttccacaccaggcagcgccagcaggcgacgctctacttcgctcagcgacacgcgcttgtcttcaattttcaccacccgatcctggcgccctgccagctgaaactggcccgacggctgctgcacgatacgatcgtccagcgcacagcccgcgcggctctccagcagatcggagaagacctgccagcgctgcggcgcgatctcgcgcagcgaaacgtgggggaaacactgccacagcgcagcgtcatcgctggcccggcgccacgcgatcaccccggtttcg

SEQ ID NO: 1071 - DNA, 292 bp, Glycine max
  Peptide Sequence Number=SeqID_117849
gatgtgcgaaaaaaggcataggtcatccagaagcaaaacactgccccccacgtgttgtctcgtgaaggattcgttggaggagcaagcgtcacagggttcctttgtcgcctatggacatcaggatgtactgactgctgccattgggctaccagaatgccccggttgtgtgcgtgctgctggagtcggtgtgacgatcaagcaatactttggaccgactccaaggacgtcctacacgtcttcaaccatggctccagaagacctagagcagttgactcaacaaattagggactag

SEQ ID NO: 1072 - DNA, 264 bp, Glycine max
  Peptide Sequence Number=SeqID_117850
gcacgaatatcaagagaatggggacaatgtggcatgcgccatcacttcagaatacaccctaggccaaggccatcccttacaacccctcaatccaacccaaacaagcaacaatctgaggataaatccctcacacgaataatagagcaaaacggaatcaaaaacgcaaaaaatggtgacctaagggctgcaaaatccgtgagtcccgtggctcgcccaggcgagcccagctcgcccaggcgagcccagctcgcccaggcgagctaa

SEQ ID NO: 1073 - DNA, 210 bp, Glycine max
  Peptide Sequence Number=SeqID_117851
atggatccgctcagcgagatgcatccgcttagcaaggcatctagctcgcttagcggatgggaaaccctagaagaggataagacaaagatctgctcacccagtgcacaaccagctcgcccaacgaggacgttatctcttctcacgctcagcgcgcccactctcgctaagcgaaaattcactaacttgcgcttagcgagatatgctcgctaa

SEQ ID NO: 1074 - DNA, 755 bp, Glycine max
  Peptide Sequence Number=SeqID_117852
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctgcagtttcggcggcatcgcctcgtcgatctgctccagctcggcggccaccgcgcgcgccgaggccagttgctgcagtgccttgcgcacgcgctcgccggccgccaatgccagcgggtcgcccgcatagctgtccacctggtcgcgatgcgcgcccagcgccgacaggtgtcccagcagtgtgttggacagcgccaggaagcggaagccggcatccagattgcggcgcacatggccgggctcacgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 1075 - DNA, 564 bp, Glycine max
  Peptide Sequence Number=SeqID_117853
atggtcatccgcacacctttcaccatccagagacgatcgaatctgatggcacgcagagacaaattatggtcattctgcacctttttgtcatccataggcggcgagccggatgacatgcggagacaaattatggtcatccgcacacctttcgccatccagagacgatcgagtccgatggcatgcagagaaaaattatggtcattctccacctttttgtcatccagaggtggcgagcccgatgacatgcagagacaaattatgttcattcacacacctttcgccatccagagacgatcgagtctgatggcacgcagagacaaattatggtcattctacacctttttgtcatctagaggcggcgagcccgatgacatgcagagacaaattatggtcatccgcatacctttcgccatccagagacgatcgagttttttcactctcgtcgtccgaaaacattcacgtccagcgacgcgcagaattcttctctgctgggcaaagacgattgggtgcaatggcaaagggaagtgtcatggttgtccaactttgtcgttttcaaaacactga

SEQ ID NO: 1076 - DNA, 400 bp, Glycine max
  Peptide Sequence Number=SeqID_117854
gtttccgtcgctaatcacgggcctctgccagtcattcggggttcccgtcaccctaagtaaagtgatccgaccgccgatcacccgggccttcatcgagaagtactgcacgcctaggcaggtgcagggtgatgcacatcaggccgcagacgcaccgccaccacctcggcaggctgatcccgctggatcactaggcatagagcgttatctacaacacttggttcgccagcaggcgaccaaccaccgtgggcagtttggggctaaggtcgcatggcttgaagactggcccgaggctcaggtaggggaggagcctgtaggatccgtcggtgaggcagaggaggcccgtatggatgaagatatgactgacttgcacagtttcttgggaggaagcggagccacgtga

SEQ ID NO: 1077 - DNA, 432 bp, Glycine max
  Peptide Sequence Number=SeqID_117855
atggccccctcgctagaaatgtgcacagaggcgggtgaccatcgaaccccctgcgcgtcacgcaagcaggagggggatgcaatcgatttagagtgtagaggcgttggtggtgctgctgtcgcgcgtgctgcagcaagcaggagaacgccgagctcgaggtttcttgaccctatgtggagaagctcacaccttctttgcaaggaaatggggcgtgcattgcattgcaaggcaacgcaaccccctctagctcggcttgctgtagcaatcgggacagcagcagtaggacgtccttgctcttgtgcgcaagcgcatcaagggggggggtggccatccaaccccctctttgttcatgctgcgcttgcacatcaagcgaaaaaaagaacgctaaagggggttccgctgatatggattccttctgtccccccgacttag

SEQ ID NO: 1078 - DNA, 1083 bp, Glycine max
  Peptide Sequence Number=SeqID_117856
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtaaggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagat

SEQ ID NO: 1079 - DNA, 216 bp, Glycine max
  Peptide Sequence Number=SeqID_117857
atgaagatgaaagcaagcaaaacaagaaatgacttgaaagtctcggattcaaactcttaccggttgaagaacgaaaaacggaccaagaaaagtgaagaatggaggaaaatcttcacagatttgctcacggaaacatctcggaagcgttacggaagcacttcgactcgattttcttcgcggaaatgtggttttacccaaaatagccgaaatgcatag

SEQ ID NO: 1080 - DNA, 927 bp, Glycine max
  Peptide Sequence Number=SeqID_117858
gactacacgtcctcacctttagaggactgcacgcccttggcttcaaagggcttcacgccctcacctttagaggactacacatcctcgccttcagagggctacatgtcctcaccttcagaggactacatgtcctcacctttagaggactacacggctgcacgccttcgccttcaaggactatgcgtcctcaccttcatagggctacacaccctcacgttcataggtctacacgtcattggctttagagggctacacgcgctcgcctttagaggacaagggctacacgtcctcgcctatagaggactacacgtcctcccctttagagggctacacgtcctcgcattcagagcacaacacgtcctcgccttcagaggactacacgtcctcgccttcaaagggctacatgtcctcacctttagaggactacaagtcttggcctttagaggactacacatcctcaccttcagagggctacatgccctcaccttcagagcactacacatccttgctttcaaatggctacatgccctctccttcagaggactacacaggactacacgtcctcgccttcagagggctacacgtcctcaccttcaggggactacacgtcctcgccttcagaggactactcgactacacatcctcaccttcaaaggggtgaacgccctcgccttcctaggcctacacaccctctccatcagaggtatacacgtccttgcctctagagggctacaggccctcgccttcaaagggctccacaccctcgccttcagactactactcgtcctcactttcaggggactacacgtcctcgccttcagaggactacacgtcctccccttcagaaggctgcacgccctcgccttcacatggctacatgccctaacctttagaggactacacgtcctcgccttcagagggctacac

SEQ ID NO: 1081 - DNA, 216 bp, Glycine max
  Peptide Sequence Number=SeqID_117859
atggaaaatgttgaaattgtgagttttaggttaatgacacatgcatgcaacaactacgtatggaaggatctgatattaccctatcaagcatcccaatcccttgtcttgtcagatgtccgatatgacactggcacggacgcttgtgttcgggttgaatttgatatgtttgacaagtgttcacccgacactgacacggacggcttgtgtccggattaa

SEQ ID NO: 1082 - DNA, 960 bp, Glycine max
  Peptide Sequence Number=SeqID_117860
atgtccaaattcgacccctacacgcaccttggcatcactctgaaccccgacggcactgtcacgcgggccttcaaggccccaaccgtcgacgccaaccccgagccctcaccgggaaccaccaccgttagcaaagacataaccctagacacccaaaaagaaacatgggttcgaattttccgaccaacgaggctcccttccgaccacaacacggtggcgcggttgcccatcgtgatctacttccacaacggcggcttcctgttccacagccccgccaacctcagctgccacaaaaaatgcacgcagattgccagcgacgtcccctccgtcgtcgtctccgcctcctaccgcctcgctccggagaaccgtctcccggcgatgtaccacgacgcacgcgacgccgttttgtgggtgaaaaaacaaatgaacgaccccaacggagagcagtggcttaaagattatggagatgcttctagggtctacatttatggctgtgactccggggcaaatatagcgttcaacgtttccatgcaggttgctgacttggatttagagcctttaaggattcgtggattagtgatgaaccaacccatgtttggaggggaaaagaggacgggatcagagcttagatatgccacagacgaaacgttgcctttgccagtgttggacttgatgtggtatttgactttgcctaaggagacagaccgtgaccataggtattgcaaccctatggtgaagggaccgcaccttgataatgtgaagaagttgaggaagtgcctcgttattgggttccatggggacatcatggtggatcgacaacaggagtttgtgaccatgttggccaagtggggggcccaggtggaagctcggtttgaccaagtagggttccataatattgacatggtggacgctgctagggctagcgcgattataaatattgccaaggactttattcttggttga

SEQ ID NO: 1083 - DNA, 905 bp, Glycine max
  Peptide Sequence Number=SeqID_117861
atggtagagacactcattgtatcaatccccaaaattgatacaccgacatactttggagatttcagaccgataagtctttgtaagtctgataatgcgttaattgctcaagagattatccatcatatgcataaaaagaaggagaagaaggcctttatcatgttcaaaatattctttaagaaagcttatgaaagagttgattgggatttcttgcaccttacacttaaggattttggcttccctcctccaacaatcaagctcatcatgaagtgcactatgtcaacaacgttatccttgaaatggaatgggaagaaacttgataattttgccccaagcagaggcctcagacaaggtgatcccatgtctccttatttatttgttttatgcatggaaaaactttcccttctcattcagcagaaggtgcaagatagtagtacttgggtccctgttaaaattgctcagaatgctcctagtatatcgcatttgttttttgtgggtgactgtttattgtttactgaagccaagtcttcccagattcgtcttgtcatggaggttttggaagctttttgtggtgcttctggtctaaaagtgaatgtccataaaactcatatcatgacatccaagcatgtctctactatcaaagtaaacagatttgcggctatttctcaattccagcacactcgtcagatagggaaatatatggggttcccaatgctgacaggaagagtgagaaatagtgatttcaattatattttggagaagattaactcaaggctagctggctggaagatgaaactcttgaatagggcaggaagtcttaggggtccatggaagaggaaggaaggtgctgtggtggttgttgttgttgagagaaaactgaaatggaaggaagaattgaaagtcaaagt

SEQ ID NO: 1084 - DNA, 222 bp, Glycine max
  Peptide Sequence Number=SeqID_117862
atgccatttgcaccagcatttgagctagagcaacctatccctcaagattcaccagctgctcaggtgttggatctcaatgagcatgcacaggagcaatcacaagattctttaaatttcagtactttgagttggttgcttgtacaaaaagcttgtttgaacagtgaactggttgaatttgatatgcaatggattgttttgtatgaaatgagtgtctgcaaatga

SEQ ID NO: 1085 - DNA, 1104 bp, Glycine max
  Peptide Sequence Number=SeqID_117863
atgccgtcgcgtccgccgccgctctcaccacccgccaccgccgccgcatctcaccgccgcgagataatcctatgcggcgcaatcggcggcgcgctcttcctaacggcgttaataatctccgtcatgattttcatctaccgcaagctctcgtactcccgaacggcgccgttcgagcacaaccagcggcgtttctcgtacaccgttctccgccgcgccacgaactcgttctctccctccacgaagctcggccacggaggcttcggttcggttcacaaggccacactgccttccggccagaccgttgcgcttaaagttatggactcgcccggttcgcttcagggagagagagagttccacaacgagctaacgctgtgttcgaatctcaaatctccgtttgtgatttcgcttttaggtttttcttccgaccggcgtggaaaaaagctggttttggtttacgagcttatgccgaaccggagtttgcaggacgcgcttttggatagaaggtgcccggagttgatgagctgggggaagaggttcgacgtggcggtttcggtggcgaggggattggagtatctgcatcatgtctgcgacccgccggtgattcatggtgatattaagccgagtaatgtgttgttggatagggattttagggccaagattggggattttgggcttgctagggttaagaatgtggaggatctaggaatggtggatgagaacgagaagaagaaagatgaggaatttagtgttttggaaggggagagtgtggtggatgttgaccggtcgccggagagttgtccggtgagggctgcggagtattcggatgcttcgccggtggggggtgataagttgagtgttgtgtctgatggtggggggtgttttgagagtgttgatagtgggagtgtgagtgtgaatccgaagaagtgtggcgtcggtggcggtggtggtggttcggggagggattggtggtggaggctggagagtgggggaggaggggaatccgggagggtgaaggattatgtgatggagtggatcgggagcgagataaagaaggagaggccgaagagcgaatgggatgattcgtgttcgtcgtcttctccgaag

SEQ ID NO: 1086 - DNA, 757 bp, Glycine max
  Peptide Sequence Number=SeqID_117864
ttggtgggcctcgcttgacgaggagagggtgaaggggaaggcgaagaagaagaataggaagccaagggagtggtggaaggaggagttttgcgaggaattgtcgaagaagagtaggaagaagaagagggggatggagtggtggcagagggaggaggaaggggtggagcagaagaggaagaggaagagtaaagggagtagagggagtattgattggtggttggatgggttgagtggtgagatgaggaacaatgggaggaggaatagccaagattggggggttagtggggatgtgccaaagagtggtgggattagcagcacccctagtatgagagggactgtttgttacattgctcctgagtatggtggtggagggcaattgtctgagaagtgtgatgtgtacagttttggggttctgcttttggtgctggtggccgggaggcggccgctgcaggtgacagcctcaccaatttctgagtttgagagggccaatttgatttcctgggccaggcagcttgctcacaatgggaggcttttggatcttgttgacacttctatccattccttggataaggagcaggcgcttctctgcatcaccattgccttgttgtgtctgcagaggtcccccgggaagaggccttccatcaaggaggttgtggggatgcttagtggggaggctgagccaccacacttgccgttcgagttctcaccatcacctccctcgaatttcccattcaagacccggaagaaggctcggtaa

SEQ ID NO: 1087 - DNA, 168 bp, Glycine max
  Peptide Sequence Number=SeqID_117865
atggtcccaaatggactagaaaatttggaatgtgcggtccgaccaccaggcaagagcaatgaagcaattccacttgaagcaattgtacaaacaattccaccattggagcgtataccagatgataaggttgtccaaacaaatgttttgccagttccaccatatccataa

SEQ ID NO: 1088 - DNA, 816 bp, Glycine max
  Peptide Sequence Number=SeqID_117866
atggacactagcagtgacatcttgtggatcatgtgcaaccatgtaggtctactctttgacccctcaaagtcttccaccttttccccactgtgcaaaacaccctgtggcttcaagggctgtaaatgtgaccctattccattcaacatctcttatgtggacaagtcctccacttcaggaacatttggcagcgacacggttgtctttgagacaacagatgaaggtcactctcagatatttgatgtactcgttagatgtggccacaacattggattcaatacggatcccgggtacaatggaatacgaggactaaacaatggacctaactctttggcaacaaaaattggccaaaagttttcttactgcgtaggcaacctggctgacccatattacaattacaaccaattgatattatgtgaaggggcagatcttgaaggatattccacaccttttgaagtgcatcatggcttttattatgtcaccctgaaaggcataattgtaggggaaaaaaggcttgacatagctccaataacttttgagatcaaagggaacaacactggtggagtcatccgtgactcagggaccactatcacctacctagttgacatggttacattccattttgctgatggagcagatttggctttggacacgggaagcttttttaatcaactcaatagcatactctgcatgactgtaagtccagccagcatccttaacactacaattagtccttcagttattgaattgttagcccagcagagttacaacgtaggatatgacctagttaaccaattttgtttacttccaaagaattga

SEQ ID NO: 1089 - DNA, 993 bp, Glycine max
  Peptide Sequence Number=SeqID_117867
atggacactggcagtgacatcttgtgggtcatgtgcaccccttgcacaaactgtgacaacgatttaggtctactctttgacccctcaaagtcttccaccttttccccactatgcaaaacaccctgtgacttcgagggatgtagatgtgaccctattccatttactgtcacttatgcagacaactccacagcttcaggaacatttggccgcgacacggttgtctttgagacaactgatgaaggtacctctcggatatcggatgtgctattcggatgtggccacaacattggacacgatacggatccagggcacaatggaattctaggactaaacaatggacccgactctttggtaacaaaacttggccaaaagttctcttactgcattggcaatcttgctgatccatactacaattatcaccaattgatattaggtgaaggagcagatcttgaaggctattccacaccttttgaagtttacaatggattttattatgtaaccatggaaggcataagtgtaggggaaaagaggcttgacatagctcccgaaacttttgaaatgaaagagaacagagcaggtggggtcatcattgacacaggaagcactatcaccttcctagttgatagtgtgcataaattactatccaaagaagttagaaatctccttggttggtcctttagacaagctacaattgaaaaatccccatggatgcagtgcttttatgggagtataagtagagatctagttgggtttcctgtggttacattccatttttctgatggagcagatttggctttggattcgggaagcttttttaatcaactcaatgataacgtattttgcatgactgtaggtccagtcagtagccttaacattaaaagtaagccttcccttattgggttgttagcccagcagagttacaacgtgggatatgacctagttaatcaatttgtttacttccaacgaattgattgtgaacttcttactggttga

SEQ ID NO: 1090 - DNA, 1032 bp, Glycine max
  Peptide Sequence Number=SeqID_117868
atgcagctgcctcctcaattcaacttcccaaagtcacaacttcagtgctatggtgaatctatatattccaaaacttcagatttgttaagcaggtgcaacacggggcagaatccactcgaaagactcatatttgttgtagcatggagcatatccaccacacgaccagcaatttttggagttgctccctacaaccccactcttggagagacccatcatgtttccaaaggaaaccttaatgtcttattagagcaggcacatgcttttacattctgttacatgctcaatgtggtgtcacaccaccctcccgtatctgccctccatgcaactgatgagaaagaaaacatagaaattatatggtgccagtatcctgttccaaagttcaatggtacttcagtggaagctcaggtgcatggcaaacggcagctaaagctcatcaatcatggagagacatatgaaatgaattcgcctcacctcttgattaaaattcttccagtgcctggaattgattgggttggcaatgtcaatatcaagtgcatagaaacaggccttgtggctgaattatgctacattggtcaatctttctttggatttggggggagtagaagattgataaaggggaagatcattgattcatcttcattgaagattctgcatgaagttaatggtcattgggatagtactgtaacactcaaggaaacaaacagtggagaagtaagagccatatatgatgcaaaagaagtcatttatgggcttcaagctcctactgtgaaggatgcagagagtgtgtggccaactgaatcagctcttatttggagtgagttgagccaagccatcctaagcaaaaactgggaaaaagcaagagaagcaaagaaagctgtggaggaaaggcagagggagctcttgagagagagagaatcaaaaggagaaacttgggttcctaaacattttattctgtctcaaagcaaagaaggggtctgggactgttcacctattcaaaagtgggtcccagcatctcctattgtcaccttgtaa

SEQ ID NO: 1091 - DNA, 339 bp, Glycine max
  Peptide Sequence Number=SeqID_117869
atggaagaagccgggagtttgttgagagaaatgctccagtacaagaatgcggcagagttaattaacattatcaacaatgaggttgatactgaatcaataagtgatttccttgccactttgtgtgagcaaggaagggttcaagaagctgtttcagttctctttggaattgcatgttttggttcaagatcaagaagagttccacattcctcttgcaaaagtggtttgaaatttggaccttgtgatgacaaagatctgcaaggctttgacttctattgttctagaattgctgcactttgtgtcaaaggggagttggagaaagcaaatcaatcagcaacatag

SEQ ID NO: 1092 - DNA, 219 bp, Glycine max
  Peptide Sequence Number=SeqID_117870
atgaaacctaacttctcacaaattacaacatggaaagacatggaagacgaaagaaatacattatttcatctgttaaacctcggagactggtctccaaactcattcaccctggctcagttcgccatttccactacaagccaaatgaaacagccaaagactgaatggaactcgatatccaacactcggctgcacatttcgcctacaaaccagcacggatag

SEQ ID NO: 1093 - DNA, 3051 bp, Glycine max
  Peptide Sequence Number=SeqID_117871
atgttgttctacccaagaaccttgtccctccaaacctcactcaagcgcggtttcacccccactccaaaacccattaattgcttcctcctcttcctcttccgccaccgcaagttcaacctaatcacccacttcttctctcagttgaaatccaacaacgcccctaccaaccgcagaaccctctccctcctcacatggtcactcctcaaatcacacaaattcgaagaagcagagcaattcatgcactcccacacccacatcacccactcctcgatgtgggactccctcatccaaggcctccacgaccccgagaaagcactctccgttctgcaacgctgcgtgagagaccgtggtgtgttaccttcttcttccactttttgtttggtagttcacaaattgagctcaaaggggttgatgggtagggccattgaggtgctggagttgatggctggggatggagttaggtacccttttgatgattttgtttgtagttctgtgatttccgggttttgtaggattggaaaaccggaacttgcgttggggtttttcaagaatgttacggattgtggagggttgaggccaaatgtggtgacttgcactgctcttgtgggggctctttgtaagatggggagggttggggaggtgtgtggtttggttcagtggatggagagggaagggttgggtttggatgttgttttgtatagtgcttgggcttgtgggtatgttgaggagagggttttgggggaggtttttgggaggatgagggaaatggtggagaagggtataggccatgattttgtgagctatactgtgcttgtggatgggttttccaagcttggtgatgtggagaagtcgtttactttcttggcgaagatgataaaagaaggacatagacctaataaggttacatatagtgcaatcatgtctgcttattgtaagaagggcaaggtggaggaggcatttggtgtttttgagagcatgaaagatttgggaattgatctggatgaatatgtgtttgtgattttgattgacgggtttgggaggataggggatttcgataaagtgttttgtctgtttgatgaaatggagaggagtgggattagtcctagtgttgttgcatacaatgctgttatgaatggtttgtccaagcatgggcggacgtctgaggcggatgagttattgaaaaatgttgctgcagatgtgattacgtacagcacgttgctacatggatacatggaagaggagaacattccggggattttgcaaacgaagaggcgactggaagaatctggcatttctatggatgttgtgatgtgtaatgtgctgatcagagccctgtttatgatgggggcttttgaagatgtttatgcactttacaaaggaatgcctgaaatggatctgattccgaattcggtgacttactgcacaatgattgatgggtattgcaaggtaggtagaattgaagaggcacttgaggtatttgatgaatttagaaagactttgatctcgtcacttgcctgctacaatagtattattaatggcctttgcaagaatggtatgacagaaatggccattgaggctttgcttgaactcaatcatgaaggtcttgagttggatataggattacttgatgatgcaaatcatatgtggatgatgatgaaaaagaaaggcctatctgtcacatgcaattcttattattctattttgagagggcatcttaataatgggaatagggagcaaatttatccccttttgaatagcttcctgaaagattatggtctagttgaaccaatggtacaaaagatacttgcatgctacctctgtctgaaagatgtcaatggtgccattcgatttcttggaaaaacaatggataattcttcaacagtcacttttcttacctctattctcaagattctcataaaggagggtagagctttagatgcgtataggcttgtcacggagactcaagataatttaccagtcatgtatgctgattatgccattgtgattgatggcttgtgcaagggaggatatctcaataaagcattggatctttgtgcctttgttgaaaagaaggggatgaatttgaacatagtcatatataattcaataataaatggattgtgccatgaaggacgtcttattgaagcatttcggctattggattcaatagagaaacttaatttggtaccctctgaaataacttatgctacagttatttatgctctatgtagggagggatttttgctagatgcagagcatgtttttagtaaaatggtcctcaagggctttcagccaaaagtacaagtttacaattcattacttgatggaatttctaagtttggtcaactagaaaaggcatttgagcttctaaatgatatggagacaaaatatatcgagcctgacagtctgactattagtgctgtaattaattgttattgccaaaagggtgacatgcatggagctcttgaattttattataagttcaagaggaaggatatgtcacctgatttttttgggttcttgtatttgataagaggtctatgtaccaagggaaggatggaagaagccaggagtgtcttgagagaaatgctccagtccaagaatgtggtagagttaattaacatagtcaacaaggaggttgatactgaatcaataagtgatttccttggcactttgtgtgagcaaggaagggttcaagaagctgttacagttctcaatgaaattgtatgtatactttttcctgttcaaaggttgtccacttataatcaaggatcccttaaacaacagaagatttatgaatggaaggatgaaccaaaatcttcaagcattgtaccttcctcttgcaaaagtggtttgaatcttggatcctgtgatgacaaagatgtaaggaatctttcaacagataatggtggttatatgacaagatcccagctgcatggatttgacttctattattctagaattgctgcactttgtgccaaaggggaactgcagaaagcaaatcaatcagtaaaagaatttctttctgacctgacagagtctatgaactga

SEQ ID NO: 1094 - DNA, 288 bp, Glycine max
  Peptide Sequence Number=SeqID_117872
atgatggatattgcaatgacaatggtggtacacaataatgatgacatgaccaatgacaatgattatgataacagtgtgataataatggtggtgggaatgaaaataacagtggtaatggtggtagtggctattgacaatgatgatcatgatcctgaggacaggagtgaggatggggacctagaacaacatgctcgacatactcatccctacccccaccgagttgtcatgtctatacccaacagtctatacccaacagctactacatatacatcttttagtgtcaagtaa

SEQ ID NO: 1095 - DNA, 2493 bp, Glycine max
  Peptide Sequence Number=SeqID_117873
atgaggttgtggtggtttttggagtttgggtgtgtatttatagtagttcttctgtttggccttgtaaaatttgggaaggccgaggtttacatagtcaccgttgagggagagcctatcataagctacaagggaggaatcgatggctttgaagccaccgcggtggaatctgatgatgatgatgatgagaagcttgattccacaagtgaggtggtggtttcttatgctcggcaccttgaaaagagacatgacatgcttctggggatgctgtttgagcgtgggacatacaacaagctctatagctatagacaccttataaatgggtttgcagttcatctttccccagaacaggcagaaactcttagacatgctcctggggtgaaatctgttgagagggactggaaagtgaagaggctcacaacacacaccccacaatttttggggcttccaactggggtgtggccaacaggaggtggctatgagagggctggagaagacattgtgattggatttgtggactctgggatctaccctcaccatccaagttttactactcataatactgaaccgtatggtccagtttcgaggtatagaggaaaatgtgaagttgatcctgacactaaaagaagtttctgtaatgggaaaattattggagcacaacattttgctcaagctgcaatagctgctggggcattcaacccttcaattgattttgattcacctcttgatggagatgggcatgggagtcatacagcctctattgcagctggaagaaatggaattcctgtgaggatgcatggacatgaatttgggaaagcaagtggaatggctccccgtgccaggattgcagtgtacaaagcactctatagactctttggaggatttattgcagatgtagttgctgcaattgatcaggctgtgcatgatggggtggatatactcagcctttcagttggaccaaatagtcctccatcaaacaccaaaactacatttttgaatccttttgatgctacacttcttggagcagtgaaagctggtgtgtttgttgcacaggctgcgggaaatggtggtccttttcctaagtcattagtttcatatagtccatggatagcaactgtagcagcagcaattgatgatcgtagatataaaaaccatctgatcctcggaaatggaaaaatcttagccggacttggattgtcacctggtgaagcttctacacgtttaaaccaaacatacacattggttgctgcaactgatgtgcttctagattcttcagttacgaagtacagccccactgattgccagagaccagaacttttaaataagaacttaataaagggaaatattcttctctgtggctattcttacaattttgttattggttctgcatcaataaagcaagtctcagaaacagcaaaggcccttggagcagttgggtttgttctttgtgttgaaaatgtttctcctggaacaaaatttgatccagtccctgttggcattcctgggattcttatcacagatgccagcaaatcaaaggaactgatagattattataatatctccacaccaagagactggactggaagggtgaagactttcgaaggtacaggtaaaattgaggacggtttgatgcctattctccataaatctgcaccacaagtagcaatgttttcggctagaggaccaaatataaaggactttagcttccaagaggcagatcttctcaaaccagatatattagctcctggttcattgatttgggctgcttggtctctaaatggaaccgatgagccaaattatgttggagaggggtttgcaatgatatctgggactagtatggctgcaccacatatagctggaattgctgctctgataaagcagaaacatccacattggagccctgctgccattaaatcagccttgatgacaacatcgaccactctagacagagcaggaaatcctattctagcacagctatattctgaaacagaagctatgaagctggtcaaagccactccttttgattatgggagtggacacgttaatcccagagctgccttggaccctggcctcatctttgatgcaggatacgaggattatctagggttcttgtgcacaacacctggcattgatgttcatgagataaagaactacacaaactccccatgtaacaacaccatgggccacccatcaaatctaaacactccctccattacaatttcccatctagtaagaagtcaaattgtcacacgcactgtgacaaatgttgctgatgaggaagaaacctacgtgatcacagccaggatgcaaccagcagttgccattgacgtgaaccctccagcaatgaccatcaaagccagtgcatcgcgtaggtttactgtgacactcactgttcgctcagtgacaggaacctatagttttggagaggtgctaatgaagggaagcagagggcacaaggtgaggatccctgttctggccaatggatactcaagatag

SEQ ID NO: 1096 - DNA, 219 bp, Glycine max
  Peptide Sequence Number=SeqID_117874
atgacaacaccatgcataagcttcaagaaagctatggggcaaataagaatttctcacccggtaggtcgaaaacccgaaaggggagctaaggcaaaagttagggtaactattgtcgtagcctacccttcgatgggaggacgagcgaaaatccaaaggagcttcttccaaaaaggaaaacacggtgttgaccttgctcctaagtatcctcaggtgcaatga

SEQ ID NO: 1097 - DNA, 267 bp, Glycine max
  Peptide Sequence Number=SeqID_117875
atggagacaatgacatcgaccaatgatgtgatggagcataccacaatagtcacacatgagtttggatgccaaggtagaggagtcaactgttgcaagaggaacctctatagtagcaagatagagagatggtgctcaacgtctaatgagaggttgatgtcgattgtggaattgttgcttgaaaatgaagttgttttggtttggtttttgagtttagaggtgtggtcaaagatgggggggtttgaattttgtggaatagcaggcggatga

SEQ ID NO: 1098 - DNA, 696 bp, Glycine max
  Peptide Sequence Number=SeqID_117876
atggttgaagtacatggaagagttgcactttctggtggctattcttttcctgatcatgccggaacaacatatgttgttcccatatcccttgaagctaaaaatgaacgctataaggtctatggtggcaggtcaaaacatttgcaagaagaacttggcataacaatgcatattgttcccttatcacttggtcatggggatgaaggctattgggtctatggtggtaggtcaaaatatttgcaagaagaacttgggagaacaatgcatactattcccttatcacttggtgctaggaatgaaggctatcaagtctatggtggcaagtcaaattgttttcaagaagaacttgatataacaagagctcatagatcaagttatccttttactttgagagacacattgttgaaatcgtcaacatcaactaatgttggatatcctaggaaagatcatgttagatcaatggatattgttcactcatcacttggtgctagaaatgaaggctattttagcaatgtctatggtggtagttcaaataattggcaagaagaacttgatagaacaacagctcagagggcaagttattcttttgatggagtaaggtctgactttgagaggtacactactaaagtgcttgggaggtttgttcagagccgaatgaatatcttgatgaaagagagaagggtgtttgttgagtcctga

SEQ ID NO: 1099 - DNA, 390 bp, Glycine max
  Peptide Sequence Number=SeqID_117877
atggcggaaaggctctatcagaagaggaatacaccaaggtacacagcttcaaaagtgccaaacaaattaacaacactaagggctttaaagaatcttgaatccatgtcccttgaagaacttgttggtaccctcaaggttcatgaacaagaacttcagcaaaacgaaggacccaagagagagaagtctttggctctcaacagccaaaagaataaaaaggtcttatcgtctaaagaacacatctcgagaaactcgttcaaagcccttaaatttgataattcctctaatgaagaatctgaggaaaactctgacaaagatgaactccccttcatctcatggaagattcgcaagatgtggaaaaacaaaggtggctccaaatggaaaaattcctga

SEQ ID NO: 1100 - DNA, 852 bp, Glycine max
  Peptide Sequence Number=SeqID_117878
atggctacttctaactcatttggtgtcgagatcattcaaatcatagtgataaccatcatacatactgacaatgagccctcaatttatattgagcattttttcgatattcaaaaacttgagaggattggtctcaaaatcaacgagacacttctcttttgtggagcgagacacttcttcaacgagcctcaaaccatctatccaaaacttatcaaaacatattggaggaatgttgagttttcaaatcgcaaggaaggacccattaagaaggataggagaaaaactataactcatgttgcaagggctctgtacaaggagaatattgacaaagccaacatgcttaataaaagtgttctccacaaaacaagatcaaagacatctctatcagatcttcacaagtttgtgctctttcacttgatggagaatattccatttcacatgcttaacactatctacatcaacattatgaggaatttgaaaggcttaggtagtcgagacaacatctgctacgctgccttaatcaacaagatgctctgggatcaaggcaacctcaagcaagctcctcaggtggacctggacgcaataaacaagaggaagcagaagaggcttgttaaggctatcactaatgaagataaagacctaagtgaaactgatgaagaggatgagggatttgtgcagatagctcttcaaaagcaaaagattgccacccaagttgtccctacccaaaaagagcaaaaaatagtccaaccaactcctgaagaatggacaatctccttcactggcaacaaggagaatccaacttcatcttcttcagataatgagtcaactgatgaaactcttgtctcccctctctga

SEQ ID NO: 1101 - DNA, 828 bp, Glycine max
  Peptide Sequence Number=SeqID_117879
atgtatatgagagatcaagccactgcctaccctccaggtttgcacatctcaaaggccaccaatatcaagataattattgataaggttgaagttgtcaactatccaaggaactggagttccttgtttagtggaaagaagttcatttgtgctccaaatgaatatgatgtaagaaccttctggaatcagatcatgtgggctgatactttgaaggtctccacctctagttatgatggaagcgataaagttgttcaccatgacattattcaagtgttacattcagtcaggaagtatcactttgatgatgcctgtgtctgtttcaccaaggatgctaacattgaaacttctactaaagttgtggatgataccattgtatgtgggatcattactgatcttactaacaccggtatcatggatgaaactccaaaggcgtacaatgcagctatagctgataaggttgtccatcaagacaaggaacctacgtccaagcagtccacaaccttaaatgaagctacatcaagagagaagggtgaacttgatattgtcattatctacttcaccacctcaggacttgctcctttcaactatgcacaccacattattgtaactagagatcaagtgcaagacatgattagtcaagccatggaatcatttgcagaacgacaaaggcaagaaaacaaagttgttgttgcacttgcacccatgcctatacctatatccccaacacttaaaccaacaccaccatccattgaaccaataccattgtccattgaaccaacaccttcacctccaccatctttacctccaccgccaccactagttcaagactga

SEQ ID NO: 1102 - DNA, 924 bp, Glycine max
  Peptide Sequence Number=SeqID_117880
atgtctgaggaaactcaccaagaaaacaagaacgcaattgagttccttgatgaatacactttctattatgacgaggaacatgagaagtgcataccatgctacaaagaagactcaacgaaagtagtcttgaactcagtcgactttgacttcaacaaccataacaaagatttagataagttcttgaagaatcttgccactcgtgattcttcccctcagcttgaggttcttgctcttgctccttcaacttatgaggttcctgtcattcttgctccaaccactagtcctattgttgatgcccctaccaaagttcttgctcttgccatcgatgaggttgttgctcccaccttaggttcctacccttcaaagggtcttcatcctgttcctacccctcagagaagagttcttggtcatactgctcttgcacctcagagggtttatacttttctcgatttggttcctgtactgtctgcccacacaactcatgtttgtgcccctcagagggtttttgcctctcaggttcctgccaagtcactggagcagacattaaatagcattgcatttgagcaggtgcatgtgccaatcagctaccaacaccacttgctttcgcataatacgaagtccaatagcatcaaattatttggtgactcatcccgatcagttcattgcaacaaatacacacattggataaaagaaggacataggtcatttgtccttgggcttgagaaatatgaacatggaggatggaaaaacatttcaaagaaatttgttccaacaaaaactccaactcaagttgcaagtcatgctcaaaaatatttcgaacgcaagaaagccccaaagaaagagaagaaaagaagaagcatccatgacacaaccttagaagacattgacatgattgttactccccacattgatcaacataattag

SEQ ID NO: 1103 - DNA, 354 bp, Glycine max
  Peptide Sequence Number=SeqID_117881
atggaaccatcagttgcctttcccattggctctggtagtgatcttgttccagggcctgctgctggagtgtttccttcaaggggtggtcatggcattggtggaagcatgctcgtagttcaacacttggaagcagggcctaatgacccccgttggtttggtggtattggtggagatcctgcttttcctggaggattgccgggtgttcctcccggtgcacgatttgatccctatggacctcctggtgttcctggttttgaacccaacaaatttgcaaggaatcctaggaggccaggatacgacgctcatccagatttgcaacatttccgaagagatgctgattcagactacatatag

SEQ ID NO: 1104 - DNA, 1335 bp, Glycine max
  Peptide Sequence Number=SeqID_117882
atggattcggacactgaagaaacaaaacccaagcatcccaagaaggagaagaaaaagaagaacaagaagaaagaggttgaggttgtccaacctcaatctgaacagattgaggttgaggtcgaggttgtccgtgagcaccccaataaaacacctcctgttgttggttatttcccttccggatttgatccggtcaagaatcatggcggcggtccctccaattttcaagtttaccggcacaggagcatgcccaagaggctggagcttgtggttcgccctccccggtcttcagtggaatttgttggaaccagttatgctggcgaggctgcggccagacaccgtgccaagtacgcacttggggttcttgacaaggaagccgggaccctgaaggttgtgcccattgctggtaataagatattcagattggagccgaaggttaaaggcgtgggagcttttgaaaatgagcctgcaaattcaacgttggaagagatgactcagcagcagaagtttgcggagactacttctatatggggaacaaagaaggatatagagaagctgtttgtggagcatgcagtgtgctgcttatcatggcatatgtttgtgcttttccttcaggctaaaaagaagctagctctcagacaagatgaagatcctgattctcaaaggaatctggatgtgaaaatgaaaagtgttacagtaaacaaaaaggctcttgaaagtacagaatctcatgtttctcgcaatataccaccgtatgatgcttctgcaactacacctcaggaggcatatatattggacaaaatcatccttaagggagaatgggattatcttgaagacatttataataatttgcaacggggagaagaagcagacttcagtgcttatccaacttttgttcgcaacaggatagaaagattgaggaaaattaaggatgagtcagaaaagaagcagctttcctgcatattctcatacatcaatcatcttataaagttcaaagatcagcattcctttgatgttttgtcggcaaagggccataaaatccccaacattctgcgtcataagttttcaaatatgtttgctgtttctgaatcaaaaaggctgccccctgaaaagattagtcttctcatttgttatgtgttggtgcttacgcttttctctgatgagttccgaactgactacacagatattgcaaaggatctgagcatgaacatactgcccgtgagacaactctatgagcatttgggttgcaaaatttcccgccagaaaaacatattttatgccacacttcctgtccctcttaaatttcctgagttgaggcagaggaagcggaaaaggtag

SEQ ID NO: 1105 - DNA, 315 bp, Glycine max
  Peptide Sequence Number=SeqID_117883
atgcagagggggtctcaatctaaaccatttgatgtaaaaatgggagatcgctcaaaggatatgattcgtgatcttggacaagaatcttttcagcaagcacatgcccctatgtatgatacattgcaaattgattcaaagaagcctttgtatccggggtgcaagaattccttgacgctattttcgacggtgttaagtctagttaatgtgaaggccaaatatgggtggagtaacaaaagctttagttcactgcttcaagttgtgcacgatatgcttccaaagcaaaacacattgcctaaaagttactatcaagcctag

SEQ ID NO: 1106 - DNA, 2613 bp, Glycine max
  Peptide Sequence Number=SeqID_117884
atgccgccggcgctgtcggatccgctgtcggtgactccggcgagctccgacgctgttttgcagcgatcggcgccggagaatcggcgattcggtgatcttagagggctgcagtggcggataaatcttggggtgttgccgtcttcgtcttcgacttcaattgatgatcttcgtcgagtcaccgctaattgtagaagaaggtatgctagcttgagaaggcgcctactggttgaaccacatgttccaaaggatggaactaattcacccaatcttgtcattgacaatccactttcacagaatccagatagtacgtggggtcgctttttccgcaatgccgagctggagagaatggttgatcaggatttatcacgtttatacccagaacatggcagttattttcagactccaggatgccaaagcatgttgagacgaattttattactgtggtgtcttaggcacccagaatgtggttatagacaaggaatgcatgaattacttgctcctctgctttatgttctccaagttgatttggagcatcttttggaagttcggaagctttacgaagatcactttactgacagattcgatggccttttatgtcaagagaatgatctttcttacagctttgattttaaaaaatctccagaattgatggaggatgaatttggttctcatggaaattctgtgaaaggcaacagtcttgaggaacttgatcctgagatacagaccattgtattactaagtgacgcttatggagctgaaggtgaactgggcattgttttatctgagaaattcgtggagcatgatgcttactgtatgtttgatgctttgatgagtggggcccatggttcagttgcaatggctgatttcttctcttcgtcccctgtatctgggtcccatagtggcctgcctcctgttattgaggcttctactgcattgtattatttgttgtctcttgtagattcatctctccatacccatctttttgaacttggggttgagccccagtacttttctcttcgatggttgcgagttttatttggacgagaattttcacttgccaacctcttgatcatatgggatgagatctttgcatcggagaatagcagcatgggaaaaggtgctgatgactgtgagttcaggatcttaaactcacctcgtggagcatttatctcagctatggcagtagctatgttacttcatttaagatcttcactacttgcaactgaaaaccctacaaggtgtcttcagagattattaaacttccctgaagacattaatattgaaaaactactagagaaggctaaatccttgcaggcttttgcactgagtgtggatatttcatcctcatcacttttgtttcttgggtctcattaccaaagtaaatctatgtatactacatctgtgacccttccatctgaatctgtgtctccgaaaactcctctgaatttgttacctgatagctattgggaagaaaagtggagggttgcccacaaggctgaagaactcaggcaagatagtctagaaaaacaggttcccactcggaaaaagggatggacagaaaaggtaaaattcagtttgagaagagcaaaatctgaccctcctttgtcaaggattcagagtggcagaaattttaggcgcagtttgttggaagatcttcgcaaggcacttggctcagaggaagatgctgagaaaatgcagcccgatgaaacactacgccagcatgataatccttctgaagcagttgaagtaaaagaagataatggctgtagtggtgacaacaattacttgtctgatgatagatctccaagtggaaattctggcagtgaggaagacttgtctatatattctgagccaactagtccccctaatgaggccaatgatcatgaaattacctcagtgaaaagtagtgttgcatctaattcacccctagacgaatgcaatgaaacttcaggtaccagttcctcatttccaatctccaatcttccagagaacatttctcagacatcacagtgcaatacagaaaattctgaatgcaacgaaactttgcataccagtcccaatgatccaccccttccaatctccgatcctcctgagaacatttctcagacatcacggtgcaatacagaaaattctgaatgcaatgaaacatcagatacccgtcccagtgatctgccccttccaatctccgatcctccgaagaacatacctccaacatcagggagcaagaacgatgaagcaggaaatacagccactcttcctaaagacaaaaaacagaataagttgcagtggttttggccgtttggacggaataatgctgaggcaatctctgagaaagcaggaggtgctgcagaagctgccaaccgcgatagcactcaaaacaatactccacaaccagcctcatctgtagctaatgagccttgtagttctgttagttgcagtggggaatctgttgacaagaatgtgatgggcactttgaagaatattgggcagtctatgctagaccatattcaggtaattgaatctgttttccaacaagaccgcaaagggcaagttactgccatgacagctctcaaagagcttaggaaaattagcaatattctgtctgagatgtga

SEQ ID NO: 1107 - DNA, 435 bp, Glycine max
  Peptide Sequence Number=SeqID_117885
gttaagaatattgatcaggtagattcatgcaagattacttcagtgaagttctcctgtgcaaaagaagttgtgtcgcttcattcacggaaaagtatggaaatagttgtgatacgggatttcgatagagaaaactatgttgagtttatgtatggaaaaactagattagtattagggaagatggggctagaagatcccataaggagcaagtataaacttatgctaagttgttcacttattattacttttgtgattcctcctgagttaccaatggaattatcaatagttgttaatacttccctgactgcactggcacggcatgacattttttgcacagagccttttcgaataccatttgtcagaaaggttgatatatgttgttttgacaagacatggacacttacatctaatgacatggtatgtccatatgagtcatga

SEQ ID NO: 1108 - DNA, 231 bp, Glycine max
  Peptide Sequence Number=SeqID_117886
atggatatgacaattaaggacaatgttgttggagagaaatttaagaggtttaataaggctgaaaaggctcattatctttctttggtaggaaagaccactaatgatggagtaggaggtgttcatgagcatactatgaaaatggtgaattggtataataaatggaaatccatgaatgtggagttaggagaggactttcttatttgccaagtgtttgaatctcttccatcttag

SEQ ID NO: 1109 - DNA, 735 bp, Glycine max
  Peptide Sequence Number=SeqID_117887
ccacaagacaaagaaaccaccaagactccaggcaacaaattgcgtcaagataccaagctggtcaatctggtgagaactgcgattgacaccgcctcaaatgaggatggctgggcgcatctgggaccagttgggtccaatattgtaaaaaatgcacctgaattcgaccctagaaactatggcggtgccgtcaaagagatggcgcaactgattgcacgcggcgttgaaagtattgctggtgtaaaagcgcgcgtgcgcacggtacctaaagtttctgccaactgtgaagcgactgaggcggacatcccatcctccggagccccttatgcttcgctacaggaccttgaggaatgtgccggattggccttaggcagccccacgcgttttggcaacatggctgcgcctatgaaatactttctagatggtacggcgggactctggctcaaaggctcgctgattggaaaaccagcagcggtctttacctctagcggatcgctgcatggtggtaacgaaatgactctgatgacgatgatggttccattgatgcatcacggcatgctgatgctggggctaccatactccgagccacaactgggaaccaccaaaacaggcggcacgccttacggcgccagtcatatcggtggcaccatggatgaccagccgatttctgaggatgagaaaaaattgtgcatcgccctggggaaacgcctggctgaaactgcgctcaaactgcaataa

SEQ ID NO: 1110 - DNA, 427 bp, Glycine max
  Peptide Sequence Number=SeqID_117888
atgtacaattatcatgagaaaggaagagctgctgatcttgaaagtgtattggcagacttcatgacatatcaagctagatctaaagatcatcaatgggaatcagaatggcaaccttattatcacaatgaagcagaaggattgtctaatctggatgacttgttaatgcaattcaaggataccgtagattcaatgcaaaaagcatttaaaagagctaagactcagattggtaagttggtggacaacatgactaaagttgtggtcagaagagaagaaaagtatgcagagattgaaacacatcaagagagcattcttcaagttaacacaatccatcatcaattgatcgccaaagaagaaaaggatgaagtctccattattcctgaatatccctgcatggcaactattggatatgttgtaggcaaagataaag

SEQ ID NO: 1111 - DNA, 504 bp, Glycine max
  Peptide Sequence Number=SeqID_117889
atggtcactggcaggggtctgggcagaggagatcgtgatgattctgatgattctgatgatgctctacagcgtcgacggcctactgcatccgcacggaggcagcgagtcgctgtgactgcggatcacgtcgatgagccaatcatccctacgccagatgttcaggatgacccgatggaggcaccagctgctgtagaggacattcctgcggacattcctgcgaacacaggcgcagaggttgctgaggatgagcatcagggatttccgggtggtccgagcgacccatccgtgttgaccctgtatgcggatcacattgcttgtagcgtatggacgggagaggagcgtcctgaattgaagctatcctctcatgggaggaaggtccacagtttaggcaggcatgtccctgccattgagggacttattgctggtacaggactaagtcctctgatcgcgtgttcggtagacaccggtgatcggggacttttgtccgcgtttgtgaagcggtga

SEQ ID NO: 1112 - DNA, 348 bp, Glycine max
  Peptide Sequence Number=SeqID_117890
atggcggaaaacccttccgaaacggtgttgtccagttcccaacctcctcctcctcctccttcttcttcttcttcttcttctcagaaatcgccccaagattcgccgcaggtccctgcattgtcgaattttatgccctttccgagtggatattattatcaaatgattcctggtatgtaccctgcgctagttccagggttgactttgccgcaacatgaggagcatgggaaccgcggagctggcatatatgctgttcccgttaacccgtatgacagacaagttactggacttccatacaacacactgattccgctgacttaccgcacacccacggttattgttagtgtgtaa

SEQ ID NO: 1113 - DNA, 789 bp, Glycine max
  Peptide Sequence Number=SeqID_117891
atggtatcagagcaacagattcttgtggagaaccctataagtcttcttcacaaaactaaaatggctgaagctcaacacatctcctcacctatgacctctacatgcaaactttcaaagagatgtaatgatctgtttcaggatcctactttatataggtctgtggttggagctttgcaatatgccacattaactaggcctaaaataagttttgctgtgaacaaggtttgccaattcatggctaagcctttggactctcactgggtggtaaaaaggatcctaaggtaccttaaaggtactctatttcatggtcttcatatgagacctgctgctgctggaaaatcattgacactaacagctatgtgtgatgatgattgggcctctgatattgatggtagaagggtccaaatcaggctctgccatttatttagagccaaatctgatctcttggtggtcaaggaaacagctagatctagtactgaagctgagtatcgcagcttagctcagacttcagcagagttgacttgggttcaggctttgttacaggaacttcaggtttccttctctacacttgcactgctctgtgataatcagagtgccgaagccattgctcacaatccagtcttccatagtcacaccaaacacatggagattgagcttctgatataccacattccagctctggatcaatgggcggatgtgctgaccaagcctctctctccagccagattagagtttcttagaggcaaactcaatgtgaagggtttttcttctgaaaaaccttccccttaa

SEQ ID NO: 1114 - DNA, 165 bp, Glycine max
  Peptide Sequence Number=SeqID_117892
atggaagaggacaaaagggtgaacttgactacttttgaaaagaacaagaggaatcaagttaatcaaaaggaaatattcctactcataaagacaggttgtccaaagtttaagaattggctcgaaaagaaagggtatggaaaacctaaggaggccaatgaaaaataa

SEQ ID NO: 1115 - DNA, 276 bp, Glycine max
  Peptide Sequence Number=SeqID_117893
atggctaaaccaagcagccccgcaaacttggcatcagccatcatttgtttctttgcctcaaagaagttcccccatagactaaaagcatcaccgggaagaatttcatcaaaggcctacaagctctacttggagctacattacaaaggggactcctatgctcaagtaataatgtgtgttaggagaataaaccttatagatagacatgacaatgaggtggggacaaatattgtctccccaatccctgaccccgactccccaacatgtctccatacctga

SEQ ID NO: 1116 - DNA, 1128 bp, Glycine max
  Peptide Sequence Number=SeqID_117894
atgatacctcttcagatgaggaatcctcttcatccatccagtgactccgaattggtacctccaactgcaaatacagaggcaacaaaaccctgggttaacctgttcaaggataacaggaaaccctccaaggggtttggattgcaattttctcctccctcagctgaagaagtactgttggatgattcagacttacaaccactggaggaggcttggggctatagccttattggctatgtagctggcagatttccgaggaaaaaggctcttatggaatgctgccagaaatggggtgtgaatttttcatattcaacccatgagagtggctggttggtattccgatttcagaatgaagaggatatgaaccaagtcatatctgcaggaccatacttcattttccaaagacccctgttattgaaggtaatgcctcccttttttgattttggaaacgaggagctcaacaagatccctgtgtggctgactgcctctaaaggctctatatcttttgcccgcgctctagtggaggtggatgcttctatggacctcattgaagaggtccgctttagactcccaaatggtaaggtcttcactcagaaagttgaatttgaaaacaggcccacattctgcaagcactgcaaaatgattgggcaccgtttagccaattgtaaagctgtgcccggagctaaagatgaccctgccttagttagcacccctgtggttcaatcacaagtggttggtccagcagatcttgatgtgaccaaaatccttaatagttctggaactcagaaggttcagcctaaccagtctgctgccagcatccatattagctctggaactcagaaagatgatcatcctaaccagctggctgcccctcatgtccaacaatctcaaggtgctatttttgttcctgttcataagcactcatctgtgctgaaaggagcaggtggtgctagatatgagcctgacgaggagggttttattcaggttaaaaccaaaactcaaaagaaaataaaaaaggtgccttcccagaagccagcacgagttgatgagatgcaattagatgctaagactgggagaccacaaaaatctggcagtaggacaggggaggcttcctcccgcccacaactatga

SEQ ID NO: 1117 - DNA, 1020 bp, Glycine max
  Peptide Sequence Number=SeqID_117895
atgatacctcttcagatgaggaatcctcttcatccatccagtgactccgaattggtacctccaactgcaaatacagaggcaacaaaaccctgggttaacctgttcaaggataacaggaaaccctccaaggggtttggattgcaattttctcctccctcagctgaagaagtaatgttggatgattcagacttacaaccactggaggaggcttggggccatagccttattggctatgtagctggcagatttccggggaaaaaggctcttatggaatgctgccagaaatggggtgtgaatttttcatattcaacccatgagagtggctggttggtattccgatttcagaatgaagaggatatgaaccaagtcatatctgcaggaccatacttcattttccaaagacccctgttattgaaggtaatgcctcccttttttgattttggaaacgaggagcttagcaagatcccagtgtgggtaaagctcagaaatctgtcccttgagctgtggaatccccaggctctaggaaagattctttccaaagttggtctgcccatccgtacggaccagctgactgcctctaaaggctctatatcatttgcccgcgcactagtggaggtggatgcttctatggacctcattgaagaggtccgctttagactcccaaatgccaattgtaaagctgtgcctggagctaaaattgatcctgccgtagttagcacccctgtggttcaatcacaagtggttggcccagcagatcttgatgtgaccagaatccttaatagccctggaagtcaaaaggttgttcaacctaaccataactggttgcaaagggcccggtcaagcttgctccagactctgtcattggtccaagaagttggctctgctccattgaatctgtctgatggagagaggatagtgttgaaatctctagtgaggagccaggggcaatccatggtggcattaatcttgttcagacttacccataaggaccttctggccacaacagaatgcagcccataa

SEQ ID NO: 1118 - DNA, 692 bp, Glycine max
  Peptide Sequence Number=SeqID_117896
gcaaccaattcaatcccatctctctctcaaatcacgacgacgacgacgatgttcggtgtcctccgctgcaaggccgggcccctccgccgcctcccctccctctctgtccccctccgacggcgatcgagcaaggcagcggcggcgatgggggaggtggacatggcggagtacgacgtggcgctgaagcacttcgacgacctaattcagcgtatactcgtcaagaagaacacaccggactggctccccttcgtcccggggtcctccttctgggtcccaccgcgcccctcccattccaacgtcgccgacctagtccacaagctcacctacgaggaccaccgccgccacccccacgattgctcccccctcctctccaccctccgcggctggccctccggaaaattgagggaaaagggacatgggtgtcggcaacttcaaatactgcattagctgcatttgtgagcaatttcttcatcgatgggaaaattgagggaaaagggacatgggtgtcggcaacttcaaatactgcattagctgcatttgtgagcaatttcttcatcgatgagaatgaatctactgatggtgaggatactgatatagagataaatggcctagacgggacaaatgggactgtgaaagtgaaggttctgacattttcagaaaatgtagctcactcagaagatgaggaaggatga

SEQ ID NO: 1119 - DNA, 117 bp, Glycine max
  Peptide Sequence Number=SeqID_117897
atgaagatcttacttggtggacgaagaagagtgggagtagatgtggagtatggggacacaccagtgatggaagatggacaaaaattggaaagtcaaaaaagtgatttggggaagtga

SEQ ID NO: 1120 - DNA, 441 bp, Glycine max
  Peptide Sequence Number=SeqID_117898
atgcattttacagtgcaggacaatgaggggcaaacagaaacatatttggaagaatgggaaataagctatagagccaccaaccgcaaaatgtcagacacaaggcaaataaagagagcatcagcacaaaagatgtacataattgaacgtaagaatcatcgtgatagcctgataggcattccttctataatacttccgccaaagaggaagaatgaaaaaaaagtcaaagtactctacgttaatcagtcagggaagtacccaactaccctgcccaaagggcatactcttagttaccctcctacatcacataattgctgcaaggatatgcacataaggctgagtaatagaaggcacaagcacagaagaaacttccaagctaaagaagcaagctcaccgcagcaactggcttggctaaattatggatcatccttcctcatcttctga

SEQ ID NO: 1121 - DNA, 342 bp, Glycine max
  Peptide Sequence Number=SeqID_117899
atggatatacagaacaacaacccatttgatcattacaaccaacaggatccctttgcaatgtccaacaacatagcacctccccctagtgtgcaaatggcactaatgtctcaacaacagcagcaacaacaaatgatgttccaacagcagcaaatgatgtaccaacaagcacaacaacagcacaacaacatgatgatggtcccttaccaccagcaacaaccatataaccaataccctcaacagatgtataattcaagttctcataatccatttggagatcctttaccggtaccaaactataatcatagttccatgccccaacagggaaattacaatttaatgtaa

SEQ ID NO: 1122 - DNA, 216 bp, Glycine max
  Peptide Sequence Number=SeqID_117900
atgacaagacatgacgcagtgaaagctctaaacatttataaaagagctggccaacaggctgaaaatcttgctgacttctatgaatactgcaaaggcttggaccttactaggaatttccaatttccaacactgagacagccacctccctctttccttgcaacaatggaagaatacattaaagaagcaccacagacaggctatgttaataagaaagtg

SEQ ID NO: 1123 - DNA, 264 bp, Glycine max
  Peptide Sequence Number=SeqID_117901
atgggaacgtttcagagctttagaaaagcctatggagctctcaaggactctaccaaggttggccttgccaaagtcaatagcgaatacaaggagttggatattgcaattgtaaaagctaccaatcatgtggaatatcctcccaaggaacgtcatgttcgaaaaatattctgtgcaacattagcacaccagccacgggcagatgtggcatactgcattcacaaacttgctaagagactttcaaagacgcgaagttggatagtataa

SEQ ID NO: 1124 - DNA, 278 bp, Glycine max
  Peptide Sequence Number=SeqID_117902
ggtacatcctttgtggtacaagtagagggtacatctacttggatttgactgagaacaagagaggatacatctcttgtggatcagttctagtggagggtacatccactaggttcaaagagaacaagggaggtatgtctcttgtgtgtttgtatgtacaacacttgcatattcagtgtatcatgtcagctcctagttcatcgactgccgtagtagatggaactgagcacgttcatgatgctcaggtttatcgttctcataacatgtcaaaggaccattga

SEQ ID NO: 1125 - DNA, 180 bp, Glycine max
  Peptide Sequence Number=SeqID_117903
atgaaggtatttacatcaagtacctacaaggaagaaccaacagaagatttagctctccataactgggaagcttcctttacaaacaaagagaagatggaagaaatacaagcggtgaggatgcctcctccacctctagaacctcacaatcactcacaaactcctctcaagctctcaggatga

SEQ ID NO: 1126 - DNA, 711 bp, Glycine max
  Peptide Sequence Number=SeqID_117904
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataactcggctattaataaagatctattttctgttgtagaagtattgtcatccaagtctcctacaagtgaacaagatgtcaataattttaatattgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 1127 - DNA, 2814 bp, Glycine max
  Peptide Sequence Number=SeqID_117905
aagcttcagtcttggtttcaacttccaaatgggaattgggagctggggaagataataacaacttctggaaatgaatccatcatttcactgcctgacaggaaggttttgaaagtgaaagaagaaagtttagtaccagcaaatcctgatatccttgatgggacaaaagcagggcctgttttggttgctataaatccctttaagaaagttcctctatatggtaatgattatattgaagcctacaagcgtaaagcaattgaaagccctcatgtatatgcaatagcagacacggccatccgggaaatgatacgagggaagactgagacagcaaaaatagcaatgcagtacttggctgcccttggtggtggaagtggaatagagtatgagattttaaagactaatccaatactagaagcctttggaaagctaaacctacaaaatgcagaagactataaatatctgaggcagagcaattgttattcaattagtggtgttaatgatgcagacgaatttcgcacagtcatggaagctctagatgttgtccacatcagaaaagaagaccaggagaatgtatttgcaatgcttgctgcagtattatggttaggaaacatatcatttactgtgattgataatgaaaatcatgttcaagctgtagaagatgagggtctgttccatgtagccaaattgattggctgtgacatcgaagatctcaagttgatactatcaactcgcaaaatgaaagttggtaatgataatattgtccaaaagttgacgctatcacaggcaattgatgcaagagatgctttggcaaagtcaatatatgcatgcctgtttgattggttggttgaacagataaataaatcacttgctgttggcaaaagacgtaccggcagatcaatcagtattctagatatctatggctttgaatctttcaataggaacagttttgagcagttctgcataaattatgcaaatgagagattacagcaacactttaatcgtcatttattcaagttagaacaggaggaatatattcaagatggcattgactgggctaaagttgaatttgaagacaaccaagactgccttaatctttttgagaagaggccactggggttattatccttgttagatgaagagtccactttcccaaatggcacagatttaacatttgctaacaagcttaaacagcatttgaattctaattcatgtttcaaaggagaaagagaccaagcctttactgtacaccattatgctgggcaggtaacctatgatacaactggatttctggagaaaaacagagacctattgcacttggattccatccaacttctatcctcttgcacgtgtcctcttcctcaaatatttgcatctcatatgctcactcagtctgataagccggcagttggtcccttacacaagtcaggtggggcagattcccaaaagctaagtgttgcaacaaaattcaagggtcaattgttccgactgatgcaacaactagagagtactactccacattttattcgctgcattaaaccgaataatctccaatcacctgaatcatatgagcaagggcttgtattgcagcagctgagatgctgtggggtcctggaagtagttcgaatatcgagatctggctttccaacaagaatgtttcaccaaaagtttgctagaagatatggttttctcctccttgatcatgttgcttctcaggatccgcttagtgtttcagttgcaattcttcatcagtttaatattttgcctgagatgtatcaagttggctacacaaaattatttttccgaacagggcagattggtgtgcttgaagatactagaaatcgtaccctccatggcattttacgtgtccaaagttgtttcaggggttaccaagcacgtcattctctcaaggatcttcggggaggaatcactactttgcagtcatttattaggggagacaaaaccagaaaggcatattcagcattacttaagaggcatagagctgctgttattatacagaagcgcatcaaagcagtatttgcaagaaacagaatgaggactattagtgatgctgcaatagtcatacaagcagttattcatggttggttggtcagaagatgctcaggaaatattggatttttgaaatctggagacatgaagatgaaagagtcagatgaggttctggttaagtcatctttcctggccgaattacagtgccgggtacttaaggctgaagctgcccttagagagaaagaagaggaaaatgacatccttcatcaacgtctccaacaatatgagagcagatggtctgagtatgaattaaaaatgaaatccatggaagaagtgtggcagaaacaaatgagatccctacaatctagcctctccattgcaaagaagagccttgctatcgatgactctgaaagaaattcagacgcatctgttaatgcaagtgatgagcgggattacagctgggatgtgggaggtaatcacaagcgccaagaaagcaatggggcaagatcaacgagtgctggtttaagtgttataagtcggctggctgaagaatttgagcataggagtcaagtatttggtgatgatgccaagttcttggttgaggtaaaatctggtcaggtagaagcaagtttgaacccagatcaagagcttagaaggttaaaacagatgtttgaagcttggaaaaaggattatggggcaagactgcgtgaaacaaaagtcattataaataaacttggaagcgaagatggcgcacttgagaaaatgaagaaaaagtggtggggaagaaggaatagtacaaggataaattga

SEQ ID NO: 1128 - DNA, 2583 bp, Glycine max
  Peptide Sequence Number=SeqID_117906
atgttgcagaaagggataattcgtccaagtacaagtcccttttcttctccggttcttcttgttcgtaaacacgacggaacctggagattctgcgtggattacagagcgcttaatgtcctcactatcaaggatcgtttcccgatacctacgatagatgagttgttggatgaattaggtggcacttcctggttctctaaattagatttactacaaggccatcatcagattcttatgaatgaagaagacatatgcaaaactgcctttcggacacaccatgggcactttgaattcagggtgatgcccttcgggctatgcaatgcaccctcatcttttcaggctacgatgaattccatctttcgtccttaccttagacaattcattattgttttctttgatgacattttgatttatagcaccacgttggaggatcatgtgcttcatttggagcaagcttttcgaattttgttgcaggaacaatttgttctaaagctctccaagtgtacatttgctcagcctcaggttgaatacctgggtcatgttgtatcagcccagggtgtggaaccagtcatggccaaggtccaggccatccagcaatggctggaaccaaattcggggcgcgcactcaggagttttttgggtctcgcaggtttctatagacgcttcatttgcggctatgcaaccattgcagcccctttgaccaagttggtcacggtggaaccttttcaatggaccgaggaagctcgtgctgcctttaatcgcctcaaacaagtgctgacctccactcctgtcttgaggttgccggatttttctcttcccttcacggtggagacggatgcctctggcaccggcatgggagccgtgttgactcagcagggacatcccatcgcgtattttagcaaagcttttcctcctaaactaatgggtgcctcgacatatgtccgagaattcttcgcgatcaccgccgccgttaagaaatggcgccattacctccttggccgttgtttccacattttaactgatcatcgcagcttgaaggagttgcttactcaggtgattcaaacacctgagcaacaaatgtaccttgctcgcttgatgggctacgattacaccattatgtatcgttcgggtagctccaacaaagctgctgatgccctttccagattaccagaatcttcttcccctactttaatgcttttgtcagtaccctgttttacctttttgcaggaactcaggcgacaattgacacagaacactgaattcactcaactccgtcaatcaatcttgacagacccagatgctcatcctgaattttcagttactaatgatttgatcctccataaaggacgtatttggcttccccaagcttttcccttcactacgactctcctctcggaataccattcgactcccaccggcgatcacatgggtatagccaagaccctagcacgattaacgaaaaacttttattggaagggaattcttcaagacgtagaacgtttcatagcttcttgtgttgattgtcaacacacaaagtatgaaacacgaaagccggcagggttgctttgcccattaccaataccatcaaagccatgggaggatttgtccctcgattttatcacaggacttccggcatttcagggacatactgttatcctcgtaatagttgatagattctctaaaggcattcatcttggaatgttacccacgcgacacacagcttacacagtggtcgttcttttcatagacctcgtcggaaaactccatggaatgctgcggagcttggtttccgatcgagatcctttatttttaagcagattttggcaggagctttttcgtctgagtggaacaaagttcaggctcagctctgcttatcaccctcaatctgatggacaaactgaggtcctaaacagggtgatcgagcagtaccttcgtgcttttgttcataagaagccgtcatcctggggcaagctcttaaggtgggtagagtggtcatataacacttcttggaattcaagttcaggcttatccccgtatgagattacctttgggaagaagcctgttaatttcccaaggtacctagaaggtaactctcccattgttgcagttgaagatatgctttctgaacgacaagctgttttcgaggaaatcaagaagaagttggaaaaggcccagagtcgtatgaagcactttgctgatgctcgaagacgtgatgttcacttcagtgtcagagacatggtcttggtcaaactaagaccccatcgtcagaggacagtgacggaatccgataatacccaatattgcagtacattgctcagtcattatgagaatgatcaacttgtggttactccgttaactattctcgacacacgtcactctgtcgaatctaaactcgaggttcttgtccagtggcaaggcttatctcctgatgacactacctgggagaactgggatcagttgcgtgaagtataccaccttgaggacaaggtgcttccggaaggggtgaaggatgatagcaaggaaaatgcagaaagcagacccaaaaggaagcagaagatactagcatacctcagagacttcgtttga

SEQ ID NO: 1129 - DNA, 1053 bp, Glycine max
  Peptide Sequence Number=SeqID_117907
atggatcaggcgggtcgggttccaggcccaataggttatagtcttctacgaggcgctcgtcttcatcagccactagcaggggttaggcgtttcagtggaatgacggaaaggggcttggtggtggaacccgaggaggctgagaggaagacggtggtacacggggacggaaagcctttctcgcctcaaggagcttctcctcttaacctcacgacggatgtcggcattgaggcccgaaacgaagcagctgaggaggaagtgtggagggagaccgacaacgcggttcgcgagatcctcaaattcagaaagggcatggaggaaactctgccaggaagaaagttggccgttaccggccatccactggtaccaggccagagctctgccgtccatgtaaaaggacgcgatggtgagtcggtcgtgatccggggtgtggtgatattcaaaaaactgagtgattttgaatatccaacccaatgggtcagatccatcgaaccggggcacatcgagcttgacgcgaggggtatcaagtttatgggtcatggtttgcaggttttcactgagactgagttgatagatggtgagcttggctatgacgtcttccaacttatcagagttggacttcgaggccatgagtgcgagacgagagcaccaaattgtcctaacagaaatgagggaatattcctaaagtggcagacaagatcaaggcacagatccttagatgtccagctcatcaaattcgattatccagctcagctcctatgctcaaacgaagtctctgaggtatgctggtatcttcttcttccttttgggtctgctttctgctgtttccttgctatgaggagagcaaggcaattttgcatcagccaagtctatgtttttagaaggaaccctgacccaagagaggtggaagctatggatcttttgcatggcttactttgggctcatgaacttggtcatgcaaatattcaatttgaggttgactataagaatgtggtggatggaatcttagcaagccctagtggaattacagattttcatgttcttttatctaattga

SEQ ID NO: 1130 - DNA, 3898 bp, Glycine max
  Peptide Sequence Number=SeqID_117908
atggacaaactcggcgaagaagagcaactcagaaccagcaccttccaacgcttaaaatcacacactttgcaccttctcgaccttttgcagaaccctcacattcagtatcagaagcattgttctctcaccgtaatcccccaactccttcgtttccttcagagttcttcgccctctacgttacaacccttcttcgactacactctgtttccgttacttctgctcctcgatgcagcgatccagtgcaggtctactcagaaagttgattctcaggaaaattataacatgcctggtgttctgaaaacacctgttaatgtgagtgatggcgttgctgaaggtgtggttaattgtttggaggagcttcttaggaagtgtcgtttgaattctgtggatcaggcactgcttttgagcttatattcctgttccgatgtgtcttgcttgtgtgaacaaattcctggtttgcctgcactttcggatgacatttataatgatgaacttcataaaactttcaagtatggttcggaatcagacaaatgtttacttgcatttctccagtctcaatttgcatcagctgctgttggacactggctatcacttcttctcaaaattgcagatacagaggctgctaggggacaaaaaggttctgcaagacttcgaattgaagcattcaaaactctgagggtgcttgttgcaaaggttggttatgcagacgcattagccttctttttgcctggcattgttagtcagttagctaaagttttgcacagtgcaaaaacaatgataagtggggctgctggaaatgtggaatctattgaccaagcaatcagaggtttggcagaatttcttatgatagtcctccaggatgatgctaatgcacctgccctagatattgaagcgtcttcagacttttattcaaatgagtgtaattcaacactttctcttttggatgagcttcgccacttgcaagttaaaaattgtgttaaaacaaaagctgctgaagatacagatgttgagtcagaaaaaatctcttgctcccaaactcaactccaagaaatggggaatactgatcctggcagagagaacatgtctttgcatgtgaaccgaacaaaagattggatgcagaagacatcagcacattcttcagatgtttttaactacagtgctatgtgtatattttactattgcaatgtaacgttttatgtgatcagtaaaatcattgaatttcagatctgtattcacccttcacaaaaggtgagaaagggacttgttgatgctataaaaggactcttgtcagagtgcttctacacactgggggaaagtagactgatgcttttggtgagctctgaactgaggccaagaggtggtcaagtggatgaaattggctgcactaaggaatgtgttgtcttcagttgcatttttccggagtgcttatgtgccttggtcgttgatgtatctaatgatgtgtcttcaactgcacaagatttccttgagtgtttgttctcacaaaatttgaaacatgttataaaacacaatgctgctgagatatttatcaggaaccttgaaaagcttcccagagtggtgcttggccatgaggagtcacatgctgtgttacatgctcagcaattactaacaataatattttattctggtcctcgtctgttagtggatcatcttcagtctcctgtagaagctgctagattcctagatttgtttgctgcatgtctaagccataatacagtgttttctggtttgctcggcataatcactaaaacagatcgatcatcaactctgggatatcttccctccattgctgagttgaaatctggagctaatttcttcaattatggcccccttcttataaattctgctttatctgaagtccctaagtgcaggcttattgaggaaaaaagtatagatgaacctgtgaaaactgctcaaaacaactatgagcttcctcgcatgcccccttggtttagttatgttggtagtattaaattataccagcctcttgcagggattctccgatttgtgggtttatctttagtggcagggcttctgtcgcatgtgattgatattctactcggttacttccgtagattggtttctgagcttcgtttaaaagaatacaataaagaaagctggcagtcttggtatgacaggaatggttctggacagttattgcggcaagctagcacagctgcatgcatgctgaatgagatgatatttggtctatcagatcaagcaactaatgattttgctaggatatttcataggtctactctaagcagaggagttcaggttcagtcttacaaacatgatagtgcatttcatgaattttcctggaagaagtccaaggataaaggtgtaaggagttgtttagttgagtgcattggtgggatcttacacgagtatttatctactgaggtatggaatgttccaattgatggcagaattgctgacttgcagcttaatgctgcagttgaagaagatattagcctatactttttccaagatgctgcaatgctacgtgagaaccttagttcttcaaattaccgagttagaaatgcagcagattctgtcttgcatatacttaccaccacatctagctatacaacagttggacagttagttttggaaaatgcagactatgtgattgattcaatatgtcaacaattacgccatttggatctaaatcatcatgtgccaaatgtgctggcatccatgctctcctacattggagtggctcacaagatattgcctcttcttgaggaaccgatgcgctctgtgtcaacagaacttgaaatactgggtagacaccaacatcctgatctaactgttccattcctaaaggcagtagtagaaattgtgaaggcatcaaaacgtgaagcttgcctgttgcccactcaggcagagtcgtttgccagatatgtcaggtctatggtctctaattcagaagaaacaacacaagacctgtgggaggacattttattcaagttaaatgattctagaagatatagacgaacagttggttctattgctggttcatgtattactgctgcaatcccacttctagcatcattcaagcaagaaatatgcttggccgctctggatataattgagggtggcacgttggcaatagcaaaagtagaagcagcttataaacttgaaagagaaattaaagaagcaacagaagaagcgctacaatcactatcattgtatcaactgaaggatactttggaagctaatgaagaagcggctgatgaaaacaggctgcttccggcaatgaataaaatatggccattcctggttacttgtattcagaacaggaacccagtggctgtccggagatgcttgaatgtgatcagcattgtagtgccagtttgcggaggagatttcttcacacggcgtttccacactgatgggacacacatttggaaacttctgatcacgtccccatttcataaaaagtcaaatttcaaagatgagaagacccctttacaactaccttatagaagcagttccgtgtgttcagaggattcattcgctgagacttcctatcttaaaattcagattgcagtgcttaacatgatagctgatttatgccgtaataagagcagttcctctgcactagaactcgttctgaagaaggtaagtggtctggttgtggggatagcttgtagcagtgttgttggacttcgagatgcttctctgaatgccctccatggacttgcatctattgatcctgatcttgtgtggattctcttggctgatatatactacactgctaagacagaaaattttcctccacctacaccagatttacctgaaatctctgaaattctccctcttcccatatcacccaaagaatatctatatgtgcagtatggaggacagagttatg

SEQ ID NO: 1131 - DNA, 1227 bp, Glycine max
  Peptide Sequence Number=SeqID_117909
atggcatgtatgggatcaatgtggtcggtaatgagaaattcatcaggaatctctatgtatgcatacccatcattaggaacaggaattgcaaacttggaatgtgcagttctctcgtctggcaataataaagatgttatgccgcttgatgctactgtcaatacaatatggccatgtaaagacactcgtgacaatttcactggtaatctctcaaattctgtacgcgaaaagggaattcatactttcaccgatgatgaagagcttagaagaggggaggaaattacaccagctcttctcaacgccattcaaaattcgaggattatattgcccatcattgttttctccaagaactatgcatcctcaacgattgtttggatgaacttgtcaagatccttgagtctcaaccagtataagtttatctgcaagattgtcgaagaggtctctgaaaagattaattgcattcctttacacgatgctgataatccaattgggctagagtctgcagtgctagaagtgaaatatctccttgaacatggatctgatgtcaaaatgataggaatttatggtattggcggtattggtacaaccacacttgctcgtgctgtgtacaacttgatttttagtcattttgaagatgatgttgacaaattagagcagttaaaggtacttgcaggaaattggtttggctctggaagtataatcattatcaccacaagagacaaacacttgctagctactcatggggtggtaaaattatatgaggttcaaccattaaatgttgaaaaagctcttgaattgtttaactggaatgcctttaaaaatagtaaagctgatccaagttatgtgaatatttcaaaccgcgcagtttcttatgcgcatggcattccattggctttggaagtgataggagatggtttgagagtgttggttgacagatctctcataaatgtttatgctcctggttttgtgagaatgcgtgatctaattcaagagacgggcagagaaattgtaaggcatgaatcaatacttgagcctggcaacgaaggaactgataaaacagaattcataaagcttgaaggatacaacaacatagaagtgcaatggaatggaaaagccttcgagaagatgaagaacctgagaattttgattgttgaaaatacaatcttttcaacaggccccgagcatctaccactaccaattagtttgagagtgctagattggtatgcctga

SEQ ID NO: 1132 - DNA, 1845 bp, Glycine max
  Peptide Sequence Number=SeqID_117910
atgctggccattgggggacatggcactagtatccgcacaagctctacttgcactgctttgctcagagaacttgagcaaatatggaacgatattggggagaccgaagtggagaaagatcgaatgctgatggaattggagagggaatgcttagaagtatacaggagaaaggttgatgaggctgttaacaccaaagcacgctttcatcaaacagttgccgccaaggaagcagagcttgcaacactaatggctgcgcttggcgaacacgatattcattcaccgagcttcgattctccactatgtctccacacccctgcccagattaagacggagaagcgatcagtatccctgaagcagaaacttgcatccatcacaccttgggttgaagaattgaagaagaaaaaagatgaaaggttgaagcaatttgaagatgtaaaggctcaaatagaaaagataagtggggagatttttggattccattctgtcaataatgctttgagcagcacaacagttgaggatgatcaggacttgtcacttaggagacttaatgaatatcaaacgcatctccgaacacttcaaaaagaaaagtctgatcgccttcaaaaggtcttgcaatgcgtgaatgaggtgcattctctttgtagtgtgcttgggttggattttggtcagaccgtgggtgatgttcatccaagtttgcatgggactcaggtggaacagtcaactaatattagcaatagcacattggaaggtctagagcaggccattctcaagttaaaaatagaaaggaaaactagaattcagaagctgaaggatgttgtagcaaaactatttgaactttggaatttgatggactcttcaaaagaagagagaaactgttttatgaagattacttctattgttggaacctcagaatcagaaatcactgaacgaggtgttctttcaacagaaatgatagagaaggcttcagcagaagtggacaggcttgccaaactaaaagcaagcagaatgaaagaacttgtttttaagaagaggtcagagttagaggaaatatgtagattgactcatattgaaccagatacaagtactgcggccgagaaagctagtgcattaatagattctggactggtggatccttctgagctattagccaacattgaagaacagataattaaggcaaaaggtgaagctttgagtagaaaagaagtaacagataggattgataagtggtttgctgcatgtgaagaggagaattggcttgacaaatataatcaagatgacaaccgatacagtgctgggcgaggtgctcacattaatcttaaacgtgcagaacatgctagaataactataggcaaaattccagctatggttgacaatcttataaacaaaacattagcctgggaagatgaaaagaagactcattttctatatgatggggtacgtttggtgtcaatattggatgattataaactggccagacaacagaaagaggaagataagagacgacatagggaccttaagaagatgcaagatctactcctaaatcaaaaggaagccatgtatggttctaaacctagtccaagaaaaaataacagctttagaaagactaatagttaccgcgcaaatggcaatggatctatgcctcctacaccccgtcgtaactccctaagtggtggaacaacatctgaactactgacaccgcggtcctactctggccgtcagaatggatattttaaggaaatgagaagattgtctactgcaccactgaactttgtggctatatccaaggaagatacaatgtcttatgcttccctttgtggttcagagcctgattcccctccccaagtttaa

SEQ ID NO: 1133 - DNA, 712 bp, Glycine max
  Peptide Sequence Number=SeqID_117911
gaatgaagctaatggaaaattgaagtatgttgatggggagttagatgtgtgggataagatagaaactaattatttaaatttctttcttctaaccaatctggtgaagcattgtagaaaatataacaatgtgagtgacattcactgggttgtggataaggaagtggatttggaggagggtttgcgtgtatgtgaaacagattttgatattcgggatatggtcatcactgcaaggcacgatggagatgaggtagagttgtactatgaccacaaggttgatgaacagcctatcctatttgaagccgatgtacctgaagatggtttaggtaatctgaatccaattccagaagttgaggaagaaggagataaagatgatggtgatggtgatgtgggtaatggtgacaacattgctagtgaggagcatgatgacattgatggtgacgaggatgtagatgttgaagtgagggtaggctgtgaatggtggactgatattccagaatacaataatgaagtccaagaggatgaagttgaaccagccgacaccttcatctacggtgtgctccaagagctcgacatcgttcgcgccaaggtcgacgtcatcgacttcaacgctgagcagaagtacctttctctcgctgttgagttctccaaactcgagtcgcacgtcgccaacctcgaatactccatcgatcagcgcctccgcgaaatcaggtga

SEQ ID NO: 1134 - DNA, 612 bp, Glycine max
  Peptide Sequence Number=SeqID_117912
atgggggaagggaaggagcaaaaacgggagggatgcactagacatatactcgttctacttcacacaatttccaaaagacatggggaaaagaacctatggtttgagtttaagaagaggggcaatgttagggaggtattcattgcgaggaacaaaaacaagagtggtcggagatatggctttgtgagatttaaatgggtcaataatgccaggaaattagagagacaactagataacttggtcctcgaaggactaaaattacacctgaatcttctgaaacatggaagggaatggaaaccaacaaagaaagttaacaaggaacatcagcataaggaggaggtggtcacagagaagctggcagagagagaaaagaggcagaatccccaacgagtgacaacattcagatcatatgcggaagtggttgcaactggcagcaaaaatatggcgaaacgatggacactgaagtatgtgcaggcatcaaacacgacatcttgcttgtctgtccaactaaccatatcaatggaaaagaagacatggctacgcaaaacttgggtaggcagactgaggaacctaacaatgtttgatagactagaagaacttgtgggacggaggtga

SEQ ID NO: 1135 - DNA, 297 bp, Glycine max
  Peptide Sequence Number=SeqID_117913
atgctgtcttcaacaaagctagaaggaggaaaaaattctcatagttctggaatagaggggaatgatgttgatggggaggcaaagattaaaaaacgtaagagaagaaagaagaaaagacaaaggaataacatagatgttgatgatgcttcacgcttgcgaaggagaacaagatacctcttaatcaaaatgaagctagagcagaaccttattgatgcttactctggagaaggttggaaaggtcaaaggaaaaatatgttcactacatcgcatctaggaatttctgaaatttttacatga

SEQ ID NO: 1136 - DNA, 417 bp, Glycine max
  Peptide Sequence Number=SeqID_117914
atggagcctaacattgtaatagtacctctggtgttgccatctataatagatgaacgtcgaactgctttcatggagggtagacatatgttgcacagcgtggttatagctaatgaagttgtggatgaagcgaaaaggtgtaataaaagttgcctagtgctcaaagttgattacgaaaaagcatatgactcaatgtgttgggattttctcttatatatcatgactcggatggggtcttgtaccaaatgggttagatcgattaagggatgcctgaaattaacctcaatatctatattggttgatgggagtcccacaaatgagtttatccctcaaagaggactcaggcaaggggacccattagtcccattcctgttcaatattgttgctgagggtctaactggactgatgagagaagcttag

SEQ ID NO: 1137 - DNA, 423 bp, Glycine max
  Peptide Sequence Number=SeqID_117915
atggcggtgaaacctcttccatcaccaggagaattgtgggcaaaagtcttggattctagatatggaagttggaagagtttggatgaaccaaggagtagtagagattctatctgggggcaggatttaagcattgtttgcaactcgtttgaggacagggttggtttaaaccaacaacaatacattcagcagataggggtggcatcaaacggaggatgggagttccactggaggagactatttatggagggggagatagaaatagctacaaaatatatggaggacttagaaagcatggtagtacaagtgcaacaacaagatagttggagttggggggcggatctaagtgagagttacacagtggggagcacttacaaattgctcaatagacacacaacaaatgaaaataacaatggagtttactga

SEQ ID NO: 1138 - DNA, 1722 bp, Glycine max
  Peptide Sequence Number=SeqID_117916
atggcggcgccatggcggtatggcgtcgaggattttcggaaaaacgccaccaaagagtggtggcgttgcaggttgcgtatggcggctgccatagccatggcggtcgttgcggaattgcggtgttgggctgacccaacccaaccctactcgagtttctcttgcaaaaggacaacacacaacagcgagcacgaacagaacagtctccagcacgacgacgacgagcgacagcgacggcgaaggcgatgcacgcgaccagcagcacaacgacgacgaacagcagcgtcgcacgcgagggcgacgcacgagacacaacgcacagtaccgacggacggcgacggctcagtgtttcgtcgggaaaagattaggccagaaaaggagctactacgagcaaaaaagcagattttaaaatgtaaacttagtattcgcgatgccatacaccagctggattctcttagttctgtgggtagcattgaagattctgccattgctccagatggatctgtttatcatgaaaatatattctgtgccaattgcaaactacatgaagctttcccagataatgatattatactctgtgatggcacttgcaatcgtgcttttcaccagagatgtctcaatcctcctttggatactgaaaatattcctcctggagatcaaggctggttttgcaagttttgtgaatgtaagatagaaatactagaggcaacaaatgcccatcttgggactcaattctccctagacagtacttggcaggatgtattcaaggaagaggctgctatgcctgatggtgacattgcattactaaatcctgaagaagaatggccatcagacgatcctgaagatgatgattacaatccagagaggaaagaagacaaccacaactttgacacagaaggagctgatgaaaatgcatccaatgattcaaccagttgttccagtctgttgtctttgaatggcgaatgtcctccagtagatgaaggcatctgtcatgaatattattctgttaatagctgcttagattctgatgaatctggggaaatagcatgtggtcctaggcagcgtaaagctgttgactacaagaaactctatgatgaaatgtatgggaaggatgctccaccttgtgaacaaatgagtgaagatgaagattggggtcctggcaaaagaaagagaagagaaaaggagtcagatgctgtcaatactcttatgactctgcatgaaagtgagaataaacattctgataatgagaaaaatgatagaacgagagaaggttcttcaggcatacaaataagaagatcttgtttcaggattccgcttgatgcagttgagaaacttcgccaagtttttgcagagaatgagcttcctccaagatctgtgaaggacagcctttcgaaagagttgggactagatcctgaaaaggttagcaaatggttcaaaaatgcacgttacttagcacttaaaaccagaaggtatcaatcagaaggagaacggcttcagagtttcacttctaagatcacaaaggattctatatctcaaaacgaggagaaagatgagcttttgaaatcgaaggtctccaaaattactgtgattcattccaagaaggatggtaaaaacatcacaggcaaagagaaaaataaattatctaacattcttttgaagaaaaggcaaccaaaaatatctccacctttagcaagagaaaatggcaacaaggtgcttttctactaa

SEQ ID NO: 1139 - DNA, 414 bp, Glycine max
  Peptide Sequence Number=SeqID_117917
atgtcgtcgtcgtcgtcgaagactggtggtggtggtgaggttagggcttcgcacatattgataaagcacgaaggttctagaaggaaggcctcgtggaaggatccagaaggccgcatcatcaagagcacaaccagagaaaacgcggtttctcagctcaaggccctccgcgacgacatcgtttcgggcaaggccacttttgaggacatcgcctctcgcttctccgattgcagctccgccaagcgcggcggtgatctcgggtcacataactgtggatatgtcactcttgaaggtccttttggtcgtggccagatgcagaagccttttgaagaagcaacttttgctcttaaaattggtgaaataagtgacattgtggatactgacagcggagtccacattattaagagaacaaaatga

SEQ ID NO: 1140 - DNA, 1491 bp, Glycine max
  Peptide Sequence Number=SeqID_117918
atgacagaaatacacgtgaagcaacgtttcaaaggccaaccttgcccctatttttcaattactggcaagctacttcggcataccttgaccctatttttcaattttcggccaggctttctacttcctgattttccctcaatagttggtcagaaatcgcaagatcatcttcaagcaaagacatcatcaatgttacattctagtattaacgaacctaatgatttgccccccgggtttgaaagcagtcatttcctaaaccaaccaaaggttgaattctccaacattccccagataaaatgggaatgccctccggtggttgttgtcagatctcaatggcgtgttgcagcaggtgaagaaagtagggagaaagagaatcagaaactgagagaaatgagggtgcttgaagcactttatccccgtctttctgccattcctcctagcccttctgtctctttggatgtagaagaggaagattatgatgatggcagaactcctctcatccctatcattcccattgaagaggaagaatctacggatattctgcctgaattggcagtagcactgaagccttcccccaatgtgcagtcgcagaactctcagcaatatatatcagcgaaaacttccattagttcagcctctaacgctgcacatgccgtttccttggatccttgtataaggcccatggctggggtatcttctggtatggaagctgatttagcagcagcctcttcagttgttgcaaccattataaggagtaatgagcaaggaaccctgattgatatggatttactgggtaaaatatttactgacccaaaaatacttgagcagttgattaatgaacatggaactgcagctaccacagcaagtgcttcctcaaatactgtggatatacccacttctgggttgaagcctgctattccatcagttctggtgtctacacctacacctgatgtgacagcttcatggactacacccacaagtgcagtgggttcattaccttctgggtttgggttgaagccttcaaatccatcagtttctttattgaatcctacacccattctgtcagtgcctgcaattccatcagtttcactattgtcttcttcacatgataagccagtgactgcatcggttccattgtccaggcccgttcctggtatgccagtaactccctcagtttcaatgcttactcatcatacacctgcacctgatatgcacaggcccgtcagcaaaaattttcaccatgtgtcgagtggaatgccccctgctttaaataaccagtctcagcaagagacagctatggcatccgggccaaagcgagccaactactataaaaacctcatcaggcaacatggtgcagacaagcaagacatccaggactcgcacataggtatccgtcatagtaacttccaagatatgaaaccggttggggagatttgtgcggtttcggtcaagtgttggccatcgtgggcggatggtacccagccatataaataa

SEQ ID NO: 1141 - DNA, 1188 bp, Glycine max
  Peptide Sequence Number=SeqID_117919
atgagttcaagctgcggaagaacctgtggattcaatttggacttcgccaaatcttcatccacatcaaccctaacttcacccacctcctctccttcttcaacaacaacctcggaaaccaccaactctccccaatcaataatcttcaggaaaaaacctcgaaccctccgaaagcgaccgaatcaaaccttcaacgaagccgccacactcctctccacagcacatccgaacctcttttccactaaaaacctaaaaaaccctgaaaagttcacgaaaccaattataaccgaatataacgactcgtctgaacctttattactcttcagagattacgaaaacagcgacaacgacaacgacgccttctctttcctccttgaaagaaaacgtagtttccaaacggagcctaacaaagccttcttcagcgtgcgagagaatattaataagccatgcgaactaagcaccaaagtggtgaattgcgacaaattggatttggagagtgaagagttcgattgcgaatcgatgctcgacgaggaaatcgaggaaggaatcgatggcatcatgagaggaagaacagttcaaaaagatgatactaattgcactgagtgtcacataggactgaaacaaaggtctcagtcaccgttgtatcatccctcgtgtcactgcggtgatggaggaaagttcggttgggtgaggactctccggggagttggtgaggatgatgatacgaagtggtggaatttttgtgtggttgatatgcttcaaatctcgccgcggatgaagcacgctgcggcggaggatttggttccggcaaccaccacgacgacaacgaagaagaaggcaaagaataagaaaaacaagaaggatttggtgaaggaattattaccggaggaggtggcagtgagtcagggcttgctgttgaaattgaattacgacgacgttcggaatgcttggtcggaccgggggtcgccgttcgccgatggttcgccgggaaatgacgtcaccctaagctgctcgtctctcgcccgcgatttgaaatctaaaagaaaaaaggacaggtctatttcttcgtggatggagggaggagtaagaaaaaaaagtgggctacgctataaagaaaagaagcagatcaggcatcagttttggatagtcaacgcacatcaacggcccagaatcaaggcacgattgagttga

SEQ ID NO: 1142 - DNA, 354 bp, Glycine max
  Peptide Sequence Number=SeqID_117920
atggagtggctagttggaaagactacccaattggagggtgagaaaatgcagaaagaggctgaagttcagaaacttatggaagagaatgtgaggttgagtgctctgcttgacaagaaagaggctcaacttctagcattgaatgaacaatgtaaaatgatggccttgagtgcttcaaacatgatttcggacgacaagagtaacatggcatcacagattttgctacccaaaagagtttgcaatcccaaggatgcagtggtgtatgttcttgcagatatctttggatctgtgagcatgaaatacggaaggagtgaaaggaacaaagatgagctaagcttcaaccatcttgagtcttag

SEQ ID NO: 1143 - DNA, 393 bp, Glycine max
  Peptide Sequence Number=SeqID_117921
atgtgcgaagaaactcgatctcgcattcgcgttctcgacgctcctctcggcactcctgatcgaattgtacttgtgtccgggaaggaagagccagaggcagccctttccccggcaatggatgctgtagtaaggatattcaagcgtgtctctggattatctgaaactgatgctgagaataaagaatcggctgctggtcttgcattttgttccatccgtttattggtggcatcgacacaggctatcaatttaattggaaagcaaggctcgttaatcaaatctattcaggagaataccagtgcttcagttagagtgttgtcaggaggtatgattcttgtcatgttatgcaattatgcatctatgatgatccccctaattcttagtagcaattattga

SEQ ID NO: 1144 - DNA, 1263 bp, Glycine max
  Peptide Sequence Number=SeqID_117922
atggagaccaagcgctgcaacttctggcttcctaacaaaaacagattttgtgcaaactgccctctcaatggctccttctcggtgctcaagcaaaatctcaaagggcatgttaagcggtgtccattgctgaaacaggttcaatctttgtctgaccaaccgttctatgataaaggcatcaatgctggttctgatggagaggaggaaacatctggggttgatgattcaagattgcccactatgacagtttcttcagaaatgaagaggaatactcttcatgaaatgagtgtggctgaattttgcaatttgattgaaaagatagaatttcttcatgagtcattgtgtaaggatattgaggactcggttcagatgccagaggtttgcagactctggattaaaagagttggagataggaaattgccatttcaagagaaacatataatgcagcaggcatctattgtgggaaatttggaaaactttggtgtactgaagaattctctcagaaggaatcaatctgagtgtgtggaacctgttgagaagaaggagaaggatgtccttgcagtgattgagtttggagctggtagagggtatttgacacagatgcttgcagactgctatggaatcaaaaaagtctttctagtcgagcgaaaggcatacaagttgaaggtaggacataagctgcttgggaaagctgatcgatcattgcgacagaatgagagcttgatgttagagcgtttgagaattgacattgaagatttagatttgaatgctgttgagtctttgcaaggagttccatatctagccactggtaaacatctatgtggagctgcaacagatttaactttgagatgctgctttcctgaatatagagaagatagtagtggacagtacactgctaataataaaaggttttttctggatttgggattgacaaaggaagaatttcatgccattacatggtttaccagctgggcagtagatgctaatcatggttcagatcttcctgatactactaattgtatatcacatttgcaaacaataaaggagcaaggtgatgaatgtgcaaatggagttgaaaaaattctctcagacatgcaagcagataaacgagcagcactgggatttaagtgcaagtggattattgacatggggaggttgatgtggttaagacaacatggattagatgcaaagcttgtcaaatttgttccaccaagcatctctcctgaaaatcatttgctattggctagaccatcaaatcgattatga

SEQ ID NO: 1145 - DNA, 804 bp, Glycine max
  Peptide Sequence Number=SeqID_117923
atggctagaaagaagatgggtggggtgtgggaatggcagcttgagtggaggagaatgctaatggagggagagatggatttggcagcaaatctcttggaggatattgaggggatgtacacagtgggaagtgcatatcgggctcttaatcagtttataattgaagaagatgatgagagggcattctctattctctggaaactaaaaattcccagcaaggtgtctcattttgcttggagattgattcgggataaattgccaacaaggatgaatcttagaagccaaaactacaatgcctctacctcacaagatcgtcaagcagagacctggtctgacaagtcattgctgcatactacttcacgcactagcatatttgccgatattccatattcaacaaaaagagattctgtcttagctgaccgtgagagtcaattggactcgtttctcccttcctccactatgtctctctatgggcaggattcttcactttcaggtgttcgttcttcagctcttggccgtgttggtgctcctattgttactacggagagcagggttcctgatgaaatcgttgtagaaataaaaggcacctcatccgaggttcaaacagcacaacagttgattcaggatgttataagcagtcacaaagaacctatcactagcagttatggcaggctagatgcaggtccaaggtcttcatactctcagttgggcactacatcgcgcctccccccatcttcattgtcctcacaaccatacacaggttatggagcttctggtttaggagactacagtactttcaggctttaa

SEQ ID NO: 1146 - DNA, 324 bp, Glycine max
  Peptide Sequence Number=SeqID_117924
atggaggggagacatatgctgcatagtgtggtgattgctaatgagattgtggacgaggcaagaagatatataagctgcaccccaagaattaaggcaagtgatgtgggacttcctaactctttagtccctttcctttttaacatcgttgctgaagggttgacgggcttaacgagagaggctcagaagaagaatctgtttgaaggatttttggtggggagaaacaatgtggacattagcattctgcaatatgctgatgacagtgtttttcgggaaagcaacaatgtcaaacgtgaaggccatcaaggttatgctaaggagttttga

SEQ ID NO: 1147 - DNA, 168 bp, Glycine max
  Peptide Sequence Number=SeqID_117925
atggctttagagttatcgacagacacaaccaagacaattactagttctgattcatcatcagcaacaagcaaggttttctttgtctcctgtgttggaccttgtggcctcaataacttaagaaggataggcttagaatgtagaagaagcatatcatttagaaggggataa

SEQ ID NO: 1148 - DNA, 222 bp, Glycine max
  Peptide Sequence Number=SeqID_117926
atgatggaaaattggcaccttactgccaggatctcacatccaaagaggaagatgatgacgactccacttttttctttgagtcagattgctgcacagtgtagagatggcattgcgccacgagtggcagagatttgtgtgacgcttgctgaaaatgaaacaagtggggaggggatgtgcaagttaagggagcaagaagaaagacttgaaagggatggagggtga

SEQ ID NO: 1149 - DNA, 1047 bp, Glycine max
  Peptide Sequence Number=SeqID_117927
atggaattaatccgagaagacccacaaacccaacttgaacattttgttaggtcactgggtgagagaaagcagtgcatgctaaagtcaattttgagggaccaatggacttggaagaagatcctcattcccacaaagtacatatcaagtatatatgctcctgccaattatcaagcagtggatccaacagcaattgtcatgttaatctttaagccaaggtcaggatcatccctgtctttgagaataaggcagacacacttcttgttggtcttcatggcttgtgtgagaccactgcaacaatctgctgtgggtgctttcgtgtcaccacccaaatatggcagacacgttgtaacacctcaacagcttgcaatagctgataaagccgtgtcagcaaaaaacaccgtagcttccaacctcggatatggcaacaacgctgaaacaaaaacaactcaaaccactcaaacaaggaatcaattaaagaacacaggcaatgagaaaccttcaaccatctcatcagcaacctctgataaagctttctcagccaaaaacaccgtagcttcgaagcttggttttggtgacacagcaacaacaacaccacaagagaagagaactgaccatgctgctgctcctacagaatatggaaaaagtgttgctcagtctctgacagagaaactagctccagtttctggaaaagttgctggtgtaggaagtggtgtgaagtccaaagtttctggaactcaaactagtagtgtgggtgtggaacaggacaagggggtttctgtgaaagactatttggtagacaaactgaggcctggtgatgaagacagggctctctctgaagtgatatcagagactctgcacaagaaggaactgcccccagtggaagttactgaagaaggtgtgagaaagcaaagtgccacattaattttgaatttgtggtttgcatgggtcgaagattcatctatgaattatgaggcaggaagggcagaagtggaacaagttaaccaaggtgcagcaggtgaaagaaggctgcaggagtcatctaattga

SEQ ID NO: 1150 - DNA, 105 bp, Glycine max
  Peptide Sequence Number=SeqID_117928
atgaagttgaagaagtcagagaccttaatatggctggactttgtggagtgtccaaaggttcaagatgaaaaaatggaggaccttcacatggacttcatggagtag

SEQ ID NO: 1151 - DNA, 1065 bp, Glycine max
  Peptide Sequence Number=SeqID_117929
atggagactccttcatccacagcaagaagaatcacaagatcccaaaccgcctccaacaacatccccgtttcaagaaagaagaacgaggagtgctcaggaaaaaagagcgtttcgaaaacgcggcagagaagcagcgtgcaacaacagcaggataatcggtgtgcgctggtggacatatcgaacgattcgccgatcgtggggctggcgaacggtaaggacatgatcgagacgccgttgtcatcgacggcgaagaagaagacaacgatgacgccaggttccggggaggctctattgaggggccaggtgaagaccctcttgcagagagtggaggaagaggctgtcatttccaaactatccatggaaattgttgcaccctttctcaaacttgccaattcttcttctgtttctccaatgtcgcttcttgctcccactcccgcaaacaccccacaagtccccaatctttctgaggtgtctccaccttcttgtgtgcttgaagaacaattgttgatctctcgggcgatgaatgaaatacttgaaggaaagaacaacgagaatgctgaatgtgagaagagtgtgataaccaggtccttgctgttggatttctcggacaaatccgaggtatcagaatgctcttctgaggtgacttatcaggaagtgacacaaggaagtgttggtagcgggtccagcgaggatgatggtgcttccatttggtcgattcaggtgaatgcgagcacacatgacgaagatgaggacgatgaggaaatgggtgaagaagaagaggattattacgaggatgatggtgatgatgaagagtgttatgttgatggtgtagggttgtcacttgatgagctatgtgctgggatgaacaacattagcgtgaatgagaacaagaacaagggttgtgggaagcacacgaggtttgtgtacgacagtgaggatgatgagattgtggagaaagtagtggaatgttgtgctgagtctgatgtgatgcatttgaaggggttgcctacacccaaaggaaagcaccttcgttttcctgaggaggaagaaaattctgacttgtga

SEQ ID NO: 1152 - DNA, 1554 bp, Glycine max
  Peptide Sequence Number=SeqID_117930
atggaacacaaggttaatgataaagaacccaacaaaaagcactacgttggtgccttgtgttggtggttaacagtgtccatcatcgcagtcctcgtagtagttgctggtgttctttctctaataaccaagtttaagtttggtcactctaattcacctgaattcacttctcaccccaccaacgttgttcagaaatatgcttcagctcttgaattggccttgcaattttttgacgtccagaaatctggtaagctggagaataagagggtttggtggagaggggattcggggctacgagatgggagtgaagagaatttggatttatcgaaaggaatgtatgatgctggtgaccacatgaaatttggtttccctttggctttcactgcaaccgtgttgtcttgggcgattcttgaatatggaggtcgcatggatgcggtgaagcagctacactatgcacttgattcgctgaagtggatcacggattatcttgtcaatgcacacccttttcctgaagtgctctacattcaggtgggggatcctgaggtggatcataattgctgggaaaggcctgaagacatgaaagaaaaaagaccactcactcaagttaattcatcttttccaggaacagaagttgcggcagaaactgcagctgcattggcctcagcatctcttgtttttaaggagatcgatttcgcttactctaggattctcctacgacatgctcaacagctgtttacttttgctgatgcatatagagtttcctacagtgtcagcatccctcaagtggggaaatactataactcatctggttatggagacgaactcttatgggcagggcagaatgagaaagcatttggtagtttaggaagtctatcatggttaagttgggatgataaacatgctgcaactcaggttcttttgtccagagtgaatttctttggtgaaagtaacatcccagatgcggagaatctcgaccttcagatgtacagagaaactgctgaaatcctcatgtgcaagcttctacctgattcaccaacagccaccgccaacagaactgaaagtgggctgatatgggtggtaccatggaactctttgcaacattcagtagcgtctgcattcttagctgttctttatagcgactacatgctgacatctcaaactgaaatactatattgtagtgggaaattgtataagccagtagatcttcgcaaatttgccatttctcaggcagattatgttttaggtgaaaatcctatgaagatgagttatcttgtgggatatggaactcaataccccaaatacatacatcatagagggtcttccattccagttaatgctacaactggttgcaaagatggattcaagtggtttgactcacctcaccctaatccaaatgtagcatttggagcactagtaggtggtcctttctttgatgagacatataatgatttcaggaacaactcaatgcaggctgaaccaaccacttacagtagtgccctctttgttgctctcttatctggcttggttgccagttcctccgtagcgtggtctttttag

SEQ ID NO: 1153 - DNA, 975 bp, Glycine max
  Peptide Sequence Number=SeqID_117931
atgctgaagggaacaacaaaaggaggtgaaatgggaggagaaggagggagagaaggggattgggagtgcagcagttgcaacaacaggaactacgccttcagatcattctgcaaccgatgcaagcaaccccgcctcctcgtcgacaccaaaaccccctctgattccaagtggctccctcgtattggcgattggatctgcaccggttgcactaacaacaattatgcatcaagagagaagtgcaagaagtgcggacaaccaaaggaggtagcagccatgccagcaattgcgatgaccggagcatctttccccccttattcacactatttttccagggccccaggaggaccagaacaaaagatgaatattggattgcttggcaatagtgcaccgtcgcagtcactgcattttaactccaattggcctgttcccagagcagataagtatggtgtccagccactttccatatggctaccaagcagaaattatggctctggacatcctcatgaaaattctaccaaccataacctgtctgttccaaagggatggcgcaatggggactggatctgtaactgtggcttccacaattactcatcccgctctcagtgtaaaaaatgcaatgcttttccacctgcaattgatgttaaacttcatgctgtttccactttttggtgtgaagcacttgggacaaagcggttagcttctgaagagttggtttatgactgggataacaagagattgaatgtaggaactacaaatgatcagcagcaaacatatacaagtttagatctagtggtagggaccggtgcagatccaaaacctggagtcttcccctcttatcccagcatgaactcaagtacagctccaagtttgccattggccacattgcttccacctcaagtttctacacctgctctcattggaaaagggtgcaaaactcaaaggatggcccccatgcaacctgttaacgttgtgtag

SEQ ID NO: 1154 - DNA, 1176 bp, Glycine max
  Peptide Sequence Number=SeqID_117932
atggcaccagctgcagccaagactctgacttacctggcccagcagaagaccctagaatcgagcttcgttcgggacgaggaggagcgtcccaaggttgcctacaacgaattcagcgacgagatcccagtgatttctcttgccggaatcgacgaggtggatggacgcagaagagagatttgtgagaagatcgtggaggcttgcgagaattggggtatattccaggtcgttgatcacggtgtggatcaacaactcgtggccgagatgacccgtctcgccaaagagttctttgctttgccgccggacgagaagcttcgttttgatatgtccggtgccaaaaagggtggattcattgtctccagccatctccaaccactgcacacttatcttgagaaagatcctaatcccaagcatgagggagagtcagtgcaggactggagagaaatagtgatatacttttcgtacccaaaaagagagagggactattcaaggtggccacacaagccagaagggtggagatgggcgactgaggaatacagcgagaagctaatgggtctagctgggaagctcatggaggtgttgtccgaagcaatggggttagagaaagagggtttaagcaaagcatgtgttgacatggaccagaaggtggtggttaattactatcccaaatgccctcaacctgacctcactcttggcctgaagcgccacacggatccgggcaccatcaccttgctgcttcaggaccaagtgggtggacttcaagccaccagggacaatggcaaaacatggatcaccgttcagcctgtggaggctgccttcgttgtcaatcttggagatcatgctcattatctgaccaatggaaggttcaagaatgctgatcaccaagcggtggtgaactcaaatcatagccgtttgtccatagccacgtttcaaaacccagcaccaaatgcaactgtttaccctctgaagataagagagggagagaagcctgtgatggaggaaccaatcacttttgctgaaatgtacaggaggaagatgagcaaggaccttgagattgcaaggatgaagaagctggctaaggaaaatcatttgcaggaccttgagaacgaaaagcatttgcaagaacttgatcagaaggcaaaacttgaggccaagcctttgaaggagattcttgcttaa

SEQ ID NO: 1155 - DNA, 756 bp, Glycine max
  Peptide Sequence Number=SeqID_117933
atgaagatagtgagttacaacgtgaacggtctgagacagcgcatagcgcagttcgggtctctccggaacctgctaaattcattcgacgccgacatcatttgttttcaggagacgaaactgcggaggcaggaagtcacagcggatttggtcatggctgacggatacgaatcgttcttttcatgcacccgcacctcccagaagggccgaaccggctattccggtgtcattacattttgtcgtgtaaagtctgcattttcgagtaatgaagtggtgttgccgctggcagcagaggaagggtttactggtcttttgggaaactctcaaactagcaacgacaaattgccattcttgatggaagatcttgaggaattttcaaaagatgagcttctaagtcttgatagtgaggggcgctgcataatcacagatcacctcactttggaggggggggggggggggggggctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 1156 - DNA, 1236 bp, Glycine max
  Peptide Sequence Number=SeqID_117934
atggttatgtgtcagaatttctatgttgaaattgcagaactagggtcaatgatttttggtactattctatgtttatgtgtttggcagaaagctgtttttgtgtacagaactcagtggcggacctacatgaaggacggtcgttatactgaaaaagactcagcggtggttgtaaggcagatgctcaaggttgcagctgagtgtcatttacatggtttggtacaccgggatatgaaaccagagaattttctttttaaatcaatcaaagaagattcacctttaaaggccacagattttggtttgtcagatttcataaaacctggaaaaaagtttcatgatattgttggcagtgcttactatgttgcacctgaagtgttaaaacgcaagtcaggtcctcaatcagatgtgtggagtattggtgttattacatacatattgttgtgtggaagacgcccattttgggataagactgaggatggtatcttcaaggaggtcttacgtaagaagcctgattttcatcggaaaccatggccaactattagtaatgccgcaaaagattttttgaaaagattactagtaaaggatcctcgggcgagattaactgcggctcaaggtttatcacatccatgggttagagaaggaggtgaagcattggagattcctattgatatatctgtcctcagcaacatgcggcagtttgtgaaatatagtcgaatgaaacaatttgcactgaggacattggctagcacacttaatgaagaagagttggctgatataaaagatcaatttgatgctatagatgtggacaaaaatggttctattagcctggaagagatgagacaggctcttgccaaagatcttccttggaaattgaaagaatcacgtgtactagagatattgcaagcgatagacagcaacactgatggcctagtggatttccgggagtttgtagcggctacattacacgtgcatcaactggaggaagactctgacaagtggcagcaactgtcacaggctgcttttgagaaatttgacatagataaagatggctatattactacggaagaacttagaatgcatacatgcttgagaggctccgttgatcctttgctagaggaagctgatattgacaaagatggaaaaataagcctaccagagtttcgtagactcctaagaactgcaagcatgagttctaaaaatgtttcaagcccatctgttcatcggcggcggagattctag

SEQ ID NO: 1157 - DNA, 213 bp, Glycine max
  Peptide Sequence Number=SeqID_117935
atgtcatggctgcaagttaagggtgcttttccattaagcccaaagcagcacttccttcatcacttgggtgttcaacctgctggtctgtttgaagaagccatattccttctatggtcttggcttaggggttatgagaaggatttcacagtgcatttcaatcactggtcaagtaatctaccacaaagttttatgtatcagcaggggattgcatag

SEQ ID NO: 1158 - DNA, 771 bp, Glycine max
  Peptide Sequence Number=SeqID_117936
atgacggagcaaaccaagctgagcgtgctctgcagcctcttcacgtggacacagcggagcaagtctgcggcgaagaagcgcgccaagttccgcaagttcctcgacgccttctgcaccgaccacaacttcttccccgccgtccgcctccttctcccgaacctcgaccgcgagcgcggctcctacggcctcaaggagtccgtcctcgccacctccctcatcgacgccctcggcatctcccgcgactcccccgacgccctccgcctcctcaattggcgcaagggcggcgccgccaccggccccaccgccggcaatttcgccctcgttgcctccgaggtgctgcagcgtaggcaggggacggcttcgggtggattgacgataagggagctgaatgagttgcttgaccggttggcttccgctgaaaacagggctgagaaaattttggttctttctacccttatccaaaagacaaatgcacaggaaatgaagtggattatcatgataatcctgaaagatctaaagctgggaattagtgaaaaaagcatttttcatgaattccatcctgatgcagaagacttgtttaatgttacttgtgacttaaaattagtatgtgaaaagctaagggatcggaatcaacgtcataagcggcaggatattgaagttggaaaagctgtgcgcccccaattagctaagagagttgctaatgcaactgaagcatggaagaaggatttgaagccgctggtgggacctccctcacctgaagtggcatgctag

SEQ ID NO: 1159 - DNA, 1436 bp, Glycine max
  Peptide Sequence Number=SeqID_117937
ttcttttcaatttgtatgggccccgagctggaggtgatgacacagaaaggattcagtttaaacaaaaattttacaggatattacagaaaagatgggagtctctcctgcatcaaggaaggagaatatttgttgttggtgatctcaatattgcaccatttgcaattgatcgatgtgatgccggacctgattttgaaaataacgagtttagaaaatggttcaaatcaatgttaattgaaaatgggggtcgattttctgatgtcttcagagcaaaacatcctgatagaagggaagcatacacctgttggtcacaaaatacaggtgctgaagtatttaactttgggagtagaattgaccatattctatttgctggttcatgcttacatgaattggatgacctgcaatgccatagttttataagatgccatgtcaaggaatgtgatattctgacacagtataaacggtgtaagccagaaagcacactgagtgcccataggtggaagggagggcatagcgttaaactggaaggatctgatcatgctccagttttaatgtctttacatgaaattcctgatgtctctctgcacagtactccttccttatctgctagatatgttcccatggttcacggcatacagcaaactctagtgtcagtgttgatgaaaagacaagtttctgaactaatgaaatcatgtgagatggcacaagaagacattgcaatggatggtacttgtgagagagaagaaccagtgaacagagctggttcatccacaagaagtccaaatgaatgtcattttcctccaagccaggattttgaagttagtagcattttgaaaccaaacaaactttctggaggttcttctcaggagtctgtttctaaatcaggaagtgaaaataaaaaatcaacaaccaggcaatgtaacagatccaacaaaaaagctagaaatggtcaatggtcccagctctcacttcggtcattttttcagaaaagtacaaatcttgacaaaggtagttccataaaagaagtagtcaatgactcatgtactgattactcaaataataatcaggcagaaccctctcaaccaagccctcgtttacaggaaattccaacagtatgtgctcataatggcagtcccaagcaatatgagttggatactgatacatgtgatccggatttagctggaccaaatggtagttccacaaaagaagaaaaaagtaatgtggcttcactagagtggcaacgaataaaacagttgatgcagaacagtatacctatttgcaagggccataaggaaccttgtattgctcgggtggtgaagaaacaaggacctaattttggccgcagattctatgtttgtgcccgtgctgagttttatgaggactcatccatctgcccatcaaaggaatttagtccctcattaaaattagagcaatgttga

SEQ ID NO: 1160 - DNA, 159 bp, Glycine max
  Peptide Sequence Number=SeqID_117938
atggctcagatgaagtttgaagaaccagtggaaatgaagatgctttgcagcattgaaagattgaacagtgataagctccaagaacaagaagttacagaggcaatgatctgccaaacccaactagagaagacaaaaacacaggagctgaaaacaaaatag

SEQ ID NO: 1161 - DNA, 294 bp, Glycine max
  Peptide Sequence Number=SeqID_117939
atgttatgcatttctttccttcctttttttagagatgagggaattgttttaaaagaccacagctccaaatgggaacctagtgatcgtagtggaaagtggctaaaattgaagcctgaatacattcaagctggctctgatctggacgtacttatcattggtggctactatggctctggacgacgtggaggagaggttgctcaattcttggttggccttgctgagcgtccatccccaaatacgcaccctaagcagtataaacgtgtcaagaattttttatcattttggttcctatga

SEQ ID NO: 1162 - DNA, 195 bp, Glycine max
  Peptide Sequence Number=SeqID_117940
atgctttgcggctccaacaaaagacttccctctaagtcacctactgctgctcatctgctcccacgaataaaagttcaagatcatcataggcaccaatcacacggtataaaaattgcaaagcctaagcatgtccacatgacactctcacttaggaaaactaggcagcaagtgtcgatgtcaccctgtcatgcatag

SEQ ID NO: 1163 - DNA, 297 bp, Glycine max
  Peptide Sequence Number=SeqID_117941
atgaatttgaataactcagtcacgcattgtgttgcagcagacagcaaggggtttaaatttgaagcagcaaagcgtcatggtgatatcattcattattcttgggtattagattgctatgatcaaaagaagcttgtctgcttacagcctaagtacttcctttttctatctgaactgacaaagaagaagttacaagaagaaattgatgagttctcagacacttactacttggaccttgatcttggagtcatcaagcagctgtttctcacaaaattgttcccatgggaggtgagaatctaa

SEQ ID NO: 1164 - DNA, 534 bp, Glycine max
  Peptide Sequence Number=SeqID_117942
atggcatccgcacctttgaatcctgtatcccagtcgttcccaaacaccattgccgagaagttcgatgattcaaactactttcactggcaacagcatgtagaaccagtgatcaaggcgcataaattgcagtgttttgtcgtcaatcctgtcattccgcctcaccatctcacggaggatgatagtattgcagatcgcgtgaatcctgagtatgaagcttgggaagttcaggatcaaacacttcttgtttggctgcagtccacattctcaaaatcagtcttgtcacacgtgctgggctcgaatcattcgtatcaggtttgggacaagatccatgagtatttctgcttgcacaccaaatctcatgctagacaattgagaaccgcaatgcgtgcggtttcacttgaaggaaaatctatcaaggaatatttgcagaaaatcaaaagttatgttgatgaacttgctggagttggagttctggtgcaacacgaggaatatgtttatgcattgcttgaagggatcctatcagattatgcaccg

SEQ ID NO: 1165 - DNA, 174 bp, Glycine max
  Peptide Sequence Number=SeqID_117943
atgggttttcgtagagtcttgcttaaaggaccttgtcctatgaaaggacttgtcaccctctggaaatccatttggggactttgtagagttcttctaagaagaccttatctggtgaaaggacatgttgatgctacggagtttttggatgatgccacttccagtgaaggaagataa

SEQ ID NO: 1166 - DNA, 429 bp, Glycine max
  Peptide Sequence Number=SeqID_117944
atgcatgccgccatcaggaatggtgagtcctccacggatggtccacgtggcagcggactcgccgggaccagtggcgatttcaagccagctggtctcgccagtcaaactggcgagttggtccctgcccatgtctcgccaaacgcagtggcgataaagccatgcactagtgcagcagtggcttcagggggcgcgcaggctagggccaaaaccgccaaaagcattggttcagtgtattctgagtgtgtgacatcgttcaacttaaatagttggttcttcctcctatgttataagttcctgagccttcaagctttcagagttaaaaacagttacaaggaagaggagctacgcacgagcaagaggcagcacaagaaggagcaaagctttttcactaatagaaaccaaacacacactcacaatatttttttttga

SEQ ID NO: 1167 - DNA, 372 bp, Glycine max
  Peptide Sequence Number=SeqID_117945
atggaaatgcctagtcttatcaaagcatcggtcaaaatcatctcagatgcgggccttgggatggctatgtttagcttagatgttttcatacccactcctaatcaaattggagaggaagacaaaagaagaacaaggcttttcatggcccttcagcctcgtatcatagcttgcggtaccaaaagagcagtcatgggcatggtcattcgcttcatgtgtgggcctcttgtaatgtctgcttcttcaattgtcattggattaagacaagacagacttcacactgccattgtacaggctgctcttccacaggggatagtgccatttatatttgcaagggaatatggattgcatcctgatattttgagcacagggtaa

SEQ ID NO: 1168 - DNA, 309 bp, Glycine max
  Peptide Sequence Number=SeqID_117946
atggcttcgagcgcgacgctctaccagattctgggagtccgcgccgtcgcatccggcgaggaaatcaaggcggcgtaccggcggctggcgagggtttgccaccctgacgtggtgccgttggagcgaagggattcctctgcggcagagtttatgaagatccacgccgcataccgcacgctatcggatcctgagaagcgggccagttatgatagaagcttgttccggcggcgccagcggacgctaacaatgtctccgtcggggtattgtggctatggtggtcggaactgggaaacggaccaatgttggtag

SEQ ID NO: 1169 - DNA, 204 bp, Glycine max
  Peptide Sequence Number=SeqID_117947
atggctttgcttcctccaatcctttatgtatatatgagaaaaaaaggcatgaagggtagcattattgttggtacaaacacgacagacgcagacaagatgagtgggaagagcatgaagttttcagaaagaaaggacggtggagaaataaagaaaaaaggtttgtacattccacatgcaatcgcggaacttgcagcttccaattag

SEQ ID NO: 1170 - DNA, 162 bp, Glycine max
  Peptide Sequence Number=SeqID_117948
atgctactgagctggctgaagttcgttagcaatagcatagttgaagcagggagtacggtggctgggcaagggggggtcgctcatgcagaactggagtttggagcgacaaagatgggcaacactgattcgaatctaaggcagagatgggttgggtgggggtga

SEQ ID NO: 1171 - DNA, 409 bp, Glycine max
  Peptide Sequence Number=SeqID_117949
atgtcaaagttaaaaataaaaagaggagataacgtaatcattactactggtaagaaagatatcaaaggtaagactggtgaagttattgaagtgatcaaaaaagaaggtagagaccctagagtaattgttgcaggacttaacatcattaagaaacacgttaagccttcagcttcaaatcctcaaggaggaatcgttgaaagagaagcttctattcatatctcaaatgtagctttagttggtaaagacggtaaagctgtaaaagtaggttacaaaactgaaggagataagaaggtgcctaaattggaaaaaatcatcttatctcaaggattaggtgatgctactgcagacaaaaagatcattgattatgctgtagaagaacttacaaacattactggtcaaaaggccgtag

SEQ ID NO: 1172 - DNA, 234 bp, Glycine max
  Peptide Sequence Number=SeqID_117950
atgaaatataacgaaacatgtcggaaatacattggtcaaaataaaaacttcgagaaatcttcgactgcttccaagagtccaaagcaagcatcaaagcttgttggcaaaaactttggtgacgaaggacaagaaattgtaaccgacacgctcgaagaggtaccaccatgcggtggcataaacgagcaccgcaaccgctccacgccaattcatccacaacaccacatcagcaactaa

SEQ ID NO: 1173 - DNA, 563 bp, Glycine max
  Peptide Sequence Number=SeqID_117951
gcacggattggttgtttgccaactatgcaagtattgactgttcccacaaggaggtagtttttaacccttcttcagtggctagctttaagcttaagggggcagggactatagtcctacccaaagtcatttcagctttgaaggccaagctgaaagtttccttatcatctgagccggtggtgagagaatatcccgacgtttttccttatgagcttccaggactcccacccctcagagagattgattttgccatggagctagagccagacactggtcttatatcgagagccccttacagaatggctccagctgagctgaaagaactaaagcgtgtcaccttagggagcaccagtgttcgtgaagaagaaggatggatcgatgctctttgcattgattatagagagctgaataagatcgatttactttcaggctacccccagctgaggatcagagttagtgatattcctaagactgcatcccgttcaagatacgggcattacgagttcatcgtgatgtcctttggtttgactaatgctcctgcagtattcatggatttgatgaacagg

SEQ ID NO: 1174 - DNA, 552 bp, Glycine max
  Peptide Sequence Number=SeqID_117952
atgtccatccgttctacaggccttgagccaaagtcccaactcaccataaacctttccctcaaaagaaaacaaaaaggagaaaattcccgatcaaaagaatcggcaaaaagcaaaaggagaaaattcccaatcaagaaaaagatgggagaaagcaaaaaaagaaagaaaattcccaatcaaggatcggaagaaaatagaagaaatatgctgaaagaattgtcaccaagtaaacgaaaaaagaaacgaaaccacgacctaaagtggtcctctacctttgattgccaaccaaaatcctgtgtgtcggtggcttgttcaccttacactaaacaaaaacagaaaaggaaaaggccaagaacactcaaagccaaaattcccacgaagaaacagaccattcccaagaaaaagtcctattcatccatgatcacgcatgtaatctttgatttgataggaaattgtcgcaacctacccttcggcgggagggcgacgcgtgactcgcgggatgcgtgttccacgaaaggaatgcgcgcggagtcgccaccaacgtttatttga

SEQ ID NO: 1175 - DNA, 195 bp, Glycine max
  Peptide Sequence Number=SeqID_117953
atgtcgattgggaagctgtgttgtgtgcccgcaagggatccggcaaaacttagagcttgggcatggattaatgcgaaagggaaaggaagaaaattctcttattatgaatgggagatgaatcccagggcttgtttgaattctcaagagtattggcgttgtactgacgaatctagcgagagaccagcatgggattga

SEQ ID NO: 1176 - DNA, 327 bp, Glycine max
  Peptide Sequence Number=SeqID_117954
atgtcacgccttctagctcctaagcaacagtgccgtccaagcatttgcataggggagatcgacaaccaagttgacaccgcacacagccatgactcacacatgtgccgcctgagcatgcttaaacacaacctcactctagacgaaactgaactggagttgcacaaggctaaaccacatggtcagatcagagaaggggctgatgaaatagaagagaagactgcgaagttgaaaggaagtgagaaggctctagttgcacggcatgaagctcgtcatgctgtagtaggtactgcagtagcaaaccttcttgctggacagccacatgttgag

SEQ ID NO: 1177 - DNA, 111 bp, Glycine max
  Peptide Sequence Number=SeqID_117955
atgattctaagacaacttttggaaaaacctaaggcagggtttagagaaatttctagggatcaccatggaagctttcttgtggggttttatggtcatgttggagggcaatag

SEQ ID NO: 1178 - DNA, 1575 bp, Glycine max
  Peptide Sequence Number=SeqID_117956
atggggtatatagatccagatgcagaggtgataaaactatctcccaagaccctaatggcaacaaacaggtttatatgtgaggtgtgcaataaagggttccaaagggagcaaaacctacagcttcacagaagaggacacaacctgccttggaagctaaagcagaagagtacaaaagagcaaaaaagaaaggtttatctgtgtcccgagcccacttgcgtccatcatgatccttcaagggctttgggagacctcactgggatcaagaaacactactatcgcaaacacggtgaaaagaagtggaagtgtgaaaagtgctcaaagaaatatgctgttcaatctgattggaaagcacattcaaagacttgtggcactagagaatacagatgtgactgtggcactctcttctctagtggaggtatatggcagcaggagactgctcgcacgcgtgacagtttcatcactcatagggcgttttgtgatgcgctagcacaagagagtgcaagattccccggtggcttaaaccctttggggactcatttgtttggcacaaaccacactactagtttaagcctatcccaagtgggtaaccaactttcccaagttcaaaagcagaaccaaaccgccactaattataacagcattttgcgccttggcaacaataatgttggtgcagcagcaacaaagtttgagcacttgattccacctctaaaccattcttcatttggacactcaccacaatcaatgccttcctcagctttcttcatgaatgacaacacaaatcaagcattatttgaagaacaccaatcacaactacaaggcctaatgcaactccaagatcttcaaggcaacacaaacaactctgattcttcatcagtaggtcctcctaattccaatctggtcaacctcagcttcttcccaataagtagcaatattggcactggcaccataataccaggtcaattcaacaacataagtggtagtaaccaaggaacaacaacaacaacaacaacaacactctatggcaattcaatagaaaacgagtcatcccctcatgctggatcgagtttttcttctatctttggcaattcaatagaaaatgcgtcatcctctcatatgtctgccactgcgttgcttcaacaagctgctcaaatgggttcaaccacaaccacaaccaccaacaacggttcttctttacttggaggaatgtgtactaacaatagttccaaagctgaaaatgaccaccaccacaatcttcaagggttgatgaactctattgccaatggaaacacgtccttgtttgggagcatgcaagggaacgaaaacaacctttgtggctttcacaacgtggatgagtccaataacaataagttgccccagaatcttagtgtaaactttggaggttctgataagttgaccttagactttttgggtgttggaggaatgatgacaaacatgagtggtggattttcacaaagagaacaacaacaacatgtcacaggtactatgagctctttggaccatgacctaaagtcagcacagtcatatcgtcattttggaaagtcaacgttgcaataa

SEQ ID NO: 1179 - DNA, 192 bp, Glycine max
  Peptide Sequence Number=SeqID_117957
atgacgacggttggcagcagttgctcttcaagcccctcctgtgagcctcctcgtcgctcctctcctctgagccttcgagccgctcctaagccttacaaaaacccttccttcaaaacctccctctctgcgcctttgctttccacaaatgttgtgttgggagagaaagaattggatcttcccatgaagatctaa

SEQ ID NO: 1180 - DNA, 129 bp, Glycine max
  Peptide Sequence Number=SeqID_117958
atggtttgggttaagaattggcaagatcactttgatccagtgatatgtttagaaagtagtgcgcagctttggagatccgggtcatctggtagactcggtattgatggaaacatcaaccgtaaccattaa

SEQ ID NO: 1181 - DNA, 915 bp, Glycine max
  Peptide Sequence Number=SeqID_117959
atgccctggcttcccacaattaaagcaagtgctttttccaccgccgccgccgcttccgccaccaccaccaaatctccctccttccatgccgcaatccctagccaaatgaccaacctccccacaccgaaaacaacctccaccgcttcctccaccgccaatgttgcccttcccggtggcgcaatccctcgccatgtgtccaaatccgccacacctaaagcaagatccgcctccgccaccacctccaatgcctacactgccgccgcctccgcgcacgcaatctctcgcgaggtggccgaaccccccgcaattgaaacaaccaccgccgctgccgcctccgccgccaccagaattactgctcctgttgcaatccctggcgaggtgtccaaactcgccacactggtagcacgcggcgccgcctccgccattgcgcctggcgccgaaaccgaagccagagccggcggcgcggttgttgttgccggcggctgcgcggggctggagaggggcgccgtcgacgccggtgacgtcgacggccttggtcttgtcgttgtcgccggtggcgatggcgaactcgacgcggtcgccctcgaggagggtgcggtagccgtcggatctgatggaggactggtgaacgaagagatcctcgccgccgtcgtcgggcttgatgaagccgaagcccttgccattgttgaaccactgcaccacgcccgtgaatcgctcttccgccatcgaaatcgcttcgattttttagacccaacaaaccctagaaacagagcctcacgcggtggaatgccaacaacagagcactttctgtggagtctctatatatatgttcgaggtgaactgaaattccaagggatctataaatcaaatccaaccctgcctattactgttaatcatttttttaaaggatgttaa

SEQ ID NO: 1182 - DNA, 1367 bp, Glycine max
  Peptide Sequence Number=SeqID_117960
gcggcgtcggacctttactgaagctcatcaaagaaggaaagaaagaagggcaagaaaacgctgcgagagcaattgggcttcttggccgtgacctcgagagtgtagaactcatgatccacgccggtgtttgctctgtcttcgccaaagtcctcaaagaaggtcccatgaaagtgcaagctgtggttgcttgggctgtttctgaattagccgccaagtaccctaaatgccaggatcttttcgctcagcataacattgttcgcttacttgtgagtcatctcgcgtttgaaaccgttcaggagcatagtaaatacgccattgttagcaacaaacctacttcaatccatgctgttgtgatggctaatagtaataattctaatggcaatggtgcgaggaaggagagtgaagacgaggaaaaacagatgcagagtaggatgcagcatcccttgggtgataggtctacaaatcagatgcatagagtggtcacaagtaccatggcaatgcatgctgccaacaagaagcagcaacaggttaatggtggtaatgggaagcaaagctattcgtattccgggattaacatgaaggggagggaaattgaggaccctgataataaggcttacatgaaagcaatggcggctagggcgctccggcagctggcaaaggggaacgcggccatttgtcggagcataacagagtcgagggcgctgttgtgcttggccatactgcttgagaaaggaactgaggatgtgatgtacaactctgccttggcggtgaaggagataacagctgtggcggagaaagatgcagaattgagaagatccgcgttcaagccgaattctccggcctgcaaggcggttgttgatcaagtgcttaagatcattgagaaggaagatagaaaactcttgattccttgtgtaaaggctattgggaatctggccaggaccttccgggcgacggagaccaggataatcggtcccttggtccggcttctcgacgaaagagaggcagaagtgtccagggaagcagccatatctctcacgaaattggcctgctcggagaactacctccaccttgatcactccaaggcaatcataagtgccagtggtgccaaacacttggtccagcttgtgtatcttggagaacagacagtgcagatttcagcactagtcctgctctcctacattgcattgcatgtgcctgacagtgaggaacttgctcgggccgaggtgctcggagttcttgaatgggcttccaagcaacctaacctgacgcaggaccaaaccctcgaggcattgttgcaggattccaagggtaggctggagctttatcagtctagaggttcaagaggattccaaaaattacatcactag

SEQ ID NO: 1183 - DNA, 195 bp, Glycine max
  Peptide Sequence Number=SeqID_117961
atggcggcagcttcctcatccactccatttttgggaatcagagaagaaagccctcagattacaacacaccatcaaccctccacagtttctccaaccacagcgcctcaaaagaaacggaggaatcaacctggaacaccatgcaaattgctttcctccaagtttctcaaaagcacggagatgagacttctagtttaa

SEQ ID NO: 1184 - DNA, 126 bp, Glycine max
  Peptide Sequence Number=SeqID_117962
atgacatgtttacatagtgactacgataccgtggcaatgtgcacctttaaagagggcaatgcaatggaagggatgcgacagttgtggggtgggggcaacatagcaaaaaggtgtgacaatggatga

SEQ ID NO: 1185 - DNA, 294 bp, Glycine max
  Peptide Sequence Number=SeqID_117963
atgggaagaaaggccaattgtgacaatcaatatgctatgaacagaggtccttggtctgctgaagaagacaaaattcttatgaacgacgttcaagttcatggggaaagaaaatggagagagctttctaaaagagcaggcttgaaaagatgtgggaagagttgtagactccgatggctgaattatctcaagccagatatcaagagaggaaacatttcttcggatgaagaagatctcattatcagactacataagctcttagggaataggtggtatatctatctatttatattatag

SEQ ID NO: 1186 - DNA, 597 bp, Glycine max
  Peptide Sequence Number=SeqID_117964
atggacaacagaacaacgaacgaaaaagcttcctctttgagatggaaaatccttcgccgcgcacttctctcacgctcgtctccaccacacccagacgagcaatctcaaatgattacaaagagcatttcacgaaggaccggccatggattcaacttgatactttctcacgtaatcgccgatagttcttcttccaccagagacgctcgcgtttgttacactttacccatccctggcgctcctcaactctttttgacacaaagagtggacaaccgtgctgacctcagtgattttgagatatgtaacagatacaacattgacaacactgggcttgtctgtaagtttctcttatcatcatcgtcacaactcacaagtactgactctaaggtaattggccatcagaagatgttcttgctcactattgcttgtcacatgcagatatattcagttattgagcttggttctggctacggcttggctggatttgctattgcagctgctacggaggcatcggaggttgtaatctcagatggaaatccacaagtagttgatttgatatttgcggttaacatggcagatagaatggttagtgagaaatga

SEQ ID NO: 1187 - DNA, 366 bp, Glycine max
  Peptide Sequence Number=SeqID_117965
atgtcatttcttgtcaatagcatttttctctccctatataatttggataaagatcagagtcagactaaaggattcagcattagcactttctttaaggatttccacagagaccttgctcgtattgtcaaacatttattatcaaaagcaggatcttctgaggctatatttttaagtccaaaaagaggcaattcattggacctgttcttggaggtggccaaggaaaacagtttgcatttcagtgtaatggagaactatgacgaagaagtctggaaacgtcacaagggattcttgaatgaagatagggactcttggcccagttatgacaaaggtcacagctatcctctcttaatcagaattaccctttga

SEQ ID NO: 1188 - DNA, 825 bp, Glycine max
  Peptide Sequence Number=SeqID_117966
atgaaaagaaaggccatgagttgtgacaaccgagatgctgtgaacagaggtgcttggtcagctgaggaagaccaaatccttatcaactacgttcaagcccatggagaaggaaattggagagagctttccaaaagagctggtttaaaacgacgtgggaagagttgcagactcagatggttgaactatctcaagccagatatcaagagaggaaacatttcttcggatgaagaagatctcatcatcaggcttcatagcctcttaggcaataggtggtctcttattgcgggacgattacctgggcgaacagataatgaaatcaagaactattggaatacttatttgagaaagaaggttgagcaaaatcacaactataacagtaatcttcctggtcatgataacattcctatcaaattaagaattgaatctccacggcgctcaaaaaattcattgggtattgttattgatcctacaaaatcctctcacccaatgacgattaaatcaatgaggtgcaccgaggttatgatgccaacgcgatccgtcaatgattttacaacaagttgggatataaacccttctgcatctaccccacaagatggccatgatcattgctcagaaggtttcctcaaacactttggtattagtgacgtattaatgccatacgaggattgccgttttaatggatatgcttgcgtcgaaataccccaacattttggagaggaaggctacaaggttaatgatgcgataggtgaaacacagtatgggaattggaagactgaggactactttccactagactatgatgtaggtttttattttaaaagttga

SEQ ID NO: 1189 - DNA, 2244 bp, Glycine max
  Peptide Sequence Number=SeqID_117967
atggctaatgatcctgaaatcaactcacctctaattaaaaggcatgtcaacaacgccgacgccaacacctcgagctcgccggacggcggcgagaattctccgatcgagcaggtggcgctgacggttccggtgggcgacgatccatcacttccttccttcactttccggacatggattttgggaactctagcctgcgctctcctctcgttcctgaaccagttcttcgggtacaggcgggagccgctttcggtgacggcgatctcggcgcagatagcggtggtgccggcggggcacctgatggcggcggcggtgacaaggcgcgtgttcatgagaggcacaaaatgggaattcacgctgaatccggggaagttcaacgtgaaggagcacgtgctcattaccatcttcgccagttccggagccgcaagcgtctacgccatccacttcgttagcgccgttaaagtgttctaccggaaggagttaacggttttggcggcgttattggtagttataacgacgcaggttttgggcttcggttgggccggggttttcagacgctacctcgtcgagcccgctaccatgtggtggccccaaaatcttgttcaggtctcgctcttcagggcgctgcatgagcaagagaagagaccaaagggagggttaactaggaatcagtttttccttatagcattcctttgcagttttgcatattatgtcttccctggctacttgatcccaatgttaacatcaatttcgtggatttgctgggtgtttcccacttccgttatagcacaccaattaggttcagggttgcatggtcttggacttggtgctattggctttgactggtcaagtatatgttcctatcttggtagccctttggccagcccatggtttgccacggctaatgttgctgccggttttgccattttcatgtatgtcatcatgcccattgcgtattggactaacctttacaaggcaagaagttttcccatattttcagatgatctattcatgtccaatggtcaaaagtacaacatctcagctatcacagactccaagtttcaccttgacatggaggcttatgagcgtgaaggccctctttatcttagcaccatgtttgctatgtcatatggcattggttttgcttgcctttctgcaacccttgttcatgtattgctcttccatgggagtgaaatatggcggctaagtaagtctgctttccaagagaataagatagatatacacacgaagatcatgagaaagcattataaacaagttcctgaatggtggtttctttgcattcttctgttcaacatcacggcaactatatttatatgtgaatattttaacaatcaactccaactaccatggtggggtgtggtgttagcttgtattgttgccatatcatttactcttccggttggagtgattagagccacaacaaatcaggcaccagctttgaatataataacagagtacataattggatacatctacccgggatatcctgttgccattatgttgtttaaagtgtatgggaatgtgagcatgaagcaggcgattttctttttacaagattttaagcttggccattacatgaagattcctccaagagaaatgttctttgcacaggtacttggcaccttaatatctgcagtggtgcatttgctaacagcatggtggctgatgaacactgttccaaatatatgcgaacgagaattgcttccagcaggtagtccatggacttgccctggtgatcatgtgttctatgatgcatctgtggtatggggtttgataggaccacgtagaatttttggagatcttggacactactcagccatcaattggtttttcttggctggagctattgctcctttcttggtttggctagcacacaaggcttttccaaataagcaatggattagacttatcactgtgcctgtgctcttgggagcattagctgacatgcctccagccacagcagtaaactacacaagttgggttcttgttgggtttctctcagggtttgttgtctaccgttactatcgcgattggtggagccgacacaactatgtcttgtctggggcacttgatgctggattagccttcatgggtgttttgctctacttgtgtttggggatgaaacagattagcctaaactggtggggtagtgatcctgatggatgcccattagcttcatgtccaacttctcctggtgttgaatctaaagggtgttctgtttactga

SEQ ID NO: 1190 - DNA, 240 bp, Glycine max
  Peptide Sequence Number=SeqID_117968
atggaagaaaagagtgaagtttacaagcattactctactgatggtggcgatgtaactggggttgcaggcttacctttgcttttgaagtggagactggttgtggctaggcttctactgatgctagcttgtactgaggagcaatggcttacaattctgcactacaaacacaaaatcagaaacaactattcaaagccattttatgtttaccaacttggccaatcaaagagtctaggagactaa

SEQ ID NO: 1191 - DNA, 288 bp, Glycine max
  Peptide Sequence Number=SeqID_117969
atggtgaactgggttgaatcttctcaccaatggtttccgactgctaaaagttggagggtccctcgtctacagcacttgcagtctgctcgcagcttaactattgcacaaaatgaagatgtggtggaacaattcttgaaggaaaacgaaactgctgagttgacggagatagatgctgccagtgattggccttgcaagggtggtcgcataccgaaaacatggcgatttgaccctttaacatcacaaaccagtggactatttgtagcaaagttcacaaaagttgtcatttga

SEQ ID NO: 1192 - DNA, 924 bp, Glycine max
  Peptide Sequence Number=SeqID_117970
atgtccttttcaaaggactacacgtcctcgccttcggagggctacatgccctcacaccttcaaaggacttcacatcctcgccataagaggactacacgcccagaccatctgaggactacatgtcctcgtcatcaaaggactacacgtcgtcgccttcagaaagccgcataccctcgccttcagaggactacatgtcctcggcttgagagggttgcacgccctcgccttcagaggactacacgtcctccctttcaaaggactacacgtcccctccttcagagggctacacatcctcaccttcagaggactacacctcctcacctaagaaggctagatgccctcaccttcagaggattaaacgtcctcacctttagaggactacacgtcgtcgccttcagaaagccgcacgccctcgcctttagaggactacacgtcatcttcttcagaggactacatgtcctcggcttgagagggctacacgccctcgcttttagaggactacatgtccttccttttagaggactacatgtcccctccttcagagggctacacgtcctcaacttcagaggactacacctcctcacctcagagggctacatgccctcacaatcagacgactacacctcctcaccttcagaggtctacacgtcctccacttcagaggactacacgtcctcgccttcagcggtctacacgtcctccacttcagaggactacacgtcctcgccttcagagggctacatgccctcaccttcagagggttacacgccctcaccttcaaaggactacgcgtctttgccatcagaggactgcacaccctggccatcagaggactacatgtcctcgccatcaaaggcctacacgtcttcgccttcagaggactacacatcatccccttcagaggactacacgtcctcaccctag

SEQ ID NO: 1193 - DNA, 231 bp, Glycine max
  Peptide Sequence Number=SeqID_117971
atgacggaagggtgtggtgaagggttttgccttgcaaaccttcccggtgatgcttttagtctatgggggaacttctttgaggcaaagaaacaaatgatggctgatgccaaggtcggcggtgctgggttatggccccgtgctaagtttcggattggttggccccctcctcccccccgtgatcagttttgttgccaggattttgccaactttggcttgcgccccgttggctaa

SEQ ID NO: 1194 - DNA, 202 bp, Glycine max
  Peptide Sequence Number=SeqID_117972
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagg

SEQ ID NO: 1195 - DNA, 300 bp, Glycine max
  Peptide Sequence Number=SeqID_117973
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgagaagtccactgaaccttatcatttag

SEQ ID NO: 1196 - DNA, 709 bp, Glycine max
  Peptide Sequence Number=SeqID_117974
ccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccaggcaggcgtgccctcggcctaatggcttcgggcgcaacttgcgttcaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtagatga

SEQ ID NO: 1197 - DNA, 243 bp, Glycine max
  Peptide Sequence Number=SeqID_117975
atggacaaatcaagtgaacaagcagcagggactgagcctcagagtagaagaagaagaagcaactcagcgtgggaagaagaagaagaagaagaagaagaagaagaagaagcaaccagcagcttcgtaaaccctaatttttttggggaagaagaagcaaccttgcatctgcacgctaagccaatatccctgcgccaagcagttttctttgtggcagttactgagctgagcgacctagttcgctga

SEQ ID NO: 1198 - DNA, 1200 bp, Glycine max
  Peptide Sequence Number=SeqID_117976
atggactacctcatccctaccttgcgggaagccaacaccgtccaacttcccgatctacctaagggagtcgtatttgacttcaatcataagttcctacagatgctggagaacaacccgatcggtggcattgtccacgaagatcatatgcagcacctgaggaagttcatcaaattgacaaacacagtacgacaaaactgtgtaccaacaaagtatttctctcctatgaagatagatcagtacatcagggacatcggaaactttgtgtggagggagcatgagaatctacctaaagcctgggaaaggttgcaagagatgatcagaagctgtccacaccatggcattactcaacagagactagtccttattttctatggtagagtgtcctctcacaataggacaagtttagatgttgcttgtaggggggatatgaggattatgaagagaggtgtcaaccaggtggagaaagatgattctcgagctgaattgggaaagcagatagataaagctcaagtccccatcactacacctctattcccaacctatgataaatgtgggattgtgcataagccaggagaatgcactattgatgacaagctagctacaaccatggatgagatcaactttgttgggggagaaaacaattcttataaccagcgttcgagcaacctctcttcacaacctgaatcaaatcctaagagggaggatgtcaatgctatgatgaatagaagtaaaaggattcaagaggactccaaggagaaggaaggttctttcctaaaagcagttgatgacatccttattgagcaggaccaagcacctaagaaagttgaggtttctaccgatgggaatctgatgccaaaaaaggtagggggtgaaaagaaggagatattgacatctcctcaaataagtttaccctttcctcataaagttctctatcctagaagggtgattaaggatgtgttggttaaggtgcacaagttcatctttccaagtgattttgttatttttggaatggaagttgataaggatgtccctatcatattgggacaacctttccttagtatttgtgatttacttgttgacgttaggcttggtggactcacctttagaataggggttgatgcactgatgaaggaggtattcctaagtgtggggatgctttaccctctagagagagttctcactaatgaggaccttgaataa

SEQ ID NO: 1199 - DNA, 891 bp, Glycine max
  Peptide Sequence Number=SeqID_117977
atgttggagatgattgggagaaaattgaaaaagaatagtgtagctcttgacattgtcaattttggtgaagaagatgaggggaagacagagaagttggaggcactcctttcagctgttaacaataatgataccagccacattgttcatgttccatctggtccaaacgctctttctgatgtactaataagtactcctatttttactggtgatggggaaggtggaagtggttttgcagcagctgctgctgcagcagcagcaggcggtgtatctggatttgagtttggtgttgatccaaacttggaccctgaactggctcttgctctaagagtttcaatggaagaagagagagccagacaagaagcagctgccaaaaaggcatcagaggatgcttccaaacaggagaaagatggtgagcagcaagctagcccacaggatacaacaatgactgagggtgccagtgcagcagcttctgaagccgagactaagagaactgatttgacggacgatgagaatgctcttctacagcaggcccttgcaatgtcaatggatgatcccacaattaaccatgaagtgagagatacagatatgtctgaagcagctgctgaagatcccgagttggctctagctctccaattgtcagtagaagacagctcaaaggactcggcaagccagtctgacgtgagtaaactgttggcagatcagtcctttgtatcttctatccttgcatcgcttcctggggttgacccaaatgacccatctgtcaaagatttgctggcttccatgcaaaatcagtctgagtattcctttggtaggcatattggtagcatgttggaaagtgattttactcgggtagttatttcacgtgttccaattgttgagttcccctgctga

SEQ ID NO: 1200 - DNA, 1425 bp, Glycine max
  Peptide Sequence Number=SeqID_117978
atggcgtctgaaaaccccaaccagagaaactccctgtacccgcaggttatcgaatcagagcccgaagcatgttcttcgaaccattcctcctctctctatcccaaaatcgacgaggtcggcgacctcgtcgaaaacctcttcccggacaacaccagcccctccgcgccgccggtcgccgccgaagaggtcctcatcaaggtccccggcgccatcctccacctcatcgacaaggactgcagcgtcgagctcgcctgcggcaacctcaccatcatctgccttcgccagggccagagccttgttgccgtctatgcgcgagtcggagacgagatccagtggcccctggcgaaggacgaggccgctgtcaaggtcgatgactctcactacttcttctctctccgtgttccgaaggaggaatcggattcctcctcaagcgacgaggagggagaaaaagcaaaacatcagaataagaaaaagaagaagaataagaaaaacaaagattccagtgccagcgtgctgagctatggcttaacgatagcgtcaaaggggcaggaggatttgctgaaggagctggacaaggtgttgcaggaatgcagtgctttctcggtgcagaaggtgtcggagaaggcaaagaaggagggggaggcgttggatgcgtcgctggagttgacaatatcgccggcagatttggagacagaggagaaaaaggagatgatggaggagaagtgtgccgcgtattggactacattggctcctaatgtggaggattacagtggaaccgctgcaaaacttattgcggctggttctggacaattggttaaggggattctgtggtgtggggatgtgacggtagagcggttgcggtgggggaatgaggtcatgaagaggaggatggctccgggttctcagggagagattagtcctgaaaccttgaagcggatcaaaagggttaagaaagtgaccaaaatgacagagagtgtggcaaatggggttctcactggggttgtgaaggtctctggatttttcactagttcaatggcaaattcaaaagccggaaagaaaattttcagccttctacctggagaagttgtgcttgcatcattggatggattcagcaaagtgtgtgatgctgttgaagtagcaggaaaaagtgtcatgtcaacatctaacactgtgacaaccgagcttgtcaatcacagatacggagaagaagctgctaaggcaacaagtgaaggactggatgctgctggtcatgctgtgggtactgcatgggccgcatttaagattcgacaggttcttaatcctaagagtgttataaaacctacctcactggccaaatctgcagctaaagctgctgctgcagaacttaagaataaaaggtccaagccaggtgggaacattgtatatattagaggtggaaacattgat

SEQ ID NO: 1201 - DNA, 3039 bp, Glycine max
  Peptide Sequence Number=SeqID_117979
atgggaaacttagctgcagagtctctctgtgctttattgttgctttatttctatggcacacttttagttagtgctaaatacataaagtataatactggggctggtgttgtgccaggaaaattgaatgttcacttggttccacactcccatgacgatgttggttggctgaaaaccgttgatcagtactatgttgggtcaaacaatagtattcagggggcatgtgttgagaatgtgctggactcggtggttgtgtctcttcagaaagacccaaatagaaagtttgtgtttgtcgaaatggcatttttccatcgatggtgggtagaacaaagtccagaaacacaagaacaagtgaaaaagcttgtggatgaggggcagctagaattcataaatggtggatggtgcatgcacgatgaagctgcgacacactacattgacatgattgatcaaaccactttgggccatcgtttcatcaaggatcggtttaacaagactcctactgttggatggcagattgatccatttggacactctgctgtgcaggcttacctgctaggagctgagcttggttttgattctatacatttcgcaagaattgattaccaagacagagctaagcgcaaagctgataagtctcttgaagttgtttggcgtggctccaaaacatttggttcttcatctcagatttttgccaatactttccccgttcattatagtgctccaaatggcttcaactttgaagtcaataatcctgatgttgatgttgttcccgtgcaggatgatcctcttattttcgattacaacgtggaacagcgtgtccaagactttattgatgctgctactacccaagcaaatgtgacgaggacaaatcatataatgtggacaatgggtgatgatttccagtaccaatatgcagagtcttggttcaagcaaatggataaattaattcactatgttaataaggatggtagagtaaatgctttgtattccactccatctatttacaccaatgccaagaatgctgctaatcaaacttggccactgaaaacagatgattacttcccgtatgccgatagtcgaaatgcttattggacgggctatttcaccagtcgcccggccttaaagcgatacgttaggatgctaagtggatactatttgacagcacgtcaacttgaattcttggttggaaagaaatcaactaaatacaatacttatgaccttggagatgctctaggaattgcacaacatcatgatgctgtcagtggaactgcaaagcagcatacaaccaatgactatgccaaacgattggctattggagcctctgaggctgaagcggttgttagttcttctttggcttgtcttactagaaaacaatcaggtgataagtgttcagcacctgcatcggcatttgcccagtgtcaattgttaaatattagttactgccctccagcagaagacaacattccagaggctaagagtttggtagtagtggtgtataacccacttgggtggaatcgtactgatattgtcaaaataccagttaatgatgctaatcttgttgtcaaagattcatcgggcaataaccttgaagtacaatatgtggatgtggatgatgttacgacaaatttaagaaaattctatgtgaaggcatacttgggggtttctccaaaacaagccccaaagtactggcttttgtttcaggtgtccgtacctccacttggatggagtacttacttcatttctaaagcaactagaaaagggaccaggagaaaagatctatctcaccccaacagtcagaaaggtgacactataaatgtaggatcgggaaatttaaagatgtccttttcctcaacctctggacaactcaaaaggatgtatgattccaaaactggagttgatatacctattcagcaaagctacctttggtatggatctagtgagggcgatagtgatcctcaggcttctggtgcatatatattccggcctaatggatcgcctccaaatatcgtttcaagatcagtgcctaccaaggtaattcgtggaccactagtagatgaagttcatcagaaatttagctcctggatttaccaggttactaggctttacaaagacaaagaccatgcagaaatcgaattcactattggtccaattcctactgatgatggagttggaaaagaggtgatcacacgaatgacagcaaatatggccacaaacaaggagttttatacggattccaatggaagagattttctaaaacgagttcgagatcatagggaagattggcctctgcaagtaactcaaccagtagcaggaaactattatccaattaatcttggaatttatactaaggataagaaatctgagttctcagtcttagttgatcgtgccactggtggagccagcatcaaagatggtgaggtggaattgatgcttcataggcgtattctccatgatgatagtcgaggagttggggaaccacttgatgaacaagtttgcgtgaacaacaataatacatgtgaaggactaacagtcagaggaaattattatatcagcatccacaagcttggagctggttcacgctggcgtcgtacaactggtcaggaaatttattctccattcttagtggctttcacacatgagaactcggaaaactggaagtcctctcatttgacaaaaggaactatcatggatccaaattacagcttgcctcccaatattgctctgataactcttgaggagttggatggtggaattgtgcttctccgtttggcacatctatacgagccaagtgaagatgctgagtattcaactcttaccaaagttgaactaaagaagttgtttgccatgaaaacgataaaggagttgaaggaggtaagtttgtcatctaaccaagagaagtcagaaatgaagaggatgacatggaaggttgaaggggacaaaggacaagaacctctggcaattaggggtggccctgtcagctatcacaatttggttgttgagcttggccccatggaaatacgaactttccttttgaaattttaa

SEQ ID NO: 1202 - DNA, 603 bp, Glycine max
  Peptide Sequence Number=SeqID_117980
atgatgaaagtaggatatgcagtgaaaaagcctcccatgtttaagggagtaaactatgactactggaaggaaagaatgattgccttctttgaatccaatcacattgatatatcgaatgttgtagaaaaaggcaatcataatcctttaaaccctcagagaaacgagatccccagggatagatggacggatgaacataagtccagatttcttctcaactctcaagcaagaaatgctttgttgtgtgctctatctcatgaagagtattcaaaagttcatagctttagaaacgctaaacaaatgcgggacaccttagtcattacctatgaagggttctcaaagagaccacaagttacagtgttaaaaaccatcaagaatcttgactctgtgactcttgaagagctcattgggattctaaaagtccatgagcaagagcttgctcgagatgaaggaacaaagaaaggaaagttgctagcccttgtagctcaaagacaaaaatgcagcattgcatccaaagagtcatcgtccaaggcctttgccattaatgacgcctcaacagaagaacctaatgatgatgaatctgataaagaagatgatgagatgagt

SEQ ID NO: 1203 - DNA, 357 bp, Glycine max
  Peptide Sequence Number=SeqID_117981
atgaagaaccaacgaaggagtaggacccacgaacgaagaagaagcagcaacaacggacaaagaagaagcaggaacactggaagaagaagcacgaatgcaaagaacaagaagcacgaaggtggagaagaagaagcgggaagccgaagaggaagaagaagcgaaaaacgatgcaacgaaagagtgactcgtacggacgagtcactattttttataaacaaaagaaaattgataatcttcaaaaatcagcttgacattttaacttttttagctggattgctaggtgtcctagaaaaaacaatggttgcccaaagcaaccccctaagaaattgggcaatgagcccaatcactaccacatga

SEQ ID NO: 1204 - DNA, 234 bp, Glycine max
  Peptide Sequence Number=SeqID_117982
atgcctaagcttatgggtgataagtggattacaacatcttcaatgggagaagtacaacaatcaaccaacaatccgaaaaagaggagaaaacagaaatggaagaagaacatcaacacaacagatcattcaacattgacaacaacatcaacacataatgcctcgtcgtcacaccacggtggcccacgccttgcctcacagtcacaacattgtggtgccatgacttctgttgtgtaa

SEQ ID NO: 1205 - DNA, 1089 bp, Glycine max
  Peptide Sequence Number=SeqID_117983
atgaagctttccacctttaaattactttatgtctgtcctcttcttgttctgttttattctaatccatttgttgtaatagccatatcacaaactgaaattgtgaagtattcattttctgctattatcgcgtttggtgattcaatcttggatactgggaacaacaattatatcgaaacatttctgaaggcaaatttcaagccatacgggaaggatttcattggagcaaaatccacaggaaggttttgcaatggcaagatcccttcagacttatttgctgaaaaacttggtgtaaaggaggccttgccaccctacctggattcaaatttgaagattgaagacctcttaaccggggtgtcctttgcatctgctggttcaggatatgatcctattacagttaaactaactagggcattgtcagtagaagatcaactgaatatgttcaaagagtacataggaaaactgaaggcagcagtaggggaagaaaagacaactctcactctaacaaaaagcttgtttcttgtcagcatgggaagcaatgatatttcagtaacatattttctgacatcattccggaagaatgattatgatatccaagagtacacaagtatgttggtcaatatgtcttccaaatttctacaggaactttatcaactgggagcaagaaggattggaataattggtttatcaccaataggatgtgtgccaatgcaaagaacagtaagaggaggcagcgaaaggaagtgtgtagaatcagtaaaccaagcatccgtgatctataactccaagttttcttcttcaattatggatctcaatacaagatttccagatgctaggcttgtctaccttgaaaactatagtaaattgagtggactcattcaacagtacaatcagtctggatttgaagtggcagatgatgcatgctgtggcattggaaatttggaatttggctttatctgtaattttctctccttaaaagtctgtaatgatgcctctaaatatgtgttttgggatggttatcacccgacggagagaacttacaatatacttgtttcagaggccattacaaagcacattgataagtttgtttga

SEQ ID NO: 1206 - DNA, 1503 bp, Glycine max
  Peptide Sequence Number=SeqID_117984
atgttgcaggagatgtggaatgctcctcccggtctcagaccctccaagtctgcaccttgttctccggcaaagcctcttggggtcgttccaagaacgcgttctgagtccttccacgtggctcacaaggtcccagttggtgacactccttatgtcagagccaaaaacgttcagttggtggataaggatccggagagagcgattccgctgttctgggcagccattaatgcgggagatagagtggacagtgctttgaaagatatggctattgttatgaaacagcaaaatcgggccgaagaagccatcgaagccattaaatcgcttcgaagtagatgttcggatcaagcacaagaatctctcgataacatcctcttggatctctacaagagatgtgggagacttgatgatcaaattggtctactgaagcacaagttgtacttgattcaacaaggattggctttcaatggaaagcgaacaaagactgcaagatctcaaggaaagaagtttcaagtctctgtggagcaagaagccactagattgctgggaaacttgggatgggcactgatgcaacagaacaattacatagaagcagaagacgcctaccgtcgcgcgctttcgatagccccagataacaacaagatgtgcaatctgggcatttgcttgatgaagcaagggagaattggcgaggcgaaggagacactgtaccgggtaaagcctgcagtgatggatggccctagaggctcagattctcacctgaaagcctatgaaagggcacagcaaatgctgaaagaccttgagtctgagatgatgaacaagggagttgataggattgaacaaagcaggctctttgaggcctttttgggttcttcatcaatttggcaaccacagccttgcaaggatcaccaccacaccacaaccttgctggcaacaacaacaataaattcagccaaaattcatgatgagtttgctgatgagaacatcaattccaacataatgttaacaaatcacacagcactgccaccatctaagggtagcaacaacaacaacagcaacaaacaagttggtgccattttggggaactcactcaatgttgcagcccctccattctatgcatcaaaatcatctatgttaagggaaccaattgagaaccagttgttctcagagacccttaagagaacaaggtctggaaatgctgcagggtccatgagagtggtgagtgatgtcagggatgccaacattaacaacaagaagttgcatgtggaattaggtgtgccagtgccacagaacaaatcaagaaggctctcctcagaagatgctgctgagaagaacaagttaacagacttgttgcccaacgacgacgaatttgaggaggccattcttgctgcaattttgggagccccaaatgaatcagataaagcttattatgacacaggtagtaccacctccaggatgttgagacttaaggtttttcaggacatcacattatctctgagtccaagggcctga

SEQ ID NO: 1207 - DNA, 120 bp, Glycine max
  Peptide Sequence Number=SeqID_117985
atgggcagaattatgtttccaattaccatctatgcaatggctcacagattggatcttgcaagttgtgttgcccagatgaggaatgaaaccatcgtcaagtttgtcttcctttctccataa

SEQ ID NO: 1208 - DNA, 336 bp, Glycine max
  Peptide Sequence Number=SeqID_117986
atggaaattactagctttagtggaggcgtcagcttgggaaacgttgcggaccatggtagcaaggagagtgatcccatgctcggtagtaataatagtgtttgcagttggcacattatccaacaatgggcatggaatgggtggggaggtggaaagatacgacaaaggcgagtaggttcggccattgcgatagccaaggaagacgaggaagaaggggccaccgagcatggagaagaggttgccggtggcgacaaagaggatgtcagagatgatgaggttgaaggcgtctttggggagggaaagacccacgccatcaaggagatttgcacgcaaaaatag

SEQ ID NO: 1209 - DNA, 341 bp, Glycine max
  Peptide Sequence Number=SeqID_117987
atggttggaaagacattggcggtgatgggttttggaaaagttagatcaaaagtggcaaggcgagcaaaagggttggtcatgcacatgattgctcatgacctctatgctccgagtgatagtgcatgtgcttttggtgtggatctggtgtcctttgatcaagccatcgccactgcagatttcatctccctctacatgccactcactccaactactaacaagatctttaatgaaaacacttttgcaaagatgaataagggtgtttgcattatcaacgttgcaagagaaggtgttattgacgaagatgcattagtaagagcactcgacagtaaaccattgctcag

SEQ ID NO: 1210 - DNA, 132 bp, Glycine max
  Peptide Sequence Number=SeqID_117988
atgaggtatgcgaattttgaaaataagggttcaggagttgtttacgcgtggggaagctcgcccaggggagctagttccttcacccctaagcaacttcattctgaggtagagtctggtacaacttcattctga

SEQ ID NO: 1211 - DNA, 612 bp, Glycine max
  Peptide Sequence Number=SeqID_117989
atgcaatgttattcatttttcagaggtttccctgtttggctcaagtacattccaagtatcagtttcagaatagacaatggaccatttaagtttcaaatggaaaagtttactaagaagattgtagatatgatgaaagcagaaaggtttactgagtttggaggtgtagttcctcacacacctgctgaggacttagcattttcaattgcaagtatcatggggaaacaaattttggttgaactattagttgtccctttattgctacaagctatgattatgatgcgcctcttaatgaatatgctaaggactatcaattccaacttggagaaggaaaacaccgagaatgaggaagacaagaaggaaaagtcttttgagaacacagaaaaggttgaagttgttgctgctattatccaaaatacaccagaagttgaagttggtgaaaggacccatgttgagtctatgaaggattctacgttcaacattgaaaacctacaatatctctttaactcttccatctttgacacttctgttaagattgcctatggccttggtcccatacatggtgaaccctcaaccttttccattccatttccccgtttgactcatctactgtag

SEQ ID NO: 1212 - DNA, 3468 bp, Glycine max
  Peptide Sequence Number=SeqID_117990
atgcgtgaatatatgccgcgtttttccccttcagtcaagtcgactcctatgctcacctcctacgaattctttgctatggatgataatcacttgccaaaatgtgtcaacctcccttcctttactggagaagatcctgttggctggctcacgaaagcggagatgtatttcatggactccttgaaatatgccttgttggatcattacgatgatcatcaattgggtccctcctctaacagaagagcaattcatgggttttatcctattggcttacctgaggatattcgcatggaggtgctgaccttcgaacttcccccaatcgcgtgccctctcacgatgacaagtgggcctagcagtccaacccaatctatggatagttccaatgggctagttgaccgagaacccaaatctgtttcgacccatgctggtccctcttcttcatggtcgggtacctgtaatctatcctacccaaaactcatggacaatcaatccgacgatcctacacccctttccgattccgttcctagctccgatgacactccaaaaattgaagttcaggatatggcatgccaagttttggattatcatgctttggccccaggggaattggcacaatccaaaaccatcaggttggaaggagagttggctgcataccccatcctcctcctcatcgacagcggagcaaaccacaactttattgtgcgggaattggtaagttctttgaacttggaggttacaatgacaaaggaactttgtgttggattgggcaatggtagcaggtgttcgtctcagggtgtttgccaaacattctgggtcaggttgggacattgtatcattgtcattaatgcatatgttctggatttagggggcgtggatatcgttctaggggtggagtggttacgcccaccattcacccgcattacaaggcctcttgcattgtgtagcagtagaggaggccacactccttcacttggacttccaggattgcctcaacaggcccatgatcacgccattttcttgcttcctggttccaaacctgcgagcgttatagttcttgacaagtaccctatacctgccatcaaaaagctgatagatgagcttcatggccactatgaaggaaccccgattggtcttgccatttgtcgcaccttgctgaaatgctacatcacttggctttccatcaattcgtggccaacagaaaaaagtgggtttcacttaccctccattgactacttggggcacatcatctctggccagggtattgggatggatccctttaaggttaaggctgtaagggattggcctaccccgcacaatgccaaggatgctcgggtgaatgcatttgagtgtcttaaacaatgcttggcatcctttcctattctagctctgctcgacttcaccaaggatttcttcattgagtgtgatgcctcaggtcatcgcattggggtagttctaatgcaagattaccaacccattgcttattttagcaaggccctttcaccttgtactatgtcaaaatctatctatgagaaggagattatggcccttggtttatcagttcagcattggcaacattacttgctaggggggagttttaaggtctatattgatcaccgtagtctaagacaccttctccaacagcgactcacgactactagtcaacagtgttggctatccaaactcatggcatatcaattcaaggaagttcagagtgatcccaacctggtccgtttgagtgaaagcttgcaatccaatcctgctgttgcgcctcactatgttctttgtgatggattgctctttttcaaaggccatttagtgctgcctaagtccttagcattaatccctacactcttagccgagttccacgatactgtcacaagtggacatttgggattcatgaagacgtataagagattgcttcaacccatccctatttcggaggtcgtttgggatgatatttccatggatttcatcacgggtttgccgtgctcgcaagggtatgaggtgattctattggtgctagatcgcttatctgaatatgtccacttcatttctttaaaacattcttacacaacaaagacggtggcagaggccttcatcaaggatgttgccaagcttcacaactttctgaagcaccattttgaggatgaatatcacctaccataccaagaccgatggccaaaccgaggtggccaattgatttttggagacattcctctattgctttgcctcggagcaaccaaccaagtggcatatgtggctgtcttgggcggagttctggtggattctgtggccactgtactctttgactgtgatgaggctcttcgccaactcaaattccatttgaatagagctcagcaaactaagaaatatgcagatgctcattgttgtcatgttacttttgttgttggagattgggttgggactgctgtgacttctttgcctcctgggttggctattgatgaacctgcttcccctagcccagaagctatacttgctacttgtgtaggaaagcaccaaggaggtccagtggaggaatggctcatcccttggaagtcacaaccagtagaagaagcattatgggaagacaaggcaaatttcatagggggtggtattgataggaattctaaatgggataggccttttaagagatactctcatgaggaggaccggatgatagttgctgctcatgcaatccatgggaacaaatgggcagccattgccaggcttctaccaggaagaacagataatgccattaagaaccactggaattccactctgaggcgtcgtggagttggtcatgatacgattaaattagaatctgtcagcttcatggaagatgttagcttggagaaagcaaaagcatcatcggaagacactctatcatgtggggatgtttctttgaaatcctcagaagggagagatgtcagttctatggagatcatggatgataaatctgatgacaaagcacaaactgagggccaaatacaccatgaagtcaaggacctacctaccctttttcggccagtagcacgcgtgagtgcttttaatgtataccactcatttgatggtacacagccttcaacatcaattaaaagacctgttccgatgcaaggagctgttttacaatcatcaaaaccagacatggaattttgtagaatgcttgaaggaatttgtggtgatcagtcagtgcctcaccagtgtggccatggttgctgtgctgctccagatggtagaaagtccgaaagctctttgttgggacccgaatttgttgaattttcggaacccccatctttcccaaattttgagttggctgcaatagctacagacattagtaaccttgcttggcttaaaagtggattggagagtagtagtgccaaaatgatgggcaacacctctggaagggactggataatgggtatgataaaagctatagtgatggcaacctattttccttgcaaatctaattag

SEQ ID NO: 1213 - DNA, 327 bp, Glycine max
  Peptide Sequence Number=SeqID_117991
atgaaaccaaatgagaagtttcaattcacattcatgatcaaggaggggtcagcagggcatttgttcaagttcttgagaaagaagacatcggatttgatctgggaaaatttgacagtggctatggctcaaaagttcccaggaagaagattgtgcagtttgtatgaaagattaccaaccttgcagaaaatgggtttattgatgaaaataaacacaagattttggaatcctggtgacacagacaaaacacagtgggaaggatgtaaagtgtggacatcatctcatctcagttccccaatttcaaacttatgggcaagccgacaatgttga

SEQ ID NO: 1214 - DNA, 213 bp, Glycine max
  Peptide Sequence Number=SeqID_117992
atgatgcaccagcttctccaggaccttagcccttacccttggtatacccccgagcagtttagagccactgttgcatggcctagtgacaaacctatttttcaggaggaggcaggacctgcatatgctcaaggagctgcccaaggagatggaggaagaactgaggatgatgaagacatggcagatttggttgattatttcattgcaggagactaa

SEQ ID NO: 1215 - DNA, 186 bp, Glycine max
  Peptide Sequence Number=SeqID_117993
atgtcaaatgaagaattgaagttgcaggatccacgatgtcggatacaatgtcctgacatcctgcccgagaatactggagttgctgtacaatgcaagataaaagtcaagtgcagaaatttttcagaagaagatagatctcctccagcatcaagccgttgcagcccagaaacgcaaattgctatataa

SEQ ID NO: 1216 - DNA, 1137 bp, Glycine max
  Peptide Sequence Number=SeqID_117994
atggatttactctgtcaaaagctcctttctcaatggcttttagtcattctctggtgttctatcatagccaccatctttcaacatgtttctgttgtgagcctaccaaacaatgaaacagtgccagcagtgattgtatttggggactctatagtagatacaggaaacaacgactatatcaccacacttgtcaaatgcaatttccaaccatatggtagagattttggtggaggaaatcaaccaactggaaggttcagcaatggcttagttccatcagacataattggtagaaagttacatacaaacttatctgctcttaaaacatctgcaaaatttggagtcaagaaatttttacctccttatcttgacccaaatttgcaacttcaagatctcctcactggtgtaagctttgcctcgggtggtgccggatttgatcctctaacagctgaattagtgaatgtgatgtcattgtcagatcaattggacatgttcagggagtacacaaggaagataaatgaagcggttggaagaaacagaacggcaatgatagtgtctaagagcatatacatagtgtgcgtaggaagtgatgacattgccaacacttattctcaattaccatttaggagtgctgagtatgatattccttcgtacactgacttaatggcttcagaagcctcaaacttcttgcagaaactttatggcctaggagctagaaggattggagtatttggtttaccagtcatagggtgtgtgccttcacaaagaacacttggtggaagcttgaatagagcctgcttagattcttctaaccaagcagcaatgctcttcaactcgaagctctccacccaaatggttgtgctaggaaaaaagttttcagactctaggcttgtttatcttgattcttacaacggattgcttaacatgcttcaaaatcctgctaaatatggttttgaagtgacagatagagggtgctgtggcacggggaatatagaagtgagccttttgtgcaaccgttacagcatagacacatgctctaactcctctaactacatattctgggacagttatcatcccacacagaaggcttacaatgtccttagttctttagtgcttgataacaaaattaaggacttcttctga

SEQ ID NO: 1217 - DNA, 1593 bp, Glycine max
  Peptide Sequence Number=SeqID_117995
atggctgcccagacaattgctgagactgcccagaaaattctcacccctgaaacccttcgctatgctgccaaacaatctgcacgttgccttgttgtccctgtccgtctccgccgtgccattaagaaataccttcgagagcaggaggagccatatatgaagaggaaagtcttgagattgtctcaaacattcaatcaaatcaaggatgtcaatctccagctggcatccaccacagcaaagaagatagttgaagacccttttgaacaatcaaaacgttggaagattaccagctcttatggggacattggtctcatatatagagatgaagagacaaatgcatatgtggcttctcgaatgccagctgtttactctgcttgttacagagtacttaaagagttgacacaaatgaaaggattagtgatatatgcactctgttatgagattgagtcatggagtcagatgagagcagatttgcatatggaagcgagaaccgttgcaaaagattttaggtctaaacttaatcaaacaggaaggcttccgggtttctccccatctaaggtattagattttggtgcggggacaggttcagctttctgggcactgcaagaagtttggccaaaatctttagaaaaagttaatttaatagaaccatcacaatcaatgcagcgtgcaggtcggagccttatgcaaggtctcaagaatttgccacttattcatagctatgacagcattcaatcactttctaaaagtatcactaaatcagagagagagcatgaccttgtaattgcttcctatgttcttggagagatcccatcaataaaggatcgaattaccatagttcgccagctttgggatctaacacgggacattctgaagtaccgtaagtcttctcgtaagaataatgaagtttgtaaagatttgatcactgagaaggccggtgcctttgtggttgctccttgtcctcatgatggggcttgtcctctggtaaaatctgggaaatattgtcattttgttcagcgtttggaaaggacatcttcacaacgtgcctacaagatgaaaaattttcctatgttgtttttagacgaggatcaaggccaaggcaatgatccttggccccttgatggtatggaatttgagactctgaaggagcagcatgcaaaaagaaatccagaggatcttgaaattgactacgaggactggttgaagttgcaacaatctgatgacactcctcatgaagtagctgatgcagaaactgacattgctgatgatttggaaactgatgacgctcctcgtgaagtagtgaatgctgtaacttatgattctgatgatgctgtggaaactgatggtcccattgatagtgaagaggacgaggaaagggaagaagaaagaggcagtgctgatcttggaggtggctggggcaggattgtcttcatgcctgtcagaaggggtagacaagtcaccatgaatgtgtgcagatccaccaaaagggatgcctcagagggttcatatgaccgtattgtcgtcactcggaccaagaaccctaccttgcatcaacaggccaaaagatctatttggggtgacctgtggccgtgttga

SEQ ID NO: 1218 - DNA, 234 bp, Glycine max
  Peptide Sequence Number=SeqID_117996
atggagcatattagtgttcatgtgacccaactcatttcagatgctatccatcagtttgttggtattgaacctcttaggcacccagtggacacagaaaagtccaacaaggcactgggatttcctgcgttaattacaggtctttgccagttctatggagtgtcggttacaccaacaaaacacatccgacctctgattaacaaatcatttattgaaaaatattacatgccaaggcag

SEQ ID NO: 1219 - DNA, 387 bp, Glycine max
  Peptide Sequence Number=SeqID_117997
atggctccaaagaaactcacctctaagagatctagaaagaccactgtaggagaaagatctagcacaactctacctgtagaatttgaatttgatggacaccactttttttgtgaggaacatcagcgccgctttaatgtgatcaaagattggtctttcctcaaggaaaaaaggctccaattagctgagggtgagtatattgaattccatatagagattgctaggaggcactggacacagcttcatagcccatgcctaaatatggccctgaagttgtcatggaattttatgcaaatgcttggcctactaaagaaggtgttatggataagcgctccaaagtgcggggccaatggattccttatgacacaaatgccatcaaccaagttttaa

SEQ ID NO: 1220 - DNA, 903 bp, Glycine max
  Peptide Sequence Number=SeqID_117998
atggatcatgagcaagaagcaagtgaagaaaacaaattaagccaagattgtaaggagttaattctatctcttcctagagagaagggttggataacaccgtatctctatttattccaaggcttttggtactcatcaactgaaatccaagccataaacacttttcaaaaccaattccaagctaaggacaatgatgttgttattgctagtgttccaaaatcgggcaccacttggttgaaagcccttacctttgctattctccatcgccagtattttccttccttagagaaccacccattacttattttcaatccccatgaacttgtgcctccatttgaatttgtcatttatgatgaaattaatggccaaactcatgacctatccaaaatgcccgagccaagaatttttgggactcatgttccattcacttcattggccaaatcaattaaagagactgactgtaagatcatttatatttgtaggaatctatttgacacctttgtttctacttgggtttttgtcaacaaaattatgccaaagtttttgcctacattacctctagaggaagcttttgaaagatactgtgaagggataattggctttggtccatcttggaaccatatactagattattggaaagagagcattgctaggccgaagaaagttttgttcttgaagtatgaggaccttaaagaaaatgttcattttaatgtgaagaaaatagctgagttcttgggttgtcctttcactaaagaggaagaaaatagtgaagtgattgaaaatataatcaaattatgtagctttgagaagatgaaggaattaaaggtaaataaatctggaacaatgggaaaaggcaggattgttgagaataagtacttctttcgaaaggcagaaataggagattgg

SEQ ID NO: 1221 - DNA, 234 bp, Glycine max
  Peptide Sequence Number=SeqID_117999
atgtcacatcctatcagagcattgtgtcccgatgtccttcagcacaagggtaaaaacataatatcaccaagtcaatcaatatcgatcaatacacaagcgttatgcaacatctacactaagactcaatcctatatgcaatgtggtaccatgtcagtgaaaaacctcgtcgggtgcctaggagtacatgacaagacaaaccacacactagcaagtcaggtcactctcactaggtaa

SEQ ID NO: 1222 - DNA, 387 bp, Glycine max
  Peptide Sequence Number=SeqID_118000
atgtaccctctcctgttctcagtcacaacaacccaagtagatgtaccctctacttgtaccacaaaggatgtaccctccaatgtgttaagacaaagttttcaggcagttagtcctttaaaactttgtcaaggggaaacaaaagatatctcaggcgagcaacgtttggaaactagaaaacttagaaagcttttggcaaaggaagaagaagaagaagttcaagaagatgttcaaagtgattcaaaggttgtaaaagaatatatgaaaaagttattgaaatgcaagtcaaggtctggtcaaaacttgtcactggtaatcgattaccaaaatcatgtaatcgattacacaaagcattttatgaaaagatgtgactcttcacaattgaattag

SEQ ID NO: 1223 - DNA, 147 bp, Glycine max
  Peptide Sequence Number=SeqID_118001
atgtgtctatcggggaaggagagtatgctgataaccgtaaatgagattttggatgttagcatttcgtttctaaaagaccatttagaggaaacactgggtccaacaaagataggagaaaatcactcaaagtgtatcaatctcacacag

SEQ ID NO: 1224 - DNA, 465 bp, Glycine max
  Peptide Sequence Number=SeqID_118002
atggcatcttcttcatgggaatattttggggagattgcaaatgtggctcagctaacgggcatagatgcagtgaagttaattgggatgattgtgaaagctgcaaatacagcacggatgcacaagaagaattgcaggcaatttgctcagcatctgaagttgatagggaacttgctggaccagctcaagatctcggagcttaagaagtaccccgaaacccgggagcctctggagcagctagaagatgcccttagaaggtcttacattttggtcaatagttgtcaggaccgcagctatctttatttgctggccatgggatggaacattgtttatcagttcaggaaggctcagagtgaaattgacagatacttgcaccttgttcctctcatttcgctagtcgataataatcgactcagggtatatgctattccttcgctgtacttaattgtcttactcaatactcattag

SEQ ID NO: 1225 - DNA, 417 bp, Glycine max
  Peptide Sequence Number=SeqID_118003
atggagagacttgaagttattgaaaaggatcgatgtgagtatacattagaagatgaagagcaaaaggtgcagagtgttattttgaaacctgagcctgaaaaagctgatgctgtggtgctgaagaaaactctttcctgttcttaccccaacttttctttcaccgaagcacttaaaaaagaaaatgaaaaacttcaagtagagctacaacattcacaagcaaatatggatttacatcagtatgaattcattcaacatttgctagatgtcacagaagttgcagctctttatgattctaaaaaaaatcacaagacagtagagtacagtgactacagttattctgatgccaatggtgacaaagctcattcttccaatgaaaaaatccacaaaaagaatgacactcattccgcatcagggtaa

SEQ ID NO: 1226 - DNA, 1443 bp, Glycine max
  Peptide Sequence Number=SeqID_118004
atgccggcggatcgccgtagcgctgacggaaggcgtcgacgtgggcgagcgaggcataccatgcgccttgctgctgcatgcgttcgatcagctccaggtaggcattgcggctgtcctgcggcgccggttcgggcgcggccaggctgggcgcgcgcaggtacttcggtgtggtcgatgcacagccgctggcgccggcaacggcggccagggcaacaatcaggcaggaagtgcgcagggcaggcatcagggggaccccatcttggacatggtagtggccagcgcgaccagcgccggcccggcgagcaccagcatcaacgctggcagcagggtcagcatcatcaccacggtcatcttcaccgagagcttgccgaccttttccttcaacgtgttgcgacgctgctcgcgcaggcggaggctgaactgccgcaggggctcctgcaccgcaccgccatgggcatgcacctgcaggatcagctgcatcaggctggtcaggtcatcgtcggcatagacctcgctcagccgccgcagggactgcgcgcgcgtgcggccatgggtataggcgacattggcctcctgaagttcgctgccgagtaccggcaatgcatcgcgaagcttgtcgccgagcgtctgcaggctctggtccatgctgaagcctacgccctgcagcagacgcagcaggtcgatcagcagcggcagctcggtttcgactgcacgccggcgccgcttcacccaggaagagagaacgaatttgggcaacagcagtccagcggccaaggcaccgatgatcaccatgatcctggccagcccggtgacgctgctgaatgtcagcaccagtgccagcaccagcacggccagcagcaggcgcaggccgaggtagatggccgtaccgcgacgggtgttccacccggccagatccaacagcagccgatcttcattggccagcaatgccgtttccaggcggccgccgctgagggcacggccgaagcgttcgagccagcccagcgaatcgtgccgtgcaggttcggggtcacgggacgcatcgcgcggctgcagggcggtcttcaacgtggccgttgtacgctgctcacgatggctgcgtacccagccgccgatacccagcagggcgatgccggcagccagcacgagcagggagagggcgaaccaggcgctggcgctcatcggtcgtctccggcggggcgggggttcatagcgatttggccaggcgatacagcaggaagccgccgacaagctccatgcccagtgcaagcagcaggatcttgtggccaagcggatcgtgcagcaccggctggaagaagtccgggctggcgatcgccatcagcaccgcgcaggccggtggcagcaggcccagcacccacgcagacatgcgtgtctcggaggtcgtcgccgaaagctcctgctgcgcctgttccaggtcgcgcatga

SEQ ID NO: 1227 - DNA, 614 bp, Glycine max
  Peptide Sequence Number=SeqID_118005
gtttcaatgcggcacgccgagcagcagctttcgcgcggaagcgccacgggcggggcacccgccgggccgtccgtcaccgctgccaacgatccggcgcggcccgccagcaccgggcgccgcgtgctgccgctggatggcctgctgcagcgcgcagggctgcagaccggctggaaaatccccatcatgctgctggtaccggggctggtactgtcggtggtagcgatggcgcggctgggcaccgcgtggatgtttccgctgaccctgctgctgtacctgcttggctgctggctgtgggtgatgcggcggaccacgaagctgcgtgcgcaactgctgcatcagctgccggacttcctcgacaacctggtgcggctgactgcactgggcaacagcctgcaggccgcgttccaggttgcgtcgatgcagaccagcgcgccgttgcgcgggctgttggacaccacggtgcgctttgcgcgcagcggcatggagttggaccgtgcactcgcgcaggccgcgcaaccctatcgcatggaggtgctgaaggtgttgtcggtggtgatcggtgtcagcgtgcgcatcggcgggcgctccgaccagatcctgcagcgcatgggtga

SEQ ID NO: 1228 - DNA, 390 bp, Glycine max
  Peptide Sequence Number=SeqID_118006
atggcaacagaaaggggcaagctgagttttgcttttgccctccccacctgtgccaccaccaatgaccggggcaggttcatggcaggagctactcttgatgctgtggagaaaattgtagaagaacaagatctggatgtcttgttttcagataggagtaacataatggatgttgctgagaatctgtctatggcaaagaagaatgaaatccaacacttaaagcatatggttcaattgggagaggaacataatcaaatgttgcgcacccgactacaactccttaaggaaggcaatcaagtattgtctggtgcctcacaagctgttgagaagcagttcaaaagcatgaatttaaattatggggcaaacagcggcgatgagatccatgatgtataa

SEQ ID NO: 1229 - DNA, 2301 bp, Glycine max
  Peptide Sequence Number=SeqID_118007
atgggatccaaaaatgcaaatgggaagaaccacaaggacaaaaggaacaaatttaaggataatttgagttctagttattcatcacccagtgatgccaaggttatcctcatcagtgatcctcgatattcaaaggctcacacggatcctcggttccgtgaggctccaaagcgtgaaacgaaggtggctgttgactctcgcttcaaccgcatgttcactcacaagagttttttgccctcttctgctcctgttgacaagagaggcaagcccaagaacaacccaacctctcagcttggttctctgcgccattactacaaaattgatgaaaaggaagttgagcagagtagtgatgaggaagaagagaatgaagaggaattgttgaaagccaatcaagtgaaaccggagagtgacaaaggaactgagtcagaagagaccagtgaatctgagtcagaagaaaccagtgaatcagagtcagatgtggatacagatacagaaacagatgaaggtgcagacgaggaagtttacgaagacgaagcctctgatgtcaaggaagacatagcaacgattgacaaagaaacacatagggttgcagtggttaacatggactggagatatgttaaggctgttgatttgtatgtattgttaagctcatttgtcccacctaatggtctgatcaaatcggtaagggtctatccatctgagtttggccttcaacgtatgaaagaggaggaagttcgtggacctattggtctatttgatgatgaagatagcagcaatgatgaccttgacaatgagaaactgcgtgcatatgagaagagcaggatgcgctttccaaagccaatgatgattgcccctttgccagaatcaacatttagtgcttctggagttcttgatgacgttgggtgtgtctcaagatcagaagaccttagaagcacatattgttattcactcttgtactattttgctgtggtggaatgtgactcaagtgccacagcaaattacatttacaaagaatgtgatggtcttgagttaaaacaatcatctaatgcgctcgatttaaggtttattccagacaacatggaattcaaacacccgcctcgggatgttgctactgaggtgcctgcaaattatgagtgcaaagatttctattctcgagcacttcagcacagtgaggttaatcttacttgggatgatgatgaacctcttcgtgcaaagacattgaatcggaaactcactgatgagcagttagccgagtttgaagtgaaggaattcttgacttctgatgagagtgaaagtgatgatagcaaggataacaacgagacagatgatcagcctgataaaatggcaaaaaaacgagccaagtaccgtgctttgctccagtctggtgatgattcagatggaggcaatgaacatgataatgcccagaatatggaggtcaccttcaatacaggtttggaagatttaagcaaatatattatggaaaagaaggataaaaaatcagaaacagtttgggatgcttatttgagtaaaaaaagtgagaaaaagaaggccgggaaaaataaaagaaagtattcatcagatgatgatgatagtgatgatactgatcaagaggcaactgaagaagcagatgacttcttcattgaggagcctgctgctaagaagaggaagaagccacaaaataaagaagatgaagaaccaaggcctgaagagattgatgggctatacaaagcgagcaaagaggagcttgaactgctacttgctgatgataaggggacagatactggtgtcaagggatataatctaaaatttaaaaaaggccccggaaaaaaaaggagagagaatgatattgacgaggagaagataccaagtaatgcatacaatgatccacgtttttcagctcttttctcaccaaactatgcaattgatcctaccgatccacaatttaaaaggagtgcaacatatgccaggcagctagcacagaagcaacagaaggataatgcggatccaccagtggaaagggaacctacaaaactaaaaggaacacaattgtcttctgaagattctggtaggatgaaggatgaggaagaaggattagatgctttgaagtcaaagaaagataaatatgaattatcatctttggtaaaatcaattaagatgaaatcaaagcaagttcagttaccctctgataataagacaaggaaagatggaaaatcatacattaaaggaggggaattggcctcttttatgtgctatagaacccagcaagggaaaaagaaacaaagcagtattattaaagaagtgtag

SEQ ID NO: 1230 - DNA, 693 bp, Glycine max
  Peptide Sequence Number=SeqID_118008
atgtacctcacgtccatgctatctatctcttctcatttgattacaaagttacaatgttgctgttgttgttgtcgtctcctttttctggacgtaaccccaatcttcactgaaccgcaccgcttccatttcaaggcgttcgttcactacttgctctcagttcccaacaaacccatcgctctcgtcgacgatttcctcacactgtttaaacctctctcccactctccgccccaaaactcactattctccaggctccgcagaatcgctcacaaagctaaggcgaagccgcaggagctggcagtaactgtggcgagtgatgcgtttacgcaattcaagcatctgcttctgcctattacggataggaatccctatctctctgagagtacaagacaagctatagcaaccacctctgctttagctaaaaagtatggagctgacattactgttgttgttattgacgaacagcagaaggagtcactgcctgagcatgagacccaactacccagtatccgttggcatctatctgaagagaggcttggtgatggcaacaagccagcagcaattattggtgatgttgctgatgaccttaatttggatttggtagttattagcatggaagcgattcatacaaagcatatagatgcaaatttgcttgctgagttcattccctgtcctgtcatgcttttgccattgtag

SEQ ID NO: 1231 - DNA, 305 bp, Glycine max
  Peptide Sequence Number=SeqID_118009
atggcttgtaaccatggccatggttgtgtgatgttggtgtatttggtggtgttgagtttatctgcttcacaaagttgttatggtttgggcacatttgggtttgacatacaccacaggttctcggatccggttaaggggatgcttggcattgatgatgttccacaaaagggaactcctcaatactatgctgttatggcccacagagatcgcatattccggggccggaaactcgccggggctgatcaccacgcgcctctcaccttcaccgccggcaatgtcacttaccggattgcctcctctggatt

SEQ ID NO: 1232 - DNA, 354 bp, Glycine max
  Peptide Sequence Number=SeqID_118010
atggttagacaagtcataaggaatagaaaggtacaatccgagggagctgatgcggaaggtggagttgccgtcggagaaggcgaggccggcgtcgatttgggagagcttgcggccgcggaggaggcggtcgcggtcggcgagctcggcgtagtactcgacggtgccctcctcaggcggggcggggattccggcggcggcggagtgggaccacttcctgacgggctcggagtggcggtggtgcatcgtaaaagtgtagacgtggccgtggcactgacaacactcccagagggagaggagcgacacaatgatgaaaacggaagcgagcatttttcttggttttttcgatctctctaa

SEQ ID NO: 1233 - DNA, 786 bp, Glycine max
  Peptide Sequence Number=SeqID_118011
atggcagatgatatcacattcaatcatagaaaacaaggtatccaccttactgaaaaggaaacaattcatttatgcttgactgagattgagaatatgctacaagccaatagaaggagcttgcgagattttccatccatgccatacccaataggatatgcacccaaccaacatcataataaactgatccataatgaaatggcatatgacaaagaaatgctagcagcagaattcaacacagcataccatttgctcacagatgagcaaaaaactattgtcgatatcattatgcgtgtagttaacactcaatcagctgcagtttacttcctctatggatatggtggaactggcaaaacatttgtttggacaaccttatcatctgctatatgctccaatggtggaattcctggtggtcagataacacattccaaatttgctataccagtccctgcaacacaaaattcaacatgcaatattcatcaaggcagtgagttagctgaattattaaaggttacaaaactaatagtctgggatgaagctccaatgtgtcacaaatttgcatttaaggaactagataaaagtcttaaagacatcatgcagaacaatgtgccttttggaggaaaaattattgtttttggtggagatttccgacagatcttgccaattgttccaaacggtaatcactcagacatcgttcatgcaactataaatgcatcatacatttgggaccattgccaaattcttaagctcacaaaaaacatgagattgctatcaactgctccccaatag

SEQ ID NO: 1234 - DNA, 1109 bp, Glycine max
  Peptide Sequence Number=SeqID_118012
ggcgagctgcgcctgaacggcgaggacctgcgcggcgcctcgccggcgcgctggcggcagttgcgcggccaggagatcgccatgatcttccaggacccgatgatgacgttgaacccggtgctgcgcgtcgatacgcagatgatcgaggcggtgcaggcgcaccacaagacgctgacgatggtcggcattccgtcgccgcaggaacgcctgcgcgcctatccgcaccagttgtccggcggcatgcggcaacgcgtggcgatcgcgatcgcgctgctgaattcgccgcgcgtcatcatcgcggacgaacccaccacggcgctggacgtgaccatccaggggcagatcctgttcgaagtgcagaagctgtgccgcgaaaccggcaccggcctggtgtggatcacgcacgacctggcggtggtggcaggcctggccgatcgcgtgtcggtgatgtacgccggccgcgtggtcgagaccggcagcacgcgcgacgtcatcagacatccaatgcatccgtacacgcacggcctgattgcgtcgattcccacactgcaatcgcgcggccggccgttggtgccgattccgggcatgacgccgtcgctgctcaacctgccgcaggctccggtggaggtgcggccggcgcaatgggtgcgctgctggcatgccggcgcgccggaggtccaatgagcgccgccgatcgcaacgccgcccccatcctgtcgctgcgcggtggtgcacgccgtggccggcgtggacctggacgtgcagccgggcgaggtcatcggcatcgtcggcgaatccggctgcggaaaatcgacgctgggtcgcatcgtctcgggcatcctgccgccctcttccggaccctttacgcctcgctcaacccgcgcatgcggggggcgcaagaccgtcgggcggaggcgcccgggtggcgcacgggccttatcccgcgcgcgcgaacaaggcccgagtacgtcgcctgggccttgatgcgccaggtggggcttgggaccccggcctttcgcgcagcgttaatccaccaccaagttctcggggcggcccagtgccaagcggcatcgggcatcgcgagcgccgctggcgctgaaaaccctcgg

SEQ ID NO: 1235 - DNA, 804 bp, Glycine max
  Peptide Sequence Number=SeqID_118013
atgaggggagcgccaaccgaagaaattctctcgcctttccttgtgagggatctaggcgcgcaaggtctcaaggttatacaaggaatccacaaggcgtggaggagtccgttgaagaaagacaaggagattagaggcatccgaaatggcgtcatcagaggttatgatggatggctaagaattcatacgcgagggttagattggctctccaaattgaaagttatcgatgaggagaacttcgaagctccggaggaagatgaagaagtccgagctctaaaattagagctagggaaggcaagattagccaaggagaagttcaaatcagctgctacacacatccggaagcagtgcaccgagttacatgaggaaaacgcggatattttagctttgctgatttttggggttgtcctctttccgaacgttgacggtttggtagacttagccgccattgatgctttcctcgcatatcaccatagcaaggaaagtccagtggtggctatcttggcagatttgtttgacacctttgaccggaggtgtgagaaaaacagtgcacggattgtctgttgtttacccgctctctgtgtgtggttgatttcacacctattccgacaagacacgagacacccgtgtccacttcaaagctatcgctcatgcgccgaaaaaggaagagtcgattgggaccaacatttggctaggatagggggcagcgcgatcaattggtttcctcgttggaaggaaggcaaggaaggagttcttttctcgtgtggggactaccctaatgttccactgatagggactaggggttga

SEQ ID NO: 1236 - DNA, 456 bp, Glycine max
  Peptide Sequence Number=SeqID_118014
atggaattcaaatatcgtgctgcccaagatcgaaggacatcatcaccactgccgtaccctctttccaccggcacctacgtctccgatcgcccattacgaggtggttatcccggcaatgttccggctcctagagttttccgaacgccggtgccagtcaatgccggagaagcgttccggcgagagttggagaaaaagcaaatcaggagagaaatacttgcccgcgagatgacgcgacgacgagaactggaggaggaagtcaggagggaaatagcaatagagagggtgttgggaatcccgtttcgagaacgagcttgggtgtctttgaatcaggatcaaggaatgaacaacccggttaataacaacatatttggtgggtcacaaccttcactgtcccctcaaattgatatcagcagacaacagacgaacaaggataaagtgatcatactatttagttag

SEQ ID NO: 1237 - DNA, 327 bp, Glycine max
  Peptide Sequence Number=SeqID_118015
atggtgggttacacaccttcaagctttgcggatttggtcttcgccggcgaaatgatcgaagtgggtctaaaaagaggcaaatatgatcatcttgctttgataaatgcaaaaaaaactggggcaaatgaagagggtgaggatgaaggagaagcccgtgctgtgactgccattcctatacagccaagtttcccaccaacccaacaatgtcattactcagccaataacaaaccttctccttacccaccgcccagttatccacaaaggccatccctaaaatcaaccacaaagcctacctaccgcacttccaatgacaaacaccacctttag

SEQ ID NO: 1238 - DNA, 213 bp, Glycine max
  Peptide Sequence Number=SeqID_118016
atggcgccaaaaacttggtcgatcccgacaagtgcaccggatcacgtatgtaaactaactattaaaaaggaaaatcattctagcctaatcctgatcaagcatcgtcctcagattcctcttgttggactaaactcgaccagaactgcattaagacaaacatacaaacaacaaggttaccataccccgatccctcgtgataatacgataaactag

SEQ ID NO: 1239 - DNA, 1188 bp, Glycine max
  Peptide Sequence Number=SeqID_118017
atggagttgagctcaccgcttgcagtgatcagtgctgttaagagtgctgggaggattatcaatgccgaagccatggataatgcacagctgtggttggcttgggtgcaaagctctagttggcttgcaagccttatttttcagtttttacccaatatgatcatatttgttagcatgtatatagtgatcccttcggctctttcatatctatcgaagtttgaacggcatttgacagtgtctggggagcaaagagctgcgctcatgaagatggtttgcttcttccttgtgaatctcattctcttgaggggtttggtggaatcgtcgttagagagtatgatcttgaagatggggcggtgctatttggatggagaagattgcaagaggattgagcagtatatgagtgcttcgatcctgtccaaatcatgcctctcctcacttgcatttctgatcacaagcactttcttggggatttcttatgatcttttggcacccattccctggatcaaaagaaacattcagaaatttaggaagaatgacatgcttcaattggtgccagaacaaagtgaagaataccctttagaaaatcagggcatagataatcaaaatagtcttcagaggccactgatgcatgacaatgcttatgacattgccaatggggataatgttgaaggacaagatctctttgtttatccaatcactggaagctcgcctgctcccaagcagacattcgattttgcacagtattacgcctttaatttgacaatttttgccctgactctagtatactgttcatttaatccccttgtggtccctgttggtgctgtttattttgggtatagatatgtggttgacaagtacaattttctgtttgtatatcgagttcgtggcttccctgcaggcaacgatgggaggttaatagatactgtaatatgcatcatgcgtttctgtgttgatctgttcctacttgccatgctcctattcttctcagttcaaggggactctacgaagctgcaagccatattcactcttggattactagtcatgtataaattactgccttcgagtaatgatagttttcaatcaactcttttggaggacattcaaacagttgataacgttgttgatactaggccaattgattatgaggtcttctcacagcccaggtttgattgggatacccctcaaaggtga

SEQ ID NO: 1240 - DNA, 654 bp, Glycine max
  Peptide Sequence Number=SeqID_118018
atgcaacactatcctatcagcacctatgattttgggcaaaccctgaaccataatagtgaatatggcagtggaattcacggtgggatcgctcaaattaccgtacccgtctctgaaccgcgtgatccgaagacgctcttcagtggcggagattccgaagtggacgagaaccgcgacgaggacggcgaagaggaaatgaatccagagcaagggggagcctttggggatgtgagtgatggtggttttggagaagccgtcagcgaggggggcggtgccagcggagaggttgagggggaggaggacggtgagggcgagggcggcgagggagaggaggagggcgaagctgcctccctcgatgaggaggaactgcgccgcgtccgcgccgcagtggcgggcgatttcgcggccggtggcgtgccagacggcgaggagcttcgaggcgagggcggcggggcccggcatgcggcggtggtcgctgcgcagcttcacgaggaggaagatcagaaggcagcacgcggagccgatcgcggagatgttcagcaaatagtcgatgttgccataccaggtgccgaaggggtcgccgtcgtctccgccggaagacgacggcggcggagggagggggtcgaccatatgaaattagggttctctgaagtctga

SEQ ID NO: 1241 - DNA, 2265 bp, Glycine max
  Peptide Sequence Number=SeqID_118019
atggagtttgaggggcaagacaaaatcttgggaccagtttcttctgtggctgaaaaccctgaagtgatgccaccatctagtatgcattgcttggaagagaatgatgccatgctaaaaaaaagtgagatacctacattggaaaaggacgagcttcccctgaaatatgaattttcgagccatccaaaatcaagagaaaatctgacttctgttgaagattacagaagtcaagtattcgatgttgaagttgaaaatgctggatcgcttctgcagaatgaaacatttggaggatacagtgagccaggttgcaatagcaaagctaatttatgtggtgataataatattgattccagggccagggccaccaagtcatctagtgatactgtacaagatatggttattggccccctaccaagagattgccttgttgaagattctaatggtggtcagaattctagaatcaaaatcatgcagtcggagatagagtcaagggataatgtgaaacaaatgacatcaaggactagaagtctgtctcctggtgctgagattaaagatggaaacaaacgccccagaattatatgtgatttttttgctaaaggatggtgtatcagaggtagttcttgtagctttcttcatataaaagatactggggccaatattgaccaggaggctgaagcagacttagttactactcatcagaagagacagttgaaagtggaagaaggtgttagggaaaatgttgagagatcaaggatgaatcagcaagaagcaactcctagttggcatccatctcaagaaaaacagaagtttccgctgagggacaacttggttccagagaatagatttccatttagtgcatcagacaactattttagctcaaatctttctttgacttcaactcgtgcagatggaatggctactcttaggaaccaacatatgtacaaacgatatacttccacacttttgagccattcaccaaattcgagcctggtttctcaatttccagcttcaagtatgccactctcccagcagattctagcccaatcaggacgttcactgtcttttagtaatgtggattctaaaaaatttttgaacactgacaaagaatatctcacatctaagtccactttctctggttctggttctggttcagggcgggaagatttttctcttgttaatttgtctagggttccatcatatcctgctggatataaatcaaaaatctgttcttatgattgggaaccttctgtgccctttcgaccatctttttttattacttctatgaatgtatcatctcctggagatctttatgaccctcttcgtgatagcattgaaatacctaatataggagatgggtctttgaaggcttcccttttaattcatggatcaaatatacaggcatcatcacaggttcggacatatggtgattctgctgtagttgggaaacacatggccaatcttaatgatgacaaaagttctgtatcatctcataataaattttgtgaaaatgagccaaataaaaattgtcttcctcgtgaaaaagattgtcttccacctgaaacagagataacatcaggaacttatgtacactatcaaggtaaaatgggcatggggcaacatacctttgaggttgcagataataaaaaaaaagagagagatttgactgagtgtgatgctagatgtcatggtgaaggatcagggcgtaaaaagaagagagtagacagggataagaaaaatcatgaaatggatgtcgactttcagatggatggcagcatgcagaaggaatcgaaggcactgaaatttttccgcgcggttcttattgatcatgttaaagagttgttaaaaccagcttggcacgagggtcgtcttagcaaggacacacatataatgatagtcaaaaaatcagttgacaaggttgttaacaccttggaaccccatcagattccgaccatagatactgctaagcaatatgtttcttcaagtcaggtgaaaattgcaaagctggttaatggcttaattgtcgtgggagcaaaacgcctcaagagcaggattgtggatgccccgcctgcggctattgcggatgtttccatgtctgaagaagaagaggcaatggttactgaattgagaagagtgaggcagaggtttgttaaagagaataaagaagagagtctagatgcagttgttagaggcaccagtggccatacactattgttgggaagaagagaattctcaagagagaaacaaggtcgtgagatgtcatacacataa

SEQ ID NO: 1242 - DNA, 1089 bp, Glycine max
  Peptide Sequence Number=SeqID_118020
atgtcgctccccgattctcccgtcgccaacgatgacgaaatcgatccatcgcttgacgaagaagaagaagaagaagaagaagaagaagaagaagaagaagaagaagaagaagaagaagaagaaatagaggaggaggaagaggaggaggaggaagaagtcgaggaagaagtggaggaggaagaggtagaaggagaagaagtagaagaagacgaggttgatgaagaagaggaagaggaagaggaagtggtcgaggaagaagtagaagaggaagaggaagaggaagaattagaagagatagaggtggaggaagaagaagaggagagcgaacaacgagcagaagaaatggaggaggaagaggaagaagaagtcgaagtggaagaggagggggaggaagaagaagtcgaagaggaggaggagggggaggaagaagaagtcgaagaggaggaggaggaagaagaagtcgaagtcgaggaggaggaggaggaggaagaagaagtcgaagtcgaagagaaggaggagaaagaagatgaggcacaacaacaacaacagcaagagacagtggaggagaagaaggaagagcgacaacagcaacaagaagcagaagaagcagtgaaggaacaacaaaaaaaacaacaacaagaagcaatggaggagaaggaggaggacaaattggcggtgccaggttctccactcgatgccgataaggatcgccaagaaagtatagaaaatatgaatcaattaggagattctagaatgaggctagtggaagccattgtcgagagagacatgaaccaaaaatgcaaaatacgtaaaaagtgtactgcacactgcccaaaattgcaaaccaaacagtacctaaaccatcggtttacaaataaagtactggcaccagagttgcagccagaaatagtgccagacacaccggaaaagatgctgtttggtgcttgtctggcgcaacagagatcaggtacgtggggtgtgcatgaagggttggctgagcaagcggttgccggggatggacagattggcaaccagcaagttgaacaatggttttgccagttggaaaggtcattggagttgcgatgctag

SEQ ID NO: 1243 - DNA, 741 bp, Glycine max
  Peptide Sequence Number=SeqID_118021
atggactttctgactgcctgctggcggcgaagaggatcctcctccgacggcaagggttccgaggtttccgggcggaaggaagggctgctgtggtacaaggataccgggcagcacttgtttggtgaatactcaatggctgttgtccaggccaacaacttgctcgaggatcagagccagattgagtctggtcctctcagcatgcttgacactggcccttatgggacctttgttggtgtgtatgatggacacggtgggcctgagacgtcgcgctacgtctgtgatcatctcttccaacatctaaaacgatttgcatctgagcagaagtccatgtctatggaggttattcggaaggcataccaagccacagaagaaggttttttgtcagtggttaccaaacagtggcccatgaatccccaaattgctgctgtgggatcttgttgtttggttggtgtgatttgtggtggtatcctctatattgctaaccttggtgattcccgtgctgtgcttggccgggtggtcagagcaactggggaggttttggcgatccagctttcgtcagagcataatgtggccatagaatctgtgagacaagagatgcattctttgcatccggatgactcaaaaattgtggttctaaagcacaatgtatggcgggtgaagggtctgatacaggacaggaaatattgtctcaacattgctagtcatataattggaaaaagggtttttaatctttgggtataa

SEQ ID NO: 1244 - DNA, 1209 bp, Glycine max
  Peptide Sequence Number=SeqID_118022
atgccgaacatagcaacgtttcgcttccttctgctgtggatgctcttcctctgctttgcctgtactgcgcgtgcagctcaacgagggccatttgccatgcggattagctgtggagctcgtcagaatgttcaaacaaaaccaaccactaccctttggtataaagactttggatatacaggaggcattcccactaatgcaaagacatcaagttacattgcccctcctctcaagactcttcgttatttccccttgtctgaaggtccttcaaattgctacaacattaatagagtgccaaaggggcactactcaataaggatattttttggacttgttgcacaggctagagctaccgatgaacctctatttgacatctcaattcaaggaactcaaatatattctttgaaatcaggttggaccactcaggatgatcaagcatttactgaagcccaggtatttcttatggatggttcagtctcaatctgttttcatggcacgggtcacggagatccagcaattctttcaatcgagattcttcaaatcgataataaagcttattattttggatcgcagtggagtcaagggataatactcagaacagtcaaaagactgagttgtgggtttgggcagtcaaagtatggtgtggattatggtgcagatccccggggaggcgacagattttggcaacatactgaaacttttggtgaggattctgatcgacctagatctgttgaaactagaatcaaacaggcttcacatccaccaaacttttatcctgaaactctttatcgatcagcacttgttagtactagtagccagcctgagttaacatatacattggatgtggatcccaacaaaaactattctgtttggttacattttgctgagattgataactcagtgactgctgaaggtcaaagggtctttgacattatgataaatggtgatgttgcttttaaagatgttgatattgtgaaattgagtggggatcgttatactgcccttgtgcttaatacgactgttgtcgttaatgggagaactttgactatagctttgagcccaaaagatggtagttttgccataatcaatgccattgagataatggaggttataatggctgagtcaaaaacattatcagatgaaggtttgggtggaatggtgatccatgcgttccccaacaacatccatggactggagccgattgccgattag

SEQ ID NO: 1245 - DNA, 540 bp, Glycine max
  Peptide Sequence Number=SeqID_118023
atggccgaatcttctcctcctccttccactacttcttcattttctgctttctcgcactcaatatctaagaagctcactgattcaaacttcttgcagtggaggcaacaaaagaagctcacctctgaaaccgcttcgctaaatctgactgaagtcccttcctcaaaatcgctacaacaatcctcctcctctgctcaagcaaatgttgcttctgaaaatgcaaattcaaactacaactcgaattttggttttcgtggctctggacatggtcgcggcggtggccggggtcgaggtggttggtttgctaatgtgcagtgtgaagtctgtttcaagtacggacatctagcctcggattgctatagtcattacgatcagaattatcaacctcaaatacctgctaattttcaaggatttcagatttctttgaatccttggaattcattcattgctgcacagcagaactatggagcttatcaacctaacagtttccccatttcttccaactcatggggaatgatgccaaagcaagtgcaattcccttag

SEQ ID NO: 1246 - DNA, 549 bp, Glycine max
  Peptide Sequence Number=SeqID_118024
atgaagaaagacatcagaagttgctgctacaatgaagggtcaacctccactcacaacaagcaaaataatacttgcaaggtaagctcactagcactgcaggatctcatgctgcaatttgagttagaagctaagcttagtgatgatttcagtggaataatgatgaacgactcgaacattttgaggtctacaaggaaagcattgaatcagtatccgaggttgtcacttgatggtggtagagatgctatgaaccggtcaagttttggcaacatacaaggaagaagatcagtttgctgtgatagaagactaaagggagggttaatagaagagaataatgatttaggatccaagttaaggtttggtgagggtatgtctttgccacatactttggcaggggagagtgtggtgtggtgtaaaccaggggttgtggccaggttaatgggcctagaggctataccattgccagtgagtagcataagatctgataacaaggagaagatcctttctgtttttaggatgcaaaacccaaggaggagatttagagaggcatga

SEQ ID NO: 1247 - DNA, 561 bp, Glycine max
  Peptide Sequence Number=SeqID_118025
atggacggaaacaagctcacctcacatgtggcggatgatagcatttcgtattcattggactcgctctcttttagtggccttgtttgtattcaagaccaccaaccaaagctcccttctcctaaccgggctaaacactaccaggtaagcaagcatgacccagaatttgaatttactagcactaaagcaaatttgaattctgctgtcaatccaatcaagatcactcctgctgaccaactaatttccaatggtcggcttcaaccacaagcactggccatccaaacaaatcagtctctgctcacaaatctacccagttcctcaagctcattactagcaacccgtagcagcagtaagatgccaagtggtagaacagacagcaaaatgaaatatcacgaacaacttaacaaagcaagcaaacatacaaacaagaaaagcacggtgacaaggacagggtttggccagaaaatgaagtcttttctatcaccatgccgtgaatgccaaaccattaagcaaggtgctgttaaagcacaaactgttccaggagaaaatctcaaaatttactga

SEQ ID NO: 1248 - DNA, 351 bp, Glycine max
  Peptide Sequence Number=SeqID_118026
atggttctgctagagaagctctgggatgacgttgttgctggccctcaacctgagcgtggccttggcaagctcagaaaactcaccaccctcaaaactattgatgaaggagacagtagcaagctgcagaagacgttgtcgatgccgtcgacaccgacaatcccgatgactcccacgactccaacgacaccgggatccgcgcgtaaagctgacaacgtttggaggagcgtcttccatcctgggagcaactccgccacaaagaccatcggtgctcagatgtttgacaaaccacttcccaacactcccactgctgtacagtggggagaccagaagcaggcaccgctgaaaggataa

SEQ ID NO: 1249 - DNA, 1254 bp, Glycine max
  Peptide Sequence Number=SeqID_118027
atggttggggccttactctattgcctcttctggagaaaggtcattccatttcttaagcaacgaaagactttgaaaggaaaggaacatgataaaatatcattaaggtattttgattttaaggaactagagagagcaaccaaaaattttagccaagattgcttgctaggttctggtgcatttggaaatgtctacaaaggaacctttgacttagaaggaacactagccattaagagagctcattctgaatcattctcaagtgtggaagaattcagaaatgaagttaggctcctctcagctgtaaggcacaggaatcttattggtttgattggatattgtgaagaaccagaacgacatggagccaaaatcctagtctatgaatatgttccaaacggttcactgcttgagtacatcatgggaaacgaaacgagcttaacttggaagcaaagactaaacatagcaataggagcagcaagaggcatagcttatttgcatgaaggggtgaaaccaagcattattcaccgtgacatcaaaccaagtaacatcctattagcggaaggttttgaggctaaggtctcagattttgggctagtaagatcagggccaactggtgatcagtcacatgtcagcagccagattaaagggacaccagggtaccttgaccctgcctattgtttaagctttcatttgaccaaattcagcgacgtttatagcttcggtatcatacttttgcaacttgtttcagctagacctgtggtggattccactgtaaaccaaagtaatcaacatattattgactgggcaaggccaagcttagagaagtgtagtgttgaagaaatcatagatgcaaatctactatgtcaaagtgagccatgcaacatggaagttatgctaaagatggggcaacttggtttaagatgtgtggttgaagaaccaaaacatcgcccaacaatgagccaggtgtgtcaagaactagagcaagccctctactcagctaatgatagcttcaataacaagaaatcttcaaagggattccttacaccaattggctcatcccaacaatcaacaaagtcggagactcggcgatcagttgaatcatacgattgttcacaaagctttgttagtattgacagtgttggattacagaaatttcatgttgatatggatagtttctcctttaagagcacagacttaagaaggtttcttccaactttggtgaacataggtcgtggaactggaaaagaaagaatcatataa

SEQ ID NO: 1250 - DNA, 444 bp, Glycine max
  Peptide Sequence Number=SeqID_118028
atggttctgtcggatgccgttaattttgctcggaatttcgcagttatggtcagagttcgtggccctgacccaaaagggttgaagatgagaaatcacgcttttcatcaataccggtttctaaccccacccttaatcttattttgtttttcgtttctcaaagtttggtttttttatgcacttatggcggtgggttttggttttctccttctgagtatgtgtagttctggtgaaacaaccctttcagcttcgggggtacttgtacctgatactctttgtgattctcaagtagctacgcgtcttaatggtgataactgtgaggatagggtattggttgtaacggttgcttcagttgttgagccttttctgtcacctcaacagagagacaatattcctcaggttggtgctgctagatttaggacctgtttggataaacttctctattag

SEQ ID NO: 1251 - DNA, 354 bp, Glycine max
  Peptide Sequence Number=SeqID_118029
gtagacatcacctacgagaactggaaagagatccctacttctcagaaggacctgatttgggaggatattcaggcggaatttgatatcccagaggcttctaacaataggacgaaaaggaagttactacagaccatgggggagagatggaggcagtttaaatcagacctcacgaggaaatgggcccttgcagccaatcaggacaatgtcgaggacactgtctatgacaaatacggcatcagcaaggaaaagtgggcccagttttgccagactcgcagagacccttcttgggaggttttttttaatcattccaatcacatgggtaatgatgttgatttcattttaattatcatgtga

SEQ ID NO: 1252 - DNA, 243 bp, Glycine max
  Peptide Sequence Number=SeqID_118030
atggctggagttgcagtgaaataccaattgacctcagaagatctcaggtttcgacatattgaaacacataagagtcaacactattcaagaattcaatgccaaatcactagtctgtatatcttagacaaatcaacaattcaccttagaagacacatcatccatatgatcatatccatttcatatagatcaactttattatattgggatggagaagccatactccaggcctatttactgtactaa

SEQ ID NO: 1253 - DNA, 219 bp, Glycine max
  Peptide Sequence Number=SeqID_118031
atggttcagcttcacgtgaagatgagactcccccgcgtggaaacgttacttgttgagattcaaaaccttagtctcttcgttgtcaatagcagtgtcctaccttcccgggactccatacttgacataaccactgttgttcagtacaagtcgggccccattttccccaatgcaacggttgttcataagtgcaattgtttcaatagttgttgggtaagatag

SEQ ID NO: 1254 - DNA, 516 bp, Glycine max
  Peptide Sequence Number=SeqID_118032
atggtgaaagccagacagtgttctcggctgtggcctcgcaaatcatggtggcgggtttcgtctccggccacgctcactctgctgctgctgacttgctccttcctcactctcattcttctagctctccacattctctccactccccatgccaatgccaactcctccgtttctcgcaacactcacatcgaagctgaagaagacgaccaggtagcgttgcggatggaagtaatatcctggcagcccagagcttttctctatcataactttctgggatgtgggtctagtttgtttgagtcgctagaaaattgtgaggtgggaactgtgaaggggagtaaaaatggagtgacatggctgatggaaaggaagaccaaggaggaatgtgaatatctaattaatattgccacaccacacatgcaaaaatcaacagttgctgataatcaatctggacagagtgtagtccacgagttggattccctcctttatacttttctgtcatttgagttcattcattattga

SEQ ID NO: 1255 - DNA, 720 bp, Glycine max
  Peptide Sequence Number=SeqID_118033
atggagtttgtgccaaatcaatgcccttggatgggttccttcgggaatttcgttgagagggtcaaaagggtgggtgccctcttcgtctctgccatcattgggaacatcttctccgcgatcttgaccttctgctttgcattagaaaaatgtgagaacttagatgttgttggcactttgttgggggctatgactggagccttgataggccaagagacagagagtggtttcattcgaggggccgctataggtgccatatcaggagctgttttttccattgaagtgtttgaatcttcccttgttctttggaaatctgacgaatctggaattgggtgtgtcttatacttgattgatgttatttctagcctattgaatgggagactagtgcgtgaaaggataggtccagccatgttgagtgctgtccaaagtcagatgggtgcggttgaaataagctttgatgaggtacaaaacctctttgacattggtggcgccaaaggtttatcgagagattcagttgaaaagatcccaaagatcacaattacaagtgacaacaatgttcatgcttctggggagaaagattcatgttcagtttgcctccaggactttcagcttggggagactggtagaagtttgcctcattgtcatcacatttttcacctaccttgcattgataagtggctgatcaagcatggttcttgcccattatgcagaagggatctgtaa

SEQ ID NO: 1256 - DNA, 822 bp, Glycine max
  Peptide Sequence Number=SeqID_118034
atggtgaaagggaggcagtctcggctagggcaccggaaaccgtcgagggggtcgtcgtggccggtgatgctgacattgctggcaacgtgctcgtttctcattctcattctgctcgctctccctattctctcaaattccaatgccaactcctctggtcgcttaattattaaacccaacgatctcaactccattgctctcaacactactactcacataagcgaagcggaatacgaccagttgggagagcggtgggttgaaataatatcatgggagcctagaatttttctctaccacaattttctgaccaaggaggaatgcgagcatctaattaatatagccaagccaaacatgcgaaagtcaacagttattgaaagtgaaactggaatgagtatagaaagcagagtacggacaagctctggtacttttctggctagaggacgtgataaaattgtgaggaatattgagaacagaattgctgattttacttttatacctgtagataatggtgaagaacttcaggtcctgcattatcaagttggagaaaagtatgtgcctcatcatgactactttatggacgatattaacactgcgaatgggggtgatcgtatcgcaacaatgttgatgtacctttcagatgttgaagaagggggtgagacggtgtttccagatgccaagggaaattttagctctatgcctggctggaatgagctttctgtttgtggaaaaaagggactttcaattaagccaaagatgcgcaatgctttacttttttggagcataaagcctgatgcaacttatgatccattaagtttacatggttag

SEQ ID NO: 1257 - DNA, 480 bp, Glycine max
  Peptide Sequence Number=SeqID_118035
atggataaattgtctcaaatgaaaaacaacttgttcaagttcttgccaaatcaacccttagcttcttttcaaaaccctaatctgagtcctagtggaagtgttaccccaggggcaggtcgaacaccaacacatagggtctcaattgttcccaaagaagctcgaagaaggcacaaaactgaaagttttagtggatgggagcccaattcgcccaaggtgtcttgtatgggccaagtgaagagcaagaagaagagaaaggcccatgaacagaaaaaggttcaaacacaagagagtgaaaataagaggtttttgcgttggattttcatgagaaatggtgagggcacaaaagaaagtgggaatttggaagagaaggcatcaaccacagaggtagctccatcgttgggtacaatgaagaaatttgcaagtgggcgagaaggatcattgcgtgatttcgatgtcgcacttatggaaaggttgatttga

SEQ ID NO: 1258 - DNA, 268 bp, Glycine max
  Peptide Sequence Number=SeqID_118036
atggcaagttctctgtctcaaacctcaacaacgctcttcactttcgtaattcttccttcaacacaatctaacacttttataatttcactttgcaggctgattctcccctcgcaagctattttatctggccgtgatggtatttcaggaactcaaggtcaccttccccatggaaagctcagtcgagatcgagatctaggtcaaggtcgagatctaggtcgaggtctaggcctagacaaaggccaagatcgcgttctagaagtcgtggcag

SEQ ID NO: 1259 - DNA, 933 bp, Glycine max
  Peptide Sequence Number=SeqID_118037
atgaacttctatgcgtggatgatgtttgtccctttgtggcttacgttgtcttataccgttggtgccttcagcatatgggacgatgatgggttccttcagggaaaaataattgactatgctggtggtatttgtccaacaccatggcttgaagagtcatcatcaaacatcgatctaatatggcatgcaggtttcaatggtggagctccatttcaagtgggagaaatcgcatccttggccatttacaatacccatctttgcactgccacaagcctactcgtttggcttacgcttgacatgattgtatataccaagagctcagtcataggtgctgtccagggaatgatcactggcctcgtctgcatcacaccaggtgcaggcttggtggatccatgggcagcagtattgatgggagcattgtctggttccattccatggtacacaatgatggtgctacacaaaaaatccgcattctttcaaagtgtagatgacacattaggagtctttcacactcatgctgtggctggtcttcttgggggtatcctttctggcgtgtttgccaaacccgaccttctaagaataatgtatcaagatacaaattattgccccggcttattctacaccttttttaagggggaagtggaccatggctttaggcaaatttggtaccaattacttggagcaggttttattattgtttggaatgttgttattactagcctcatttgtattctcataagccgcattgtggatcttaggatgaaagaagaggatcttgaggttggtgatgatgctgcccatggggaagaagcatatgcattgtggggtgatggagagagaatgaggatccctcttcgtcttcatataggtccaacaattccttccttgtgccgaaaaaggttttcaattcctctcactaggaaagaaggagaatag

SEQ ID NO: 1260 - DNA, 1512 bp, Glycine max
  Peptide Sequence Number=SeqID_118038
atgcgtggcgtatctcgaagagtgcaacaacttttgagacccaaacttcacaaagactcgttctattacacagaactgttgaacctttgcaaaaccaccgacaacgttaaaaaagcgcacgcccaggttgtggtccgaggccacgagcaagaccccttcattgccgcaaggctcatcgataagtactctcacttctccaacctagaccacgcacgcaaggtgttcgacaatttgtccgaaccagatgttttctgttgtaacgtggtcatcaaggtttacgccaatgcggatcccttcggtgaggctttgaaggtttacgatgcgatgcgttggcgtggcatcaccccgaactactacacttacccgtttgtgctcaaggcttgcggcgccgagggagcttctaaaaagggtcgagtgattcatgggcacgcagtgaagtgtggaatggacttggatttgtttgtgggcaatgcccttgttgcgttttacgctaagtgtcaagatgttgaagtgtccagaaaagtgtttgacgaaattcctcacagagatattgtttcttggaactcaatgatttcggggtatactgtgaatggatatgtggatgatgctattttgcttttctatgatatgttaagagatgaaagtgtggggggtcctgatcatgccacgtttgtaactgttcttccggcgtttgctcaggcagcggatattcatgcagggtattggattcattgttatattgtgaagacaaggatgggacttgattctgctgtggggactggacttatatcgttgtactcaaattgtggttatgtaagaatggcacgagccatctttgacaggatctctgatagaagtgttatagtgtggagtgcaataattaggtgctatggaacacatggtcttgcgcaggaggcgcttgctttgttccggcaattggttggggctggcttgcgccctgatggtgttgtgtttttgtgtttgttatctgcgtgcagtcatgcaggtttgcttgagcagggctggcacctttttaatgccatggaaacttatggagtggcgaagagtgaggcacattatgcttgcattgtggatctgttggggagagctggggatttggagaaagcagtggagtttattcagtctatgcctatccaacccgggaaaaacatttatggtgcattgctgggtgcttgtagaatacacaaaaatatggagcttgctgaattggccgcggagaagttgtttgtcttggaccctgataatgccgggcgttatgtgattctagcacagatgtacgaagatgcagagcgatggcaggatgcggccagggtgaggaaagtagtcaaggacaaagaaataaagaagccaattgggtatagctccgtagagctggaatcaggtcatcagaaatttggggtaaatgatgagactcatgtgcatacaacacagatcttccagatcttgcatagcttagataggattatggggaaagaaactcgtgcaatgtga

SEQ ID NO: 1261 - DNA, 360 bp, Glycine max
  Peptide Sequence Number=SeqID_118039
atgacctccttgatggaggccatgctaagcatgaagcgaatgatagagagcaacacgaccacaacagccgccactagcgccaccgctgaggcagatctgatccattcctccgccataaaccaagcaaaccaacccatccaagacgtgttgggtcaaggaggagaggtattgggtagcaccggcggtccacacgtagggcataataggaatgcttacccctatggcttaccccccaattatacgccacctaccatgcacatgcccaacgagaacgctaatcacgccgttcccgttaccttggagggtcaacaaccccagcctgtagggggcacccgtgaagaaccttgggagcatgcttaa

SEQ ID NO: 1262 - DNA, 216 bp, Glycine max
  Peptide Sequence Number=SeqID_118040
atgccccaatgtgaaagcggttgttgtgcgtccacttgtcctgatcataaatttcacagagctagggaaaaaggggtgaagatattaatgggcctgtctactctagagggagagattccctcatttaatgggggtggtcttttctggttcctctatgacaaccagtatcgccatcatcatgcccaacctctttcttgcccctctgcccactcttga

SEQ ID NO: 1263 - DNA, 144 bp, Glycine max
  Peptide Sequence Number=SeqID_118041
atggctactgaagaacccataataagagataatgttagcgacttcagtgatgacgagcaacaacatgattttgacgaacatggtgaaccaagcaatcaaaggcgagagtatcattcagcaaaatacgcaaaaggtgggagttga

SEQ ID NO: 1264 - DNA, 621 bp, Glycine max
  Peptide Sequence Number=SeqID_118042
atgccaattcacattaagaaagtcactacaaaggacgaactcaagcaatttattcgttttaactacgaactttataagaacaacgcatactccgtgcctgatttgctcgaagatatgctggataccttcaatccagagaagaacgctgcttatgacttctgtgaagatcaagcttatcgataccgtcgacctcgagggggggcccggtaccagcttttgttccctttagtgagggttaatttcgagcttggcgtaatcatgctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 1265 - DNA, 168 bp, Glycine max
  Peptide Sequence Number=SeqID_118043
atgtcacaaaaccctacggaaatcgcgacaattggtgttaaggagctcaattcggctaccaagaatccaaatggaagtaaagataaagacactaatttcgttctagggatctcaccatccaaccggccactagcggaagtccaagcagtgaaacctgtgaaagcatga

SEQ ID NO: 1266 - DNA, 171 bp, Glycine max
  Peptide Sequence Number=SeqID_118044
atggcagctcgtggtggccactggtggttgtgggtggtggaggaggagatttcacttagcaagctcgtctcgttaagcgagagtccactattggcgctaagcgtgacttttcgcactaagcgcaattcctcttgggttgggattagcgctgagcgcgacaattcgccctga

SEQ ID NO: 1267 - DNA, 243 bp, Glycine max
  Peptide Sequence Number=SeqID_118045
atggatcatgagtttaaagagaagatggacaagttacaaggagtgattgatggtaaaagggggacgggttatgcagaagggacacagttaactagttgtttttgtggaatgcattataaagtggcactttatgcattgggtggcaatgttgtaaagcagttgaagacttttgtatggatccctctccatgaagaagtgcagagtgcagacacactactgagtggcatacaaatggagtattga

SEQ ID NO: 1268 - DNA, 1674 bp, Glycine max
  Peptide Sequence Number=SeqID_118046
atggtggaagctttagtgacaggaaatgacctctgtgcttttgtgcaatcttcaatagagacaataatcttgtgtagttctcaaacttctttgagcaggacacaaagtcacagagcatttgtcattgagtatttatctcctctgtcacagataaatgagatcccaaagctgacatctggatgcactgagttcatagaatctgctgagcggattttggagaagaggaagatgaaccaaacaatgctaactaatcacagtactttgcttgacttgctagaaattcctcaactcatggacacatgtgtacggaatgggaattatgatgaagccctagatttggaagcatttgttggcaaactttcaaccatgcatccaaagttaccagttattcaagcgttggctgcagatgttaggctgactacccaatcacttctttctcagcttcttcagaaacttcgctcaaatattcagttacccgaatgccttcgcattattggatatttacggcgaataggagtatttagtgagtatggaatgcgtttgctgctccttggtacttttaatttctggcttccatttgactcaacggttgtttattgtcagttcttaagatgccgagaggcatggcttactggtatactcgaggatctggaccaggcaaatccatatgagtacttaaaagggatgatcaactgtcacagaatgcatctttttgatgttgttaatcaatatcgagcaatatttgcggatgacacatcaggaagtgaggaaaattatgacggtgggcttctttttagttgggcaatgcaccaaattacctcacacctacaaactctgaaagttatgcttccaaagataactgaaggtggatcactgtcaaatattttggatcagtgcatgtactgtgccatgggacttggttgggttggactggattttcgaggcttgctcccatcactttttgaagaagctgttctcaacttattctccaaaaatatgagtagtgcagtagaaaattttcagttggtcttggattcacatcgatgggttccccttcccggagttggcttttctgcacatactgtcggtgatgaaaatcatgaggatgtcactccgccctctaatttgatggagcatccacctcttgctgtttttattaatggtgtatctgcagcaatgaatgagctacgtccatgtgccccaataagtctaaaacatgtccttgcccaagaattgattaagggattacaggctgtttctgattcattgttgctgtacaatacaactcgagttctaaggtctaatgagtcaggacttttcctctcactctgttgggcatttatagaggctgcctatcctcattgtgcaacttgttttgggcgttgctatctgggtggagcaactctcattatggatgcaaagaatgtatacaatggaatcagccgcttattagagacttcctctgcaagagaactcccaaaaccagtgaacaatgtagaatccaagagcgtagctgagaatggcgaatcgccaaaaatggaaaatggagaaacacctgatgccaaagaatctgaagccgtcaatagtgaagaggtgaatgaagaaggcaccgaagaaggccctactttgcagacagatcgggaagacactaatcttgaaaagccacttgaataa

SEQ ID NO: 1269 - DNA, 1539 bp, Glycine max
  Peptide Sequence Number=SeqID_118047
atgacgaggttgactcgtgattttggtgatacaatgcaaagagatgctgtgcctgcggtttcttctgatgttgtgtttgcttctagtcggtttcctaattacagaattggagctaacaatcagataatagagacaaaggatgacccaaaagtgctatcaatgaaggaggttgttgcacgtgagactgcacagctgttggaacaacataatcgtctctccgttcgtgaccttgctagtaaattcgagaagggtttggcggcggcagctaagttgtctgaagaggctagacttagagaggcagcatcattggaaaaacatgttcttttgaagaagcttagagatgcacttgaatccttaaaagggcgtgtggcaggcagaaacaaggatgatgtagaagaagctattgctatagttgaagctctagcagttcagttgactcagagggaaggggaactaatacaagagaaggcagaggtgaagaagcttgcaaattttcttaagcaggcttctgaagatgctaagaaacttgttgatgaggaaagagcttttgctcgtgctgaaattgaggatgccagagcagcggttcaaagagtggaagaggcacttcaagaacatgagagaatgtctcaagcttccgggaaacaggacctggagcaattaatgagggaggtccaagaggctcgaagaattaaaatgctgcatcagccaagcaaggtcatggatatggaacatgagcttcgagcattgaggtctcaacttgcagagaagactagacagtatcttcgacttcagaaggagttaacaaggacaaagaaaggtggggaaaatgttccacatttatatgaacttgaagggaatgaaacgttaggttcttatttgcaaattcaaccttgctctgataatgcccctgaagtttcaaaatgttcaattcagtggtatcgtgtatcatctgatggtgccaaaaaagaacttatctcaggagcaacaaaatcagtttatgcccctgaaccttttgatgttggacgcatattgcaagttgatattatttcagaaagcgagcatgtcacactttcaaccgctggtccaatagatccagctgctggtttgggaacctatgtagaggcactagtgcgcaaacatgacactgaattcaacgtggtagtaacacagatgaatggttcacatcatccaactgaatctattcatgtgcttcatgttggaaagatgaggattaaactttgtaagggaaagacaacaattgccaaagaatactattcaagttcaatgcagctttgtggagttcgcggaggtggaaatgccgctgcacaagcactattttggcagccaaagcaggggcattcttttgtattagcttttgaatcagagagagaaaggaatgctgccatcatgcttgcaaggagatttgcatttgactgtaatacagacattcagacaattactgagaattctgattgcattttgtctatggacactggcctcgtggacaggacaatatgtgaatctactctcattatgtaa

SEQ ID NO: 1270 - DNA, 300 bp, Glycine max
  Peptide Sequence Number=SeqID_118048
atggggcttagcgagtctctgaacctacatgatgaaaactcgaaggcggcagcgggtgtgagtgcggcgatgtctttgatcttaggtgggatttttgtgtttatagtgtgttattatgtctgcattcgtcttcgctcccaaacccacagagacgtgcctgctgccgccgccgtcgccgccgtcagtgaccaagaaacggtcgagaagtgtcccgtattcgtttactcgacggtgaagaaggagaatgtggcggcggaggagtgcgccgtgtgcttaggcgagtttgaagactgtgacgtg

SEQ ID NO: 1271 - DNA, 294 bp, Glycine max
  Peptide Sequence Number=SeqID_118049
atgaagaaatttgataccttgactggaggtcaagttcttttcaaggtggagaaggatgttatgaatttcgatttgatgactcttgcagagttaaacatatgtgatgactccagtataattgaagagttcaaggtggaggataatgtaagcactccacaaaagatggcccttctaatggtttcgtccaagatattatctgtcaagttgaaagcttgttgtcttgatattggttcgttatttgttgggctgcactccattcatcaaagtgctgatatgccaacaaagatgcagtag

SEQ ID NO: 1272 - DNA, 441 bp, Glycine max
  Peptide Sequence Number=SeqID_118050
atgggttttagacatctccatggtttcaatctagtcatgctagggaggcaaggctggaaattaactaccaaccaagatgttatgcatccatgcttcacgggtattatcaaagagggaataaaatggagagtagggaatgacaaatcaatttctgtttggaatcaaccatggatttgctcttctagaatcagttccagaccttcatctatcccaccaaatggcctcgaacaactcaaggtaaacactctcatcagacatgattttaattgttggagaagtgaaattctcgaacagatattcaatgaagatgtcaaagagatacaacaaatgcctttagtcaacattgttggacaagataaaatcatttggaggcttggcagcaatggagattacttagttcgtttagtgccatcaccttatggagaatatgttgggcaatga

SEQ ID NO: 1273 - DNA, 894 bp, Glycine max
  Peptide Sequence Number=SeqID_118051
atggaagctatttctacaatgccaagtactacgactcatcaaccagtaaggtccattagtttgcccacaagagtgcacccttcttctcaaagagttgaagcacttttgaaccaaattaagcctcacacatgtttggaagcagagacaattcaaagcgatttggtggtgcttgctgagttgtacaactgtatggaggaactcttcaattctccacagacccaacaagcacttttgcactaccaaaatgggaaactagtggaagaggcattgtgtggctcagtgacactcctagatgcatgtggcacagcaagggatttattgttggctctaaaagaacatgtgcaaactcttcaatccgccatacgcagaagaagaggagattcgagcatcgaaaacagcatttgtgaatatggtggcttcaggaagaaggccaagaaggaaattgccaagcaactaggggcaatgaagagaacggagaacaaagttaatacttgttttctaatgggtcaatctcaagatcagcatttgatttacctagcaagagttctaagagaagcaagcaccatcactatctctatatttcgttctcttttgttgtttctatcaatgccaggactcagaacaaaagggacctccatgatctcaaagctaaagccaatgagattgttttcttcagagaaagggcagaagaacactaatgttgtggaccttagtgctatgtgctccctccttggaagggcaaaacacagtgatgccaaggttgaagttcaaattgctctaagagtgttagagacattgaatgttagcattgatggtcttgacggtggattagattgcattttcagacgtatagttcaaaatagagtgtcatttcttaatatgcttgctcattag

SEQ ID NO: 1274 - DNA, 870 bp, Glycine max
  Peptide Sequence Number=SeqID_118052
atggcaaacaagtaccataagcttcgctcaataagtttgccttctagatctcatcctagcaccgttagagtagaggaggagctgagaaagatcaaaacttgggaaggaacatccacaatatccacatcaaagtctattcacacaggcctttcattgcttgaagatttgtacatttgcttggatgatcttctcaacatggcatccacccaaaaggtgatttctcaccataggggtgacaaatgtgtggaagaagtgttggatggttcggtgagaattttggatatatgtggcatcacaagggacaccatgttgcaaattaaggaaaatgtccaagcccttcattcttctcttcgaagaagaaaaggagactcatgtgttgaagcaagtgtggccgagtacaagttgttcacaaaaacgatgaagaagaatgccattaagttgatctcatctttgaagcagatggatggcaaatttggggtgtccccacttttggatcttgatcaccactttgctgctgtgattagagttcttagggaagtcattctaatcaacttgtcagtcttccaatttattttgtcattcttgaccgtgtcttcatcgaactcaaagacatccaaatggtcgttggtggcaaaattgatgcataagggggcaaaaccatgtgatggcaccaatgatgagatgcagtgtgtggaagcagctttgagctccctcctaaatgaagggactaatgatgacaagatacatgtggcacatgaaaggttggaggctttggaggatgccattgaaagttttgagaatggtttggagagtttgtttaggcatttgattaagactagagcttcccttttgaacataatatctcagtag

SEQ ID NO: 1275 - DNA, 228 bp, Glycine max
  Peptide Sequence Number=SeqID_118053
atgatattgttactcctcctcatctccaaagacgataacgtcggttgggacaaatttggtgtgacaaagcatatgtctaccaacggcaattttgaagcacttggtgacagtgttagtggtggtgacaacgttgacaagctcaattgcatacatgtactaatggtggttgaagtgaaggaagagtggaaagaaaaatgtgttgttggaaacattggaagtgaagagtga

SEQ ID NO: 1276 - DNA, 957 bp, Glycine max
  Peptide Sequence Number=SeqID_118054
atggcggaatcatcgtcatcgtcgttggcgaagtccgactcggaggtagaagaaatgctggatcggatgctgactcgtttggctctctgcgacgattccaagctggagccgctgctctccaagcttctccctctctgcatctcctccctctcctcgcaatccgtcgccgttcgcaacaaggtgcttgagattttgagtcacgtgaacaagagagtgaagctccagcctcaaattggtctacctttgtctgacttgtggaaattgtattcggaatctgctgctgtccctatcataaggaatttctgcattgtgtatatagagatggcttttcagcgtgttaatgcgaaggaaaaggaagatctggcacctgatctcttggtgaacatctcaaaacttccacttcaacaccaggaaattatccttagaatcattgttaagcaaagatcaccctcagttataaatcttcaggatatgactacttatggatttctgcttccttctagtggtggattccctcctgggctttcagtagctcaagtcaatcgtgttacggggaaacaacaattgcaaagtaatgaaattttactaagaaagttgggtattttgaatgtcattcaagctatggagcttgctcctgagcttgtttatcctttatatattgctgcctctgtagattgtgaagagcctgttattaagagaggcgaggagcttctaaagaagaaggccaatggtgctaatttagatgatttaaatctgatcaacagactatttttgctatttaatggtactgttggagttgaacatgttgattcagaatcaagagttagtcccgggagtcctgctttaaaggcaaaattaatgtctatattctgcagatctattgcagcagcgaacaatttcccatccaccttgcagtgcatttttggttgcatttatgttttatttgaggttgtttga

SEQ ID NO: 1277 - DNA, 1153 bp, Glycine max
  Peptide Sequence Number=SeqID_118055
taatgacgacaatgacaatggtaatgatagtaacgacaatagtaatggtgaatgcaatgacgatggatgcaacaacaatggtgacaacaacgatgatagtgatcatgatgctgataatgatattgacaataataatgatgatgtgataacgacaaaggtaatggaggaaataatggtactggcgataataattaatggtgggattgatgataccaatgatgataacaataatagtgacaatgatataaaaatgacaatgccaacagataacactgatgatgacgataataatgatgacaataacactcacaataaagatgataataatgacgataagggtgattcctactgtggagaaggttgccagagccaatgcaaatctgcaacaccctcaacaccaactccaacaacacctagtagtggtggagatattagcagactcattagctcttctctctttgatcaaatgcttaaataccgaaacgatggccgctgttctggccatggattctacagatatgatgctttcattgccgctgctggctctttcaatggctttggcacaaccggtgatgacaacactcgcaagaaggagattgctgctttcttggctcaaacttctcatgaaaccacaggtgggtgggcaagtgcaccagatggtccatatgcgtgggggtattgttttatcaacgaacaaaaccaggcaacttattgtgatggtgggaattggccatgtgctgctgagtggagtaattatggatggatcttgactctttgtaacagcaactacaattacgggcaagctggcaaagcacttggtctggatttgataaacaatccggatcttgtagccacagacgcaaccgtgtcattcaagacagccctatggttttggatgactgcacagggaaacaagccatcaagccatgatgtgatcactggaagatggactccatctagtgctgacagctcagcgggtcgggctcctggctacggtgtcatcaccaacataatcaacggtggcctcgaatgcggccacggccaggataatcgggtccaagatcggatcggcttctaccgaaggtactgccagatgatgggaataagccccggagacaacttggattgtaacaatcaaaggccatttgcttaa

SEQ ID NO: 1278 - DNA, 279 bp, Glycine max
  Peptide Sequence Number=SeqID_118056
atgtcatcagactcaaacatggtcgatcccgcatgccccatccctaatcttcccaaccaatccgctaccaccattgacgacaagaatcagaaggttggcaagtttgaaggctacatagttcaaagacttgctgacgggagccccattagccgtgttacaagatttggagatgcttctgctaaagaattctcaagtgcttatgaagaagctcatttcatttttcttctcttagaagtgcttttggagaagtttatggaaacatgccctttaagaagctag

SEQ ID NO: 1279 - DNA, 1338 bp, Glycine max
  Peptide Sequence Number=SeqID_118057
atggcacttgaaggtctttgtcttcttaaaagtggaagtgaaattgttggtcttaagtatcccaaactgggtatgatgctggattacattcttcggcaacagccaaagttgttggagtccagtgaaactagagaacagaaccttctttttccttcaaatacatatgtggccatgattaaatttttattgaagtgctttgagtctgagttggagcagaacaaatccttagaaggatcatctgaatttatttcatcagtgaagacattctgtttggttctcgagcattctatgtcatttgaaggctctgttgagttgcatgccaatgcttccaaggcattgcttataattggatcacatatgccagaggtggtagcatcacattttgccctaaaagtttcatggcttaagcaactattaagtcatgtggattgggacactcgtgaatccattgcacgcatacttggtattgtgtcttctgctcttcccatccctgatgttatgtctgaattgacttccttattcagccaatcacacaaatcaaggtttgagactcagcatggagctctttgtgcaataggatatgtaactgcaaattatttgtctacaacacctatgccagaaatatttctccaggatacacttagatgcctggttgatgtggttaattctgaaacttctgcactggctgctgctgcaatgcaagcactaggtcatattggactacgtatttcattacctccacttgatgattctaattcagatggaattctgataatgttatctgataaattgagcaagcttctctcgggtgatgacattaaagcaatacagaagattgttatatctattggacatatatgtgtaaaagaaacatcgtctactgagctagatatggccctaaatttgattttcagtctctgtcgatctaaggttgaggatattctcttcgctgctggggaggccctttcttttttgtggggtggtgttcctttcaatgctgacataattctgaaaactaactatacttcgctgtcaatggcttcaaattttttgatgggagatttgacctcttcagtatctaagcagagtactaatgaacaaagtgaatatagtggagattatcatgctgctgtgagagatgcaattaccaaaaagctctttgatgttcttttgtatagtagcaggaaagaagagagatgtgctggaactgtttggctagtatcacttataaagtactgcggcaatcatcctactattcagcaaatgcttccagaaattcagtttataacctttggtgcccaagcaggagtgcttggtcaaggttgtttgctgggctga

SEQ ID NO: 1280 - DNA, 234 bp, Glycine max
  Peptide Sequence Number=SeqID_118058
atgtcattgcctagcgctgttcacgtgttctctattatcaagtgcgaagcttctggtgactgggaagcacgttattctgttgttttccagatcggttccttcgccaagtatatgtatatgtgtatatataagaaaaaaaaagaagtagagatgagagtcgtcatcacagaaagggcaggacggacgaaatcagtgtcctatctttgctttcctcttatctccgatgagaggtaa

SEQ ID NO: 1281 - DNA, 1362 bp, Glycine max
  Peptide Sequence Number=SeqID_118059
cttgttgaagacactgaagtatttacggatggagctcttggggaaagtgctagtggagggaaactgaacacttacaaggagttgtgtaacttagcaaatgagatgggacaaccggacttaatttataagttcatggatttagcaaactatcaagcttctctgaattcaaagaggggtgctgcttttggcttctctaaaatagcaaaacaagcaggggttgttcttaagccatacttacgttctttaattccaaggcttgtacgctaccagtatgatcctgacaaaaatgtgcaggatgcaatgatacatatatggaagtcacttgtggatgattcaaagaaaaccatcgatgaaaatttagatctcatcattgatgatttactagtacaatgtggatccaggctttggcggtcacgtgaggcatcatgtcttgcccttacagacattattcaaggacgaaagtttcatgaggttgggaagcatttaaagagattatggtctggaacatttcgtgtaatggatgacataaaggaaactgttagaatttctggtgaaaaattatgccgtgctgtaacttccttgacaacaaggctctgcgatgtctctctaactgatatgtcagatgcgcacaaagcaatggatattgttttgccttttttgcttgcagaaggtatactaagtaaagttgatagtgttcgcaaggcatcaattgcagttgttatgaagcttacaaagcatgctggaactgcaattcgtccacatatgtctgatttagtgtgctgcatgcttgaaagtttatcaagcctagaagatcaatcactcaattatgtcgagcttcatgcggcaaatgttggaatacagtcagaaaagcttgaaagtttgagaatttccatagccaaaggctctcctatgtgggagactttggattcatgcataaaagttgttgatgcagaatcattgaacacattgatcccacggcttgctcatttagtgcgatctggagtgggccttaacactagggttggtgttgccaatttcattaccttgttgcttgaaagtgttggtgttgacatcaagccatatgcaaatatgttggtgagattgttgtttccagttgttaaggaggaaagaagtactgctgcaaaacgtgcctttgcaagtgcctgtgcaaaagtcttaaagcatataccagcctctcaagcacaaaaacttattgaagatactacagctttgcatgctggtgacaagaattctcaaattgcatgtgcatttctcttgaagagctattcatccatggcagcagatgttgttggtggatatcatgctgttatcattccagttgttttcctttcaaggtcatga

SEQ ID NO: 1282 - DNA, 1044 bp, Glycine max
  Peptide Sequence Number=SeqID_118060
atgtctccagcctatttgaggaactatgggaagaatacacaagtggggaacgaatcactctccacttgtacttgggagaaattgtttcacttatttgtgagggcatgtcatcatcatcatgggcaatctgccgaggctatatgcaggcttagtgaagttttgggtgaatctctttcttctcaccatgaggttttgcttcagtctctcatgaaggaaattcctggtcgcctatgggagggtaaagagatgctattgctagcagtaggtgctctatgtacatcctgccataaagcaattttgactcaaggttcctcatcttccattgccattctgaatttggtatcatctgcatgcaccagaaaggggaaaaagtatcgtgaagcagcactttcctctctcgaacaggttataaaagccttggggaatccagagttctttaatatggtttttcccttgttgtttgatctatgcaattcagagcccctaaagtccgggcaagcacctttggccagtgacgctgctggatcagagttgaacagtgttgaagagatttctgttccacataacaaaatagttgactgtttaacctcttgtatccatgtggcacatataaatgatattcttgaaaagcaaaagggcttagcacacatgtatacagcattcttgttacctgaacataaatggactgtcaaaactacagcctttgtatccatcagagaactttgctcaaggcttcaaaatgttgtgaaggactcccagggaagtaacgaacttgctggagcaacttcctttgttcaggagatatttcattctctgtcaccaaaaatactacattgcataagcacaataaagattgcccaggttcatgtttcagcttcagaatgtcttctggaagtcatgaaccttgccatggacgtcccttcagttggcaccatcaatgaaggattcaaggacgagctgcttcatcagtacgagatagagaagaacgaaggtgcaaagtcaatattaaaaaagtgtgtcaacattcttcaagactggaaatag

SEQ ID NO: 1283 - DNA, 588 bp, Glycine max
  Peptide Sequence Number=SeqID_118061
atgacccaagagctggtagcccgcggagacaccttacggttatccgcacctcgtcattcagtgaccccaagtgtgattgacgagcagaggccaatgtggtcatctgcgccctttccggagatgtcatcattttccgatggagacttttcaagtctcacaagttatccagaactacgtaggtctgagttcctcattggaggatacgtaggagcaagagcctcgcttttgtcgaccgcaccgctttttgttaccatgatccaagagctggtagcccgcggagataccttacggttatccgcacccttgtgtcatccagaggcggcgggcccgatgatacgcggagataccttacggttatccgcacccttttgtcatccagaggcggcgggcccaatgacaagcagagacaaaatttggtcattctgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatga

SEQ ID NO: 1284 - DNA, 1273 bp, Glycine max
  Peptide Sequence Number=SeqID_118062
actgttgcatctgcggagtgccagagcgagcagcccgaccaacaaaaccctcttacgagcagcgagtggcagcagagccccgcgcccagccggttccaggcattgatcacgagcaatgcccatgctcaggtcactgatgcccctctcatcgaaatgcggcgccaacgcatcgaacgccgcctgcgacggcgcaccgtcggtcaagcgagtcagcgcctcggcccagcccagcgctgcgcgttcgcgtgcatcgaagaagcggctttcgtgccacgcgggcagggtgtccagcttgcgcggctcgatgccgcccttgcgcagcgcggtgccgtgcatgtccatgcagtagccgcagccgttgagctgcgacacgcgcaggaacaccagttccatcagggtcgggtcgatcgaactgtcatgcaccgcctggctggtggccaacaggcccttgaaggcctcggcggccaggcgggtgtaggggacgcggggagaggcgtggtcggacattttcggctccatggcggccacgttggccgcctttcattaccaggacgccgcaccgccatcgcgcgtgacaaccgacggcagtttttccggattcagcacgctgtacacgttggcgatgcggccatcggccacttcgatggtggtgaccgagtgcagccgatcgccatggaagcgcaggatcgccggctcgccgttgacgtagcccagctgcgccggatgcaccgcgccacgacgtgcgatggcccagaacaggcggccgatgcgctcggcgcccagcagcgggcgtaccgctgcggtgaccacgccgccgccgtcggagaccagctgcgcgttggtgtgcagcagggcctggattgcttcgctgtcgccgcgctgcgaggcatccatgaagcgcgccagcagctgccggtgctggctggcatcggcattgaagcgtgggcgcccggattgcaggcgctgccgggcccgatgcaccagctgccggcagttggcttcgctgtggccgatcaggtcggcgatttcgcggtagtcgtggtcgaacgcctccttcagcaggaaggcggcgcgttcctcggggccgagctgttcgagcagggtcaggaaggcgaccgagacatcgttggccagcgcatgcagctgcgccgggccgggcgccgggtcgggctccagggtgaccgccagtggctcggccagccaggggccgacgtagtgcatgcgctcgcgcttggccgcgcgcagccggtccaggccaagccgggtggtggtg

SEQ ID NO: 1285 - DNA, 873 bp, Glycine max
  Peptide Sequence Number=SeqID_118063
atggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttatggggatggaattgttagggccgatgttccttttcgaagggcagaatctaaatatagtgtggaacaagtag

SEQ ID NO: 1286 - DNA, 291 bp, Glycine max
  Peptide Sequence Number=SeqID_118064
atggttcaactgatttctgataccatctattgtttacagggatcgcgcccacaagacgcccagtggacccgaagaagtccaacagggccctggggtttccagctctgcttacgggcctctgtagtcctacagggtgcccattccccccggcaagggatcgtgcccgcaagacagctagtggactcgaagaagtccaacagggtcttggagttgccaagctctaattacgggcctcggtcagttctacggagtgtctgtcgcccccagcaaggtcatcaacccccctactaa

SEQ ID NO: 1287 - DNA, 405 bp, Glycine max
  Peptide Sequence Number=SeqID_118065
atgtggaggcaagtgaaagccacaagccaagatgagtcgattggaagaaggaggaacatcaatcccgttcatgtcgccttcattgttgataagtacctttgcgacaataatttctcaagcacgcgttccatctttcgcaacgaggcatcttctctctttgccacttcgtcaatcaaccagttgccgaagactttggaggagatgctggatgagtatatatttttgaagaaacaaaatgcgatcctgaatcaagaaagagtcatggtgatggaagagaaaaacaggattcaaatactgttgcaaggcatgcagaatgccctgaacacttacaatgcttttcagaggccaccctcactgaatgtcgcggggatgaatgcaaattttgcagtagttcctcaaccgaga

SEQ ID NO: 1288 - DNA, 798 bp, Glycine max
  Peptide Sequence Number=SeqID_118066
atgattagtgtgtctgacaagaagagaaaagatactgaagcagtaaatgggcctatagttgcaaagaaacctcgtggtagaccacctggcaggaaaaatcaagtccaaggtgaaaacacatcaccacaatcaagtaatgctgtcaacaaccaagtagtttcttggccatcttcttctgcaactcaatcatcatctgggaactgtgcacccagcggatcactggttcaaggatccaatgctgtcaaaggctcattcaatcaccctccactttttgttccagacaattccccaattccaaagacacctacaacacaatcctctcagagtgatacatatgtatcccctactaaaatttatcctgctgcatcttgcaatggagaggctagtcctacttgttgcactatgaatccaaccaacaaagttatggttggccctgaaacacaaatggcttataaagagaacagtcattgcaattctcctatcgaagtagatacaggcaaatcaagtaagaaggatgacgtaaggagcaaactgaactttgatgcctctaatatgcctgagagcttggacaaatcattgtctaatgaggtttatacatctgagtctgacaaggaagttgacatatctgacattgatttttcaaacttgatggattgctgcccattcctaggaatcacatccgaagatttttcttaccatccagttccaactcattccaaggataatgcttcaacgtcttctcatgaattcaatgctaatcatttgacttaccatcaaactgcaaacaatcaccgataa

SEQ ID NO: 1289 - DNA, 657 bp, Glycine max
  Peptide Sequence Number=SeqID_118067
atggcttctggtgccagagaagttgctatttttgcatcagcttcggaatcattttcaaaatcaaacattaactgtagcatcgaagagagccttattcgtttccgagctgttactcgtgctgctaaacaactctcaattcctgttcgagggtatgtatcatgtgttgctggatgcccagtggaaggaccaatccctccttccaaagtggcatatgttgctaaagaattatatgatatgggttgctttgaaatctcccttggtgacacaattggagttggcacaccaggaactgtagttcctatgcttttggctgtgatggctgtagttccaatagataagatagctgtccactttcatgacacatatgggcaatctcttccaaatatacttgtgtccctccaaatggggattagcacagtggattcctctgttgctggtcttggtgggtgtccatatgctaagggagcttcaggaaatgttgcaactgaagatgttgtttatatgttgaacggccttggtgtcaaaaccaatgttgatcttggaaaactcatgttggctggggatttcatcagcaaccatttggggaggccatccacttcaaagactgccattgccttgaaccgtgtcacaagtaatgcatccaagatatcatattaa

SEQ ID NO: 1290 - DNA, 1887 bp, Glycine max
  Peptide Sequence Number=SeqID_118068
atgcgccatgagaaacagcttcaagaagaccatgaccatgatccgggttcgtgggaatcaatggagggtcttcttcgttgccctgcgaatttcgttcctctgtctcccatcagcttcctagagagagcagcgaaggtttgcagagacagaacctcgcttgtgtatggttctttggagtataactggggtgagacccatcaacggtgcttgaaactcgcttctgctattacccacttggggatttcacaaatcactactttctggatgctacttgatttttcatctgcactgcaatgcttagatgtttctacaaaatgtgctgcacttttaacaattctaatttgcgttgataaaacttttgctagggaacaaatatctggaagcatcttgggacttccaaaggtaaatgaatcactgatgatattccatgttgtttctgcacaggttgccaccctatcacctaatgtccctgccatgtatgagctacattttgctgtcccaatggctggagccattctttgcacccttaactcacgcttagatgcggctatagtttcagtccttcttgagcattcacaagccaaggtcctttttgtagactatcaactacttgaaattgcacgaggagcattggacctgttaggcaaaaaagctagagaattgccaattttagttctaattgccgacaatgattgcacatctcacattgacattacttcagttagttatgagtatgaaaggctactggctgatgggcataatggttttgacatagtgagaccccattgcgaattggatcctataagtataaattacacctctggtaccacatctaggcctaaaggagtagtcttcagtcacaggggtgcttatcttaactctctagcaacggttttgctctttagaatggatctttttcctgtttatctttggaatgttccaatgttccactgcaacgggtggtgcctcccttggggagtggcatcacaatttgggaccaatgtttgtgttaggaaggtcactccaaagaacatttttgacaatatagctcagcataaggtgacacacatggcaggagcaccaacagtgcttaacatgattgtgaactctgcattgactgatcgaaagccactcaatcacaaggtggaggtgatgacaggaggttcgcctccgccaccacaaattcttgccaagatggaggagattggctttaacatctctcacctttatggcctcacagaaacatatggtccaggaactttctgtgcatggagacctgagtgggacttgttgccccatgaagagagatcaaagatgaaagcaaggcaaggggtgccccatgtggctttggaggaaattgatgtgaaagatccttccacaatggaaagtgttccatctgatggcaaaacaatgggggaggtaatgtttagagggaatacagtgatgagtggatatttgagagatttgaaagcaacaaaagaagctttcaaagatgggtggtttcatagtggggatctagctgtgaaacattctgatggttacatagaaatcaaggacaggttgaaggacatagtagtctccgggggagagaatattagctcggttgaggtagaaacagttttgtatagccatccagcggttcttgaagctgcagttgttgcaaagcctgatgatcattggggccaaactccttgtgcttttgtgaagttgaaagaggggtttgatttagatgctctagaaataatcaacttttgcagggaccatttgccccattacatggctcctaaaactgtcatttttcaagatatgccaaaaacttcaacagggaagatacagaagtttgttctaagggagaaagccaaggcttttagaggcaaccaagcataa

SEQ ID NO: 1291 - DNA, 411 bp, Glycine max
  Peptide Sequence Number=SeqID_118069
atgcgcttttccatctccacagcagaaacagttcttgtctgtgtggagatggataaagtgaccccaaatctttatggaaatctagttgcaaacactgcagcaggcattgctggaggcactggagtcatgccaggaggtaatgttggggctgagcacgctgtgtttgagcaaggtgcatcagcgggaaatgtcggtagtgataaaataagggaacaaaagaaagccaatccagtggcgcttcttctctcgtcagctatgatgcttaggcatctccagtttcctgcatttgctgaccgtttggaaactgctgtggaaaaagtcatcctggagggcaaatgccgaacaaaggatcttggagggacaagcaccacccaagaggttgtggatgcagtgatagatgctttagattga

SEQ ID NO: 1292 - DNA, 1104 bp, Glycine max
  Peptide Sequence Number=SeqID_118070
atgtctaggttatggttttccacaccattctttgttatcattctccccgtggcggtggctgcgcttttcttccggctcgaaccgttcgatccgggttttttgccggttcagctgggccggtccaccgtggcggttccggcaagtaacggccacgtgcgagttggatcggaagctatgggcgagggacacttggagggccccgaagacttggcctacgacgccgcggcacgtgtcgtctatactgggtgtgaggatgggtggatcaagcgagtcacggtgaatgactcggtgcttgactcggcggttgaagattgggtcaacacaggaggaaggccacttgggctaactctgaagccgaatggtgaactcatagttgctgacgcggaaaagggactgctgagagtgtcaagtgaaagggagattgagctgctggtagatgagtatgagggcttaaagttcaaactaacagatggtgttgatgtagcagatgatggtaccatttatttcacagatgcatctcacaaataccctgtgaaagatgctgtgttagacatcttggaagggaagccaaatggaagattcttcagctataacccagcaacaaagaagacaaccctgcttgccaaagatctctactttgccaatggcgttgcagtttctgcagatcaacaatttgtggtcttctgtgaatctgtcctgatgatatgcgagaaatattacgtacagggccctaaaaaaggaaccatagagaagttttgtgacctacctggcatgcctgataacattcattatgatggacaagggcactatttgattgcaatggtcacggcccttactcctgaattggaattggcatatagataccctttcattaggaagacttttgcaattgttacaaagtatgtagggagtctacctatctcgaagaatggaggagttctagtcgtggatttagaaggaaaaccaactgcacattattatgatcccaaattatcattgactagtgcgattaaaattgggaatcatatatatggtggttccattttctacccctttgtaacacgttttgatattgagaagtaccctgctctccccacagtttga

SEQ ID NO: 1293 - DNA, 279 bp, Glycine max
  Peptide Sequence Number=SeqID_118071
atggctgaagcatgtggtaaccccctaaactttcacaatgctcgtaaaatccgggacattgttgtcttgcaagtcgagactgctgctattgtaaataagaattcactagttggtgacccccctacggatgttgtacctcctttagtgttcaagaagaaaaacaaggataagttgaaaaggaaacaccataaacatcaaaaatcattcgaggattcttccgaccaccatcgctcaaatcctatggtgtgtgccaaaacgtactcgcctaaaggtagtgag

SEQ ID NO: 1294 - DNA, 495 bp, Glycine max
  Peptide Sequence Number=SeqID_118072
atgtctcatctgagccacaagaccttggtttatcttcctgaaatgaggcctgaacatgaagctgaggaaggccaagccaatagtcttagttccatttcttcttggcctcatcgtttggagaatgttttccctgtttatgccatgggaacttccaaccctgtcttgaattcttcacttcacatttcggattgtcttgatcctatttgggatgttgtcagagaagaagccaagttagaggcagaaaaggagccaatattaagcagcttcttccatgccactattctatctcatgattgcttggaggaagcattggcttttgctcttgccaaccgtctccaaaagcctactcttttggctactcagcttatggatatattttctaatgtgatgaagcatgataaaggtatccaacaatcgattcgcttggatattcaggcatttaaagatcggaatcctgcttgtttgttatattgctcagcacttttatttatgaag

SEQ ID NO: 1295 - DNA, 516 bp, Glycine max
  Peptide Sequence Number=SeqID_118073
atggagaaatactacacaagggtttttggagttgatatacatcccgctgcgaaaattggggatggaatcttagtagatcatgggacaggtgttgttattggtgaaacagttattgttggaagcagagtttcattgatgcaaggtgtaactttaggtggcacggtaaaggaaacaggtgatcggcatcccaaaatttctgaaggtgtgctaattggagctcatgcaactatacttgggaatataagaattggtgaatgtgtgatgatagctgctggctctcttgtgttacaagaggtccctcctcacagcattgtggctggtgtaccagcaaaggttattggaagagtacatgagcattatccatccttaaccatgcagcaagcttcaacaagagtttggtacatttacaattttggagcacagctcagtcatggggagtcttattcttggcattggagtctctcaacaggggatctcccaacctttgcattgttgaaggatacatcaccctcttaa

SEQ ID NO: 1296 - DNA, 335 bp, Glycine max
  Peptide Sequence Number=SeqID_118074
tcttcaaccccatagatagtttctctttctctttctccatggatcttcaagatttcctccttcgtgctcgagtcttgatgctttacaggcaagcattgagaattactggccgagccccttcttctgctaaaggggtgcagtttttctacgtagcagccatgcatggcgccattggtgatggcgccttcgacagggacgagccacgtggctgtgtcgccactgcgactggcgacagcagcgatgtcgccacctgcaatggcgctttggccatgcagggtggagtcgctggtgcagcttttgctgaaaacgccagctcctttggcgatttagggtga

SEQ ID NO: 1297 - DNA, 234 bp, Glycine max
  Peptide Sequence Number=SeqID_118075
atgcagtttttctacgtagcagccatgcatggcgccattggtgatggcgccttcgacaaggacgagccacgtggctgtgtcgccactgcgactggcgacaaaggactgcatattgcagctcttattggcgcgtccaagggtgcatggaagcgctggtttgaccagcgacttcagcacctgcaagctgcaggcataggctgcaacagcacctgcagctactcagatcgtagctag

SEQ ID NO: 1298 - DNA, 1197 bp, Glycine max
  Peptide Sequence Number=SeqID_118076
atgcttgaggcttgggtttctctcaagaagacacttcaatgcaaaccacagccaaatcaagttcatgatccaaagattactaggcagcaaaaaggtaatcagagaacaaagtcaagtaatctagagagttcaaataccaaagatttcatccaaggaagcaagaagcacttaaaaaaatcactaagttatagaggggacattgacatcactagtcccataacccatgaaattgttctcgacagctcaaacaatggaacttgtcgatgttgtccttgtcctcaaagcaataacggcaataaaggttcggaaggttctcatagaacacgaaggtcagctacatcttcaaaaataacaatgacatatcctgttgattacaatgaagcaaatgtttcctccaacacaagggcgttggttcagatggattctgatggttgttccacattgacatgtcataaatgtcgcaagaaaatgaaaaatcttgatgctgtagaagcacaccatatctcccagcattcagtcactgaacttgaagaagattcatctagacagataatagaaacaatatgtggaagtggaacaagctctattattaattcggaaaacatgttggggcagattgattgcattttaaaggttctgaatgtaccaaaaacctttgcttgctttgaggaatatagagaaaaggtgaaggataacgctgacaaactacagaagaagcatccacgttgtgtggctgatggaaatgagcttttaaggttccatggcacaactattgcatgctctcttggcacaaacagttctagcctgtgcactttagactattgtggcatatgtcaaatcctgcgaaatggcttctccaccaacaaggaattccatggtgcattgggggtttacaccacttccacaagtgggaaagcctttgaatccatttccatcatgacatcccatgagaggccatttcctagaaagtctgtcatagtgtgcagagtaatagctgggaaaattcatagtcctcttgaagaagaaagggttgattcagagtttgattcattggcagaaaaaataaatggtcattcttcagatgctgaggaactctacgtgttaaatcccaaagcccttctcccatgctttgtggtgatctacaaacatcaaacagacaaggttaggaggattttaggaggttcagctcaagcataa

SEQ ID NO: 1299 - DNA, 309 bp, Glycine max
  Peptide Sequence Number=SeqID_118077
atgaccaaaaactatggcttccttatctgcatacttgtcattgtcttggatattgttgctggaatacttggaattgaggcagaaatagctcaaaacaaggagaagcacatgtgggtgtggatatttgagtgtaggtacccaagctatcaagctttcaagctaggattggcagctgccacattcttggcacttgctcatgtaattgctaacttgcttggcggatgcatttgtgtttggtctaaagaacaatacctatccgccacagcaaataggaaattagcagtggcttttctaattttctcgtggtaa

SEQ ID NO: 1300 - DNA, 174 bp, Glycine max
  Peptide Sequence Number=SeqID_118078
gagaggatcatccacaaaagatggttcaaggcaaatttgtctcaaatttgggggaggtattatcaaggtataaaagctaagtgcctaagaaaaagggcaagtatggggaaggaaaaaaatgaaggttattctatggatgaatgctctcctagaacctatgcttttgaatcctag

SEQ ID NO: 1301 - DNA, 663 bp, Glycine max
  Peptide Sequence Number=SeqID_118079
atgaagcccccatctttgcaaaggatgccccgacctttggtttgcttcccggaagcttccataattaactctgttgggattcatttaaaagttgtttcccaaggtaagacaactgttgctaaggtcgtatatgccaaactatgttatgaatttgaaagttgctgcttcttggaaaatgtaagagaacaatcgcagaagcatggattaaattatttacatgataagcttctctttgagctgctgaaggatgaacctccccacaattgcacagctgaagttgtaggatccaaatttgttttgagaaggctcgcaaataaaaaagttttgattgtgcttaatgatgtgaatggttttgagcaattagaatatctggcaagagaatttgtctgcttgggaccaggtagtagagttattataactacaagagataagcatttgcttattcgaagagttgataaaatacatgaagtcaaggaattgaactttcaagattcccttaagcttttcagcttagttgcattcagagacagcaatcctcaaatggaatatatagagctatcagaaagggcagttgcatacaccaagggcaatccattagctctgaaagtgtttggcttcacttttccattccaaaagtatagaagtatgggaaagtgcacttag

SEQ ID NO: 1302 - DNA, 318 bp, Glycine max
  Peptide Sequence Number=SeqID_118080
atggagattgtggtgggggtggtggagttctctggaactatagagtcctacaacaactacgaaaacatgtcaacggattttagccatgcaacgattaagagcactagaactgagtattccttcaacaacctcgaatcaggcttgcaaactttcaggggcgcagagattctctatgttgacagatctagcgctaaacagattgcgtttagcttaccttgttggaaaccagaccgtgccgtggcccactctggaacacttagctccttcaacaacagcggaaccggatcccagactttcgacggtctcaagtttaactga

SEQ ID NO: 1303 - DNA, 1200 bp, Glycine max
  Peptide Sequence Number=SeqID_118081
atgaaagacattgccgacaagaagcgttgcgacgttgactttgctgaaggggactctgtcttggtcaaattacgacctcgcagacagtcaacagtttcagggggcaactacactaagctcacaaagaaattctatggcccattcaaagttattcaaaaaatcggccccgtcgcatacaaactcgacctgccggcctcctccagaattcatcctgtcttccactgctcactacttcgaccttaccacccccattcaccctcacaagagacccccgccacgctacccgcctccgctgaagataactaccctctcataactcccctcaccattctagacaccaaatggcaggactcaggaaatgagaagaagcttatggtcttggtgcaatgggcaggccttttgccggaggacacttcctgggaatcatgggcaactttgaaagagacttacaaccttgaggacaaggttgttttcgatgaaggcgagaatgttacaattaatgactcagcccaaagcaatacagagcaaagcataatcaagcatggtgagcaaggaatagaatcaaacacagaagcaattcagggagtagaatccaagccagaaacagggaccagcatggaaaaagcatcaagaccaaaaaggggagttattaagcctcgtttgcggtgtcttcatccttctgttttatcctccgacacgcctgttactttgatactcgataggtgtccaaagcttgagagagtagaaggtgagaagcatttaaaatctctagagaagatcagtgtcaaaggctgctcaagtttggagaaatttgcagagtcatcagatttaattgaaaacttggatttgagcaatacaggaatccaaacattgaacatatcaatagggcgtacgcataatcttaagtggctcaatctggagggtttaagactcgggcatcttttaatggagttatcatgcttgatatctctcaaggagttgaagctttcggatagtggatttgtaattgacaaacatcaactacatgtcctgtttgatgggttaaggcccctacaaatactatattggaagggttgtagtaacttgtttgaactacccgacaacatcagtgtcttatcacaattgcaagaactaaggctagatggaagtaatgtgaaaaggttgcctgaaagcattaagaatcttcaagtgttggaataa

SEQ ID NO: 1304 - DNA, 279 bp, Glycine max
  Peptide Sequence Number=SeqID_118082
atgaacgaactccttgacaaggaggctaaaaagctggatgaaaaggttcgacgttttgttgaacaaaagataggtgttgagatgaaaaaggccaaattgaaggagaccctggaaagatgtgaaggtcaaaaaatgaaactgaaacaagaggctaagaacaagcagaggttgaatgagaaatgggaaggtttcagaacagcttttgcagacaactgcggagcaccggtagctgatgactgttggtggcatcaacccgaacttttgattttttattattaa

SEQ ID NO: 1305 - DNA, 914 bp, Glycine max
  Peptide Sequence Number=SeqID_118083
gaattttcactgacctcaggagaaataaacgtgttgaacttgagagggacagcaatcgaaacattagcatttccatcggtcgtctcagcaaaattgaaaagctctctgtctgccagtcactcaaatatgttccaaaggagttaccttctctgacatgtcttagtgaactgaatcttcataactgcagacagcttgacatgccaaatttgcataacctacttgatgctttgcgttctgtcagaaagctgattttggacgagtgttgtaacttttctcgagtcccttgcaatatcaagcatctttggtgccttgaatacctgtccctaagggattgcacggggcttcgatttatacctcagcttccaccatctgctgaacatttagatgccatcaactgcacatccctggagacagtgttgcctctaatgcctttgagacaaccgggacaaaatgacataagcatttcatttgaaaactgcttgaaattagatgaacattcaaaatatggtattacagaatatgccaacttcacaatgaagcatgttgcatatgcaaatgacagtggttcacatcatctgaataaaagaggtggtgctgtttgttttccaggaagcaaggtgccagagtggtttgaaaacaggacaacaacaccggcttgtgtaactgttcaacttcctccaccttcccacttgttgggttttgctttctgtgttgtgctttctcagtttcaatcaaatgctaagtatgagtatcatcagatagtatgtcgatggtgcttggaagatggtaaaagtgttggatacatacgtagatggtattacaaagctatcagggaattgaattcagatcatgtttatgtatggtatgaaccatcttgtgaaaagataatcgacatactatctgatcgccattaa

SEQ ID NO: 1306 - DNA, 234 bp, Glycine max
  Peptide Sequence Number=SeqID_118084
atggcggtaggaaactctgatgagacagaaagcaatggcataaaaactcaggtgcagaatcaagaaaaagactcctcctgttattgcttacctggtatgtctcttgttgaagcaattatggagattggtaagcacttgcggtggagcaattgggaaatatctggacgtttcttcgtctgcttgttgattgagaagcaaatggagaaaaacagaaatagaaaaatgtatagttag

SEQ ID NO: 1307 - DNA, 330 bp, Glycine max
  Peptide Sequence Number=SeqID_118085
atgactcctagtcatgatgcccttctatatcacaacgggaggtggaacatgccacgccaaggcgaatttatgggttacttgttcacaggaaaaaatccaaaaagatttgacattccttcgggatgtagcatcgacgaactcaaggatgtgatcaagcaagttgcacctcaagggatctccccttatggtattcatgaatcacaaatggttaggcgattgttttttcgacagccaggtcattctgagtattcagaaaaagttatcaaatttgaaataattgatttgaaaaccgacaatgatgtgttgaaggtcttagtaaagtctaactag

SEQ ID NO: 1308 - DNA, 174 bp, Glycine max
  Peptide Sequence Number=SeqID_118086
atggctcgtagagttccaactgtaatagacagtgacatgattttgtcttatggtcgacaactggtgaagtatatgatgattgatgaaccttcaaaacttatggaggtaaaactttcttcattcgccaagcttgtagctgaatactgttccagctgcagcaggaactctttataa

SEQ ID NO: 1309 - DNA, 387 bp, Glycine max
  Peptide Sequence Number=SeqID_118087
atgtattttgctgaggtaacactacttgagaacaatatcattatttacaaatttgtacaagacctgcatttctttgtcactggtggtgaagatgaaaatgagctcattctagcatcagttcttcaaggtttctttgatgcagtcacccttctgttgaggagtaatgttgacaaaagagaggcacttgagaacttagatctcattctcctgtgtcttgacgagattgttgatggagggatgatacttgaaacaaatggacctcttattgccgaaaaggtgacctctcatagcttggatgctgatgcccccttgtcagagcagaataacaatgtcatgttacttgatcttcaatctgaccggaagaagttattaatcgaaatattgtga

SEQ ID NO: 1310 - DNA, 519 bp, Glycine max
  Peptide Sequence Number=SeqID_118088
atgaaaaagaaaaagggaacatacttaacgtggctcgtggctcgtcttgacactcgagagaaaggtgcgaagaggcaccggcaatggagggacctgaccatggttttcccggtggcaaggatgtcagaggagagggcgatggcagactggtggagctggagaggagtcaggtacggagggagctttagtagccaaatccgcaactttggaggccggatctgcgacgttgtgagcggcactggttttgcttgtggttatggtgggaatgagaaggtgagggtcagtgtgagagagagagcgccagagatgaaaaaggagcactttccaaagacggttctaaagtctaaaccgttgttgaacacttgcgttcaaagacgcaaaagtgtatataaaaaaacttcgtaccccattgcccagaggctcttcgctatgcgaaggtatagggaagggatattgtacaagcgatactgttgtatatacatcctagcatttgcaaggtgcagaactatggtgacctaa

SEQ ID NO: 1311 - DNA, 549 bp, Glycine max
  Peptide Sequence Number=SeqID_118089
atggaggatggggtctcgcttaaggagaagtatccaagactataccagatttctcaacaacaacaccaacacatccaacaaatggggacaatagcaaatacaggttggaaatggaagcttcagtggaggaggttctttttggaggctgaaatagacactgttgcaaaatttatggaagacttacagcgtctgatgggagattcaagcggtaagtatacaatggggagtgcttacgaattactcaataggaatttgccattggagagtcaagatgaaacgtttaaagtattatggaagataaaagtctcaagtaaagcaacagtttttgcttggagattgatcaggaaaagattgcctacaaagaataacttaagaaggaggaatgtggaaattaatgatgtcacttgcccattttgcagaagtcatgatgaggacgaggctcacttattcttcacttgtgctaacatgttgccgctatggtgggaatcacgatcatgggtaaacatagtgggtgctttcttggaaaatccaaaacaacacttcctttaa

SEQ ID NO: 1312 - DNA, 324 bp, Glycine max
  Peptide Sequence Number=SeqID_118090
atgaggagcaatcatgtgcgtttgaactggggcattacaatgcctcttattggattaggcacttattccttcccaaatgataggaagacaacagaacttgccgtcaacaatgcccttgagaccaatggttcagcaagagttagaatgggtgccacagatgtcattgccagcgttaaggtgggtagagggggtgatgagttgagagcaaaactgtcaaatgctcttcaatgctgtctcttgggtggtaaaagtggagctggcctattttccccctatagtgaagattatgctttcccttccatgttgcgtctttttaatctctaa

SEQ ID NO: 1313 - DNA, 207 bp, Glycine max
  Peptide Sequence Number=SeqID_118091
atgagaaggtcttcttggttaaacactggactcaaaagactaaccgcttttgggttcattgcaagaagcggatttgcttcttggttgattactggactcaaaagactaaccgcttttaagttcattgattttacaaggatagtggaaatctcaagcggattgcttggggactggatgcaggcatgggttatggctgaaccaggataa

SEQ ID NO: 1314 - DNA, 366 bp, Glycine max
  Peptide Sequence Number=SeqID_118092
atgataggaggaagattattctgttttctgctagctatgcaaatagtgagtttggtttctgcagtaaggaagccgtttcttccagcccaagaacagactctacagtctccaccaccagataatatagaatcaaaaaagggtatagaaggtacatcagagacaatgaaggaagcatatgatggaggagtgagcaaaatagggtcaagcccaccaagttgtgagcacaagtgctatggttgtgttccatgtgaagccatccaagttccaagcacgagcaccaggcgcagccatttgggaatccagtatgcaaattatgagcccgagagctggaaatgcaagtgtggtctttccttctatagtccatga

SEQ ID NO: 1315 - DNA, 1002 bp, Glycine max
  Peptide Sequence Number=SeqID_118093
atgagtgttctgttccgtgttcgcattcatgacaggtcaacaactgagaagggtggtggcaagagtaagagacagtggaagctatggaagagcacttcagaagggtttgggattggatcatcaatgcataaggggcaaggtggtggtggttcctttgtggtagatggtggagcatttgctgctgctttggctgctgtggtcagaactccactcaaagacttcatggtcatcaagcaggaatgggctgccattcgtatccaggcagtgtttcgaggtttcttggcaagacgagctttgagggccctgaaggcagtggtgaggttgcaagctatatttcgtggttggcaagtgagaaagcaagcagctgttactctaaggtgcatgcaggctcttgtgcgagttcaagcacgtgtcaaggcaaggaatgttgggaactctcaagaagggaaatatgcacggtgcaatgaagctgatcctgttaagcaagctgagcaagggtggtgtgacattccaagaactgcggaagaggcaaaattacaaatgaggcaggaaggagcaattaagagggatagaacaaaggcatattctcagtctaagaagaaattgacagcgagtccaaactcaagagcttctaagtcagtgattcctctcaagaaccgcaagctagacagaaagagctcgggatggaacatgctagatcgctggatggctgcaaagccatgggagagcaggtcaatggtagagatgtatttggactcacctgtcatgactccagtgaccagtaaaagtgatcatcttgttcttccctttaattcgaatcaacaaattggcacggtcaaagcaagaaggaatggtgtgacaactaggatttcaactaaatctcttacaactagtcaatcaactccatcatcttcagccataagctctgaatgcatgtatgatgatagccctatgtcaacttcatgcacatctggatccacagctcgaccatctaacaacaat

SEQ ID NO: 1316 - DNA, 279 bp, Glycine max
  Peptide Sequence Number=SeqID_118094
atggacgtggtctatgtgactcatactcatccatgtgaaatgaagctcatcaagcttgactgtgacactcttagagatactccacttggaaatgaaactctaaccataggagtatttgcaagtcgaataagagttggtttgactataggtgcaagtggtacaaatgtggggacattggcagcttcaacaacagctgccggtggtgtaacttcaattacaacctcttcagtgactagtgcatttggagagcaaccatttcttcatgcattgaatgaatga

SEQ ID NO: 1317 - DNA, 555 bp, Glycine max
  Peptide Sequence Number=SeqID_118095
atggttttggggcctctgcattccactggaggtacaacattcccgaattggctaagaaacacaagccttggaggatttacggctttggttgcagcaactgggttgcctgatcttgccaatggtgttgctctactaaattctgctgggcaatttggtgatgggaaaagggagactaaaacttctgaagaaacagctctacaaaagtttgtcctaaaacctttgaaggaagttttccagcgtgtggttcttggatttttattctggcaggcaaagcaaccagctcggattctgtcagttctaaaaagtgtgtatataaattcttccaatgtggatgactatctcgtggaatctataacaaggccagctcaagatccaaatgccggagaagtttactacagccaaagcgaatcgaatcaaagagttctatccaaaaacaactcttgtgaactgcaggctgggcattgtccacatgatgagacaccagagcttgtgaacaaggctttattggattggttgaccaccctcacttctgaagtgactctccaaacagtttga

SEQ ID NO: 1318 - DNA, 633 bp, Glycine max
  Peptide Sequence Number=SeqID_118096
atggcagcagaatcatcagagggcgaagaagaaaccaagttaagcggagggagcttattgctgaccgttgacgacgacttaacggaaatgggaaagaaagccgcttggagcgtcagttcctgcaaacccggtaacggcgtttcctctctccgtgacgacaatctcgaaacctattggcaatccgacggagggcaaccccatttggtcaacattcagtttcaaaagaaagttagacttcagttgattgtgctgtacgtggatttcaagcttgatgagagttacacgccgagcaaagtttccatccgtgccggtgatggttttcacaacttgaaggagattaagaccgtggaactcgtgaagccaactgggtgggtttatctatccttatctggagttgatcctaggcttgagatcacagagttaaggtgtattggaatgatgaaatcggaccttctccctgcttttgatcatattgtgtttggggcattatcagtgttgttaaatatcttttttgacaacctccataagctattgaggccgagggaggcccaccatggcagcaccataaggcacaatggcatgtttatatggcagagtttcagccttccaccatgttctgccatccaccattaa

SEQ ID NO: 1319 - DNA, 2106 bp, Glycine max
  Peptide Sequence Number=SeqID_118097
atgggaactgatggcggtgaacagatagagacattaccaaatcctcgctcctttaaggtacatcgtacaatgtgcacagaactcaggaaattagttgataggatattgcggattattccacagatagaagcagcacgcccttgtggaatgcaggctctgtgtttgctgaacaaggcaattgataaagccagacaactgctgctatactgctccgaaactagtaaactttacctggcaataacaggggattccatactctcaaaattccagaaggcaagaaaatcgttagccaaaagcttagtccagattctgaatatggttccagttatgttggctgcagagatttctcgactaattggtgatcttgagtgtgtgacatttgtcttcgactctgctgaagaagcagctgggaaggttgtgaaacgattgctccagcaagatccttcaacgtcagataaagatttaatggaggaatctgaaataaaagattttcagtttgtagcagcaagacttggtattacatccccaacggccatcctaatagagaaacgatctattaagaagttgctagaaaaactcaaacgaaatgaccagacaaaagagattgtcttgaaaaatcttttgtttctcctgataaagcaccggaaatcaatcacaggagaacaaatggaggtctattctcaaattgaagtaccaattacaactgagaactcaggtcatgagtctcaagaaaaccttcatgtcaagtcagacccatacttgagccatggtcagtatagaactcatgccggtgatttgagcagacttacacctcctaaggaatatacatgtccaatatctttaaggttgatgtatgaccctgttgtcattgcttcaggaaaaacatatgaaaggatgtggatacaaaagtggtttgatgagggtaatactatatgccccaaaactaaaaagaaactggttcatatggcattgactccaaacattgccttaaaggacttaatattaaagtggtgtgaaactaatggagtctccattcctgacccgagtaggctagtgcaagattgtcactcatgggaagcttcctccaactccattaggagttttggaagttctttgtatgatttgaacttcccaacggattttagtaacatgtctcttggatcattagataccaattataattcagattcctcccacactaaggccaatcatagcttaaatttgatgttgaacaagagcagtgacaattcacacaggcatcaatctcgtgcacggatacatgatgctgattggatgcatttgtctaaactccatgagcgtcaatgggaatctcaatgccaagtcattgaaaatataaaaatggatttcaaatgcaattgccaagctttttgctgtgtgtcatctgagaatttcattgacccactcacgagatttctgagcactgggtgtgagcggcatgatgtaaaagctctgagagcaggaactaagttgctattggaatttatgaagtgttgcagaaatggtatgaccaatttaagtgaagatacgtgcattatgttggaaagtcttcttgatacagaagtgattggtgaagctctcaccataatggaagaactgacagggaattggtatgaaaaaactaacattgcagcttccagtgtactctcttctgtttcaaagatccttgattcagagggtagggttactgttgttgaaacaaaaggatgcatatcttctgttgttgaaatacttgagactggcagtgatgaggaaaaagaacctgcgctggttattcttctctccttatgctctcaacgtgtggaatactgtcagttggttatgtatgaggggattattccttctcttgtcaacatctccaacaaaggaagtgatatggcaaaggcttatgcattagaactactccgtcttttgaagggtgatagcgagtttgagtatgaagattgttgtgagccaaatctcaacggctctcaagaacctaacaacaatcactatcaagaaaagaaatcgtcaaagaaaccgtcaattttgaagaaactgtcactcttctcaaaatccatttcagttgcaccaaaaaccaagagatga

SEQ ID NO: 1320 - DNA, 416 bp, Glycine max
  Peptide Sequence Number=SeqID_118098
atgcccctcctctgccacctttacctcggcggcaacttcttcttcggccagatccctctcgagtacggcacttggcagcacatccagtacctcgccctcttcggcaacgagttcgccggcaacgacctctcctacaacatgctctcaggcgaacaggtcttactcatttggatttggacggagtctggcatcgaagaggttggtgatggaatcggcgacggtatcgtcatggcgatatcggagagggaagggatgaagccactgttcttccagaggagggttttttttccgttgtcagagtcgagcgtgaggtacgataggggggagctcgttgcggcggagcaagtcgatagcgagtccgatgtttctgcggtcgtcaggggtggcagccgcggcggcgttctcatgatttggtg

SEQ ID NO: 1321 - DNA, 4338 bp, Glycine max
  Peptide Sequence Number=SeqID_118099
atggaaagcgtggcgcattctcggcaacctccagacaagaaaatcaccgccggcaccggcggtttcccagccgaaactctatacgaccacgtctacggcggagcggcgaagttcaccgccggcggccaccaccactccctctcgccgtgcttcgaggactacggcgagattttcgccagcttccacgagccgcgcgcctccgccattccggtgctggatcttccggcgctcgacgccgccggcgaggtcttcttcgacttccgaaacgccgcgcgcgactactccgaaatcttccgtggcttcgacggcctcgacttttggctctcctatgaagacttgtttcgccacggtgtctccgaagaagaagatgatgatgatgatgaagaagaagaagactggtcaccggtggaaactcactcattttctggagacttggagctttttggaaataatcaaggtatgtcaaatggagatcatttgcggccttttgatggaagtacggagttcaacatttcgtatcataaggttgatggtacaagcaatgaagatatatcgaaggggaaaagtcatataagtcagctgcgtgctgatcttgaattcactcatgtatttgatgaaaccacacactttcataggactgatccttccttacaggtcgttgatgatgttgaccttgacatggaatataatgcaaggcagacaaagagaaaccatctgagaaaaatggattcccaaccgggtagttttaattctggtgaactggttcttggtggtgatcttgattggcatgacggatgcaacagaaatggttctcattccagtgagacattcgtaactgtgtctgacatcagcctcagaactctagcctctcaagtgccacccccttctcggccaccacctgcattggatgcaatacaggagctcactagtagatttcattcaaacaatgagtgggttgattctgaagagactctaggtgacacttcgccacccttccttgatgtggaggttgatatgaattcatctgctgctgctgtcaaagaagtcatgcacagaccggaagcaaaacctaggagtgccaaagaattaaaggagaggaagaaaggggttttccaaagcaatgtacattcaagttatgatgtaaaaaataatgaagcaaaggtgagtgtgaatataactagatttaatagtttgaatgacgagggaatgcaggcgacttgtgatcagagaattggcaaaaataaagtttctgccacagatgaaaggcagaaaactaggaaggctgccccagaaactcttgaatcgttagaagaggaaagacttctacaaatgtttgaggaaaagcacatcaaggaatccaggtcatctcaagaatcagatagaagtactggagttgggacatggaaagaagcaactgaattttttgaattggtgggaacagaagaatctggaaagttaattcagcccataaatcatagtagtacaaagagtttggtacaagataccagaatacatgagcatggcaagaaagaaagagaagcatttaacattgaggaaagcaagaagaaatctaaagcaggaaatggggcttatgaacagggaaaaatcattaagaaatctaaatcatctaatgaggaatgcaggcagagagaaaatgtgaagaatgaggaaatggtggatatctttgagcttgaaatgagtgagaaggcaagaattgttcgctcgcatggaaaaactgacaagaaagtacctaaagttgaccaatcaggaagcttaaaagacatgcccgagacacaatgcagggagcttaaacgagtggagggtgagaaaccaaaaaaggttgatagacaactgctaaatgaagttcagcagagcacaaaacatattgaaaatgagaaaaaactcaaagaggatgaacagcaacaactgagtttgagaaagctcaagcagtctaagatgaaagaaaatggaaaaattcaaagagaagcttttgctcttggagttgcagaggttgagcaaagggtgaaaggttctgtgatgctggaaaaatttgaaagatcaaatgagacctttaatctggatagtcctgaggaaaatatgactggcaaaagagaaaatatagtcatccttgaacaagataaacagtttcagaacaagaaggaactgaaagagacatgtgaaaatgaagaaattgagaaaagtcttaaaggttcttttaaattggaagaaaatgatgaaggcttaaagcatgctcctgagcaggtacagtatgaaaagggagttcaacaagactttgaactggaaatgaatgagaaaataactagagtgcctttccagcagggggaaaatgaggcatatgaaagagatcaaggcaaagaaaaacttggtgagaattatgatgggtatagaaaaggaaatagactaaaagatgtgattgatagcaaaggggttcagaaagttctgaaacaagctccagagctagaaatgtatagtggaaatgaggctcagaggaagaaagaaatagagagcccatcaaaccaagcatttgacagggaagtaattgtggctatatcacatgaggatagtcactccaagcaatctgagaggatgctcaaagatgctgataagaatgaaaaagataagggattggacaaacctttggaacaaatggaaggtggagaagggataaacatgagtttttcaaaagaaaccaatgaggcatggaaaacagagagtgatgaaaatcttctggcagctcagtcatcctccattcatgaagaaaatattcgaaaaccagaggtatgtcaagaccctatttctgaccaggaaattgaaaagacaggaagtgactgcatagttggtggaaagaaattggaagaggtgtgtgtggaaaatctaaaggataaagggaaaaaaggagcttcagaaatgtcccaaggagaagcagagcattcaggaaaggcggcttccactgcaacaaatgttgatggtgatgagcatagtattagttgtgaaatgacaaggactgagaaaactaagacagcccctcaaatggaatttgatcctcaaagtagagagaggaaaattgtaacaaatggcgattacagaaggaacacaatagctgctgaacctgctacagtgcaagacccggtaaatatccagaaaccttctcaaaggtctcatgtatcacattccaccagaagcaaagagaaaattcttgatgaaacttctgcctcagttgacaaagatggtgagaggataagaagagaaagagagttggaaaaagaccgtctcagaaagatagaagaggagatggagagagaaagggaaagacagaaagacagaatggctgttgacagagcaatgctggaggctgagagggaaagggaaagagaaaaagatagaatagcagttgataaagcaactttggaggctcgtgatagaacatttgcggatgctcgtgagagagcagaaagggctgcatttgagagagcaactgcagaagctcgacaaagagcactggctgaggccagagaaagacttgaaaaggcatgtgctgaggccagggacaaaacatatgctgataaggcagctgcagaagccagattgaaagcagagcgaactgctgtagaaagagcaactgctgaggctcgagagcgtgcaatggaaaaagtaaaggttgatagagctgcattcgagtccagagaacgattagagagatctgtctctgacaaatttagtgtttctttcagaaatggtggaacacagggctcttcatcctcagatatgctggatccacgttgtcagaactctacctccttcactcattccagatatccatattcctcagtttatggtgcttcctctttttctgaaagatcagaacgagaaggcgaatcagctcagaggtgtagagctagactggagaggtatcgccgaacagctgagcgtgcagcaaaagctttggaagaaaagaacatgcgtgaccttgtagctcagaaggagcaagctgagagaaatagattagcagaaactctggatactgaagtccggaggtggtcaagtggaaaagaaggaaacctgcgtgcattactttcaaccttgcaatatattcttgggcctgatagtgggtggcagccaatcccactcacggacgtcattacttctgctgctgtaaagaaggcttataggaaggccaccctttgtgtccatcctgacaagttacagcaacgcggagcgagtattcaaaacaaatacatatgtgagaagttgatttattttgaaccatctgcaaaggaggatttgtcagagcaaaccataataatgttgcataactaa

SEQ ID NO: 1322 - DNA, 198 bp, Glycine max
  Peptide Sequence Number=SeqID_118100
atggatgttgtaaccttcagctccagccttagcattcatttccttcctctctcagagaaacaccaaagacttcttcaaggtgtggacgacaacttgtacaaggtactgagtttgagtccgaatagtgcaaccatggatgacataaagaaagcatacaaatcaatggcgcttcggttaccaccccgatgtgtgccatga

SEQ ID NO: 1323 - DNA, 1167 bp, Glycine max
  Peptide Sequence Number=SeqID_118101
atgcaacaaattctaaacaataaagacattcatcaaattcagaacattcttcttttcaacaccaatgatgatgatgatgatgctcaaatctggaaatttgctttgaatggtgtggtgcctactaggttcgttactcttagacctctcttcttcaataggaataaagcgtgttcaaggaaacgggaagaaattatgggctctaaaaatacctcccaaagtcatgcatcttatttggaggattcaaccagatttgtcttccttccagagttaggcttcgttcagaaggagttcaatgcccttcaacaacttgcccttttctgccacaaccatcttgaaaaccctagacatatttccttcagatttgaccatgcggtctcagtgtgtctgaccttagtggatgatcgtaatctgattgatgttgggttatctggatatgcatatacttgtactcgagttgggctttctgaaaggttgaataggatgcttatgaaccttgaatggcatttgctgttccagaagcctctatgtaaatcggaccacaggctcttgttgattcttcaggatagggaaaggacttcaatcgttttctgcgaagctcttagggtcgtggctcgaattgggatcaggggattctctctttctccgatgatctccaaaattggaaccgggagagttgtggcgggaataggagcaagtgctgatacaggaggaactattatggccagcttggtcttcaagcagtcttcaggcagctctccatgcaccactgccaccatcgaacaacaaaccacagattgtgatgctagcacaccaccacgaggtgaagacggtgcacaaacaccaccatcatgccctcgttcatatggtgatggtgaaccagatctgaagaaggatggagatggtggctgtgagttgcaatgtgagcatggcctccctcgactcctcgatgcaggcaacgacggaggactcggaggagaagtgggtggtgaagagatcggtgcatttggtgccactggagacaaagctactacgattcgtggtgttgaagcggaaggagtcaacatcgctactggcagagatggcgacgatggaagaggcggtggacccaacacgacagataataatcttgtcagaatcacaaaagttaacgatgagggtaaatgctag

SEQ ID NO: 1324 - DNA, 432 bp, Glycine max
  Peptide Sequence Number=SeqID_118102
atgtgtgatgatatgcaccattgcagaaaccatgccatcaatattgttccagtatcgcaaatagatattgtcagtgagcatccagaaagattttttgtagctgaaattgttagagaaaagatttttatgcagtatcgaaatgaaattccatatgcatgtcaggtaaatgttgtaaactataaagctcggccaaatgcaaaagaatacatacaagtagagattttggttgagaaaaactcacagaagattatccttattggaagagaaggaaaggctttgaaactgcttgcaacagctgcccgccttgacgttgaagacttcttacagaagaaagtttatcttgagattgaagtgaaggttagagcaaattggcgacaagatgaagggcttcttaatcactatggttatgggggtcagatacgtgttatataa

SEQ ID NO: 1325 - DNA, 345 bp, Glycine max
  Peptide Sequence Number=SeqID_118103
atggacgaaatcccctgctgtaacaaaaagatttttgtaaccataatagttcctcctgtatcagcacttgctcctattcccgccacaactcttgttatctatattgccaaacacctcccggttccaattttggagatcatcggagaaagagagaatcccctgatcccaattcgagccacgaccctaagagcttcgcagaaaacgattgaagtcctcgtgagtcagccaagaagcaaggaaatgaaccaggggaagacctttccctatcctgaagaatcaacaagagcctgtggtccgatttacatagaggcttctggaacagcaaatgccattcaaggttcataa

SEQ ID NO: 1326 - DNA, 507 bp, Glycine max
  Peptide Sequence Number=SeqID_118104
atggatattggaaggctaaaagatcttgttcaaattgttggaaaagagagacttgtgttggatctcagttgcagaaaaaaggtacttacctttatatttgatgtgaaaggtctaaaaaacccaatgtgtcacaacaaaggaggggaggatggtaaatatgcaattgtcactgatagatggcagaagttcagtgatgtgtttgttgatcctgatgtaatggaatttcttgccaactttgctgatgagtttctggttcatggtgttgatgttgaagggaagaagttgggaattgatgaagaacttgtggctttgcttggcaaatattcaacgattcctgttacttatgctggtggtgtgactgaaatggctgatctagagaggataagaacggctggaatggagcgtgtgaatgttactgtgggcagtgccttggatatttttgggggaaacctggcttacgaagatgttgtagcttggcatgcccagcaaaatgcctctgtagtttaa

SEQ ID NO: 1327 - DNA, 431 bp, Glycine max
  Peptide Sequence Number=SeqID_118105
gggagaagcttgccgcccagctcgcccaggtgagccaggttgcttcctccagaagcaacaaccttctggaggaatcttccggaaggcccaagacgcaaagtatctcaaagcggctaaccaaagattgcatgtcatcaagctcacttgcctcttgttgacaaaggggcggataacccttgggtatctccgcatgccacctgacttgccgtctctggatgacaaaggggtgcagataactcttgggtatctccgcatgtcatcgaacttgcagtcttggatgactaaggtgcggataacccttgggtatcttcgcatgtcatcagacttgcaatctgggatgactaaggctcgcttgcctcttgttgacaaaggtgcggataacccttgggtatcttcgcatgtcatcggacttgcaatctgggatgaatatg

SEQ ID NO: 1328 - DNA, 222 bp, Glycine max
  Peptide Sequence Number=SeqID_118106
atgtggagattagagtttttcaagcatttgactcactcaataagtttgactaattccagctattcacatgccgttccttcatgtatcaaatttcaaagttcaagcactagagtttggacctaccgtgagatggagatagttgaagtggctgttgccctgtctaatgcgtctgctcttgaagagtctcagctaatgagacagaatatggaagagcaaaactga

SEQ ID NO: 1329 - DNA, 298 bp, Glycine max
  Peptide Sequence Number=SeqID_118107
ggcatacattcaggagtttaagaaaattgcagaggctctcgtctatggcgaaccagtagaacctggtcctcaacctcctgatctcttggagaagcaaataagcttatttccacctgttgtggtggatgccaccccccttggtgtaaattttggggatgtttgcgctaatgtacatcgattcactgaagacatagaccgatgtagaattgttaatattctaagacggtcacgagacatagatcatcttagaatgcaatgcatctacattggtccttcatcattgaccgtcatagaatga

SEQ ID NO: 1330 - DNA, 318 bp, Glycine max
  Peptide Sequence Number=SeqID_118108
atggaaaatggcataggcttgtacattttgctgttaggttcagttcaaattaagtatacagaggcagagaccaatccctttctatcaactccagccatgccccttttcgtcgcctctatcacttgtcatgtcctggcatccatggctgacacgaacttgcaagctccattcataatattccacctgtcaggaatagttggatgtgaggtactcatgtgggttcttctcactgacattttctggagttatatatttgctgtaaaagacagcaggcttgttaaggcaaggccagttaggcgcttggctttggcctattaa

SEQ ID NO: 1331 - DNA, 525 bp, Glycine max
  Peptide Sequence Number=SeqID_118109
atggacaaagatcaatggatgtatgacagtataatgtctgaagaagttgatatggatgatcaaaataaacaagaatgtggtgtgaatgaacaacatattgatagttcggatgcgttcaatacttctcaggtgtttgtcattatgaggtctgacacacaagctggtagtagaggaaggacttcatttgtgttaattggttgtgaaaggagtggtcagtatagatgtagaaagaaagattgtgttagaagagatactgggagtaggaaatgtgggtgtcccttcaagtttcatgggaaaccagtgattggagagcaaggttggatggtgaagttgatgtgtgggattcaaaatcatgaattagccaagtcattagttggacatccatacgttgggcgattgactatggatgaaaagacaattattgctgataagaccaagtcaatggtgaaaccaagaaacattctgctaacgttgaaagagccgttgaaggagcacagtgtcaatagctatacaacaatcaaataa

SEQ ID NO: 1332 - DNA, 573 bp, Glycine max
  Peptide Sequence Number=SeqID_118110
atgatgttaggagaaatggaaagttgcctccttgtccttactgatataataaatgtcattgcccgcaatccccaaggatgtagagaagacattccagcagcaaaagatgttagatccttaagtttaggactgagtttgggtatgaaaatccacaaagcgtaccttgtccttatagccttggagttaacttgtattggaattaagtatggagtctccaacaccaataatccttttcaacaatcaagccttcttatgcttttcctcactgctatattttcccatgtccttgcatccaccgctgatatgaccaaacaaattatcatcataacatttcacatctcagggataactggatgtgaaacactcctgtggattctcattcatgactttatgtgctactgtatggtcaacttgcttcttttactcctagccaaattcttcttcttcaaccaagttgctcagctggtcgtttacttcttcaaatacatcagtcagctgctgcgccaagtttcaggttcaaatgttgatcagatgtcaaatttggagctgcaaccacagcaagatcgggtgtag

SEQ ID NO: 1333 - DNA, 693 bp, Glycine max
  Peptide Sequence Number=SeqID_118111
atgagtaaatactataaacgtgtgaagacaaggaacaagtgtattaatctctatctctatcttatgtacaaagaagtccaagttcaaggcttcctccttttcccgcttcaattctcaaggctaacgacgatgctgaaggtcacgacgcgttgcccatgcaagggccttctttgttcggttttttccccctttggtttttatattgctttggatgggaatctgacgagattccacggaaaaaaggctaacggcggttctaaaggtgacggtgctttgtcatgcaagggccttctttgtttgatttttttcgctttggttttaatactgctttggacgggaaaaaggtgtgacctttgtctgattccgacgaggttccacgcaaaaaaagctaacggcggtgctgaaggtcacggcgctttgcccatgcaagggccttctttgttcgattttttttccgctttggttttaatattgctttggacgggaaaaaggctaacggcggtgctgaaggctaacagcggtgctgaaggtgacggcgctttgccatgcaagggccttctttgtttgatttttttttgccttggttttaatattgctttggatgggaaagagaaaaaaggtgtgacctttcacagcaatatgattcacaggctaacggcagtgctaaaggaaaaaggtgtgacctttgtctga

SEQ ID NO: 1334 - DNA, 585 bp, Glycine max
  Peptide Sequence Number=SeqID_118112
atgattttggagactatgcgaaattttgtttcgaagaatttggagataggctcgcatggctatgcatatgggacgaaggcaccgggtcgtaagtctcaggggctccgtccagacagtggagggacagagccttatcgtgtttcacataacatacttcttgctcatgcaaaagctgtccaattgtataggaattcctataaggaatctcaaaatggagagataggcataaccctcgattctagatggttcgtgccctattcagatgcttcttcagacatagaagctaccgaacgagcacttgacttcgagattggatggttcatggaaccattgacatcaggaaagtatccagaaagcatgcagctttatgttggtagacgattgccagagttctctaaagaggaagccgagcttgtccgtggatcatttgattttattggactaaactattacaccaccaataccgcgcgcgttgccactggctatacggactcagtgcatcatcatccagatctatctactgatcctaatgtcgaacttggattagtaactcgtctcaacgggtcgtctcctataggtccagtg

SEQ ID NO: 1335 - DNA, 1407 bp, Glycine max
  Peptide Sequence Number=SeqID_118113
atggacgacgaagctattgctaacggtaacggagctccgtcgcctccatgtgtcgtttcggtgtctgcattatccggctcccggcgccgcctatcgacgagcttcgtggagcggagccgcctccatttctcgtcgtcggagaagctcaagccaatggcgtgggtatcgctccagggaaggctcctcaacgccgacgaagccagctcggctcgaaccatcggcggcggcgtcttcagcgccgaacaagccattgcttggaacctcttccctcccatccacaggtttctcttagtcgcggtcatcggcgctgccgttgcgcgctcccgaaaagactttcaaatatgccaactcaaaaactccgttcaactcagggaccaggtgctgttaaacatgcagcaaaagcttgatagtctttgcgagttagtagttaacaattctaaagaacactcgactaataagtcttgtgacaaggatggggaattgcaattgaatgagactttaggcgctgggaaaattaactttattgattgtggttgttggcattgtgagcaacactctggtttctttaatgaattaatggagggtgcctctattgcaagaagctctggtgcaaatgaggtacttcaatataagatgcccttctctaatgaagatcaggaggagcgaagaatgtctgacatgtcagattgggcttcaagtgtcacatcttctgctgatatccagttaaacaacttggctgtagaacaagatatgtataatcttaggagggactctgaagagaaggataccacaataaaggagttaaccagcctgttgaactctaatgaggttgctaattgcaagtccactcattacttctactgctatttgaaacagagaattgctgaattagaagactttatacggaggaaaaatgcaacaatttcaaaattaaagaaggacatgttggttttagaacaaaaggttgtccaacttacaagacttcgtcgaccttctttctctgccagtggcacaaatgacggtcagccgccacatattatgatagataaccttctttatgatatggagagcaccactagcccctcctcatcttctgattcagatagttcttctgtcgtcaaagcaccaaaacttcctactgatgttgtcctgaaacaagattttgctcccaaacttgatcagaatcctacaccagcaaaagtatccagttcatcaggaagagtttttgaacgccactcaaagtctcgatccgttagtcctcgtaaagaagtttcaagtagccaaaaatctaatgcagcttccgcttcagcccaaaagctattgtcagctcgtggggacttgaaaaaaaatagaagacgatctcttaatggagataagagtgcaactgcacctaagggatgggtatag

SEQ ID NO: 1336 - DNA, 231 bp, Glycine max
  Peptide Sequence Number=SeqID_118114
atggatcatgggggtaggggcttgtaccatgttaacatcgaccctttgagggaagtggaaaataccttgcacatcacaacatcgtcattggagtacaggttgacctgggtggtaaatgtgcctaagtgttcgtttggatccgaggtgccatcatatctttcaatgttcagggaattccatgttatgggtagaggggtatccattatgtcatccacaaaagggtgtcaatga

SEQ ID NO: 1337 - DNA, 864 bp, Glycine max
  Peptide Sequence Number=SeqID_118115
atggattcttctgctgtcgtgggtagcacaatttcagagcctcatagtgatatggaatttgaatctcatgaagcggcatatgcattttacaaagaatatgctaagtctgcagggtttggcactgctaagttgagcagtcggaggtctagggcatcaaaagaatttattgatgccaaattttcatgtataagatatggtaataagcagcaatctgatgatgcaattaatccacgcccgtctccaaaaattggttgtaaagcaagcatgcatgtgaagagaaggcaagatggtaaatggtatgtctatagctttgtgaaggagcataatcatgagcttttaccagctcaagctcatttttttcggagtcacaggagttctgatccactaagtaatgatgttcgaatgcgaaggcgcaagaactcaaatgcagtttctaaattatttactgcatatcagaatgttgattgcttagagaactttgtgaaacatcaacacgataaaggacgaagtttggttctagaagcaggacatgctcacttgcttcttgaactcttcatgcacatgcaggaagagaatccaaaattcttctatgcagttgatttgaatgaagaacatcgactaagaaatgtgttctgggttgatgctaaaggcttggaagattttacttatttttctgatgttgtttcttttgacacaacatattttacgagcaaatataaaataccattggtaatgttcattggagtaaaccatcatattcaaccaacattgcttggctgtgcattgattgctgatgagacaatatatacttttgcctggttactgcaaacatggctcatagcaatgggagaacgagctccacaa

SEQ ID NO: 1338 - DNA, 618 bp, Glycine max
  Peptide Sequence Number=SeqID_118116
atgaggaatggtttcatgtgccactctgaggcatcaactgcagtgtgcattgctgggtctgtggttgtgcctaggacaaggagtaggaggcatcagagaagtgtttctcttgatggtacaaggttgatcaactatgccaagtactccaaacttgttgactccagcactagcagcaggttcaattcagctcacaagaaatgtgactctgactctgtctctgtaccaaacatcaagcatcaagagaatgaatcaagggaacttcagaaaaagccaacagataatgtcttccagggttgtttggccagtatggtggttgtgatgcgggttgctattcattgtcaaggatgcgcgggtaaagtgaaaaagcatctatctaagatggaaggagttacatcattcagtgtagatgtagagtccaagagggtgacagtaatgggacacatttctccggtgggagtccttgagagcatttcaaaggggtgcctcaggagggatattttgttcgttgaagtctttttggaagtgcagaaagcaaaaaaggagtccattgtgaatgtgaacaacagggacaagtcccaaactagctggctagtatccacactacaagattcctattga

SEQ ID NO: 1339 - DNA, 735 bp, Glycine max
  Peptide Sequence Number=SeqID_118117
atggcctttcaacagcaacaggttataaaggatatggaccagagcaaggtgaaaagatcactatatataatatatgtcattcaagtaataaaatgtatatatcctgcgaaaacaacatttcagaccttgaggaaagcaatttctcttgcattctacaaagatcagcttcttatgggtcccaatctgaagatagctgtgcaggatccatcctttccggcctacatagattcgagtgtcataattggtcaagctgccaagtttgtggataaagctgggaagtacaaaaacatagaatacatgacatgtggacctcaaagtgacttctttcctgatcttcctactatttcaaggactgaacccattttcttcaattctccaaacaatcccactggtcatgcagcaacaaggaagcaattagaacaacttgtggattttgccaaagtgaatggatcaatcattatctttgactctgcatattcagcatacgtcactgatgatagtcccaaatcaatctacgaaactcctggagccagagaggttgcaattgaagtgtcatccttctcaaaatttgctggcttcacaggtgtccggcttggttggacagtggtccttgaagaaatcttgtattcaaatggctttcctgttgtgcttgatttcaaccgtataatgtgcacatgttttaatggagcatccaacataactcaagctggtggactagcaagcctttccccatag

SEQ ID NO: 1340 - DNA, 839 bp, Glycine max
  Peptide Sequence Number=SeqID_118118
atggctacaggacacatccgcaatacatgggttggtcaagcccatgatgaggtccgtcaacgccgttttcttccccacaaactccggcggcttgaacaacacgtttcgaaacgtctccttgcgattcgtccccttgaacggcgtcgttccgtagagcatctcgtaggtcagaactccgagggcccaccagtcgacggagaagtcgtgcccctcggcgcggaggacctccggcgcgatgtactcctcggtgccgacgaaggaggtggatcgcacgaaactgagtttgcgtcggttgaccgggctgactcgggcgggcttggggtttttgtttttagcgtggagtgggagtgggagtgggacccagcggcggtgtttgcgggaaggaggaggagtagtggtgttggagggaatattaacggagggagagagggtacgggagaggtcgaagtcggtgagggtgacgtgtccggattgctggatgaggacgttttcgggtttgaggtcgcggtaggcgatgttcatggaatggaggtgttggagagcgcagaggatctcggcgacatagaagcggatgacggcgggggagaagacgtgatcagtttggcggtagcggagggcgttgaggtcgccgccggggcacccaataaggaagggaggaaggggtgcgaatgggataagcgagagaggacgttcatttcccagcgggcgcgtcgaggagcgtcgtggtgggaggatgatttgtctacgactttcagtgccacgtgggagttgttgttttctagttggaccaggaacacggtgcccatgcctcctttgcctaacactttcactgctttaag

SEQ ID NO: 1341 - DNA, 366 bp, Glycine max
  Peptide Sequence Number=SeqID_118119
atgttgaaggtttttgcagttatagaattagtattgctgatagtgtaccctggtgctcatggtttgagcagagatgattttcctcctggttttgtgtttggtgcatcaacttcagcttaccaggttgaaggtgcagcaaatgaagatggaaggaagccaagcatatgggacaccttctcccaagctggaaatgggaatatgtatgctggtaatggagatgttgcttgtgatcaatatcacaaatataaggaagatgtccagctcatggctgacacgggcttagaggcctatagattttccatatcatggtcaagggttattccaggtgagatcatcaaactgctgtcatggagattcttaaattaa

SEQ ID NO: 1342 - DNA, 1107 bp, Glycine max
  Peptide Sequence Number=SeqID_118120
atggcggaggagctgaagctggacaaccttaaagcagtgaaagtgttaggcaaaggaggcatgggcaccgtgttcctggtccaactagaaaacaacaactcccacgtggcactgaaagtcgtagacaaatcatcctcccaccacgacgctcctcgacgcgcccgctgggaaatgaacgtcctctctcgcttatcccattcgcaccccttcctcccttccttattgggctcattccactcccaaaacttaatgggctgggccgtcccttactgccccggcggcgacctcaacgccctccgctaccgccaaactgatcacgtcttctcccccgccgtcatccgcttctatgtcgccgagatcctctgcgctctccaacacctccattccatgaacatcgcctaccgcgacctcaaacccgaaaacgtcctcatccagcaatccggacacgtcaccctcaccgacttcgacctctcccgtaccctctctccctccgttaatattccctccaacaccactactcctcctccttcccgcaaacaccgccgctgggtcccactcccactcccactccacgctaaaaacaaaaaccccaagcccgcccgagtcagcccggtcaaccgacgcaaactcagtttcgtgcgatccacctccttcgtcggcaccgaggagtacatcgcgccggaggtcctccgcgccgaggggcacgacttctccgtcgactggtgggccctcggagttctgacctacgagatgctctacggaacgacgccgttcaaggggacgaatcgcaaggagacgtttcgaaacgtgttgttcaagccgccggagaccccaccaagcgtttggggttacgttcgaggcgctagtgagatcaaggagcatcagtcttttagagggggtaagtgggacctactaacggaggttctgcgcccgccgtttattccgtcgagagacgacgtcgacgcaacaacgaccaagtctttcgctgcgggacttgacataaagggatactttcagagcttaaaatcaccgccgtctctgcccccttcgccgttacgctcaccgtcctttgagtttcagaataatgtttctttaccggaattctga

SEQ ID NO: 1343 - DNA, 390 bp, Glycine max
  Peptide Sequence Number=SeqID_118121
atgctttgctcttgctcttggcttttgtgggtctacaaatttacaattgggactctactgctcacgtttgataaaaatcaactcaatgttagtgcagtctatcaagggagagaaagacttgttgagtggaaaaaggacccattattccctaatgcaacattgtactggaatactattatctatggtatatatcaccttcctcattttctccagaatgctggacatttcaaaattgatgcactactcaagatccactgctttgtggatggaaaagacgaagttagccttaaacttcaagaagaacaacatggtcatggaaaagacgaagttagcattaccaagaaatcagttactgaactaaccattaagctaacacgtaccttgcgttga

SEQ ID NO: 1344 - DNA, 264 bp, Glycine max
  Peptide Sequence Number=SeqID_118122
atggcttgggtgagacagttcataggacttcattatctcagaatggcttgtcaaaatggtgatgccctgaatgcattgaagagcaacttgcaagatcctaacaacgttcttcaaagctgggatgctacccttgtcaatccctgcacgtggtttcatgttacatgcaacagtgataacagtgtgacccgtgtatctttctggtcaactggtttcacaacttggtcaacttacaaatttgcagtactttatctctacatggagtga

SEQ ID NO: 1345 - DNA, 240 bp, Glycine max
  Peptide Sequence Number=SeqID_118123
atgaagtcactctctccatgcttcttcaacctcataaacaattgcttccccaatccacacacccctcttgatctacataatatccatcaagctcagaaacatcttgaccttgttgaacaacccaaaatcgaactctgggtagctccaagttctcttctttctgctcttacctcggaatctgaagctaaaatctcagttgggtgtgctcaggttacagcgtgttacacttacattgcatag

SEQ ID NO: 1346 - DNA, 653 bp, Glycine max
  Peptide Sequence Number=SeqID_118124
atggacgcagagaaacacgaggaactggaaccagagaaacggaacgcaaaccgaggcaggattttagcgtttcaaaggtcagattttttctcactttttgtggctgagtatgggtcaccatcaaaagagaaagtgggccctttttgctccactcaaatggggacatcaaaacagaaaaatttagaagctctccctctctctcacgcagccttctcttcttttcttcctccaccattgttgcccaacaaagcttcaacctttggtgccaatttccgctccaaatcgcaaaaggagggcatttccggagtcgtgaagcgcgtctctacgtgtgggacttcgaaatttcagcttgtgctgtttgaatgttgtattactttgatgttggggaagcttgggaggattgatgaggacccggtgttgagagaaacgaggatatgggctacgtgggagtacgtgagctcagttggaggtgggcaacaggggaagtacgtgggagcaccactagtgaagtgggcaaaagttgaagccatgtcaagctcccgaaggaagggatctctcatggttgagaaaggatcaccaaatgatcattatgagagagggtggtgtgagaagaagaatgatgatgatgatgatgtgttagacaaatggcctct

SEQ ID NO: 1347 - DNA, 228 bp, Glycine max
  Peptide Sequence Number=SeqID_118125
atggcaatggggcttagcgtaaggaggtgtgctaagcccgaatcaacaagaggaatggaagaggagagagagcatgggaaacaagaagaggttatggccttcgcgcttagcatgagcatcgcgcttggagtgcgacctggctgttacagttgcattaatggtcccacgcttggcgaacgtgacttgcttagcgcaccaaggacgacgttctttggtcttcgctcttaa

SEQ ID NO: 1348 - DNA, 330 bp, Glycine max
  Peptide Sequence Number=SeqID_118126
atgacactcaatgtctacgaatcctccaagatttataagcaaaagatgaaggcataccatgatcagaaactactgaagaggaacttccagctcggacaacaagtgttgttgttcaattcccgactaaagctttttcctaaaagactcaagtccaagtggtctagccccttcacaatcaaagatgtgaagccctatgaagcgattaaactgatggatccttcatctactgacccagagcaaagctggattatgaatggccaaaggttgaagatctacaatggtggcaatattgagagattggccaccatcatccacctccaagacccatga

SEQ ID NO: 1349 - DNA, 249 bp, Glycine max
  Peptide Sequence Number=SeqID_118127
atggacatggacttgggcaacatgatcaaattactcacatcgctcagtccaattcttcgagagtctccatcagctctccctctagcagccagtcttgtcaccagaggttttctaggagcgggtcgcttggccaggggtccagccttcctttgcccggggaggggggtgacacctctagagctggagctgatgttgatgtcggtgatgatgatgttgcagatggtggtgatgacgaggactatgttgtag

SEQ ID NO: 1350 - DNA, 1197 bp, Glycine max
  Peptide Sequence Number=SeqID_118128
atgtttgtgaactgtgagtggaaggaggaagcaagggcagtggggcagctgaggaatgagcggttggctaacttggttggttgttgctgtgaaggggaagagagattgcttgttgctgagtttatgccaaatgaaactctctccaaacatctctttcactgggagagccagccaatgaaatgggcaatgaggctgagagtggccttgtatttagcacaagcattggagtactgcagcagtaaaggaagggcattgtatcatgatcttaatgcttatcgagttttgtttgatcaggatggaaaccctaggctctcttgttttggactcatgaaaaacagcagagatggcagaagctatagtacaaatttagctttcaccccacctgagtatttgaggacaggaagaatcacccgagaaagtgtaatatacagttttggcacactcttgcttgatcttctgagtggcaagcatattccacccagtcatgcacttgacctaatacgtggcaaaaactttctgatgctggtggactcatgtttggaaggtcatatttcaaatgatgatggaactgagatagtgagattagcttcacgctgtttacagtatgaacctcgtgagaggccaaacgccaagtcgcttgtgactgctctagctcctcttcagaaagaaacttcagttccatcacaagttttgttgggcataccagatgagattaccccatcaaaggaagcagttccactgacaccttttggtgaagcttgttctagaagagatctcacttcaatatatgaaattttggaaacggtggggtacaaggatgatgaagatgtagcaaatgagctttcgttccaagtgtggacagaccaaatacaagaaacactaaattctaagaagcaaggagattctgctttccatgccagagacttctctaaggccattgagtgctatacacaattcatcgatggcggaacgatggtatcaccaactgtgtatgcaaggcgctgcttttgttaccttatgatcaacatggtacaagaagcactgggagatgccatgcaagctcaatcagtatcccccacatggccaattgcattctatcttcaagcagtggccctcttcagcctcgggatggaccatgatgcagaggaaagtcttaaagatgcaacaactctggaaaccagaaaacatagaaactga

SEQ ID NO: 1351 - DNA, 291 bp, Glycine max
  Peptide Sequence Number=SeqID_118129
atgcctctagtgtcatcaccggctactggagggagagatggtggaggctctgcatctgtagggaggagtttctccgacagagaaaaaggcataaaggtctggctggtagatggaggagagatgtctagaggagggaccgctggtggaggagctgctggaatgtctggaatggctcgggtcttgacctgttttggccccatgaagacactagaagattctacaggattcacaactagcttggtttcatcttcttatagaaacattgaattcaagtgcccccaacaagattag

SEQ ID NO: 1352 - DNA, 741 bp, Glycine max
  Peptide Sequence Number=SeqID_118130
atggattctcaggttgccgtagctcttgctctttcacttgttggtggtgtcagcacttctatcggtgcactttttgtaattgttaataaagctcccagtttgaagatgcttgggctattacagggttttgctgctggtttgatgcttagcatatcgttctttgatttggctcacaatgctttgaactcattgggcttcttgaaaggcaacctttggttttttgctggggtaatattctttgctgttgttgccagttttatcccagagccaacacttacacccacttctgatgtgaagggcagaaagaaaaatggggatgaaggaggcaaggatattatgaaaaagcatcgccggcaagttttgttcagtggaattgttacagccgtaggcataagtttgcacaattttccagaaggaatggcggtgttccttggatccttaaagggcctccgtgttggcatcaacttagcattagccattgctctgcacaatatcccagagggtgttgctgttgcacttcctgtttattttgcgacacaaagaggctcttcgctatgcgaaggtatgggggagggatgttgtacgcagccttacccttgcatatgcaaagaggctgtttccggattcgaacccatgaccaacaagtcaccaaagcacaactttaccgctgcaccagggctcgccctcatatatatatatatgttctcatgggaaatatgttctcagtggctgagtaggtga

SEQ ID NO: 1353 - DNA, 267 bp, Glycine max
  Peptide Sequence Number=SeqID_118131
atgaagatttattggtgtcaccgtcatgtcttcaaccccgatgaatgtaacattatcgtacttgatgaaatagctatcaaactgcaacggaccgtcacaagagcgagagcactaatcgttggtgaggttgttgcaacactggaagaggatgtagatagcatcgaaggaggcagagatggtgaagttgttgtggttgataaaggtgacggagttaacgaggggatgaagagtgagttgacaatattttcgtgggaaaaattcgagtga

SEQ ID NO: 1354 - DNA, 351 bp, Glycine max
  Peptide Sequence Number=SeqID_118132
atggctgaccacgggaccaggaagacgaccacggaccgcttagaagacgcgatcgcgcgcctcaccaatagccaagccaacctcaacgaacgctacaccaacatctccgataaggtagactctatactggatcacctacggttacgcgacgagcaccagaaccagacctccgtcagcaacaccaacggccatcgcaacacagtcaaactcgatatccctcgttttgacggtcgtgatcccatgggctggatattcaagatgaaccagctcttccagtaccagcacacaccggaggaggaacgtatcaccgtggcttccctgtaccttgacggcgccgccctacatatatga

SEQ ID NO: 1355 - DNA, 3298 bp, Glycine max
  Peptide Sequence Number=SeqID_118133
cctccacgccatgtctggtttaccttcatcaaaaacttttcgtgtgtatggttccatccggaatacgcgtatcactgtgctcatagatagtgggagcacccataattttctccaaccaagggttgcacacttcctccatcttcctatcgaggacacccagcccctccgcgtccttgttgggaatgggtccacattggactgtaacaagcgctgccccaacactcctctacacattcaaggtcactcgttttcgatcaccttccacctccttgagatcagcggagcggatgcggtgcttggcattgagtggctgaagcaattcggccaagttacgactgattataccttcttcatgatgcgattcaatcacttgggccaggaggtttccttacgggctgatgtcgctacgggcccagaaccggcttccgcaacacaagtcaaacgcatgcttcacacgggatcaacttcagccttgttccatttacgtatcatacccactaaccccatagacgagaccactactcatcttccccattcactcgaatcaataacgaagctcatcctccgttatgatcagttgttccaacctcccaaaagcttaccaccttcacgtgaggtgaaccaccgtatcactctcttgccgtccacagccccggtgaacgttcgtccataccggtaccctcattttcagaaggctgagatcgaaagacaaatcgcagagctgctctcccctggcttcgtacgaccaagtacgagcccgtactcatctccaatccttctagtgaagaagaaggatggaacctggcgcctatgtgttgactataggtccctcaacgcgatcacggttcgcgatagattcccgatacctactatcgacgaactgctggacgaactagggcacgcctcatggttcaccaagctcgatttgaggcaaggatttcaccaaatcctcatgaatgacgctgatgttgagaaaacggcgtttagaactcaccatgggcactacgagtacctcgttatgccttttggattgtgtaacgcaccctctacgttccaagtcgcgatgaatcgcctccttgctccgttcttacgtcgtttcgccgctgtattcttcgatgatatactcgtctacagcagctccctttcatcccatgtccaacaccttgacctgatctttcaagccttgctacgcaatgagttctacttgaaacgcaccaagtgtctctttgcccagagggaactcgagtatcttggtcatgttgtttcggaagctttcgataccctcaaatccgctatgatcaacaccccagttctggcccttcccaatttccatgaaccatttgtcgtcgagacggatgcttcaggcactgccatgggggctgtgctctctcagcaagggcacccattagcgttcttcagcaagaacttcaaccctcgcctccttaatgcgtcaacctatgtgagggaactccatgctatcacatccgcagtgcgtaaatggaggcaatatctcctcggcagctccttcacgatcctcaccgatcacaagagtcttcgcgagcttatgactcaggtgattcaaacgccagaacagcactattacctttccaaattgcttgggtttgattacacaattcaatacaaaacgggagccaccaacgttgtggctgatgcactctctcgcagaccaccggaaccaggcgagttgctgatcttatcagtgccccaattcgacttcctgcgcaatatccaccaagctcttgtcagtgatcctgaatttcagtcgttattaactcgtgttcaagagaacccttcagcctatcctcaatatcggatccataacgggttcttgttattcaataatcgtatatggctgaataaaaccaacccgtacatcacgaccctcctatcggaatttcacgcaaccccgttaggtggtcattttggggtagccaagactttgcaccgcctcgaagcaagcttcttctggcaaggacagaagcaagacgttcagaagcatatcagggagtgcaaggtgtgccaacaaagtaaaacgagcacccatcggccggcgggcttgctacaaccgctgccagctccggttggggtgtgggaggatatctctatggacttcgtcactcacctcccaccgtcaagcggtttcaccgtcattatggttgttgttgataggtattccaagggggtgcatctcggagcgctgcctacgggattttcggccttcaaggtcgccatgctcttcgtggaaatcgtctgcaagcaccatggtttccccaagagtattgtttccgatagggaccccgtgttcctaagcgctttttggagagaattattccggcttagtggcacccatctacgcttaagcacgacatatcatccacagtcggatggccaaaccgaagtggtgaatcgcgtccttgagcagtacctccggtgtttcgttaactcacaaccttcctcgtggttccgctatctagcactcgctgagtggtgttacaacacctcgctgcattcgagctccggtttgaccccgttcgaggttatctatgggaaacccccacccacgatacctcaatatattccgggcttcaccaataatgaagttgtggcgtccctggtccagtctcgacaagatatccataccaaactgcagaagcagctgaagaaagctcaagcttcaatgaagaaatatgcagatgctcatcgggatgatgtgacctttaacgaaggccaatgggtctatgtgaagcttcgacccacccgccaacgctccgccacgggaccacaccaccccaagctatcaaaacggtacttcgggcccttcaaaattctcgcgaaggtgggagaagttgcttatcgactagccctcccggcggaggcacgcatccaccccgtcttccattgctcactgttacgccgtcatcatggaccttccccgtcttccactgaaccctggaacttagagatagttggtcagagacccaagcaacgacccctctgcatcctggataggaggcttgacacttccacttaccccccgacgaaactcgttctcgtccaatgggttggccaacccccggaggacatttcctgggaatcatggcttgagctacaagaagcctaccaccttgaggacaaggtggttttcgaggatgacggtattgttagcaaccaggttcacgaagaagaagataacactcatgaagatgcttctgttgtgcccacgagacccgcacgtgctataactaagcctagatacttacaggattatgttagttag

SEQ ID NO: 1356 - DNA, 228 bp, Glycine max
  Peptide Sequence Number=SeqID_118134
atgggtacatcagcttgtcagttcttgagttatagaatgcacaacttcactgcaaatggtggtcctgacccttccatcatcacttcgtttctttcccaactaggagcactatgcccgcaaaacagtggtgcctcaaatcgagttgcactggatacagagacatttgtagaggactactcagactcaagcatgcattgcaaagtctatggtgaagatgggcaacattga

SEQ ID NO: 1357 - DNA, 1446 bp, Glycine max
  Peptide Sequence Number=SeqID_118135
atgatgggtttactaggaggaaccaagaagccacatgctgttctgatcccatttccatcacaaggtcacataaacccatttctcaaactagcaaagctcctccacagcaacggcttccacataacctttgtcaacactgacttcaatcaccaacgcctcgtcaagtctagaggccctaatgccctcattggcttcccaaatttccaatttgagaccattcctgatggtctccctccctccaacatggattcaactcaaagcatcccagctctttgtgactctaccagaaagcattgtttgatcccattctgcaaccttatctcaaaacttaatcactctcatgcccctccagttacttgcattttctcagatggtgtcatgtccttcacaatcaaagcttctcagcagtttgggctacccaacatactcttttggactcacagtgcttgtgccttcatgagcttcaaggaatgcaagaatctcatggagagaggcctaataccacttaaagatgcaaactatttgacaaatgggcatttagactctgccatagactggattcctggcttgaagaacatcactctaagggaccttcctggcatctatcgtaccacagatccaaatgatatacttttggactttttggtggaacaaattgaagcaacttcaaaagcttcggctattattctgcccacatttgatgccttggagcatgatgtgctgaatgcactctccacaatgtttcctaaactttacaccataggcccactggagttgctccttgttcaaacttcagagagtacatttgactctattaagtgtaatttgtggaaggaagagtccgagtgtctcaaatggttggattcacaggaacccaattcggttctctatgtgaattttggcagtgttatagtcatgagacaccaacaactagttgaattggcctggggcctagcaaatagcaagaaaaagttcatgtgggtgattaggcctgatttagttgagggtgaggcctcaattttgccaccagaaattgtagaagaaaccaaagacagaggcctattggtgggttggtgtcctcaagagcaagttttgaagcacccagcagtggctgggtttttgactcactgtggttggaattccacgcttgaaagcataaccaacggggtgcctctgatctgttgtccctttttcaatgaccaaactctcaattgcaggtatatctctcgtgaatgggcttttggcatggagatggatagtgataatgttacaagggctgaagtggaaaagcttgtgaaggagttattagagggtgagaagggtaaagagatgaagaaaaaagcaattgagtggaagaaattggcacaagaagctacccacactaatggttcttcctttttgaatttggaaaaactggtgaatgaattgttgtttgtcaagagttag

SEQ ID NO: 1358 - DNA, 525 bp, Glycine max
  Peptide Sequence Number=SeqID_118136
atggctgaccacgggaccaggaagacgaccacggaccgcttagaagacgcgatcgcgcgcctcaccaatagccaagccaacctcaacgaacgctacaccaacatctccgataaggtagactctatactggatcacctacggttacgcgacgagcaccagaaccagacctccgtcagcaacaccaacggccatcgcaacacagtcaaactcgatatccctcgttttgacggccgtgatcccatgggctggatattcaagatgaaccagctcttccagtaccagcacacaccggaggaggaacgtatcaccgtggcttccctgtaccttgacggcgccgccctcagctggtaccagtggatgtttaccaatggtttgatcacttcatggcaaggcttccttcaagctttagagtcacgatttgcaccaactttctatgatgatccaaaaggcacgctattcaaattggttcaacgcggatctgtgaatgaatacttaacagaatttgaacgtttggctaatcgtgtg

SEQ ID NO: 1359 - DNA, 333 bp, Glycine max
  Peptide Sequence Number=SeqID_118137
atgcagggtgataatgatgctaactctaaaaagcaatttgacccctgctcaaaggaaacgaataaagagactaatgtagagccaggggatgtttcaaataagaaggatgacatgtgccctactaatgtggagcatgaagatgctgagcaaagggatgttccaaatgaaaaagatgacatggagtgtacaacaaactcgaatatccatgttagtgataataatgtgagacgattgcctatgatgataaacaacaattttgccagtaaagaaaaccaaatgacaaaattatgggactactacaccaaatacaaacgattttataaggaccagtaa

SEQ ID NO: 1360 - DNA, 576 bp, Glycine max
  Peptide Sequence Number=SeqID_118138
atgggagataacaatgtcaaccttccacccgggtttcgattttatcccacagatgaagagcttgtggtccatttccttcacagaaaggcatctcttttaccttgccacccagatgtcatccctgatcttgaggtctacccatatgatccatgggaacttgatggtagagctttagcagaggggaaccaatggtactactacagcagaaggacacaaaatagggtcactggaaatgggtattggaaaccaacgggaatagaagaaccagtggtttcaagcacaagcaacaagagagttggcatgaagaaatattttgtgttccatgtgggagaagcccctgctgctggtatcaaaaccaattggataatgcaagaatatcgtctatcagattcttcttcctctaccagatcatccaaaagaaaatcacaaccaaaaatagaatacaataaatgggtgatatgtcgtgtttatgagcgcaatggcgacgatgataatggaacagagctgtcgtgcttggatgaagtattcttgtcattggatgatgatcttgatgaaattagcttaccaaattattag

SEQ ID NO: 1361 - DNA, 534 bp, Glycine max
  Peptide Sequence Number=SeqID_118139
atggacttctcagttgtcttcttgggtctgttatgggacatgttacagctggtgttgccatcccttgaaaactccatatttgcacctaaagattattcgagttcacagttcagaggccttaaggttgtgttaaccgaggatgatggtgtaaacaggaccgtgaccaagaagctacttgagaagcttggttgtcaagtaatttctgtttcatcagggttggagtgcctgagtgctataagtggtgctagtaactcattcagaattatcctgttggatcttcgcatgcccgaaatggatggctttgaagtggcaaagagaatccggaggttccatagccatagttggcccttgattatagctcttatagcaagcgcagaagaacatgtgagggagaaatgcctacttgcaggaatgaatggattgatccaaaaacctatcgtacttcatcagatagcagatgaacttagaacaatcctacaaagagcaggtgaaagcacagtttttgaaagcatgcttgggtttaagaaaatatga

SEQ ID NO: 1362 - DNA, 348 bp, Glycine max
  Peptide Sequence Number=SeqID_118140
atggccagccaggcaaggaagtcgttacagaatgtcatgagccatggaatgtggagggctatacattgtattatggggatgctgtcattgtttcaagaggataatttgaggtctgagcagaagattgttggtgatataatgttgaaaatgaaacctttccttctgcattcgatgatgagggaagctgcttccactgccaagtgcttgtgtgtttatgaaggctttggttttgaaattgatgtccagaagtctttgcctgaaacagttatggtttttcttgaaagtgatggtggagacagggatgataaaaatattggaatctggagatcaaacagtcaaaatgagtag

SEQ ID NO: 1363 - DNA, 633 bp, Glycine max
  Peptide Sequence Number=SeqID_118141
ccctcccccgcggtggaagcccaaggcaacaccgtccgcgccctcaaggcctccaaagccgcccaaccagaaatcgacgccgcaatcgaagccctaaacgcgctgaagctcgaaaaaagctccatcgagcgctccctcctcggcggctccgactgccgcaaggccttccgtcagtccgtggtgaacacccttgaacggcgcctcttctacatcccctccttcaagatctaccgcggcgtcgccggcctattcgactacggccctcccggctgctccgtcaagtccaacgtgctctcgttctggcgccaacacttcgtcctggaagagaacatggtcgaagtcgattgcccctgcgtcactcctgaaatcgttctcaaggcctcacgaagaagagatgagagagaaaataaacgagggacaagtctggaggagatgcgcgagggtgtgaacacgtggcgcattgtggaagcggaggaagaaccagagtccctgctgctgcgacgatggaggtgccgcccccgccgctgggcttccgagaggccgagagtgattcgccgcctcgctggcggaaaccaccggacctacggcggcggcttcctcgccgtctccgctgtattgaggggagttgtttga

SEQ ID NO: 1364 - DNA, 309 bp, Glycine max
  Peptide Sequence Number=SeqID_118142
atgggggtgatgattttgaggcctaattctgctccaggagctgcgagtagtggtagctctgtggagttgggtgctgtggcagccattcacattccgttccttcatgtatcaaatttcaaagttcaagcactagaagtctctgctaatgagacagaatatggaagagcgaaactgagaactgcaacaggtttattagaatccaatgatggccagccaggcaaggaagtcgtttcagaatgtcatgagccatggaatgtggagggctatgcattgtattctggggatgctgtcattgtttcaagaggataa

SEQ ID NO: 1365 - DNA, 1485 bp, Glycine max
  Peptide Sequence Number=SeqID_118143
atggcggagctgaaactctctgagagccgcgacctgacccgcattgagcgcgtgggcgcgcactcccatattcgcggccttggccttgactcctccctggagccacgcgccgtctcggacggcatggtcggccaaactgccgcccgcaaggccgccggcgtgatcctccagatgattaaagatggcaagatcgccggccgcgcggtcctcctcgccggccagcccggcaccggcaagaccgccatcgccatgggcatggccaagtccctcggcctcgaaaccccctttgccatgatcgctgccagcgaaatcttctcattggaaatgtccaaaaccgaagccctcacccaggccttccgcaaggccatcggcgtccgcatcaaggaagaagccgaagtcattgaaggggaagtggtcgaggtccagatcgaccgccctgcggtgtctggcgccgctgcgaagaccgggaagctgacgctcaagacgaccgagatggaaacggtttacgacctcggcgctaagatgatcgaggcgttggggaaggagaaggtgagcagcggcgatgttattgcgattgataaggcgtccgggaagattacgaagcttggacggtcgttttcgcggtcgagggacttcgacgctatggggccgcaggtgaagttcgtgcagtgtcccgatggagagttacagaagaggaaggaggttgtgcattgtgttactcttcacgagattgatgttattaatagcaggatcgaatttctcaagaataatatggggatttacattgatgcttctaatgtgcatggtgtggaaatggagttggaatttagacttgtcaagaggggatttctggctcttttcactggagatacgggtgaaattcgtgctgaagtcagagagcaaattgacaccaaagtggcagagtggagagaagaaggaaaggcagagatcgtgcctggtgtccttttcattgatgaggtgcacatgcttgacatagagtgcttttcattcctcaatcgggcgctggagaatgatatggctcccatattagttgttgctaccaacagaggcatcacgactattagaggcacaaattacaaatccccacatgggatccccattgatcttctggatcgactactcatcatctctactcagccttacacggaggatgagattcgcaagattctggatatcagatgccaagaggaagacgtagacatgagtgaaggtgcaaagtgtttgttaaccaaaataggtgtagaaacatctttgagatatgctattcatctaatcacagcagctgcattggcatgccaaaagcaaaaggggaagaccgtggagttggatgatataaatcgggtttataatctgtttttggatgtcaaaagatcaacacagtacctaatggagtatcaaagtcagtacatgttcaatgaaacaggagaagctgatgaagatgaagccaatgccatggtctcttag

SEQ ID NO: 1366 - DNA, 537 bp, Glycine max
  Peptide Sequence Number=SeqID_118144
atgaagggcatgggaaagatgaaaagatccatcaactacttcaacacatgggacaacttccatgtcattaacatcaagggtgagagtgtaacaactttgggttactgggataatattaaggcatgtgggctgtctagaagagttgcaaggctagttaacatctcctccaccttgcacgagcttccaccaccgtcatcgccgtcgttgacaatctccgccgccatgcctacaccgtccgcatcctccgatccaatccttgaccgcctcgcctcgtccgattgcgcggtgaaattcaaagccatccgcgaggtgaagaaccacatcatcggaaaccgaacgaagaagcactcctacatcaagcttggggccgtccccgtcgtcgccgccgcactcgccgactccgaccccaacctcattgtccaatccgccgccgcgctcggcagcttcgcctgtggcgtcgacgacggcgtccgcgccgtcctcgacgccggagcttttcctcgtttgatcgggctcctctccgctcatgacgagaag

SEQ ID NO: 1367 - DNA, 138 bp, Glycine max
  Peptide Sequence Number=SeqID_118145
atggagcagcagctgactgatatatttgaagaagtaaacgagcagctgagcgacgtggttgaagaagacgaatttggccagcacggaggatgcaaggacatgggaaaatatagcagtgaggaaaagcagaaggcttga

SEQ ID NO: 1368 - DNA, 1635 bp, Glycine max
  Peptide Sequence Number=SeqID_118146
gttgtggatgctgctgctcgttctttacgaatgatttatcaatcaatgctagctccaaagtatgacttttttcaagaggaaaacatgcaatttcttctttcattattgaaaagtgagaatgaaaatcttactgggctaggtgctggcattgttattcattcttgcaagacaattggcgaacaaaacatattatgccatgctggtgttttagagaaacttactagccttcttgaaggttctctaagtcagcgagatgctagtctagagtccttagctgcaattattagagacaacccagtgtctgtctctgaatttgtggaacttcatagtggaagagctttacattctgtaacagaattaactaaagacagatatcctcgaacaaggttactagcctgcttgtgcttgatttctgtgaagaattcttcgacatgctacctccaagacgtaggaatcaaaaccaaattggtatacattttgcttgagctcctcgatgattctggtcaagttggagatgaagcttcttttgctttctcaagattaattgcagagaaggaagatttgcagaagttagcatttgaggcaaatgctattaataagttcaactgtctcttgcaaaagcgtcctgtacatcctaaacgacttgaaggggtatttctggccttggctgatctttgctcaaaattggagtgctgcaggtctagttttctttcattgcaggtcttaaacctggtagttgatgccttaactcatgaggatgccagtgtacgcactgcagcttgcatttgcttaagaagtgtctctcgctcaatcaagaatttgagtgcaggtcgttttatgaatgaaagggttgtttttcctctggttcagcttctctctgatctttctacttctgtccaggttgcagcccttggtgccatcagcaatatagtggttgactttatgccacataaatcaacattcatacaatgtgggggcattaaagagcttgtgcaattgacgaagtcgatggattcatctttaaggcttaatgctgtatgggccttgaggaacatggtattcctggcagataagatatgcaaggaaggaattttcgtggagttaacagcatcttcaatggctagccttatctgtgatcctgagccttctgttcaagaacaagctctggcccttgttcgcaattttgttgatggatgtgtgtactcagttgaacatgcttttgctgaagatggtatcatactagatgctgttggaagacaattacaaaaatcttcaaaaattgaaattgggatacaggggatgtatgttctcaacaatattgctagtggcaatgagtttcataaggaagcagtaatgcagctactattccctcaagatgagaatgggtctcactctttctttgagcagtttttgcagagtcatgacagtcgcttacgcacagctgcagtttgggtcatagtaaacctcacttttccagctagtcctggtgcatttggtcggattgtaaatctgcgtagttttggcattgtttctcgaataaagaagatgtccaatgattcttgcatggatgtgaagcttcgtgcaagacttgcacttgggcagattcttacttttggtgatagtcaaatgcaataa

SEQ ID NO: 1369 - DNA, 228 bp, Glycine max
  Peptide Sequence Number=SeqID_118147
atgggtactctctggcctgtggtagacgacgagaagcaacagagactgtggaacaggatcacacctgcccagcagagacagtggctgacagtggtagatgacgagattcagttggaacgatcaagtgcgtcaaaaatgaaaacaaggactggaacgtgcccagaaggaacatacgaagctactgggactggtccggtaagattccgatcaccggaggacgacgcgtga

SEQ ID NO: 1370 - DNA, 666 bp, Glycine max
  Peptide Sequence Number=SeqID_118148
atgaaagccttggagaattcagtggagttcttaaagtgggtgaccagcaaatacaactctcagcttttggagatcaagaagagtgtggagcaaattaatagcaacaaacagatgctgggaaagtggataattcgaagcattggtggtgcacattttgacctcatcagagaaacagttatgaagaggctgttgaggagttacatactatacaagggatggtgggtttgcaattttgacccacagatgctgattttcgttatcatggtggagggagcaatgtttcacttgggggaaccactccacttcgacttagtcagcagcaaagtccagcaccacaagcacctttccaccaagaaactggagcttgacagcttccctatgaggagtatgtcaaaagccaaggaagatgtttttcattgtggccagccatttggccctgtggacaaatgcccagaaaaaggtatgggagttatgatcttgcattcttgcctgaagatgaagacatggcttaggacagggagattgtccaaactcaagggggagatgactagtaggaattctcatgcaaggggaatccccaatttctacctagatgacaagattgaatttcagagtgcatgttattgttatgatataagggagagggaaatagttagggaaagttag

SEQ ID NO: 1371 - DNA, 547 bp, Glycine max
  Peptide Sequence Number=SeqID_118149
aagcaaccggtcgtattgtctgtgccaattgccattttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaattggcaccccccgatcgtatttcgcctgagattaaagagaagataggcaatctgtcttttcaaaactatcgtcctacaaaaaaaaatattcttgtggtaggccctgttcctggtgggaacaggggaaggggtcagatttatcttgacgggagcaagagtaataataatgtgtataatgctacagcagcggtgattgatattatacctccaggaccagaacttcttgtttcagaaggtgaatctatcaaacttgatcagccattaacaagtaatccaaatgtgggtggatttggtcagggggatgcggaaatagtacttcaagatccgttacgtgtccaag

SEQ ID NO: 1372 - DNA, 556 bp, Glycine max
  Peptide Sequence Number=SeqID_118150
gcaatttaagtcagatttgacctccaaatgggctttagcacaaggcaaggaggacaatgttgacaaagtcaatgaaaagtacggtatcagcaatgacaagtggaaccaattttgtcaaagccgtagagacccttcatgggagggagtcgtacctcctgctaagcttaaggtagctccttctactactcgtgtttacacaaagggaagttgtatcgatccctcagggcaggacccaaacacggctgcatcaaacaagtgtgggttgtatgttgatgacaatactccccacctggttgcccttggaagaatttatgaagggtcgacaaccatgcccaatgtccctttgggcaatgatatgatgaaggtgggtgttaaggaagttcgagacgttgatgctcacgtccctgtacccactgaagaggataaacaaagaccagagggaccaacgaagcctgctgataggccgaaacctgatgacgatccaatatgccagaggacattgatgatcccacaacttttcctcaagcttatgtcatgggatgcaactgtgtttagg

SEQ ID NO: 1373 - DNA, 306 bp, Glycine max
  Peptide Sequence Number=SeqID_118151
atggtgaacgacattttcacactatctaggcacaaggaaaacatggttcagcccaaaccaagtgctggccttaaggggaaacctcaccaacatgctctcactcatcatgccttcttgtatttcaacaaacaaaagcttgggccccctaggcctaagtcatgttttggcatttatcctaattctcgcaagctgtccgcatccaaaaaatggcatttcactgagcacttggtgggcgcacttttgggtaccaacaacaagggaatgggggcaatgtggcttgccccatcatctcagtacacaacctag

SEQ ID NO: 1374 - DNA, 426 bp, Glycine max
  Peptide Sequence Number=SeqID_118152
atgtatgaatatcctaggagaacccgcgcattaacgtgtaagcattcctttcaaaattcatatggatgttcatgcttcgttggaaaaagggaaatggttccgaagaaactttccacgaagaggtctagaagagacgccgcagcggaagggtccagtgccacccgcgagtttgatagtcatcgtttccggagcgccgagcaccagcagcgcttcgaggccatcaaaggatggtcgttccacagagagaggcgtgtccagctcagggaggatgagtatacggactttcaagaggagatagcttgtagacgttggacgtcactggtgactcccatggctaagtttgaccctaagatagtcctagagttctatgctaatgcttggcccacagaggagggtgatgtgccattattttctcctatttcttaa

SEQ ID NO: 1375 - DNA, 531 bp, Glycine max
  Peptide Sequence Number=SeqID_118153
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 1376 - DNA, 185 bp, Glycine max
  Peptide Sequence Number=SeqID_118154
ctgcttccgcggcgagagcgggtcgtcgcgtgccggtcgggggacggattgggaacgggcccttcggggcctcttccccgggcgtcgaacagtcaactcagaactgtgaagaaatcaaccaagcgcgggtaaacggcgggagtaactatgactctcttaaggtagccaaatgcctcgtcatctaa

SEQ ID NO: 1377 - DNA, 231 bp, Glycine max
  Peptide Sequence Number=SeqID_118155
atggagtttttgcagatttcaatcggtgaaatcaaacgaaaaatgaaaaagaagaagattgcaagttacgggagtcgatttgatgaagaaatgagtaagataggaaggtttgggaatggagggacgtcgcaaggtggaagaggctgtgcaggggtttctgaaaaacgtggtatttatagaccaggacgcattgtaattgattacaagtactggccatctgttctagtgtaa

SEQ ID NO: 1378 - DNA, 540 bp, Glycine max
  Peptide Sequence Number=SeqID_118156
ggcaagctccgccgcaacgcgcatgagcagtaatttactttctcttaacaagcgtagccagcgtccggcgattttccgtactgattcagcaaacagcgtgcaagaaaataggataatgccgatatcgacggcagaggccgttctgggtgcctcctggcggtttactccgtataatattcagcttttcatcaggttggcgaaattcacggcccgcaacccgtcggcgctggcgcacgcgctgccgtttatcaaaccagcccaccgcaagctgaccgacgaagagcgcgccgcggtcgaattctacctcaatcagcaaaacaagctgagcaacaaactgttgcccggcggcggcgctacgctgcccgcggccaagctggcgctcactccgcaaagcgataacgtttatcccgtcacgcacgccatcacccgctacgggctggccagcgacgatcccaataaatggcgctattacctcgacgctgaagaggtgcatctgccgccgttctgggaccctatatcaccgccgacaaccatgtggaa

SEQ ID NO: 1379 - DNA, 441 bp, Glycine max
  Peptide Sequence Number=SeqID_118157
atgacgttgctactcagcaacattatgcccagcgaccacaactctaacctccccctgccgaagtgtcagttggtttatgccattctgacacaggtgagtgtgcacgcggctcagctgatttctgatgccatttatcagtttgcagggatggtgcctatgagacaccctgtggacctggagaagtccaacagggcccaggggtttcccactctgattatgggcctctatcagttctacagagtgcctgtcgcccccaacaaggtcatccggccgcccatcactagagccttcattgagaagtactgcatccccaagcaggcgcagggcaaggcaccacagtttcctggagacagccatccacaggtagccaatgcaccaccgtcacccccggagtccaccttggctcacctacggaggagaattataagcaattgggcttga

SEQ ID NO: 1380 - DNA, 216 bp, Glycine max
  Peptide Sequence Number=SeqID_118158
atggatgccgccattcctactggcgtgaagcttgtatcgccattggcagcaacgggacgaaagcagagtcactgcccatgccgctattcaaactggcgggacatgctgactaagcatgtcgccattggtactggcgggacatgccaacggggcagtcccgccactggcgcctgcggaacacgttgtagcatgtggggttgcagtgtttcagtctga

SEQ ID NO: 1381 - DNA, 105 bp, Glycine max
  Peptide Sequence Number=SeqID_118159
atgactctggctggtgtcgcacgtgcagaaaggttttacaatgattgtgactgcaccctgcaactcccagaaaaagtcaaatttgaggatctaaccaatatgtga

SEQ ID NO: 1382 - DNA, 330 bp, Glycine max
  Peptide Sequence Number=SeqID_118160
atgaaggaacgttccgcccacgcctgtatcgccggccaccatagcgaaaacatctctgtcacctgtttcgctggtggcaatggcgaaaccggcaattctgaccagcttgtaatcggagttcctcgagtcgaagccgaagccaaagcaagaagaatagtcgccgtcacagagggcaacgacggaggtgaaaaagagattgttgaagaagggaagggacaaggtggaggagtgggtgaggaaggggtcgtcacagtggaaagagtagccaaggaggagaagggagggggagtggcggtggtggagggagatgaaggaagaactgcatattag

SEQ ID NO: 1383 - DNA, 3487 bp, Glycine max
  Peptide Sequence Number=SeqID_118161
tcgccttccagtttatgagcaaatgggttgggagcatattgtttctcattggagaagtgcttttagcagagccagtgttgttgtgtttccagattttacttatccgatgttatatagtgagcttgacactggaaacttctttgtgattcctggatcaccagtagatgtgtgggctgcagaaagctatcataagacccatgcaaaggagcagctaagagaacttagtggatttggtaaaaatgatatgctggttctagttgttgggagctcagtcttctttgatgacctatcttgggactatgctgttgcaatgcattctgtagggcctctgctgacaagatatgcaaggaggaatgatgcaactgactcatttaaatttgttttcttatgtggcaattctactgatggttatgatgatgctttacagggagttgcttcacgtatgggacttcgtcagggttccataaggcactatggcttgaatggtgatgtgaatagtgtgttactaatggctgatatcatcctatatggttctgctcaagagattgtggatggagttcacgggatatttttttctaaacacaatcctgaagctttgatgaatgctttttcacttttgctttcaaatggaagactttctaaatttgctcaagcaattgcatcatctggaagacaacttgctaaaaatgtactagctctggattgcataactggctatgcaaggcttctggagaatgtactcaattttccctcagatgctttactgcctggtcctgtttctcagattcaacaggggtcatgggaatggaatttattccgaaatgaaatagacttgtcaaagatagatggtgatttttccaatagaaaagtttccattgtttatgctgttgagcatgagttggcaagtcttaattattcaacaagcatctttgagaatggaacagaggttccactgcgagatgaactaacccaattggattgggatattttgagagaaattgaaatatctgaagagaatgaaatgtttgaagtggaagaggctgaagagagaagggagaaaggtgttggcgtatgggatgatatatatcgtaatgctagaaaatctgagaaactgaagtttgaagtcaatgagagggatgaaggggagcttgagagaacaggacaacctgtgtgcatttatgagatatacaatggtgccggagtgtggccatttttgcaccatggttctctctatcgtgggttaagcctttctagaagagcgcagagacaaagttctgatgatgtggatgcagttggtcgtttgcctcttttgaatgacacatattatcgggacattctctgtgaaatggggggaatgtttgcaattgcaaatagggtggataacattcacaggaggccttggattgggtttcaatcatggcgtgcggctggtaggaaggtagctttgtcagcgaaagctgaaaaggtcctggaagagacaatgcaagagaattttagaggagatgtcatatatttttggggacgttttgacatggatcagagtgtcataggaaaccacaatgcaaattctttttggtacatgtgtgacattttaaatggaggcaactgcagaactgtttttcaagaaggcttccgccagatgtatgcattgcccccccatgcagaagcactgccccccatgcctgaagatggttattggtcagcactgcacagctgggtgatgccaaccccttctttcttggagttcataatgttctctcggatgtttgttgattccattgatgctctgcacagagactccactaaatacagcttgtgcttgttaggatcttcagagattgagaagaagcactgctactgtcgcgtgttggaacttctcatcaatgtatgggcttatcatagtgcacgaaagatggtatatataaatcctaacactggttctatggaagagcagcacccaattgaacaacggaaaggttttatgtgggcaaaatacttcaatatttcattgttgaaaagtatggacgaagatctggccgaggctgcagatgatggtgaccatccaagggaaatgtggttgtggccaatgacaggagaggtacactggcaagggatttatgaaagggagagggaagaaaggtaccaagagttgaacaatggaaactttccatcacttaatcttacgcataaagaagttggtggctctttctacacagtacgggagattgtacgtgatgtaattcaagaaaatagagtgttaggtcctgctaagttcactttagaagagctaaacactgatcaattttttgaacaaaatccgctgggttcaattgccagaaatcctcaaccttttttggctgcatctttaattgaaaatcattgtgaacctgataaacttcaggatacaaatagcaaaatgatttctgcttctgatgtgtcttatactgaagctgtgcaccaggcggttgacaaagggcatgtcataagtattggccatgtagatgtgacaaccaatgaatccattgaagtgcctgttgttgctgctgatgggtgtgatactggagctgagcttccaatgtttgacaaagggcatatcatgaatgttagccaggttgatgtgacaagcaatgaatctgctgaaagtgttgttatttctgatgagtattgttgcgctggaaccgagcacaaaattattgacaaagggcatgtcttaaatggtagccaggtgaatatgataaccaaggaatccaatgaaactgctattcctgagacacaggtggatgattcttctgcactcaatcaaaatgttgagcaagaattggcagctgccgcgataccaatggctgaagtaactgctgtgacagaagacttgatagtagagacatttccattaagctctgtttctgggactactgatggaataagaagtctgggagggttgggggactctagtaattcaccagaaaatgatataaaaatgttggaagtgaaacaaggtgagaagtatgcccctggaaatcaaatattggagaactcctctaacactgggcttgataaggaggagaatgtacaagatatattagaagaaagctccaatcattctacccgcaaagaacattttgatcatcatgaatttgaagatcgcactgattctcaagttagagcatctcatcaaaataccacaaccttcaaaaccattgaccaaaaccagatgatagatggagttaagacaagcactcacaccaataacctcagcaagacttgtaaaccttcagaggaagatggtagcctgctaaaagctgataaacatagagttgatgatcaacttggtggcaattctcaaagaagaaaaaacacaactgtggataggatcaatctagaatcctgggatggagcagctaagaaatctgcaaaacaagaacctaaccctcttttagctgttttgaaagtttttgttgatgcttttgtgaaattttggtcgggatga

SEQ ID NO: 1384 - DNA, 495 bp, Glycine max
  Peptide Sequence Number=SeqID_118162
atggggagcatctccagccacgtaacagacaggagcaatgccatcaaggatcctccaagagccagatttaagagagtaaagctcaaccaagggagcagaaaggccaaagctttcatcatccacaatgcaagaaatcctgataaccttgtaatcgcaattagtggaatcaaagccgagggcaatgcaggaattgtagtagcaagggtagtcgtggggtgtggggaggcagacatatcgtcgaatacttggattgcaaatgataatggggaggcatcgttcaccgtaggcaatgcaaatgagaccattacagaaggaaaggacggggaactcgagatcggggaaggagggaaggcggaggagggtgtaggagagggtgagggagggatcgtggtggtggcggcggtgggggaggaagagcttgttgctgaagccaaggaggagaaaggaaggggagtggcggcggtggagggagatgaaggattcgttgctgattag

SEQ ID NO: 1385 - DNA, 306 bp, Glycine max
  Peptide Sequence Number=SeqID_118163
atggccatgtcaacaattttattcaaagcctctccatgggaagggattttgattttgctgcccattgcattacttgaccatctaactctatgtgtccattgttcacctctaagccattattataagtttgtggagaattctgttattgatttgacatatttcatcctctccgaacaggtccttgatgatacaagcagtgttcgtgcctctcttcggaagagattgacggctgatgatcctgatctcacaacagatgaacaactcagaataaaggagtttcttgaagcttgtcctgatgaggattag

SEQ ID NO: 1386 - DNA, 546 bp, Glycine max
  Peptide Sequence Number=SeqID_118164
atgacggaaaggggaactcacgagagctatccttggcgcgcgaacgccaattctcggctgggagcgaaccggatcgagtccatcgccggagaggaaccgctgcgaaatcttcccggggacgaagcggagcgcggagccgaagcggattcctccgcggatgtagctggcgcgctcggcgcgctggcggaagacggaggtaatggagctctgcatgaccagggaggcgagggcgaagaggaagacgacggcgatgatgaaggcgtagaatccggacttggacttggggaacggaaagagccacagcaacaagcccttgcgcttgtggaggtgagatcggttgatattgttgttgctgttgctgttgttgttcgaacgcggcaattgccgatcgaaggagccacggtgccggtggtggctagggttccgcttgaaggggaatccgccgcggatcgcaccgaatccaatgtcgccgccgccgccgccgtcatcgatctccggctgcgacgccgcgttgcgcgacaatcccatcggaaaatcaatgaatga

SEQ ID NO: 1387 - DNA, 288 bp, Glycine max
  Peptide Sequence Number=SeqID_118165
atgttcgcatttttattggacatcataacgagagagaaaataactcaccgatcagagggagaacaagaagaagaagccggcgaggaagaggtacaactaatagaaccgaacgcgattgggtccaagacgaaatcgttgaagaagaagaagaaaatcacggcgacgatggcgacgccggcgagggccgtgaagagcaccgccggagtagagggcgaggccgcggctgccattagccagaacttgccaccgccaccgacggagagaaaggtggtttcgctattgctatag

SEQ ID NO: 1388 - DNA, 861 bp, Glycine max
  Peptide Sequence Number=SeqID_118166
atgtccgacaaagaacttttcaacagcatatgtggaatagcaatatttctagtttgtggtcctgaactcgaccttgtagcccttgggccaaaaaggttgaccccagagatattagggcacatgacgatagatccccagtcattgatgttggttactgtgattcggaatctacagaagttgggttatgtctttaagatatttgcagtaggacatgggaaggcccgctcaatatgggaaaacataggtggcggaatctctcctttgagtgcaaagcatcaaggcctgatcgattggtcaatttttgaaggtatcattgttgactccctagaagcaaaagtagccatttcaagcgttatgcaggatcctttttgttctgtaccattaatatggattattcaagaagatagcctttcaagtcgccttccagtttatgagcaaatgggttgggagcatattgtttctcattggagaagtgcttttagcagagctggtgttgttgtgtttccagattttacttatccgatgttatatagtgagcttgacactggaaacttctttgtgattcctggatcaccagtggatgtgtgggctgcagaaagctatagtaagacccatgcaaaggatcagctaagagaacttagtggatttggtaaaaatgatatgttggttctagttgttgggagctctgtcttctatgataacctatcttgggactatgctgttgcaatgcattccgtagggcctctgctgacaaaatatgcaaggaggaatggtgcaactgactcatttaaatttgttttcttatgtggcaattccactgatggttatgatgatgctttacaggtagtctttcctttttaa

SEQ ID NO: 1389 - DNA, 453 bp, Glycine max
  Peptide Sequence Number=SeqID_118167
atgaaaggactaaaggaggctttgaatactgtgatattaaattggtatggtgtgtttgataatgtgatacaaaacctcgcgagggactttgatgcatttgatctacggaggcggcttccagctgtagttagcaaattatacaaggcaataaattccaatggaggtgtaacatatatacattgcactgctggacttggaagagctccagctgttgcgagcaaaaggtcgtgctttccaaaactggatgccattaaaagtgcaacagctgatattcttacaggcctcagtaagaagtctgtcactttgtcatgggaagacaaaaattgctctaccgtggaaatttcaggacttgatattggatgggggcagaaatgtctcagttcctctattatagagcatgtaaagttcaatacatcacatggaaatattatcatacagcaccatcatcattaa

SEQ ID NO: 1390 - DNA, 366 bp, Glycine max
  Peptide Sequence Number=SeqID_118168
atgaccacttatgtgttggaagcagaggaaggtgatcctgttgccattacagttcacccaagtggggatgattttgtgtgcgctctcagcaatggtagctgcaaattgaagtatttccccatggcttgtagattgtttgagctgtatggtcgtgaaacaaacatgaagttgttggctaaggaactggctcctctacagggtattggtcctcagaaatgtatttcttttagtgttgatgggtctaaatttgctgctggcggaatggatggacatctcagaatcatggagtggcctagtatgcgtgtgattttggatgaacctagagcacacaattcagttcaggatatggattttaggttggtatag

SEQ ID NO: 1391 - DNA, 1434 bp, Glycine max
  Peptide Sequence Number=SeqID_118169
cgaggtcaaaatcgtttaaaacccttaaaccctgcgacgccgtttctcgtcatctctctctccggtgctccgttgtccgacgagaccgaagccgtgtctcgtgagcagatgggtgagattaaagagaacgttcctcttccgaagaccaagccttccactgaacaggacgttacggatgagctagacctgagaatgaagaagtatcttagaggagaaggtgctaatttggagggtttgaaggataaaaagctgaagggtcaactagctgctaaggaagacttatatggaaaatctgctaaagctgctgctaaggctgagaagtggcttatgcctagtgaaggaggttatttggaggctgaaggcttggagaagacatggaggatcaaacaggaggcaatagctcacgaagaacatggtccagtgttaaggcttcagtttctggaaaaccattttctcttggcttcaatcaacaagtttggacaacttcgttatcaggacgttacaatgggttccatggtcggtaattttcgaactggcttaggacgtacaaatgtaatgcaagtgaaccccttcaatggggttgtttccttaggtcactcaggtggtactgttaccatgtggaagccaaccagtgcttctcctcttgtcaagatgctatgtcatcatgggcctgtctcagcactggcatttcattcaaatggcctcttgatggccactgccgggaaagataaaaaaattaagctttgggacttgaggaaatttgaggttcttcaaaccttaccaggtcatgcaaatactctggattttagtcaaaaaggcttgcttgcttgcggtaatggttcattgatacagattctgcgtgatgtttctggtacacaaaattattccaagtatatgactcattccatggtgaaaggttaccagataggaaaattggtatttcggccatatgaagatgttctaggcatagggcattccatgggctggtctagtattcttactccaggagcaggagaacccaactttgactcatgggttgcaaacccgtttgaaacttctaagcagaggagagaaaaggaaatacggtctcttcttgataagcttccacctgagactatcatgctggatcccagcaagattggtacggtgaaaccaagaagagagaggccaacaaagcaagagagggaggctgaaatagaagctggcgttgaagcggctaagggcatgaaactgaaaaagaagacaaaaggaagaaacaagccaggtaaaagggtacagaaaaagcaagaggcagtttctagagtgaagaggccctacttggagcagaaaattcaagaagaggaaagcatatcaagaaagaagcagaaaactagtgaggatgttgaactaccaaaatcactacagcgctttgctcgtaaaaaagcatcatcatga

SEQ ID NO: 1392 - DNA, 1158 bp, Glycine max
  Peptide Sequence Number=SeqID_118170
gtcgactctagaggatcccacgttcttccgccgcctgttcccggacatcccgcaggaacgcatcaacgaatcgctgggctcgggcgtgatcatcgacgccaaggagggcctggtgacactggccgacgggcgcacggtcaaggccgaattcctcggttcggaccgcgataccgacatcgcgctgatccgcattccggcgcagaacctgaccgacatcaagctcggcaacagcgaccagctgcgcgtgggcgacttcgtggtggccatcggcaatccgttcggcttcagccagacggtcacctcgggcatcgtctcagcggtgggccgcagcggtatccgcgggctgggctaccagaacttcatccagaccgatgcgtcgatcaacccgggcaactcgggtggcgcactggtcgatctgcagggccagctggtcggcatcaataccgccagcttcaacccgcagggcagcatggccggcaacatcggcctgggcctggcgattccctccaacctggcacgcagcgtggtcgaccagctggtcaagcacggtgtggtggtgcgcggcacgctgggcgtggaaagccagaacctgaccgcgcagatcgcgcagggcctgggcctgggcgaaacccgtggcgcactgatcacgcgcgtgctggccggttcggccgccgccgcagccgggctaaagccgggcgacgtggtggtctcggccaacggccaacgcgtggacagcgccgaagccctgcacaacgtggaaggcctggccgcggtcggcagcgcattgacgctggacgtgcgccgcgagggcaagccgctgcagatcaaggcaacgttgaaggaacaggcgcgcgcggtcaccggcgagagcctggacccgcgcctgaccggggccaccttcgtcgacctgcccgagtcattgcgccagtccggtgtcggcggcgtgctggtcagcgaggtcaagcgcggcagccgcgcggccagcaacggcctgcagcagggcgacatcatcaccgatgccacggtgggcgaattcgccgacctggccagctggcgcgccaacttccagcagcgcccgccgaccctggtgatacgcgtgctgcgcaacaatggccagcagcagggccagctcgtgatgcgctgatcgccctgccgtaa

SEQ ID NO: 1393 - DNA, 291 bp, Glycine max
  Peptide Sequence Number=SeqID_118171
atgcaaaggttgaaggttccaagtacgaggagtttagagagaattgtagagaatcaagcaaaaatagaagctttagggttgtccaaattggccaccattttcaatgatagaattcaaaaagctaagaaaaaggataataaggaggccaacgatgatgatgaagactatgtacctgaatatgaagggggacttggatcaaatttttcaagtgaaaattacgagaacgacaaacgtgatgagtttgctgctacagatgatcttgagtcacgaaaaagaaaggcaactctttaa

SEQ ID NO: 1394 - DNA, 213 bp, Glycine max
  Peptide Sequence Number=SeqID_118172
atggggggggggggggggggggcggggagggtctcggtaaggaagctcgattcggctaaggagaaagtcagtggtgatgaggagaatggtgaggaggtggagcaacaatgtcctttggaagttgtgggtaacatcttggcttcggccactcattctcctttttttgcatttccctttgccatcgaagacgaatatggagatagtgggagatga

SEQ ID NO: 1395 - DNA, 267 bp, Glycine max
  Peptide Sequence Number=SeqID_118173
atggagggacttccccaaggttaccgtcccaacgttggtgtctgtctcatcaactccgatgatcaggtcttcgacaaagatctgtcgctagttttggcggaacaatttcgtactaataagatgatttttgtggcttctaggttgaatgtcccaggagcatggcaaatgcctcaggggggaattgaagatggtgaagagcccaaatctgctgccgttagggaacttcgagaagaaactggaatagtgtctgctgagataattgctgag

SEQ ID NO: 1396 - DNA, 693 bp, Glycine max
  Peptide Sequence Number=SeqID_118174
atgaaggaggaggtacaatttatgtgtgtacaagaaactaaaaaagaggtgattaatgaagagatatgccaagctatgtggggtgatgcagagttgcaatgggtttaccaaccaaccaacaataaatgcagcatttggaaggacgatggagtagaagtcacatttattaatgtctattcaccatgtgatatggatgcaaaaagaaggctttggggagatttaattccgcataaggagaataaatcatggtctaatgtgggcattataggggacattaatagtgtgagaagaattggggagagggaagaggtcaaccctagaggagtcaaatatgagaaaatctctttggaggataataatatgttgatagggagatttgaggaagaagaagtgagggaggcaatttgggagtgtgtcaattctaaaagtttggggcttgatgggggtgctaatgcttcttttgttgctctaactccaaaggtcgaggatccaaaagtacatcatggtgtcattgatgaaagacaaagtgcctttttggggggaagtaatctcttgcatagtgcctttatagcaaatgaagttgtggatgaagcaaggagaaagaatgaaaagtacttgatcatcaaagtggatatgagaaagcatatggttcagtatgttgaagcttcctcttttatattctacaaagattag

SEQ ID NO: 1397 - DNA, 210 bp, Glycine max
  Peptide Sequence Number=SeqID_118175
atggttgtgcttggaggtgcagggcaacatacatctttgtacaaggagacccttcttgtggtaattgcacaagatgacaaaaataaaatccttctaatagcctttgtcgttgttgagggacaaagcaatcattactacaacaatctaagaaaggaagcagatggtgatcaaggtaataattggcttagggagattccacgagaaaagtga

SEQ ID NO: 1398 - DNA, 915 bp, Glycine max
  Peptide Sequence Number=SeqID_118176
atgcttgtaactggtgaggtccctaccgagctgcatgcattgcctgggtttaggtctgagttggagctggacaagctttgcaatgggtttcaggcctctgctggaggtgtcgtcttgcagatctatgtagaattcattgccctggcttgcttggtagatggggatttcatcttcaaatggggcatgaagactatagctccaagctcgttgaatgtctttttgccaattaaggcaaaggagcttgccctaactaaaggtggtcatcaagtccatgtagcctctagtctcaactctctcgcctgcaaagtcaaggagtggaccgacgtaagggtggctagagtcgagaaaggcctcgagtctctagaaggttttccagtactggatataagtggaattgccctggtcaataaggaccctggataccatgaaatttgcaatgaagatggagacaactacggggtcgtcttggttgacgtggttgattcccttgatgtccctattcgtaaaggtgatgagaggaagactttgttgtacttcctccagaatcgtggtgcgattgactgtcagggccttggtgtttacttcgtgtttgtcatgcttctatctggcttgtcagacttcattccaaaatctggacatttcttccatctagatgtagcccttggctcgctcgcgcagtttttccatgctactgagtggtttcttgcacagattgtctgtgaacttgtcaaggcatatggtttgcaccccaagagtattgtctgcctccataatgtgatcaacaaaagaatgccgacggataatctgtcctactggacagtgtacgtgggagagactcaaatcatctatagtgttgcctatgcatcggggggggctcttgcatctaatgctaaaccaagtgctaaccatggatga

SEQ ID NO: 1399 - DNA, 792 bp, Glycine max
  Peptide Sequence Number=SeqID_118177
atgggagaagaacgacgtaaggcagtcaaagaagaagttgacaagctcctccatgcaaacttcatcagagaggttaggttctctacctggctcgccaacatcgtcatggtcaaaaaggctaatagcaaatggcgaatatgcactgactacactgatatgaacagagcatgctctaaagacacataccatctgcccaacatcaacaggctagtcgatgggacgtctgggttccaggtgctaagcttcctggatgcctaccctggatataacaagaccaggatgcatcctccagacttgacaaccatgtcatccacatatacctcgacgtttcattcgatctcttgtttgaagactcagtccattagtcgttgggaactcctcaaatacgacaagcttctcaaccctgaaaaatacatttttaggataagaggaggcaagttcctcggctttattatcatacagctgggaattgaagtcaacctcgacaaatgcacaaccatactggagatgcatagtcccaccaacattcaagaagtctataagcttaacggcccacttgggccctccagaagattcctccagaaggctgttgcttctggaggaagcaaccctgctcgcctgggcgagctgagctcgcctgggcgagctggaaaaattgtttccgtgaagaaaatccaagccaaggcgcttccgaaacgtttccgtaacgtttccgtaagtgatttcgcgaaggttttcgaccgttcttcgacgttcttcattcgttcttcatcgttcttcggtcttcaacgg

SEQ ID NO: 1400 - DNA, 1410 bp, Glycine max
  Peptide Sequence Number=SeqID_118178
atggcatggataagaaggaaagcagacaagacctctttgctgcctgaaattgttttaatcacaatcgtttcgtttcttccatttaaagaggctgtaaggacaagcatcttgtccaagaggtggtcgaaaatttggctttcaacaaagaacatagagttcaacgaactcttctttcttaaccctcctgaaactgatgccaccaaacaattacagagaaggacacttttcttcgacttcatcacccacttcatggacaactaccgtgtcatcaacacagtggacaagttttctctcaaggtttcaaaccctgaaagttgtgctgacattatagaacgttgtgttgcatttgctactgagcgtggggttaaagagttaaggcttgatttctctgacccaacatgggaggagaatgaggatgatgataatgaccatcatgatgctttgtttcaattgccaaaccatgtttacaggcatgcatcccttgaggctttggagttgtatgcttgtggttttgccatgcctgatatgtgcaaccttgtggaactcaaggatgtttcttttgggtggattgaaatgagtactaacactgttaagactctattatccactcttgggaaacttgagaacttgagtatgaagaaatgttggaatttggaacattttgatatgcgtactcaagaagttggattaagaagattggtcatagataagtgtcattttgtcatctctgattacgtggatttgagggcgccaaatcttaagtttctcaaatattctggaaaattggggatttttgaagtaaaagcactccctgaggtcgtacaagaagcacaactggacttcactcctatgcccaaatttgaagaatatggggatgaactttgtcaattattactcgatctcagtggtgttcgtgttcttacagtttgcagtttcttacttcaggctcttcctactggagaagaacagatgcgtatgcagcacgatatggaggtgaggcatttgctcgtgaatactgatttggataatcaagaactgtttggatttgtgttgcttcttagcagttgtgtttatttggagaaactcacgttggacataggccaaggaaaaatctatgatgaacatgttaagccctatcctttcgactttgcgaaattctgttgtgaccaatacgcaatttttgaatgcgtaaaagacaatctaaaggtggtggagataaatggatcccgagcgagcaagaatgaattgcgtttgtgcttctatctgatccaagttggctgtgtcttggagaaacttattatcaatctagcgaaggaagagggtaatgaaatgttggaaatagagcgccatgaacgtgcaagcttgttattcgatgttccaaaggcttcaaagaatttacagatatggatt

SEQ ID NO: 1401 - DNA, 225 bp, Glycine max
  Peptide Sequence Number=SeqID_118179
atgggtgcttttacagagaagcaagaggctttggtgaatagctcgtttgaagcattcaaggcaaaccttcctcaccacagcgttgtattcttcaattcgatattggagaaagcaccagcagcaaagaacatgttctcatttttaggtgatgcagtagatccgaaaaatcctaagctcgcgggccatgctgaaaagctttttggattgggatgtatactggattag

SEQ ID NO: 1402 - DNA, 876 bp, Glycine max
  Peptide Sequence Number=SeqID_118180
atgacgctcttatcctctcacctacttgtcttctccgccgtccaccaccgtgcgccgccgaccaccaccacccggaacagcccaacaacaaaccacactgtgcggtttctgtgttctcccggcgtgccgccagctgtccgcttggatcaaaggttgccgcgctttgttgtccccggcgccggagcagaagatctgctctacaatgccggagccaccgtcggcgttcttggcggcggttacgccctcgtccgtgcctttgacgaactcactcggagaaacatcctccaacaggtaccccattttatgtttcatacgaggaaggatagcaactcccctaaggctcgctactttgccgcttttgttcctctcgtcaattgcttgaggcttttggtcaatggtctctcactggcttctgatgagggactcatcaaatccgtcaccagagaaggagatccactagaattgctaaggggtcccctttattatgttctgatactgattttatctgctcttgtgttctggcgtgagtctccaattggtgtgatctccttggcaatgatgtgtgcaggggatggcatagctgatatcattggtagaagatatgggtccatgaagattccctacaatgaacataagagtttagccggtagcatgtctatgcttgtctttggattcttggtttcaatagggatgctctactactattcagttttaggacatgtgcagttggattgggcaagcactctgcccagagttgcttttatttctttcgtggcaacattggtggagtctcttcccattactaaggtagtagatgacaacatttctgttccactagctaccatggcagtggcatttttcactttccatcattaa

SEQ ID NO: 1403 - DNA, 1251 bp, Glycine max
  Peptide Sequence Number=SeqID_118181
atggcacttgaatcctgtgaaggtggagaactttttgatcaaataaccaggctgtgtcagggtactcttaagaatctgtgtactctcagtactgttaggaacatggaagttgttaatttcaacctttctgatttctatgtgcagaaaggtcgtctatcagagaatgaggcacgattctatgcagctgaagttatcgatgctcttgaatacatacataatttgggagtcatacatcgtgatattaagccagagaacttattacttaccgctgaaggacatattaaaatagccgattttgggagtgtgaagcctatgcaggatagccaaataactgtccttccaaatgcagcatcagatgacaaagcctgcacttttgtgggaacagctgcttatgttcctccagaggttcttaattcctctccagcaacttttggaaatgacctttgggcacttggctgcacattataccaaatgctttctggaacttccccttttaaagacgcaagtgaatggcttatttttcaaagaattatagcaagagaacttagatttccagattacttttctgacgaagcaagagaccttattgaccgcctgttggaagcaggaagttatacttgtaggctattggataacagacatagggatttggaccccagcaggagaccaggtgctggacctgatggttatgctattttaaaaagtcacccatttttcaagggggttgactgggataacttgagggcacaaattcctccaaaacttgctccagaacctgggactcagtcgcctgcgtctgatgatgttcatgactcatcgtggagtccttctcacattggggatggttctgcagcttcggttagacaacctgacggtgctacatcttctgaggggactggtcacataactaggctagcttcaattgattccttcgattcaaaatggcagcaatttttggaacctggggaatctgttcttatgatctctatggtgaagaaattacaaaaactaacaagcaagaaggtgcaactcatccttaccaacaaaccaaagctgatctatgtagacccatcaaagctaattgtgaagggaaatataatatggtctgataatccaaatgatttaagcatccaagtggctagtccatcaaatttcaagatttgcacacctaaaaaggtaatgtcgtttgaggacgcaaagcaaagagcatggcagtggaaaaaggctattgaaggacttcaaaaccggtga

SEQ ID NO: 1404 - DNA, 1069 bp, Glycine max
  Peptide Sequence Number=SeqID_118182
atggaaaagggaaatactttttacctgttctatgagacgaaaaattcaatcactatgcaaggtgatattggagtttcaaaaagtactgataagggagcaacatggcagcagttgggaattgccttgaatgaggattggcatctttcttatccttatgtctttgagcatgatggccagatatatatgatgcctgagggaagccagaagggagatcttcgtctctaccgtgcagttaacttccctttgcagtggaggttggaaaaggtcgtcatgaaaaagccccttgttgattcttttgtcatcaatcatggtgggaggtattggctttttgggtcagatcatagtggttttggcacccagaaaaatgggcagttggagatttggtatagcaattcacctcttggtccttggaatcctcacaagaagaatcccatttataacattgataggagcttgggagctcgcaatggaggcaggccatttaaatatgaaggaaatctttatcgtatgggtcaggactgtggtgatacatatgggagaaagttgcgtgtttttaagatagaaactctcactattgatgaatacaaagaagttgaagtacccttaggctttgttgaatcaaacaagggtcgaaatgcttggaatggggctcgataccatcacttagatgtgcagcacctgccatctggtgggtgggttggtgtcatggatggggatcatgttccttctggagattcagtccggcgattcacggttggttgtgcttctgttgcggtcgctgctatactcattgtactattgggtgtgctacttggatttgtgaattgtattgtccctctgaattggtttattcataactctgggaagagaaattttactgtcttgtcttgggaaaggtcaaatgtgtactgttcaagagtaagacggttttgcagacgtctgaaccgagccccaacatttctccgtggtaaaataaagcataatgcttgtgctaggaggtttattcttgccataatatttgctgtgggagtcggattgatgtgcataggagtgaaaaatatctatggtg

SEQ ID NO: 1405 - DNA, 507 bp, Glycine max
  Peptide Sequence Number=SeqID_118183
atgggttcggggcagattggcggcggcggaaacggtggtggttgttctaacggcgggagttgttgtgatatgagtgtgaagtgttcgtgtaggtggagattggagaaccaacaatactacaagcggttattttcttcgggtttcattttcttctttgggtgtttcgttttgttcggatccattgccaccctctacggttggttcgctttttcgcctacagtgcacaccgcactttcctcttctttcggttgtcgtgaagacaatgagggttcttggtctattggggttttctacggtgactcacctttctctcttaagcccatagaagctgcgaatgtatcaaacgatgagactgctgcttggcctgtcgcgaatcctgtggtgacgtgtgcttcagtttctgatgttggttaccccagtaataataataataatcggttcttgctgccacctttggttccctccttcatcacgtttctatctggtgcttctgattctgtgaaatag

SEQ ID NO: 1406 - DNA, 159 bp, Glycine max
  Peptide Sequence Number=SeqID_118184
atggaagtgaagactgaagagtacgccgccgcgggcaaagagttaggttttcctttttgccattgctatttatttatttttattgggttccatatgagaggacaagagggtgcagtcaagcttggcaagccagagtctcttcggctggccgattgctga

SEQ ID NO: 1407 - DNA, 766 bp, Glycine max
  Peptide Sequence Number=SeqID_118185
gccaggagcacccctactcatgtatctctcagtagctggcaaagctgttagctcagtcctcatacaagaggaagggaagcaccaacatcctgtctacttcaccagtcgcatgctccatgatgccgagaagcgttaccaaatgatagaaaatgtggcactaacactcatcatctcggcccgacaacttaggccctacttccagagtcatcaactggtagtcaagacgaactaccccatgaagcaagttttgagaaagcctgaactcgcaggaaggatggtggcctgtggggcggggatcattctcgaagtccctaacaatatcactctagagcaagctctcaagctcaacttcagagtctcaaacaaccagacaaggcacgaggcgctcattgcaggtttgaagctagcaagagaagttagagccaagaggctacgatgctacatagaatcgcagcttgtccaatgtttcaaaatgtattacatccccagggaaaccaacacccgagcaaacttgctctccaagttggccaacaccaagaaggtcgagcgcctgaagaccattatccaagagacgctccaaactcccactatagatgctgagaaaattatggtcggagaagaggaggaaccaaactggatgaccctaaacaagaacttcctaattcgggagtcagggcaaacaccctcgactttaccaggaggtgcagatgatgctaagagtttgcagacatgccacacactcctcccgacaatcttcataaactga

SEQ ID NO: 1408 - DNA, 417 bp, Glycine max
  Peptide Sequence Number=SeqID_118186
atgaaggccgacatggaggccatgaaagagcaaatggccacaatgatggaggccatgatgagcatgaagaagattttgaagccagatgcggttatagttgccgctactagtgctgtcgctaaggtgaacccgatgcccccatctggcctcaaccaaatgaatcatccaacctcaaatatggtaggcaaagatttgggaagtacggacgaccccatgatgtgcaaattcaaaacgagcacgctttcccatcatatggcttgcctcccaactatacaccacccaatgtggcatacactctcaatgaaaatctcaataactccactccgatactcattgagaaccaataacctcaatctgatcaggcacatatctctcaaaccatgggggagacacatgaaattccccaccacaatctag

SEQ ID NO: 1409 - DNA, 696 bp, Glycine max
  Peptide Sequence Number=SeqID_118187
atgaccaaattgaaaaagaagcatcctcttccttcagaaatcttattctttaagattatctctgaagcaagtcttcaagatggaaagcttaagattccaaacaagttcactagggaatatggtgttaatctgtcaaacccggtgtttctcaagcctccagatggtatagaatggaaaattttttggactaaacatgatggtgatatttggtttcaaaagggttggaaggaatttgctacatattactccttaagtcacaaatatttggtgttgtttaagtaccaagaaacgtctcatttggaggtacacatatttgaccagagtgcccttgaagtagattatcctttctgtggcattaaaattgaacatgaaaaccttgaccacgttagcaatgactctgttgaagtttcggatgactctattgaagttttggatgagctgactccaagtcagaagaagactagactgaaatcaacatcatgttctcgaccacgtaaaaaattgaacacaggcccaagtgaagtttttgaagaaagctccaatttgcctcaacatgtccaaattaaaggtgaacaatctcaaggtactaaccttggaatgtcatctgacaagcaagtacctagtgatcccattttaatgagctacgtattaactgagagtctggctaaacgagaaaaagcaatggatgtgctataa

SEQ ID NO: 1410 - DNA, 1272 bp, Glycine max
  Peptide Sequence Number=SeqID_118188
atggctcctgaacagcctccagctaagagacagaagaaggatcagtcttcttctcagtctgcacacagaactgagtaccccactaagttcaggactgtaactcatgagcagaggtacgagacagaaatcaagatgagaaacttcatcccagagaaaaacttcaagctcaagccaggagaatatgatgagatacagaaagtcataacatggcgaaagtgggagaagctatgctcctttgcacagaacttccaccctcaaatagttcgcgagttctatgcgaatgcctatggcattgagggtgatacaactcccctgcacaccagctgggtgagagggaagatggtctcctatgaggaggagaccattaattctttctttgggactcaagcagctgcagattgttcctataaggctggaggcgacctagtcaaggactatggcgagatgaagaaacttctagctaggccaggggccatctggattggcaagaaagttaaaccgaggtgtctccggtcaatagacttgtatccagtggtacatgcatggagctcatggatgcatcacactgtgctaccttgtgccaacgagtctaatgtaactgtagtgcgtagtcaattcctgattgctaccatcttgaatgagcctttggacatcggtcggatcatctctagtgacatccatcaagttgcccaaaccaacaagcctaaagccacactatctcatccttctttgatatgcttcttatgtgagcgagcaggtgtaggaatcccttgggatgagcctactgcgacaattcctcgccccatcaccgccgcatggatagattctcggcttgatgggccaatgggagcaccaccacagccacaggagcaacagccacagccacagccacaacaggagcaggagcagcatgctcaggaggaccagccaccggcaccctcttcccttgatcagtgtctgatgctgctcgtgcagacacagacacaacttagccaagacattcatcgcctagttacagaggcaagggttcagtcaagaggcacaaatgcattatgccgcctcctggctcttcagtttcgtagccagcaacagcaggagttactcaagcctcaaggccagctgacagaggcagacattcttcagatggtaggcttagagaagcctgcaaaaccatcctcttggcatccagcaaaggtaccgaccgcggatggagctggagaggatctccaggatgaggacctgatctacccttcctcttcccagccaatctga

SEQ ID NO: 1411 - DNA, 264 bp, Glycine max
  Peptide Sequence Number=SeqID_118189
atgaaaggtcagattagggtttcgttctctaccgaaaccgcaagccaagttggaagattccgctccaatcgacgggttcctctcattgttgagtctcaacggagaacaacaacaaaatgctctcgggaacggaagcttcgagcatactccagacattttctcaacgatcccaacggtcagattgtgaagctgcagaccaaatttcgagaagatccaacggttaacgaaggctgggcagcatttttaccgaggcagatcatgtag

SEQ ID NO: 1412 - DNA, 99 bp, Glycine max
  Peptide Sequence Number=SeqID_118190
atggaagatgctaagcttatgaaaactccaatgcatgcttccaatcttctaagcaaagacgaatcagatttcagtttgatcctcgagaatcacatctaa

SEQ ID NO: 1413 - DNA, 801 bp, Glycine max
  Peptide Sequence Number=SeqID_118191
atgaatcttttactcgccgctgtaactctcctcgtcttttatgcggcgaaatttttttactcaaatttctgggtcccatggagaacagagcggcacttcaagaggcaagggatagggggccctggctaccgtccgatcttcggaaatacatcagagatccgacggctctacgcagaagccaagtcagaggcaagtgcatcccctcctccgttccaccacgacatcatgggacgcgtggctccattctacgaccggtggtctcgcgcgtatgggaaaactttcttgtactggttcggttcgacgccgcggttggcggtaaccgaaccggacatgattaaggaggtgctcatgaacacgcgcggggagtatgtgaaagttccgttcaaccctcagtccaagttgctctttggacagggccttgtgggcctcgagggtgaccagtgggcccttcacagaaggatcataaacctcgcctttaacttggagcttgttaagggatgggtgcctgatattgtggcaagtgtgacaaagaagctggagagctgggaggaccaaagaggaggaagagatgaatttgagatagatgtgctgagagagcttcatgatctttctgcagatgtaatatcaaggactgcttttggcagcaattatgaagagggcaagcatattttcaacttgcaggagcaacaaatgcatcttttctcacaagcagttaggagtgtgtatatccctggattcagcctgggaattacaaataaactaccaatttcgtcctggaagtattactctctccctgagtag

SEQ ID NO: 1414 - DNA, 186 bp, Glycine max
  Peptide Sequence Number=SeqID_118192
atggagaattggcgaacagcgctacgcaataacttcgcggggctccagactcgaagggtctccgaaaaaagtggagaatggagaattggcggacaacgctatgcaataacttcgcgcggctctagactcgaaggtggaggacacatgaacagcgctaggcaattacattcatgggtctccgaataa

SEQ ID NO: 1415 - DNA, 1049 bp, Glycine max
  Peptide Sequence Number=SeqID_118193
cgtcgctgaggcaagccttcgaatctctgcaaccatccctgagaccccctttctccttatccattctcacccccgaccaatacgccctcctcaaccgcgcaatcctccacggcgttttaacggagcctcatttggccaatacccacatcaaacacttgcatgcaatcgtcgccgacgcccacgccaccttcctcagcttactcctcaacgccgtcctacaactctaccccaaactcctccactccgtcaaaacgcagttactcaggctcaccgaggaaatgcttcgcgttttgggtatcggatacgacgccgttttgctcttccttttgcgccaaatcgccgccgccgattgcaccgatgccaacttatcgctctgctccgagttgctgacccttttcttaaaacaatttgaacccttattggaaggcgcgcctcatgttttgtcgtctgcgttgtacacgtttcttagggttttatctgataaatttagggttagcatcgaaaagttggagattttgaagcggagggagattcatctgtgcgtgaagatagtgagggaagagtttcgcttgtgtttgaaaattgggagggattttattcgcttgttgcaggatttggctcatgttcccgaattcaaggccatattacaagacattgtgttcaatccatctgtgtttaatgtttttggttttaaggatcgtgataaagagtttgttatagtcgatattgtgaggagtaaacaagttgaggagagtgtgaaactggctttgttttatgactggctcttctatgatgaaaggatggatggtatcatgaacatcaagccggcggttctgctcatggtgcattctgttcccaagttcatcaacgtgacttgtgctcttcttgagttcttgtcgcatcttgtggatcgttatgacgtgggacggaagggtgtcattgttaaagggtctgaaaaggttgttatcagatgggaaggttggaagctcttaagggatttctgccagaaggatagttgctacttgctaatccacaatggccacctttga

SEQ ID NO: 1416 - DNA, 1621 bp, Glycine max
  Peptide Sequence Number=SeqID_118194
atgaatctgctggcagctggtcatgacagtggcatgattgttttcaagctggagagagaaaggcctgcatttgttgttagtggtgattcattgttctacactaaagatcggttcctgtgtttctatgaattttcaacacaaagagatgcacaagtacttccattccgacgaccgggctctttaagcttgaatcaaagcccaaagactctttcctatagcccaacggaaaatgcttttcttctgtgttcagatgtagatggtggatcttatgagttgtattgcatatcaaaggacagttatggtaggggtgatgtgcaagatgcaaaaaaaggtcatggagcttctgcagtctttgtggctcgtaatcggtttgctgtgctggagaagagcagcaatcaagtccttataaaaaatttgaagaatgatattgttaaaaagagtgtccttccgattgccactgatgctatattctatgcaggaacaggcaacttgctatgtaggtcagaggatagggttgttatatttgatcttcagcagaggattgttcttggtgaacttcagaccccgtttattaaatatgttgtctggtctgatgacatggaacatgttgctttactcagcaagcatgccattataattgctagcaagaaacttgtacaccaatgcactctccatgagactatccgtgtaaaaagtggagcttgggatgaaaatggtgttttcatttatacaacactaaatcacatcaaatattgtcttcccaatggagataatgggataataaagacattggacattccaatttatatcacaaaggtctctggcaacacaatcttctgcttggatagggatggaaagaacagatcaataattattgatgctactgaatatatttttaagctttccctcttgaagaaaagatatgatcatgtcatgaacatgataaggaactcacagctttgtgggcaggctatgattgcttatctacagcagaagggctttcctgaggttgcactgcattttgtgaaagatgagaaaattcggttcaatttggctttagagagtgggaacattcaaattgcagttgcttcagcaacagcaattgatgagaaagatcactggtaccgattaggggttgaggctcttcgccaaggcaatgctggtattgtagagtatgcataccagagaacaaaaaattttgagagattgtctttcctttatcttgtcactggtaacatggagaaactgtccaagatgttgaaaattgctgaagtcaagaatgatgtgatgggccagtttcacaatgccctatatatgggtgatgttcgagaacgtgtcaagatattggaaaatgtgggccatttgccacttgcttacatcactgcatcagtccatgggctacatgatgttgcagagcggcttgcaactgaactgggagataatgttccatctttgcctgcaggaaaagtaccttctctcatgatgcctccatcacctgtcatttgtggaagtgattggcctcttctcagggtcatgcaaggcatgtttgatggtgtgcttgacaatacaggtcggggagtcgctgatgaagaagagtatgaggctgctgatggtgattggg

SEQ ID NO: 1417 - DNA, 246 bp, Glycine max
  Peptide Sequence Number=SeqID_118195
atgtatgacacgttcgaccggggatgtgaaaagagcagcgcaagaattgtttgttgtgcactggctctctatgtgtggctggtttcacaccttttttctccaagaaggagtcaagaacttccccgattgctagccaaggccaaagcagtggcggacacctactccgcccccgaggagatccacggacttctcagctattgtcagcatatgatagacttaatggaccatatgattagaaaccgctag

SEQ ID NO: 1418 - DNA, 310 bp, Glycine max
  Peptide Sequence Number=SeqID_118196
ccttttatgttttaaaattctcattttagttacttatgattgcgatgttgctcaagataattcttctgtcaattttaaactaacacgtgagatgattaaacctgattgcggtggcgtctcagaggtgtgcggctgcgccgtggtgctgattgcagcaagggttttgcgtcccagcgcaatgcagagaaccttctctgcccgacgcgaactccaaaagcgatgggaaccctgtcctccgccacaggtcgctaccgtcgatgaagcacccactgtgcagaccgtcgacgcttctcttttgccgagtgagtga

SEQ ID NO: 1419 - DNA, 330 bp, Glycine max
  Peptide Sequence Number=SeqID_118197
atgtccattcttcctggcctcaacagtgctgggtctagcctctccttgtggttggtggtgaatatgatgattctctcgtctccacaactagaccatagcccatctatgaagttcagtaatccagacaaggtcaactgcatccgtccatcagatgcacggagctttacacggaagatcgtcctatttggcatccactatccaatgacatttaacagcgaccttcgaaccacagaaaacaacaaacaagaggaaaacaacaatcaaatgtctgaaatattgcgtggattgatggtgaaatgccttttgggatctttggaagtggcgttatga

SEQ ID NO: 1420 - DNA, 477 bp, Glycine max
  Peptide Sequence Number=SeqID_118198
atgatcaaagacagaaaaattgccagccacacagtcttcctggtcggcaagcccagcaccggcaagaccgccattgccatgggcatggccaagtccctcgagctcgaaacccctttcaccatgatcaccgctagcgaaatcttctccctcgagatgtggaaaaccaaagccctcacccaggctttccacaaggccatcaacatcggtatcaaggaagaaaccaaagtcgtcgaggttcagatcgaccatcccgcagtggctgatgccatcgtgaagaccgggaagctaatgttgaagtcgacctggatggagacatatcaaatgtcttgcttcaaaggaaagagagtacatattctagggatgcggagaaaactttccattttagttttctgtgcactcccaccggctcctaaatcggcaacaatgcttaagctcggaagtggaagctatggaaaccccttgagctccacttgttag

SEQ ID NO: 1421 - DNA, 282 bp, Glycine max
  Peptide Sequence Number=SeqID_118199
atgggaaaagataatccagaatttagtgtggatgatcagaaggttacatttgatttgtttgatgcagcaaagcactcaattgaccggaatgtctactccaaggggttggcaaaagtttctttggagcaatggatgaggaaagaacttagaaaaaaatttagtcatccactcgctcagcgcgttatgtgcgctaagcgccccaacccccacccattggctgaaggggtcttgctaagtgagacaattgcagtaatcccaaaaacctctatggattgcatttaa

SEQ ID NO: 1422 - DNA, 642 bp, Glycine max
  Peptide Sequence Number=SeqID_118200
atggctgaatgttactcatcacttgcctatattgaaagtcgagacgtgctatatgaaatatgtgggccaaaagaagataaggttcaagtagttgatgactcgctaagtgaggcagatccgctaagcgagtgtcattcgctaatcgaggaatacaactcacttagctgtggaagcaatgacttccaagattattttgatgatgccaaagaatcaagagttaagcaagttccaaagaatcaggcttcaagaatcaagtctcaaagaatcaagattcaagaacaattaagtttcaagattcaagaacaatcaagatcaagattcaagattcaagagaagttgatttcaagattcaagagaagaaatcgagaagcaatagtcaagacttcacaagggaaacatgaagagtctataaaaggtacatcctttgtggtacaagtagagggtacatctacttgggttgttatactgagaacaagagagggtatatctcattgtggatcagttcaagaggagggtacatccacttggttgttcaaagagaacaagggagggtacatcccttgtggatctttggcttgtaaaggattttacaaggttgaaagaaatctcaagaaccgttggttgcttggggactggatgtag

SEQ ID NO: 1423 - DNA, 318 bp, Glycine max
  Peptide Sequence Number=SeqID_118201
atggggatcgcacccgcaaagacacccaatggacctgaagaagtccaacagggccctggggtttccagctctggttacgggcctctggattgtgcccgcaagacacctagtggacccgaagaaggccaacagggtcttggagttgccagctctaaatacgggtctctgtcagttctacggagtgcccgtcgccccaacaagcgggcaatagacgcaccgccaccacctttagagttcacccctgctcatccacaaaaaggtttgagtattgcctacaccacatggctgaccaataggcgaccaagtccaaagccaaag

SEQ ID NO: 1424 - DNA, 444 bp, Glycine max
  Peptide Sequence Number=SeqID_118202
atgtggcagggcattatggcggagacaaaacaacagctaaggtcttacagaaatgaatacatattggtagccgtggattatgtgtctaaatgggtggaagctatggccacttcaagaaatgacgctaagactgtggtgaagtttatcaagacgaatatttttgctcgatttggggtacctcaaatcttaataagtgatggtggttcacatttttgtaatactgagcctcgcctcggatacgcccctgaggggcaagcagttagtggtgtacccctgccaaacactttggagggtcctcaattttgcccacaaccccaacccttgcatgttgtggcgggaagaatccctcatgctatggcaaagaagggaaagttggatcatatagaggaatggctcagggccattgaaggaggcagagatcatgcttttgctgacatggcatag

SEQ ID NO: 1425 - DNA, 474 bp, Glycine max
  Peptide Sequence Number=SeqID_118203
atgaccatcacaccccctcgtgcaaaagggattgtgattgggtcttccaagaaaagaagctctatgaaagttgagaagtctgggaagaagaagcaaagaactgagtatcaaaccccttctttgtttcaagacatgaagtttaaagataagtttgatgttggatggttcaacaagcaagttgtaaatggaaggtatattgaccttttagacatcaaagaatgtgaacaccttttggcagacattatgagggttcctaaggacagttcaaggctgtatgaagattggcttgagggcaagggacttagaaagacaaaagttcaaaagaagtttctggagaacaagagagatgacttcaaatccaaatctctaaaatcttttggaaggattatccattggatgtgcatgcactatgtgctgcccaaagttggtacctttcaagaagtaaataactatgatcttctagtcatttactga

SEQ ID NO: 1426 - DNA, 180 bp, Glycine max
  Peptide Sequence Number=SeqID_118204
atgaagaaagttagggaagaagcattgactatcgagctgaagaaaaatctgtcatactcactatgctttaagctagccactacatttgtcacctgtatggcagcatggctcctgcttcagtcgcaacgaccactgtcccttgccagcgtgaggagcaccaccacaaggtcttcaagctaa

SEQ ID NO: 1427 - DNA, 447 bp, Glycine max
  Peptide Sequence Number=SeqID_118205
atgtgccttagagacattaggcataacaaattcgagaattccttaataggaatagtagaaacaagcctaggacaaggtccgatttatttcaattgctatccaaacaaaacagtgagtctgatggacagaaacatacttgactctctgttcttaaacatccactttcatgggcttgacatgaaagaaggatcaattccagcagcattaatctataggattcagtacaaggtcatgaatacttgtgcttcaagagtccttctaaaaccacaaaaaagagagacaaccttgtttatcaccgatatgacaaaggccaatgtttttctcccaagaaccataaaatgggatgaagtaactcttcccgaaaaatgggtcattgacaaggtcacaccgtcagttccccgacctgctccaaccatagaacaaatcaagcaagataactccggtaag

SEQ ID NO: 1428 - DNA, 2232 bp, Glycine max
  Peptide Sequence Number=SeqID_118206
atgtcggtattggactggtgtttggagcttacattccgagaaagaagcaatgtgtggagacgcatcacgcatgtggtgacaattggcattggggtggtgggaggtgggttgtcaacgaacaacgctcttggttgtgggacacaggagcaaaaggatgcgacagtgatgaaggctgatactggtttcacataccctgttagaactcaatttttggaggatattctggaaatgtcgggctacagattgactcctgacaatcaaattgatgactatggtcaagaaaggatttggaaaatgaacaaacaggccccaagaaagaggaaaagccaaattgcttcttctgtagaggatgcattacgagcggctgatttaagtgattatagtctgcaaacaagggagtctttgtcttgttggtatcctgactgtattggttttaacctcattcaatatatcttgtgcaatatatgcgagcatgaaagaccaggtgctattttggtttttatgattggatgggatgatataaatgctctgaaggagaagctcctaactcatcctgtcttgagtgatcctagccgagttttattgctgatgtgccatagctcaatggacagtttggagcagagaagaggaagagctggtcgtgttcaaccaggagaatgttatcatctctatcctagatgtgtatatgattcttttgcagagcatcaattacctgaaattttgaggatgcccttgcaatctctctgtctgcaaataaaaagtttgaaactaggaagtatatctgagttcttgtctagggctttgcagtcacccgagatacttgcggtgcaaaaagcaattgaatatttaaaaacaattggagctttggatgagaatgagaatctgactattctagggcacaacttgacaatgcttcccatggaacccaaacttggcaagatgcttatatttggtgttatcttcaattgcctggatcccatattaactattgttgctggccttagtgttagagatccttttctaacacctttggataaaaaagatgcagcaaagtctcaattttcccaagattacagtgaccatcttgccattgtgagggcctatgagggatggaaggatgctgaaaaagaccttaatggacatgaatattgctggaaaaattttctttctgctcaatccatgagagttattgatgctcttcgaatggaattcttatccctgctcaaagatattgggttagttgatagcaatacgagcagctgcaatgcttggagctatgatatgtatctcatacgagcagctgtttgctatggcctatatcctggaatttgctcggttgtgcataaggatacgtcattttctctaaaaacaatggaggatggccaagtgctcctacattcgaattcagtgaatgctcgggaaactagaattccatatccatgggtagtttttaatgagaagataaaagtgaactctgtatttcttcgtgactcaacagctgtgcctgattcagtggtgcttcttttgggtggaagcatctcaaaaggagatacggatggtcacttgaaaatgtcaggaggatatttggagttttttatgaaacctgctgttgctaacatgtaccagagtataaggaaagaacttgacaaccttattcggagtaaattgcataatttcctgatgcaacttattaggaaaaacccaagtctcacattggctagaaatagtgtcaagatagagtatataagtgaagggaaactttcatcctatgagttagcttttggggttgagttagtccaaaatccacattctaagatgatatcagagtctatcctagatccattcaaagggccatgcaccaagcccaaaagtgctggacgtgaagggctccttaaaccatcaatgatggcattgcaacaagcatcggtttcaagaacagacagtggacccgggggtgataattctaaaagtcagcttcaaacgttgctcacacgagctggatatggtgcacccttctacagcactaagcaattgaagaataatcagtttcaggctaccgttgagtttaatggagtgcagataatgggccaaccctatatcaacaagaagaatgcagaaaaagatgctgcggctgaggcacttcagtggcttatgggtagaagagaaacagggaatgaggatatcaatcacatgacaatgttgctgaagaaaagtaagaaagatcataattga

SEQ ID NO: 1429 - DNA, 405 bp, Glycine max
  Peptide Sequence Number=SeqID_118207
atggactgcatagtgcccagcccaaaatcgcaaaccaaacagtacttaaagaagggtaaacagaacgagctccaattgtgtgtccgcatggatgctccgtttgaggcaaaactctcaggttatgctcgcacaagaggagcgactcctgcagtagaagtgcagcccaagacggtgcagatcggtggacgacgatgctggtggtgggttcacctgctggaaacgtccccagagctccatcgacggacagcggctgccggaaaagggggaaaattgctggaaaggaggcagcaagcagaaaggtcaactggaatgcagaaaaatgtcattggaaagcgccgaaataagtgcaacagccagaaaggtccaccagaaataggaagaagactgatagaagaaaggcagtga

SEQ ID NO: 1430 - DNA, 336 bp, Glycine max
  Peptide Sequence Number=SeqID_118208
atgaacttctctccccgaaaaagtgccctgcgtggggtcgctaaagcggtgtgttgtgttggttgcgcacatggacggcatggcgttcttgaaaggtcactgatgcagaccaacaagaggacggtgcactggctaccaaacaggcccaacagtgggtgcgggtacagttcacctataaagaaagttgtgcatagatgtgtctatgcgaggaacattggtgaacgccatagtggaagcggggtgaacgtcataggggaagaagattctgaaggaggggtacaaaaagggagggagacagctgtttacacttacacaatacagctgtctcctcaataa

SEQ ID NO: 1431 - DNA, 333 bp, Glycine max
  Peptide Sequence Number=SeqID_118209
tattggccatcatacaacacttcatcgaaacaactttacccagcccaattcaaggtcaaatcgtgttggcctgacacagaatgtgtagacaggggagaactagtagattccagcaggattcagttgaatgcaaagcccaacgaaagtattttggaagaagatgcaaattggaatgaagaaggggggtactactgcataggtagaatttggggaaacagtaacataaaatatgttatcagtcagttcctttcaaacatgaggacaaggttgacttttaggaggagtggtattgttaggaatgtggaaaagggaggagttagtaaggatagttag

SEQ ID NO: 1432 - DNA, 291 bp, Glycine max
  Peptide Sequence Number=SeqID_118210
atggaaagggaagctcggggctttgcttgcacttgcatgtcctctcgccttccatttctcgccatgaattctcaccgtcccgttcaggttgctgctgctgacaacggggttaatcgtgatgttgaatttggggcttcttcactaccattactactgtcagtgtgccactgtgcctttttttctctttcttttctacctaaaagattttcttttgtaagtttcgtttctgctgctgtatccgaagctgtatcagtgtctggttgtaacaccaacaacgtttggcacaagtag

SEQ ID NO: 1433 - DNA, 657 bp, Glycine max
  Peptide Sequence Number=SeqID_118211
atgcccgccgcgtcgaaaaccggcgcggcccagcccagtgacgccgaggaagggccgccccgcaccgaggctgtcgtccccctcccgcgcagcgagagagggggaaggcgcgaagcgactcagggggagcttcattcaggccggttcgcccatcttgctttgcaggtagttgggcaggccgatcttctcgatcaggcccagttgcttctccagccagtaggcgtggtcttcttcggtgtcgcgcagctgggccagcagcaggtcgcggctgttgtagtcgccgtggcgctcgcacagggccatggccgagcgcaggctgtcacgcacgcggtattcggtggccaggtccttgcgcagcatctcttcgacggtctcgccgggcgtgaactcgtgcgggcgcatgtcggggcggccgcccaggaacaggatgcggcgcaggatggcgtcggcgtgctgggtttcctcttccatctcatggccgatgcgctcgaacaggcgcagcaggccctggtcctcgtactggcgcgagtggatgaagtactggtcgcgtgcggaaagttcgccgcgcagcagctctatgaggcattcgatgacttctggctggccttgcatgttcttcttctcctgactgtgttgaacaccgcaagtatcgcgtga

SEQ ID NO: 1434 - DNA, 447 bp, Glycine max
  Peptide Sequence Number=SeqID_118212
atgaatatctatcatgaagcgcgcggcgaaccggtaaagggacagattgccgtcggcactgtcaccatgaaccgggctaactgggacgtcaaagagatctgtccggtggtgtacgcacccaaacagttctcctggacgtctctgcacaaacatccccatcgccatccgccgcagcatgacaaaagctggcagcgcgcgcagcgcctggcccagcggattgtcgaggccgttaatcataaaaaaaggccggatgcatcacatccggccttatttatttcacgtcggcttagctggcctgacgggtttcatgctggcggcgccaggccaccaggtcttcaatggtcaccaccggcatggcgtgctgcttcgcaaacgcaatcacttccggcgcgtgcgccatgctgccgtcatcattggtcaattcgcacagcacacccgcaggtttga

SEQ ID NO: 1435 - DNA, 345 bp, Glycine max
  Peptide Sequence Number=SeqID_118213
atgaagatcgtaaaggggtataccaagaatctacaccgtccggaagcatctattgttgaaaggcttcccaagggtcaacatgacgaaagagtaggaggtaagggttcaagactgcatgttatcactcaaagtgtagaagatttgcaacaagctcatttgtatgtgttgaataacagtaatgaagttttgtcatacatactttaccatgaaggtttagtgaaggagagtaatccaaaaatgacgaagaacagagtcatgaaagagcataacaagactttcctagattggtttaaagatacaatctttgctgatgagcctaaaagaaatgttgtaacttggaaatga

SEQ ID NO: 1436 - DNA, 417 bp, Glycine max
  Peptide Sequence Number=SeqID_118214
atgaccgaccctctcgatgagtcgatctcttgctttctcataagggtgaacccttgggtactagtaccctcacctccagaggactactcgtcctcgctgtcaaagggtcatgtaccctcgccttcagaggactacacgtcctcacctccagaggactacacatcctcgccttcagagggccgcacgccctcgccttcagaggactacacgtcttcgccttcagaggacttcgcgtcctcacctttagagggctacacgtcctcaccttcagagcactacacgtcctcgccttcaaagggtcatgtaccttcaccttcagaggactacacgtcctcgccttcaaagggtcatgtaccttcaacttcagaggactacacgtcctcgctgtcaaagggtcatgtaccttcacctttgtag

SEQ ID NO: 1437 - DNA, 399 bp, Glycine max
  Peptide Sequence Number=SeqID_118215
atggccaacattgagatcaaacccagcagtggtaccgaggtggaaaccggacgtgatgtggcgctggccgcacgaacgctgtggcagggacaaacggcaccgctgctgtcctcgttctcgtacgcggcgctggaagcggcgatgcaggccgcgccggagctgccgcgcggcctgctgctggatgagtggcacgacgactggcaggcgctgaccgccgcgctcgactgcgtctccatccatttaaatcatcgcttgctggacgtcggacgcaccgccgcgcttaaagccgccggtctgcgtattctgcatgttcgccatgccgctcagcggcatcagtgccgcgataacaatcagccattttttcatggtgttcctccatcagtgcggcctgctgtgtga

SEQ ID NO: 1438 - DNA, 267 bp, Glycine max
  Peptide Sequence Number=SeqID_118216
atggagtcaggtgacatgcgggggtaccgtatggttatccgcacctttcgtcaaccaggggcaaacgagcccgttgacgcgcagagactaacatcatcttctgcaccttttgtcatcctgacccatggattcaggtttactctagtcgtctggagacattcaagcccaatgacgcacgagattcttctatgctgggcagggacgatcaagttcgatggcgtggggaagtgtcgtggttgtcccactttatcgctttcaagacactga

SEQ ID NO: 1439 - DNA, 855 bp, Glycine max
  Peptide Sequence Number=SeqID_118217
atggatacgttcgcgcgtggtctggctgggcacgcgccagccaccgcgcggattattgcagctggcgaatatgctgcgcgcgcaggcggcgcgcagcggctgttatcagagtccgcagccatttcatccgcatatcacgctgctgcgcgatgccggacgcacacgctatacgccgctacagcgctggacgctgggcgacacgatgaaggaatcctgatgaagtttagccctgcactccagcccgccacgctgatccaacgctacaaacgcttcatcgccgacgtggtgacacctgaggggaaaacgctcactctgcactgccccaacaccggagccatgaccggttgcgccacgccgggtgacacggtctgtggggcatttatttgcgttaataccctgcgcgccaatcagctggttaaggaagcgctgacccatggcactattcccgaactggtgggttatggtacgcataaaagtgaagtgaaatatggcgatgaaagcagcagaattgacttcatgttacaggcggaagacaggccggagtgctatattgaagtaaaatcagtgacgttagcggaacaggaaaatggctacttcccggatgcggtaacgctacgtggacagaagcatctgcgagagctaatgagtgttgcggcggcgggcaaacgcgccgtgttgctgtttgcggtattgcattcagccattgaacggttctcccctgcccgccatattgatcctaaatacgcgcaattgttgaatgaggcacaaaagcagggggtagaggttttagcttataaagcggaactttctgccgataatatgactctgagatcctctcttcccattgtcttataa

SEQ ID NO: 1440 - DNA, 1000 bp, Glycine max
  Peptide Sequence Number=SeqID_118218
atgagtgatggggagaccttggtgtcaaaaggtggaaagtttgaatttggttttttcagtccaggcaatcttgttctcaccaaaaatgagtctctagtttggtacaccaacaactctcacaaccaagcacagaatccagtggcggagctcttggacagtggcaatcttgtcataagaaatgatggagaaacaaacccagaagcgtatttgtggcaaagttttgactatccatctgatacattcctgccaggaatgaagttgggatggaatctccgaatcggtcatgaatggaaacaaacagcatggaagagtccagatgatccatcaccaggagatgtttatcgcgttttagaactctataactatcctgagttttatgtaatgaaaggaacaaaaaaggcataccggtttggaccttggaatggcctatattttagtggattgtctgactttgagaatggcaccatgtatagcttttgttatgtcagcaataaacatgagatttccttcacatatagcattgcaaatgattctttcatcgccagatctgtcgcaaatcaaacagcaattacaatttatcgctatatgtgggtggtaggagaacaagattggaagatgtctagatccttcccacaagagttttgtgacacttatagcctctgtggagcttacgggaattgcgtaagcagtactcaacgtcaagcctgccaatgtttaaaaggtttcagtccaaagtcaccagaagcatggaactcatcggattggagtggaggatgtctcaaagttccggatactacacatacttggtgggatgagagtattggtctagaggaatgcagagtgaagtgtttgaatagttgttcttgtatggcctattctaattcagatataagaggtgaaggtagtggctgtgtcatgtggtttggagatctaattgatatgaaacagcttcaaactggtaagcaggatctatatatcaggatggctgcttcagagctag

SEQ ID NO: 1441 - DNA, 721 bp, Glycine max
  Peptide Sequence Number=SeqID_118219
ggctcggagatcgtcgccttcgatgtagattcccgcttcgtttcgccggagcagtcggagcggcgttttcgccatgccgccgccagtgtgaagccggcgcgcctcatacactagacgatcgattccacgctgcgcggcaatctgggaccggaaacgcgcggggcgctgtcgggcagcgggcgccgtcgcgccatcgtcgcgccggccttcccggatgccggccgcaccacggtgggcggccggcaatacgtcgacggcgtcgcgctggagcagaccgcttttgcgcgcgatccgaagaacccgatcgtcaccggctacgtcatggagcgcatggcggggctggagccgacgcgttttcagccagcaaagtgctggtggcgattggcagcctgcatccggcgaatgacgcccagctggcaagcctgcggcaggcgggtgcggtgctggttacgctgcctgaagcggccgatcccgaggcggtagcgcaagaggtgcgaacggcgtttgcgcgcgccgatgtggtttgcctgatgtcgccccggtcgcgagcggccacggcggatcatgccgctgcgctgggcgcggtcgtcagccgttgcacgccagccttcgatgggctggtggcgaccggcggcgataccgcgcggcgtatcgtcgacgccatggcggctggctcattgacgctgttcggcgaggtggaacccggcgtgcctttcgggtt

SEQ ID NO: 1442 - DNA, 216 bp, Glycine max
  Peptide Sequence Number=SeqID_118220
atgtctttcttttttgtcttcttgacagagaggttctatcaattctctaaatggttgacaaaaaactttgaacccgtggtgttgcacattgctgcggtagaggaggacaaggaatggaaccatgaggccgataatgtaggcgttcatatcgctgatccaacgatcgcagaacaattcggaggaaatgtggtgttgttttggtggctactacaatga

SEQ ID NO: 1443 - DNA, 369 bp, Glycine max
  Peptide Sequence Number=SeqID_118221
atgcccctctatgccaaatttttgaaggatacgctaactaagaagaaccggtacatccttagtgacagaattgttatggaaggtaattgtagtgttgtgattcaatgcattcttccaatcaagcacaaagatcctggagttgtcacgatatcgtgttctttgcgacttggagagatagagataatgcctacatgcttgaccctccagttagctgaccgctccatcacaaggccatatggagtcattgaagatgtctcggtgaaggttaaacaccttatattcccatctgatttcgttgtcatggacatagaagaggatgttgacattcctctcattcttggccaaccattcatctctactgcaagctga

SEQ ID NO: 1444 - DNA, 372 bp, Glycine max
  Peptide Sequence Number=SeqID_118222
atgtcagttatagacattgaacatgacatcaatatcctcatcgtcactaataatagcaacctagtaattgaacatgccagacctagcagaaatggggcattgaaggtcatgcctgatgtaagctccattggagcttgtaggcctaggatcttcttcatcaatggattcctttgcttcttggaagatgaatggcaacgaaatggagaaggaagagggagacgccacttcaaggagaagatgagtctagaagaaattcaccaccataggaggccatggataagagcttggaggaagaaggagatgaatgaagggagaggaagagaagagcacgaaattttgtgctctaaaagaactctgaaatatgaagtttaa

SEQ ID NO: 1445 - DNA, 681 bp, Glycine max
  Peptide Sequence Number=SeqID_118223
atggcgcgtaaaaagaaagaagaggctcaacagacccgacagcagctgattgaggcggctatcggacagtttgcaacacgtggcgtagccaatacgacgctgacggatatcgcggatgccgccagggtgacgcgcggtgcgatctactggcacttcaccagtaaatctgaaatttttaatgccatctgggaacagcaattaccgcttcgcgacattattcgcgaccggctttccctttccgaaaatgacgatccgttgttaatgcttcgtgagcagtttattacagcattgcagtatattgcccatgagcctcggcaatgtgcgcttttacaaattctgtatcataagtgtgaatttagcagcgatatgatttcagaaagtgaaatcagaaagcgtattgggttcaatgatgacgcgttacgtgtcacgctggagggctgtatttcgcgggggattatttcacccaggatgaatgtggacctcaccttgatcgtatttcacggtttttttagcggaatcattaaaaactggttaatgaataacgacagttttaatctctaccagcaggcgcccgccctcgtcgatagcattctggcgacactcccgatcgttcgcgtatcgcctcatgatgattacagctccgcgccaggccggcaagcgcttgagatagagcaggcttga

SEQ ID NO: 1446 - DNA, 204 bp, Glycine max
  Peptide Sequence Number=SeqID_118224
atggtcatggacatggctgacacatttggagaagattttggtattcatttcaaccaatggtcatccaatattagagcaggatttaatcatatatttttctattctataatcactcccgattgttggaatggtgaaggagttgcattaatgcagaaatttccacagaatcatcagtgtcaagattgcagttcttcagcactttaa

SEQ ID NO: 1447 - DNA, 768 bp, Glycine max
  Peptide Sequence Number=SeqID_118225
atgttctataccctacatatagagaagcatgctttgcaatgggttttttgcaagatgacagagaatttgtggaagcaatcaaagaagctaaggactagggtgtcattactaaacctgaagaactttggaatcagacatggaattgaattacacattgatgataagcaacttaaaaatttaacattactggaaattgaaaaacttctgcatccaaaccaaaaatcactcaaagactatcctacaatgccatatcctgagggtggaaatcctgcatcatgtctagagaatagcttgatattgtctgaacttaattacaacaatgatcaggctagatcagaattcaaaaatctttttctatcgatgacagacgaacaaaaacaaatttatcacaaaattatggaagctgtcaacaacaatgaaggtgacatgttttttctatatggatatggaggtacaggaaaaacatacatatggagaacattagcaagttcactgagggcaaaaaatcaaattgtgattatggttgcttctagcggcatagcttctttgttattgccaggaggcagaactgctcattccaaatttaagatacctgtgccaatttttgaagactcaacatgcaatatacttcaaggaagtcagctagcagaattgttaaatcagacaaatctgataatttgggatgaagcacccatggcacacaaattttgctttgaagcacttgatcaaactttaagagacattattaaagaaaaaaaatcccaataa

SEQ ID NO: 1448 - DNA, 198 bp, Glycine max
  Peptide Sequence Number=SeqID_118226
atgaagaagaacgcactggtggcgaagatcaacaaggtacaacatggatcaaacaatttttatggcttatcttttgaggtaggagaggaagatgtcaggaggcttagtcaggcagttgtagcagcggtgtggagctgtgatgcggccaaaagtcctgcccccgatggcttttctttggaaattttcaagtcctgctag

SEQ ID NO: 1449 - DNA, 405 bp, Glycine max
  Peptide Sequence Number=SeqID_118227
atggccttgttgagaaaaaaggtatgctggattaaatgggacatggtttgcaaatccaagaaggatggtggcttaggtgttaaagaactggagatgttcaatgatagtcttttatcaaattggaggtggagattgcttcaagatgaagagtcaatgtggagcagatttttatccttcagatatggaaatgttcacatgcttccattaaagctacaaaatagatctaccagttcaatttggtggcatgatttagttggattgggtgcaaccaagatgcagcaagagggctggttaaaagaagtgatagtgaagcgagttggagaggaaactaggactcttttctggtctgaatctagaaggggaatagcagcatcaaggattcatatcctagactattccaagtag

SEQ ID NO: 1450 - DNA, 479 bp, Glycine max
  Peptide Sequence Number=SeqID_118228
catcgggggtgttatgtgatgcaaaggtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtaaaccagatggagagaaggcaaacaattcgaggcagaggaagacccaaaaagactataagagaggttatcaaaaaggatctcgaacttaatgatttggatagaagtatgggatttgaggaggatgtttggacatggtcgagaatggaatggtctctactaccttga

SEQ ID NO: 1451 - DNA, 147 bp, Glycine max
  Peptide Sequence Number=SeqID_118229
atgtcaactgttcagaggcaaatgatgcacaagccgttcattaaagaaattgccacttggcggagagagggtgacacctttggatcagacccattggggatgacacttggggaaatagaagattacaaattattcatgattgattga

SEQ ID NO: 1452 - DNA, 579 bp, Glycine max
  Peptide Sequence Number=SeqID_118230
atgacagcccgcgaaggcgcggcgtgcgttgtgccgggccttcgcggtgaaagcgcgttgtcggttaccgatcggcgaagcccgcaatgccggccaagacggccaggagggcaagggatcctgaggagtggtgaactgacgctattctatgcagcggcaaaggcggctgatataggtattactccgaaagcgccgctaccactcatagcccaactgaatgttgtaatcgggatcctgattggtggaataaggatcggactggcggcggcgatcggttttcttcaccgggccttcatacgcgggataaggtttggcgcgcggtttgctgcagccaggatgatcgcactcgatatcgacgcgaaaaccgcttttatctctcgcctctgcccaggcaatcggcgcgcgcccaacggggcgctgcaagcggcaaaggccagcagaatggcactggcggccggcaatgcaactataaaacagcagaacgagaattactatcatttgccttgggcgttacgggcgagccaggcggcgattccatcggcagacggggtcaaatcctgtgcgtttagccgagattag

SEQ ID NO: 1453 - DNA, 156 bp, Glycine max
  Peptide Sequence Number=SeqID_118231
gagcagctagaatgcctgaagcgggaggagcgaacgaagtgagaactagatcgagagtccagttttcagtgacttcaaggagcaaagccataggaaataaggcaactctcttgacagaggggcatagcgggtactctaaccataaggagaaggaag

SEQ ID NO: 1454 - DNA, 216 bp, Glycine max
  Peptide Sequence Number=SeqID_118232
atgaggattctttcatgggccaaggttcaaagtagctcaaggttgtgtcccaacatggtcttttcatcgtgcgagcccgattttgatatctggggcaaaacaaattcgtgtgtcaaggtgtcggtctcgggtcgaatttccatatcatttccacgaggcacgcgtaacaatgatgatttggaaacaacgtgcaaaattagtcatggctacagctag

SEQ ID NO: 1455 - DNA, 306 bp, Glycine max
  Peptide Sequence Number=SeqID_118233
atgtcattgcctggcgctgttcatgcatcctccaccaacgagtctggagccccgcgaagttattgcgtagcgcttttcaccaattctccattctccacttttttacggagccccatgaatgtcattgcctggcgctgttcatgcatcctccacctacgagtctggaaccccgcgaagttattgcgtagcgctcttcgccaattctccgttctccactttttaacggagccccatgaatgtcattgcctgtcactgttcatgcatcctccaccaacgactctggagccccgcgaagttattgcgtag

SEQ ID NO: 1456 - DNA, 795 bp, Glycine max
  Peptide Sequence Number=SeqID_118234
atgagtcttgacaatgcactgatagcagctttggttgagcggtggagagaaacaaattccttccacttagctgttggagaattgacaataacccttgaagatgtatcactattacttggattggctattgatggagaacctgtgataggtccaataagtgcaccaagttcagtttgtgaaaaattattagggagagtacctgaggacctgaatggtggaatggtgaagcttacttggctgaaggagttcttctctgagtgtcctgaagatgcatcacaggaggaaattgagcgatgtacttgtgctttccttttatacctagtaggcagtacaatattttctacaacaacagggaacaaagtccctgttatttacctttctttgtttgaagactttgacaaggctgggaagtttgcttggggtccaggagcattagcatttttatatagagcacttggcaatgcttctcttaaatctcaaagcactattagtggctgtttaactctagtacaggtccagtggctaccttacaatgacatggactgttcatccataccagaagatataaaagctagtctgattttatgggaatctaggactatgctattgtgtttcgacaaagtggaaaggcatcttcccgatcgttgcttaaggcaatttggcatgcatcaaactatcccaaaatacgtggaacgatgggagaggaagagttgtatagtggatcacggggtagacttgatggaaaaaatggagtttggctctcagagtggtcagaaccttgggttatgttgttga

SEQ ID NO: 1457 - DNA, 1353 bp, Glycine max
  Peptide Sequence Number=SeqID_118235
atgagatatggaggactttatcatgtgttctatcaatacaatcctagaggtgcaacttggggaaatattgtgtgggcacattcagtgtcaaaggatcttgtgaactggaccccactagatcctgccctatttccatctcaaccgtccgatataaatggttgttggtcaggatcagccacactacttcctgggaacaaaccagccattttgtacactggaattgactccatgaatcgccaagtccaaaatttggcccaacccaaaaatttgtctgacccatttcttagggaatgggttaaatcacccaaaaatcctctaatggaaccaactagtgctaacaacattgattcaagttcattcagagaccctaccactgcttggctaggcaaagatgggcaatggagagtacttgttggaagcctaagagaaactagtggaacggcacttttgtacaagagcaaagattttgttgattgggttcaagctgaacaacctttacattcaacccttggaagtggaatgtgggagtgccctgatttttttccggttttgagtaatggccaattgggtgttgacacatcattgaatggtgaccatgttaggcatgtgctcaaggctagcttgagtgctaaacaacatgattactatatgattgggagttacaatgctaccaaagatgtgtttatcccggataacgggactaatcaatttgttttaagttatgattatggaaaatactatgcctcaaaaacgttctttgatgatggaaagaagagaaggattttgttagcatgggtcagtgaatcatcaagtagtgccgatgataagaagaaaggatggtctggaatttatacaattccaaggactatatggctgcacaagtctggtaaacagttggtacagtggccagtggtggaaattgaaaagctacgtgcatacccagtcaacttgcccccacaagtgctaaaaggaggccaattgcttcatattaatggtgtcacagcaacacaggctgatattgaaatttcatttaaagtgaataagttgaaaaaggctgaagtatttccaaattctgtgtcttccttaaacaaagacaatgatttggccacttatggaacttttgtggacgtggaccctcttcatgagaagctgtcgttgagaaccttgattgatcattctgtggtggagagttttggaggagaaggaagggcttgcatcacagcccgagtttatcccacattggcaatcaatgataaagcacaaatatatgctttcaataatggaacagttgatgtcaagatcacaaaactgaatgcttggagcatgaagaaagctcaaataaatcgaaactaa

SEQ ID NO: 1458 - DNA, 213 bp, Glycine max
  Peptide Sequence Number=SeqID_118236
atgagggaaattgcaaatattgctgatatagtctcagcagaagggttggattcttataatagagagttgcttgatgaagtgataaacattgtgcacaaatgtttaacagggcagtttgaagaaattccaaatgagaaagtgaaaaagaagggtaaacggaaaggcatttattggatccacccccatgttgctgatgtatggcctggtttttaa

SEQ ID NO: 1459 - DNA, 309 bp, Glycine max
  Peptide Sequence Number=SeqID_118237
atggagcctaactcttatgatatacaaatgcatgacaggtcttccttaaacaaagacaatgatttaacctcttatggaacttttgtggacgtggaccctcttcatgacaagctatcattgagaaccttgattgatcattctgtcgtggagagttttggaggagaaggaagggcttgcatcacagcaagagtttatcccacgttggcaatcaatgataaagcacaactatatgctttcaataatggaactgctgatgtcaagatcacaagattgagtgcttggagcatgaagaaagcacaaatacattga

SEQ ID NO: 1460 - DNA, 1191 bp, Glycine max
  Peptide Sequence Number=SeqID_118238
atgactatgtctactatttggcttttgactctcttttctgtcatttatggcagtgcagctactcatcacatttatagaaatcttcagagtgtatcttctgattcctccaaccaaccttacagaactgcttatcacttccaacctcccaataattggataaatggaccattgagatatggaggactctatcacctgttctatcaatacaatcctaaaggtgcagtttggggaaatattgtgtgggcacattcagtttcaagggatcttgtgaattggaccccactagatcctgccatctttccatctcaatcgtccgatataaatggttgttggtcaggatcagccacactacttcccgggaacaaaccagccattttgtatactggaattgactcattgaatcagcaagttcaaaactttgcccaaccaaaaaatttgtctgacccatttcttagggaatgggttaagtcccccaaaaatcccctaatggcaccaactagtgctaacaagatcaattcaagttcatttagggaccccaccactgcttggctaggcaaagatgggcattggagggtacttgttggaagcaaaagaagaactaggggaatggcaatcttgtataggagcaaagactttgttaaatgggttcaagccaaacaccctttgcattcaaccctaggaagtggcatgtgggagtgtcctgattttttccctgttttgagtaatggccaattgggtgttgacacgtcggtgaacggtgaatatgttaggcacgtgctcaaggttagcttagatgacaaaaaacatgattactatatgattgggagttacaatgctgccaaggatgcatttatcccagatgaagagtctaatatatttgttttaagatatgattatggaaaatactatgcctcaaaaactttctttgatgatgggaagaagagaaggattttgctagggtgggtcaatgaatcctctagtgttgctgatgatatcaagaaaggatggtctggaatccatacaattccaagggctatatggcttcataagtctggtagacagttggtacagtggccagtggaagaagttgaaaagctacgtgcatacccagtcaacttgctaccccaagtgctaaaaggaggcaagttgcttccaattaatggtgtcacagcatcacaggagttcagataa

SEQ ID NO: 1461 - DNA, 477 bp, Glycine max
  Peptide Sequence Number=SeqID_118239
atggtggttgcatccattcgtcttcttccttctccattcctctctttcgcgcctcgtttctctccatattcatattcatggcgctgccgtccctcttccaccattcccttttcttccatccactccaaagcttctactaagggagatggtggagtagtggaatttggtggtgatcaaacagagcttatatttttggggactggaaccagtgaaggggttccacgtgtcagctgcttgactaatcctttacacaaatgtgaggtgtgttcaaaagctgctcaaccgggtaataagaataggagacttaacacaagcatcctcattcgtcaccccggttcctcaggaacacacaataatattcttatagatgctggaaaaagaagcctaaaattgatccatttggagttgaaggatactccattgttttttatcacgatttttctatcacagtgctctccggtggtttcctgcttttgg

SEQ ID NO: 1462 - DNA, 510 bp, Glycine max
  Peptide Sequence Number=SeqID_118240
atgacatgtgactctcgaactcgtgcatcgtctctctcactcacgcatcttctgtcacagggaggaaaccctgagccccaatcccgcgaaggtggaggagaagatggaagcggaaatgggaatggaaaggacgccgcaaagaagaataaccatcatcctcgcccggagaatgtcatgctccttcgccgcgccgccacctcctctgccagagctccgctgtttgagctaccgattatgaatcctgcgcagtacgagagtgagagtgagaccatttttggtgctcttaatctgaacctgcaactcttttgtaatgaagttctcaatattgtcgacgggacgcatccacaatcgaagctcaacatcaaagccacccaaaggtcccaggatctgaaaaagctttacctaacttatcactgttacaatgtcttaaacattgttgcggaggagaagatggtaccgtttgactatggtcccttggctcaagtgacaaatgaggacatcgtgctttga

SEQ ID NO: 1463 - DNA, 156 bp, Glycine max
  Peptide Sequence Number=SeqID_118241
atggtggttcctagggcatctcatgtcaatctcatgcattttttcgtgcatcgcataagtatgcccgggtcattcatctctatgaggaaaaaatgcactttacggcagccttaccgaatggatgctagagctagagtaatgggtgaagtagacgag

SEQ ID NO: 1464 - DNA, 132 bp, Glycine max
  Peptide Sequence Number=SeqID_118242
atggcggcagcggcacctgatgaagcagacgttgatgtgcatcgtcctggacatgcagtggatggttatgtagcaattgctgataagttggagagactactgaacctgaggatcctgatcgaaggaacataa

SEQ ID NO: 1465 - DNA, 354 bp, Glycine max
  Peptide Sequence Number=SeqID_118243
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtgggtttgtggtgatttggaggggagggacgaatcaagcgacagggctgaatctcagtggatcgtggcagcaaggccactctgccacttacaataccccgtcgcgtattaa

SEQ ID NO: 1466 - DNA, 327 bp, Glycine max
  Peptide Sequence Number=SeqID_118244
atggtagttacacttaacatcatatttagtatcctggcaagaataaatgaattagatgatccaacactatcacctgaggaatctcttatggatttttacagaattgattatcattatcgtcatctattgaatgttgattatgcaataagggatggcgtgagagtaaagggatattttgtctggtcactgctggactgctttgaatggagtaatggttatatacctcgatttggattgatttttgtggatcacaaaaataatttgaaccgatctccaaaactctctgcaaaatggttccggaaatttttacaaaatcgactgctttga

SEQ ID NO: 1467 - DNA, 1035 bp, Glycine max
  Peptide Sequence Number=SeqID_118245
atggcgacgaagcagcttccgcagatcgccattctgggagctggtatctttgtgaagactcagtaccttccgagactctccgagatctctcatcttttcattctgaaatccatttggagccgcactcaggaatcagctacagctgccgtagacatagctcgtaagcattttccccaagtagagactaagtggggagataacggttttgatgacatcattcacgatggatcaatcgatgctgttgccgtggtcttggctggacaaaatcaggttgacatctcactcaggttgctaaaggctggtaaacatgtccttcaaggtacaagtgaattggaagctgcattgtctagctacaaatctatttcttctgatgctcccggtcaattaatttggtctgtggctgaaaattatcgatttgagcctggcttagtagagtgcaagaaactaattgctggcattgggaaaatgatgagtgtccaagtcattattgaaggatcaatgaacagttcaaacccctatttttcaagctcttggaggcgcaatttcactggaggtttcattcttgatatgggtgtgcatttcattgcaggctttacaatacatgactggaaatctaagattaagtttggaatgttttgccttagtcatttggagaatggatgttcaggagtgtttaccttgtggcgagttgttggcttgaatggaaccctgcaagttgagcgtggattccaaggacaacatggttacctggtaggatccgagctttactttaaaatcactgaagttgcaacctattttaaccaaagcactgtttcattttatggtaccgatggacaaaacaaaagctcttttttcccattcagtggagtaactgaagaattaaaagcttttattaatgatgtatctgaaatcaccctcaagcagaagcggaatcagtttgtgactgagcctcgcctctcttatgtcgaaggtgcaagagatgttgctgtgttagaggcaatgcttgaatctggagctaggcaaggatttgcataa

SEQ ID NO: 1468 - DNA, 216 bp, Glycine max
  Peptide Sequence Number=SeqID_118246
atggttggagcattctcgcaaaacatcgtgaccctgactggtctccctatgatcttacttagtgagagtgacctgacaaacccattgtgtggtgtgtcttgttatgtactcctaagcgccccagcgtggtttttcactgacatgatgaataggtggatgactatgaagaacctcatgctagaggacacgggaacaccacgctctgataggatgtga

SEQ ID NO: 1469 - DNA, 990 bp, Glycine max
  Peptide Sequence Number=SeqID_118247
atggctccaagctctaaattcagaagagcccttggggcagtgaaggatcaaacaagcataagcctagcgaaggtgggaagcagcacctcagttgctgaccttgatgtggcgattgtgaaggcaacaaggcacgatgaatacccagcagaagagaagcacataagggaaattctgagcctaacatgttactctcgagcattcatcagtgcatgtgttaataccctcacaaggcgtctcaacaagacaaagagctggacagtggctttgaaaacacttgttttgattcaaaggttgctattagaaggtgatcctgcctatgagcaggaaattttcttttcaactcgacgcgggactcgccttctcaacatgtctgattttcgtgacaactcaaaatctgattcttgggacttctctgcatttgtgcgaacatatgcattgtatctagacgaaaggcttgagtacaagatgcaaagccggcgtggaatgcgcagcatgtatggtttagatgaagatgaggaggaaagggaaagagaaaaggaaatcattgtgagatccacaccagtgcgtgacatgaagttagaccaaatcttttccaaaatgcagcatttgcaattgctgcttgagcgctttttagcttgccgccccacaggaggtgcaaagaaccatcgaattgtgatagtggctctctacccgattgtgaaggagagttttaggatatattatgatatatcagaaatacttagtatcttaattgatcgcttccctgacatggaagtgtcagactgtgttaaggtgtatgacattttctgccgtgttggaaagcagtttgatgagctagacctcttttttggatggtccaagagcattggaattgcacgctcttctgagtaccctgagattgaaagggtcacacttaagaagttagaggtcatggaagagtttatcaaggacaagtccgccttagcacaaagcaacaaacttgaagcatag

SEQ ID NO: 1470 - DNA, 1320 bp, Glycine max
  Peptide Sequence Number=SeqID_118248
atgagcagttcgggtttgggtggggggattttggacttggagtctccatttcatagacaccagcacacccaattgggtcaacaatcaataactggtcaacagcacataaatattatgagtggtcttgaaagtgatcaccccattggcctaattgaagtgaagagtttgaatgtggcgttgaattttggtaaagcaaaggcacttgctccttccaatagtaatgagttgagtgaagaagatgagcctagctatgcagaagaagggaattgtgagaacctggatggtgggaacagcaaaaaggggtctccttggcagcgaatgaagtgggcagacaatgtggttaggcttcttataacagtggtgagttgtgtgggtgatgatggcacaattggtggcatggatggtcataaaaggaaatctggggttttacaaaagaagggcaagtggaaaatggtctccaagataatgataggcaagggttgccatgtgtcaccgcagcagtgtgaggacaagttcaatgacttaaacaagagatacaagaggttaaatgacatacttggaaggggaacttgttgtcaggtggttgagaatcctgtgctgatggattcaatgcctaacctgtcagctaagatgaaggatgacgttcggaagatattgagctcaaaacacttgttttataaggagatgtgtgcctaccataatgggcaaaggataccaaattctcatgaacttgatttaccgggctattctctggagcatgggagggactccagagataataatggatctgaggatgaagatgaggataacaatgatagtgaggatgatgagtcggatgatgaaattaatactaatgcacatgaggatggggggaggatgcaggagctatgtgatagaaataaattaagtgacgaggatgtccattttggtccacaaacttctcgaatggataaatttgaggttgaaatggcaagggttttccaggaccccacaaagttgttgcgtgaacaaagagagtggattaagatccagatgttacagcttcaagagcaaaatatcagctaccaagcccaagctcttgaacttgagaaacaacggcttaagtggttaagatattgcagcaagaaggacagggagctggggaagctgaggttggagaacaaaagaatgaaattagaaaacgagcacaggatcttgaaactgaagcagaaagagcttgaggcagatttcagtacatctgagatgtctttagaccctgcctctcttggaatcaaccggacgcaagggagggaacatatcagcttaggcagacaacagtag

SEQ ID NO: 1471 - DNA, 1188 bp, Glycine max
  Peptide Sequence Number=SeqID_118249
atgatggttgataaacaacggtacccgacaatagaacaaaagcttgctggccagcttcacttgagatccaactccaacctttccccacatgttggaacttgttacgaacgtctgaaaagaccagctctgtttcagcaacgattttcactaaaaaatcattcaaatgcagggttgctgtgccctctcgtgcctgcatggaaagccactagccatctgcattctgtagcttcagctgcttcaccagtgttggtcccatccccatcagagaaaaactttgcaagctttgccactgattttctcatgggtggagtttctgctgcagtgtccaagactgcagctgctcctattgaacgcataaagcttctgattcaaaatcaagatgagatgatcaaggccggtcggctctccgaaccctacaagggcattggagattgctttggcagaacaacgaaagacgaggggcttgtttcattgtggagagggaacactgctaacgttatccgttacttcccaacacaggccctgaactttgcatttaaagactactttaagaagctatttaacttcaagaaagacagggatgggtactggaaatggtttgcagggaacatggcatctggtgcagcagcaggagctttatcatcggtgtttgtttattctttggattacgctcgaacccgccttgccaatgatgctaaagctggaaagacgggtggagagagacaattcaatggtttggtcgatgtgtacaggaagactcttcgatcggacggtgttgctggcctctaccgtggcttcaacgtttcttgtgttggaatcattgtctaccgtggtttgtactttggaatgtatgattctctgaaaccagtactcttggtaggaactttgcaggatagtttcttggctagctttgctctggggtggatggttactattggtgctagcattgcctcgtaccccttagatacggttcgcagaagaatgatgatgacatctggtgaagctgtcaagtacaagagctctttcgatgcattctcgcaaattgtgaagaatgaaggttcaaaatctttgttcaagggcgcgggagcaaacatccttcgtgcagttgctggtgctggtgtgctttctggttatgacaaacttcaggtacttgtcctgggaaagaagtatggttctggtggggcttaa

SEQ ID NO: 1472 - DNA, 387 bp, Glycine max
  Peptide Sequence Number=SeqID_118250
atggcgaatgcaacacttctgccgtgttcttcagtgtgtatgggggggggggggggggtagattctgctccacgtttagaaagtttgtacataagtgctgccactatagcactattgcattgcggaattccttgcatctggggtcgcaactctgtttactattgcaactgctatgggtgtcgaggttgtggcatgcatcctgaatcctcttgtaatctcttgcacaagtacttgtcacaagataagtctaaatacgctgtaaataagctcttctatacgaaccctaagtatttgtcacataattatgggagagttgacacaaaactacaaaaggaacttaataagaagcaaggcctcaaaattacagctttgaggacttggggttag

SEQ ID NO: 1473 - DNA, 804 bp, Glycine max
  Peptide Sequence Number=SeqID_118251
atgaagctcctagaatccaagaaaagagcagagtcacggccagagtcgtcggaaaacccttcagacaccgatcccccgcacaagaaaactagggatttgccaaacttgaccgaatgccacgcctgtggcttcaaggttgacgtctgcacaggtaagaacagactccgaaccctctatagcgaatggcgtgtggttcttctctgcaagaaatgtttttcttccgtcgaatcttcccaaatctgctcctattgtttttccggagcgtctcccgagtcatttcgttgcaatcagtgtctgcattctgtgcacaaatcatgtttcttaaagtacaaaaacgctgctccgtggtcctatgcttgtttgggctctgaattttctgtctgtgtggattgttggattcctaaacacttggcaatttccagaagaaggaataaaataggagttaagaatgggaaaaatggtagggttatgccagagaagggcagtcctagggtttttgggggtggaaatttggtgaggtcaatggaggatttggttgaggatgcaaaacgtgcggttggggagaaggttgaggctgctgctagggctagagatgaggcaatgcagaaggctatggtggctagaagtgctcttgagattgcaaacaatgctttgagtttagtggcaaatagggaggagagtagtctgaatctgcctcccaagatggatgctgttaaagttcttgatggttccgagttgacttttgagttgcatccacgtttcaatagcttgcccaggatttcaaagagttgctgcttattgaat

SEQ ID NO: 1474 - DNA, 444 bp, Glycine max
  Peptide Sequence Number=SeqID_118252
atgatgtttggtgcttttgacatgcggggcggagggggcaccatgtcattaccaactttcttccttgactttgttgctaatccatatcggtcaggatgcatactttgcaaagcaagcatagagcataggtcatctaaacaacgaatggtgatgataatccttactatgcatcccagccaacctattactccccaacaaagaatgaagaacacccaccctaccatcacctaccacctccaagcaaaggaaaacacccaccctatgtctttaagtcaccaccaccctctccttatgtctataagtctactccactgccatctccttcaccgactccaccatatgtgtataaatctcctcctcctccttatgcctacaagtctcctctaccaccatcttattcaccacctcctccatatgtccttctgcaacaatctactaagctaa

SEQ ID NO: 1475 - DNA, 2628 bp, Glycine max
  Peptide Sequence Number=SeqID_118253
atgggatcgttgaagacggaggaagatctgaaggtgtctaatgaggctatcttatatgttaacggagttcgcagattgctgtctgatggattagctcatttcactcttctcgaacactatgctatcaatgcttgcttagcacctctatattctgtagaaggcatgcatgtgattacagtggagggattgggaagctgcaagcgtggactacaccctgtccaggaatccctggctcgggctcatggttcacaatgtggattttgtactcctggttttgttatgtccatgtatgcattattacggtcaagtcaaacaccacctagtgaagaacaaattgaagaatgccttgcaggaaatttatgtcggtgcactggttacagaccaatatttgatgcattccgggtctttgcaaaaactagcaatgacttatatactggggtttcttcattgagccttgaagaaggaaagtctgtttgcccatcaacaggaaaaccctgttcatgtaatttaagcaatacaaatgataaatgcgtaggtggtgataatggatatgaacctacttcctataatgaaatagatgggaccaaatacacagaaagggaacttatttttcctcctgaactgttgttaaggacaccaacctcattaaatttgactggatttggtgggctaatgtggtatcggcctttaacacttcaacatgtattggatttaaaagccaaatacactgatgcaaagttgctagttggtaatactgaggtaggaattgagatgagactaaagagaatgccgtatcgggttctaatttctgtaatgcatgtgccagaattaaatgttttgggtgcaaaggatgatggcttagagataggtgctgcagtaagactatctgatcttatgaattttttcaaaaaggttgtaactgagcgagctgctcatgaaactttgtcttgtaaggcttttattgagcaacttaaatggtttgctggaacacagataagaaatgctgcatcagttggcgggaatatatgtactgccagtccaatatcagatctgaatcctctatggatggcagctagagcaaaatttcgaattattgatgctaaaggaaacatcaggacagtcctggccgaaaatttcttcctcccgggttaccgtaaagtgaatttagcaagtggtgaaatcttgctgtcagtattcctgccttggaataggacttttgagtttgtgaaagaatttaaacagtctcatagaagggatgatgatattgcaattgtaaatgcaggtattcgtgttcatcttcaggaacatagtgaaaactgtgtggttgctgatgcatcaatattttatggtggggtggctccatattcacttgcagcaacaaaaactaaggaatttctcataggaaagaattggaaccaagatctgttgcaaaatgcattgaaagtcctacaaaaggatatattactcaaggaagatgctcctggcggaatggtagagttccggaaatctttgactctaagtttcttttttaaattttttctgtgggtgtctcatcaaatggatagcgtcaaagagagtataccatcatcccatctatctgctgtgcactcagtccaccgaccaccagttactggatctcaggactatgaaatcaggaaacgtgggacttctgtgggttctccagaggttcatctatctgcaagacttcaggttacaggagaagcagaatatgctgatgacacaccaatgcctcccaacggtttgcatgctgccttagttttgagtaagaaacctcatgcccgaataattaaaattgatgattcagaggccatatcttcgcctggatttgtgagcttatttctggccaaagatgtaccgagtgataataaaattggaccggttgttgctgatgaggatctctttgctgtagattatgtcacttgtgtgggacaggttataggagtagttgtggccgatactcatgaaaatgcaaagattgctgcacgaaaagttattgttgagtatgaagagctcccagccatcctttcaatacgggatgccatcaatgctagaagttttcatcccaatacagaaaagtgtttgagtaaaggtgatgttgatcactgttttcaatcaggtcagtgtgaccgaataattgaaggggaagttcagatgggaggtcaggaacacttttatctggagccacatagcactttgatatggacagtggatggtggaaatgaagttcatatgatatcatctagtcaactgttgtggttggagagcccaaggctttataaaccccacattagattcctatacttccagcgtgggactcaagtcccataccttgctcctcagaagcaccagaaatatgtttcccatgttcttggccttcccatgtcaaaggtagtttgcaaaacaaagcgaattggtggtggatttggggggaaggagacaagatcagcctttattgctgctgctgcttcagttccatcttatctgttaaatcgaccagtgaaaatcacactggaccgagatgtagacatgatgataactgggcaacgccatagttttctagggaagtacaaggtgatacttatgcactttgtttgtaccacaatatga

SEQ ID NO: 1476 - DNA, 339 bp, Glycine max
  Peptide Sequence Number=SeqID_118254
atggcaaacaatgttcaaccatgtcatgaccttgatcctagagaagccaaaagcccttcaaagatgttaaacttggacgtggaagcacagttgagggaggaggagaagggttttgactatgcgaagagggcacagtggcttagagctgctgttttgggtgccaatgatgggttgctctcaacagcatccctcatgatgggagttggagctgtgaggaaggatgttaagagcatgatactaactggggtggcagggttggtggctggagcatgcagcatggccattggagagtttgtttctgtttactcacagttattgatatcgagttggctcagatga

SEQ ID NO: 1477 - DNA, 318 bp, Glycine max
  Peptide Sequence Number=SeqID_118255
atgaaaagttgtctcctctgcaatctgctgcgtcttcaagctgttgctacaagcctatgccctagctgcccgtgctgtgcatgtcttgccaatgggaggggcgattctaactccatgtcaccagactcaccattgtcaatgacggtatcctctacatactggtcacatcagcgtgtctcgccaacatcaatggcggcatgtccacggcactgcattgtcctccctttgttcaatgtggtttcacttccctgcttttctctcagacaagacagcgcattggaaatttggaaaaaggagcataacacaactcacatttga

SEQ ID NO: 1478 - DNA, 243 bp, Glycine max
  Peptide Sequence Number=SeqID_118256
atgcagttggcaatgagggtttcatgcttctgtaccagcaacggagaagtgtttcctgggtatgatactctcctgcaaattggctgtaggcttggtgaatgcaggattattttatgtgaagcaggtgccaagcacaagttgcaaaaattgcagcttaatttcccgaggttagttctcaaagcccctatcatttcttcagctgatcccacagaaacaaatgacgggattatgagtagtgcctaa

SEQ ID NO: 1479 - DNA, 369 bp, Glycine max
  Peptide Sequence Number=SeqID_118257
atgggtaacaatgatccttgcaagtctattgacatatgttctatacaaattagaatgcatgatgggattgttagaaccttaaccgaggaagcaacaccaaatgaaattcgcaaaggctatggacatacaaaggccatgttggactacgtctattctaattattgggggcctttgagagttccatcattgggaggagcaaggtacttcctctccatcatcaattattactccaggatgacatgggtattcatgatgaagaagaaatttaaagctttcgaatgtttcaagcattggacgattcttatgaagaatcaagcaggaaagacagtgaagtgtcttggaccgataatggattacgaaattcaatga

SEQ ID NO: 1480 - DNA, 2283 bp, Glycine max
  Peptide Sequence Number=SeqID_118258
atggctgcaactccttccaaatcctttcaaactccctccaaccccaaactccgatccaaatccaatcccaaatcctcgccggctgtaacccccgacactccacaaaccctacatattcgcagatccacgcgtgccaagtccctcctcttcgatgctcccaagcctccccacagtccgctccaaatctcgctcacaactccgaagcggaggacgcgacgatccattgttgaggaggattccgccgaagataaagccacacccagcaaaatttcacctaaaaataaagctccggtcgtcgatgcgtcgaagaagaagaatgggaagagctcaattgaatttttctttgctccggtaacaccagcttcatcagaaaaggcatccactaggaagagggagggtgaggggggtgttgtttccagagctaaaagggggaaatcggaaaatcgtgaaaagagtgcaaaattgcctcagaggcgcgtgtattacaaaaaagtgatttacgatggaggcgagtttgaattgggggatgatgtttatgtgaagaggagagaagatgctagctccgatgatgaagatcccgaaatggaggagtgtaggatgtgtttttcctctaacgatgaggtcatgattgagtgtgacgattgtttgggtgggtttcatttgaaatgcttgaggcctccattgaaggatgttcccgaaggggattggatctgtgggttctgtgaggctcgtaagatgggtaaggaagttcagttaccaaagcctccgaagggtaagaaactagttagaactatgagggagaagctcctttccagtgatttgtggtctggtcgtgttgaaagcatatggagagaggtagatggcaactattggtgtcgggtgcgctggtatacaatcccggaagagacttctgttgggcggcaacctcataacctgaggagggagctatatcgaactaatgattttgctgacatcgagatatcaaataaaggagaattgggatgtcataataatgaaacagttgatgcagctaacgcttacattataaggatgatcctcaggtcaggcataatgttcaagatggaatctgtccttagacattgccatgtcatgacccccaaagaatatgctaaagctagcaatgagggagatgatgttttcttatgtgagtatgagtatgacatccattggcacagcttcaaacgtcttgctgacattgacaatgaaacagagaatggtgaagagtctgacagtgatgaagactggaatgttggcaaggaatcagactccgatacagatgaagatgttgaatatgaagaagaaaatattaaaaatgcacaatctcagccatcaagaagccatcacttagctgcaaatctgtacaagggacggttctttggacttcaaaagataggcacaaaaacgattccacagcatgtaagatctcacaaacagactgatcttgagagagcaaaggctacactgttgttggcgtcactgccaaaatctttaccttgtagaaataaagaaatggaggagataactacattcatcaaaggtgctatttctaatgatcaatgtctggggcgttgcctctacattcatggtgttccgggaactggcaagacaatgagtgtactgtcagtaatgagaagtttgaagtcagaagttgatgcaggaaacatcaaaccatactcttttgtggagattaatggtctgaaattggcatcaccagagaatatttataaggttatttatgaggcactaaatggccacagggtcagctggaaaaaggctctccacttgctaaatgagagatttgtagaaggaaagaaaaccagagatgaggctgaccagccatgtattttgcttattgatgaacttgatcttctagtaaccagaaaccagtcggttctgtacaatattcttgactggcctactaagccacattccaagctaattgtcatagggatagcaaatactatggatcttccagagaagttacttcctcgtatatcaagccgaatgggcatacagaggctttgctttggcccatataattatcagcagcttcaagaaatcatttcaagtcgcctcaagggaattgatgtatttgaaaagcaagctgtagaatttgcttcaagaaaggttgcagcaatctctggagatgcacgtcgtgctttggagatatgcagacgtgcagccgaaatagcagattatcgtgttaagaagctaatttctaatcctgattgtgttactgcaggcatatactttacatcttaa

SEQ ID NO: 1481 - DNA, 1139 bp, Glycine max
  Peptide Sequence Number=SeqID_118259
taggagatgctgaactcaagttgttcatgaaggctattcaagaacaagtcatgactctaaatgcaaggttggatgatttacaatctacttctagtaatgagccaagagttgacaactacttaggtaatattaagattaatatcccaccattccaaggaaaaaatgatcctaaattgtacttggagtgggagaaaaaggattacttcaaggagatgcagatagtcatgattaaagccaatgttaaggaagactgggaggcaactatggcaaggttcgttgcaggtttaaagaaagagatagttggtgtggtgaagttgcaacattgtgtggagatggatgatttgttgcacaaaacaattcagttggagaggcaaatgaagtcaaaagttgttgcacctaaaggtaaaatggaaaataatatctcttctagatcacgtgatatcaagtgttttaggtgtcaagcagttggacatattgcttctcaatgtctaaataaaagaatactgattgtgagtgataatggagacatagaaattgagggctcaagtgatgatgaaatgccaacattggaggattgtagtgatgttgaagttgctgaacttgtacatggagttgcacttgttacaaggcgtgctcttagcatacaacctaaggaagatggtgatgtagagcaacgtgagcttatttttcatactaggtgccacataaatgacaaggtatgtagcatgattattaatagtgggacttttaccaatgttgctagcactttgttggttgagaaattgaacttgccaaccaagaagcatcctaatccatatagacgtcaatggttgaatgattatggagatagaagggtgactaagaaaattttggtttcattttccattggcaaatacaaagatgaggttcttgatgttgcattgatgcatgctagacatataattcttagtaaagaggaaaataagagagtgggtgcatttgcaaagaaaacagaagttgaaagtgctttgttcgaaggagactggaattcactaatgttttccagaagatttgcctcaaggattacctcctttaagaggttgttggaaaaagaagtggatgacattgtctatattgtccagtgtatccctctgtcctag

SEQ ID NO: 1482 - DNA, 214 bp, Glycine max
  Peptide Sequence Number=SeqID_118260
atgcatgcccagggtgttggaccccttcctttcagcctccctatggcattttatagcaaaatgagggaggtggtggccgcccagacaagctgggttgctgtggaagcaatgactttcaagattattttgatgatgccaaagaatcaagagttaagcaagttccaaagaatcaggagtcaaaaagcttcaagaatcaagattcaagaacaatcaa

SEQ ID NO: 1483 - DNA, 699 bp, Glycine max
  Peptide Sequence Number=SeqID_118261
atgttggtgaggctttgttctgaaagcatcccgaatcacgtggcgatttcaccatccttctcaatcacattcttcttagctgcaaattcgtttgttctgctgttaacaaggcgggattggcgaaactcctatgctggagagaccaatgctaaaggtgaggagcaaaagaaattggatgtgctttcaaatgaattatttgtgaaagccttaatcagcagtggacgcagaaggttgaagaggctatatttgtgccatcatcacatcgtggcaagtcagttcaaagctctagaaccaaccaacactccatcttttagtggtattgttaaaatacattatcttatcaaaatctttggtatttacgtagtgaagaatgaggctgaagtaagtcttgaagatgcattgcaacctgggaaccaaatgttagcagctggttactgcatgtatggaagctcttgcacgttcgtgcttagcaaaggaaatggagtgaagttcatattgactcacccaaacatcaagttaaattggcatatcaagttattagaatttttcacaggaaattctaaatgttcttccatcaagcaggaggtcaggctttcacaggaaaaaatacatgaaggattaccagtattccttggcagctacgatgacatggagcaaatgaaagagctttatgctgcatccaaagaagatgattactag

SEQ ID NO: 1484 - DNA, 588 bp, Glycine max
  Peptide Sequence Number=SeqID_118262
atgaggaaggtttaccaggactactgtgatgccatgagcaatctttctttaggtataatggagcttctaggaatgagccttggagttggtagagcctgctttagggagttctttgaagagaatagttcaataatgaggctgaattactaccctccgtgtcaaaagcctgacctcactttaggcactggacctcattgtgatccaacatctttgaccattcttcaccaggaccaagtgggaggcttgcaagtttgtgttgacaatgagtggcattccattaagccggatctcaatgcttttgttgtcaatgttggtgataccttcatggctctttcgaatgggagatacaagagttgcttgcatagggcagtggtgaatagccagacaacaagaaaatctcttgctttctttttgtgtccaagaagtgacaaggtggtaagtccaccatgtgaattagtggacaatttgagcccaaggctatacccagattttacatggcccatgctgctggagttcactcaaaagcattacagagctgacatgaaaacccttgaggcatttgccaactggctccggaaaagtaactga

SEQ ID NO: 1485 - DNA, 273 bp, Glycine max
  Peptide Sequence Number=SeqID_118263
atggtagccataaccccaaccaaggttcatcaacctccatttctccgagaatacgactcgaacgcaatgtgtgcttgtcatggaaaagccccggggcattccattgagcattgtaggggcctgaagcgtaaggtgcaaggattttcaactttcaccggaagtgggtgcaagccattggtctgtttgctcaagcgacctgtgctcctgagtttggacttccaagaccgttcaatcagagattactcatcttgcacgttggtgggggtgccgtaa

SEQ ID NO: 1486 - DNA, 1045 bp, Glycine max
  Peptide Sequence Number=SeqID_118264
gaaggcgtgcccgccgtcattcccgccgaggcctgtcacctgggctggcaggagtcgctgcagttgctgaccctgctggtggaggccagcgtgccgggctgagaccctgcacaagccccggctgtcacacagctgcggttgatggattgcggtgcttcggaggacaatggcagtattgcccgccaacgcccggaggacatggaggtcatccgcgtggtgctgcgcgccagccagtcgctgccgccgcacaaggtgccgggcagcgtcagcctgcactgcctggaaggcgagctggaggtgatgctcggcgaaagccgccagtccctgcaggccggccagctgatgcacctgccggcgaacatggcgcatgcgcgcaccggcaggaactgcatgaacggcccggccaccagcccctgcccgtagccgatgaaggagcgcctgtagcgctcggtggtgtagttggcgatcaggtccagccttccgatgatcttgcccatctcgcgctcgaagctgaggttgcgcgcgtcgtcgccgagaatccagttggccacttccacgttgcgtgcggcgttgtagatcagctgcgggtccagcccatggaccagggtgaagctggtgcgcccgccgtgggcggtgatgatggtgtcggccagcgcatggacgaaggcggccacgcggtcgcccttgaaatcgggctgcagcgccagcgagagtgcggccacgtcctgggcaccgtgcaggtcggcccagggctggcgctcggtgatggcgatgcgcacgtaggcggatgcggcctcgcggctttcggcggttttcttccattcggcggggttgcgcaggtacagcttgtccatgatgcgcatcaggctgtccaggttctccttcatggccagggtcgccatgcggttgctgtcggactgcacgatttcaccgggctcgaacgaggcgccctccaccttgccgcgcggcgcgggcgtgtcggcacagcccgctgtcagcagcagcgccagcaccggcgcaaggcggcgcgccgcgccacctcccg

SEQ ID NO: 1487 - DNA, 333 bp, Glycine max
  Peptide Sequence Number=SeqID_118265
atggacgaagatcaatggaggtatgactttgcgatgtcacaagaagttcatatggattatgattatgataatcaagaagaatgtggagtgaatgaaccacatgtcgattgttcaaatgcttttaatacatctcaggtattcgctactcgagatgatgttttgcaatgggctcgaacagttgcccatgaaaatggatttgttgcagtgattatgagatctgacacagagaccgaaataaagaattcgttagaaaagacaccgggagtaggaaatgtggttgtcccttcaggcttcgtgggaaaccagtgcgtggaggggaaggttggatggtga

SEQ ID NO: 1488 - DNA, 174 bp, Glycine max
  Peptide Sequence Number=SeqID_118266
atgagggaaggtatgccattgaaggaatatcttgatgaactaaactttattatgatagagctacgtgacattgatgtcaaaatggaagatgaaattctggtaatgactccgttaaaggtggcaggaagagcaaagttgatcctaaggatatcttcaattattgcaaagaactga

SEQ ID NO: 1489 - DNA, 2391 bp, Glycine max
  Peptide Sequence Number=SeqID_118267
atggagatgcaacagaagaggagaagaggtgagaggaggcgtcatccactaggggataagccatggaagaaggagtttcgccaccaagaatgtgccttagataagaagcttagagaggatgcttcaatggaggaaaagaaagagagagaaatagagaggggagagcacgaaattgaaggaagagaagagggagagaagcaacttttgttgttgcaatctgagactaatgatgctgaattggagtttcatgatagtgaagacaaatttgatggtatggctgacagctctaatgtggttattgaagaccaccatttatcacttaatgctttaaaaggtggtatgggtgtcagcacgataaggtttatggcctatattgggaagcttccagttaaggttttggttgatggaggcagttcagacaattttttacaaccacgagttgcgaaatttcttaagttgcctattgagccagcacctttttttaaggttatggtcgagaatggcaattacatggatgctggggcatgtactgtttttgatactcctacatcattacctcctccaagatctcatgaccattctattacattgattgaaggctctcaacctgttaaggttaatccttacaggtatcctcacagtcaaaaggaggaaattgaaaaattagtaaatggtatgttggaagaaggaactatccaaccaagcaaaagccccttttcatctccaattattttggtcaaaaagaaagatgactcatggagagtttgcacggattataaagcattaaatgctataattgtcaaagacacatttccaattccaactgttgatgaattgattgatgaattatatggagcggttttcttctccaagttagacttgagaactcatcatggtcattatgaatggttggttatgccattcggtttaacctatgcaccagcaacctttcagagtttgatgaatgacattttcaaaggagcattaaggagatttgtgttagtcttctttgatgacgtccttatattcagttcttcttggaaagaccatttatctcatttggaatttgtgttgaacacattgaagcaccaccagctatttgctagattctctaaatgtgcatttggagttagagaaattgattacttgggttattataggaggtttgtgaaaggttatgcatctatagcagcacctttaacagatcttttaaaaaaggactcttttaagtggtctgttagtgccactactgcaattaataagttgaaggaagtgatgacttcagctccattcattattcgaactgatcaaaagagtttgaaagaactgttagagcaacgattgcaaactcctgaacaacaacagtggcttcccaaatttctgggatatgattttgtcattcaatataagcctggtagagaaaatctacctgctaatgctttatcaagaagctttttgatggcttggttagaagctgtaggtgtttggatgaatcaagtatcagctttgttacaagaggataattctttagctgcaatttacaaacaatgcatggaaggtactgtacaaggcactgagtatgcagtgaaagatgggttgttgttttggaagggtagaatgatgattccttccaataaagaactaaaagaacaaattatgcaggagtttcatgcctctaaaattgggggtcatgagggagttacaaagtcagtttcacgaatttgcaagcaattttactggccaaaaatgcagcaagatataagagactttgtgaggcaatgtattatttgccagcaagctaaagttgaacaagctttaccagctggtttattacaacctttacccattccacagatattttgggaagacattgctatggatttcatcagtaatctacctccttcccgtggttatgctactatttttgttgtggtggatagactttcaaaatttgctcattttataccactgaaggctgcttttaatagcaaatctgttttgttcaaagcacagggaactatattggctatgagttctgtctaccatcctcaatcagatggccaaactgaggctcatagcattggaatgcctcccttcaaggctgtttttggacgtgatccaccatcagttattccttatgaatctgaccctaaagatccagccgctgtgcaggactcattgattaatagagataatttacttcaacagttgaaaactaatcttttaaaggcccagaattatatgaaacacaatgcaaataagaagagaagagattgtcagttggaaattggagatttggctctgaatagcgactatacggctatcctctatcccgctatagcggttttcgggcagaccgctacagccactatccaagattcaaaatattga

SEQ ID NO: 1490 - DNA, 981 bp, Glycine max
  Peptide Sequence Number=SeqID_118268
atggccttgttgctacaaacgcattaccctctctctctacgctcaccgcgttgcccttatctcttccctaacccttattatcattcatttctcattatccccaccaatcccctaccgcgattcaatgccgccattacattctccggtcaccggactccgtcgcgcccttcgtcggcgccacccgcagcctccgctttcgatcgccacgcgcgtccggcaacgccccttctcaaggcttttgcccgcgccgccgtctccgccctgctgtttctctgcttcggtgttcgcatgtgcttggcctcttcgccgccggcgccggctctgccgacggttcaggaggagcaaactgttcaagatgatcatgatggaataaaacaagatgacaaagaaactgtagtagataaggaattagaggaagcctttaatgcctggaaatctaaaacatttgcattgactgttcctctgaaagttgttgctctacgtggctccatacctccttcatggatcaaggacttcataaattctcaagggaggagaatgaagtttaacgtcaagtattatgcaagtcttgagaacatcttttctgacctatcaattccctttaccaaaggaaaaattggcccagcatctgctttggcggctgatattgttggtattggtgattcatgggtcaaatttgctattaacaaagctataattgaaccaataagagatgtagaagatcaggaatggtttaaaagcttagatgacaaatggaagagagagactgttaggtcaggaactacacaaattgaaagtgggcctgagactgtgaatggcccaagagtcttggaagtttacaatagaagggataagggtgtaatgaaaaaaggggagagttggttaggaaaatttaacaaaaaaggatgcacaatactaccacagagaagtgttgttgggatgaagttatacgggattttagggaaaaaagggaagttttga

SEQ ID NO: 1491 - DNA, 474 bp, Glycine max
  Peptide Sequence Number=SeqID_118269
atggctgagcacaacgagcgcactcgtcttcaacaactgcaatcagaagttgcaacgctgacgaccaacgttccaaggaccagaaattacaagatcgtttccgttcagatgcagagatccatagaactattgattcagaatcaagcagcggacactggtggttcgagctcaaacagaggtactccaaatactccggttatccattcagttccaatttcatctactataggtgtgaaggaaatttcattgagttttccccattttgatggtcaatcaccaataattgagtggatttttaaggctgagaaattcttcaattatcaccacactcctgatcaggatcgtgtggatattgcttccattcattttgagaaggatgtgataccttgtggattgaacaaagacatccatagagatgtagttgctcaagctcctgctgatttgttgtgtgcggtgatggaagcttgcttgtga

SEQ ID NO: 1492 - DNA, 838 bp, Glycine max
  Peptide Sequence Number=SeqID_118270
atggatatgtgtaacgtagtgcatgcattaaaaccagttatgctaatggtgctggtgcaggttgcaaatgcttgggtcaatgttctctacaagctcgcgcttaacgatggcatgaacttgagtgtcattgttgcttaccgttatgtttttgcaactgctttcattgctccacttgctttcattcttgaaaggttcttcttctgctcatggttttacgttacggaagacgaggacaaagatgacttggaggatactgtttcaggcatttctttgcggcttaattgggcaaagatgagtgaaagatacccgtgtccttattcgagcacagcgttgatgtccctaatgggggcactcttatccatttcatttgctttttgtgttgaaagggatttgagtcagtggaggttggattggaatgtcagactattgactgtggcttatgcgggtatagtagtttctggagtgatggtagccgtgatttcgtggtgtgtacgcacgagaggtccactgtttgtctccgtttttagccctctaatgcttgtcgttgtggcctttgctggatccactattttggacgagaaactataccttggaagcaaagagatgaagaagaatcaatctgttccgccagaaagcatccataaatctgacacagttgaaataatggtcaaatctcgcgtagaagataaaagcaacaataagagcaataccctcgttaattctgtaaatgcgactgcggataataaagattcatgggaaaatagatgtgaaaacaatgtaacacatatacactgctgcaaggagcgagaagaagaagtaacatctcagaatggctcac

SEQ ID NO: 1493 - DNA, 501 bp, Glycine max
  Peptide Sequence Number=SeqID_118271
atgagggagggatattgtacgcagccttacccttgcatatgcaaagaggctgtttccggattcgaacccatgaccaacaagtcaccaaggcacaactttactgctgcaccagggctcgccctcagattaagtaaacataatggtgggtgtgggctcgaaaaaaacaagcccgttaggaatgccggctttgcaaggtggacttcgtgggacgggcttacctgcatgcccagctctacctgcagcgcgcaaagggaatcattattccttgctttcatgaaacaacattgtgagagatggaagaaggaaaatacggttgaaattgatgcggagagggagaaaaaaaacgggagggatggtcgccgcccgcaggaatcgcctccaatgagtgacatcatggaggaatttgggctcgcaattctgttagcaaggaggtacacatggcagcagattcgcatagcatggaagtcaggaaaagcacacgcacaaggagagagaatataa

SEQ ID NO: 1494 - DNA, 249 bp, Glycine max
  Peptide Sequence Number=SeqID_118272
atgcagatcgatggctttttggatgcaccaacagtttctctaacagaccatagtgctttaagggtgttgctaggtgcacccagaattattactagtgcacccaacacatttttaaaatggtataattgcctctgcctgattttctttaaaatgggactgagaggtagcagttccatgaaggtgaaagtattaccggtgttgtgttttttcaacggagatgaagtactccgtataaaagcatacggatga

SEQ ID NO: 1495 - DNA, 162 bp, Glycine max
  Peptide Sequence Number=SeqID_118273
atggacaaggctgttatattaagtgatgcagttcgagttgtttctcagttacgagaggaagctcaaaagctgagggagtccactgagaatctacaagagaaaatcaatgcattgaagcttaaattgattgaaactccttggaattcattcgtttcaaagtaa

SEQ ID NO: 1496 - DNA, 327 bp, Glycine max
  Peptide Sequence Number=SeqID_118274
atgctcaagattcagcatgtggatgcacacaacgctgcacgatcagaggtgggtgttccagatttggcttgggatgactcggttgctgcttatgcagagaactatgctaatcaacgtaaaggtgactgtgcactgattcactctggtggtgaatacggggagaatattgcaatgagcactggtgaactaagtggcacagatgcagtgaaaatgtgggttgatgagaaagccaactatgaccacgattccaactcctgtgttggaggagagtgcctgcactacactcaggtcgtttggagagactcagtgcgtcttggatgtgccaaa

SEQ ID NO: 1497 - DNA, 525 bp, Glycine max
  Peptide Sequence Number=SeqID_118275
atgggatacttgtgcattaaggtttcgttttgtgtgatgtgtgtgttggggttggtgattgtgggtgatgttgcctatgctcaagattcagctcaagactatgtaaatgcacacaatgctgcacgagcagaggtgagttctcaatcaccaagagcaaatgtaattgttccaagtttggcttgggatgatacggttgctgcttatgcagagagctatgctaatcaacgtaaaggtgactgtgcactgatccactctggtggaaaatatggggagaatattgcaatgagcactggtgaactaagtggcacagatgcagtgaaaatgtgggttgatgagaaagccaactatgactacaattccaattcctgtgttggcggagagtgcctgcactacactcaggttgtttgggcccactctctgcgtcttggatgtgccaaagtgacatgtgataatggaggcactttcatcacttgcaactatgatccccctggcaacttggttggtgaaagtccctacgaactgtag

SEQ ID NO: 1498 - DNA, 267 bp, Glycine max
  Peptide Sequence Number=SeqID_118276
atgggtgcgactgttttgagtttgggatggtggaaaacattcaagggaggtggagctgacgtgggtgctattgttggtgggggttgtgcggaggaggacgaagttgacgtgagtgttgttggtggtagtggttatgtggaagaggatggagctgtcgtgagcggcgggggcaacagcggagttggcatgttcgtggggaggaagaaaggtagtggtggccggatcgccgaggcaatcttaggagaaaggcatccagtgaggatttga

SEQ ID NO: 1499 - DNA, 1215 bp, Glycine max
  Peptide Sequence Number=SeqID_118277
atggtagaaatgaggggcatatgtaatgtgttgcatgggttgaaaccagtgttgctgatggtgttagtgcaaattgcatatactgctgtcaatgtgcttttcaagctcgccataaacgacggaatgagcgtaaaggttgccacagcatatcgcctcgcttttggatctgctttcactgttcctctcgcactcatttctgaaaggaacaaaagaccaaagatgacttggagggtgcttttcatggcatgtctttgtggcttattcgggggaagtttatttcaaaaccttttctatgagtccttggctttaacatcagcaacgtttgcgtccgctctctacaacctcattccagccattacctttgtcttggccatctcctgcggtttcgaaaggctaaatttgaaggcagcagcaggaaaggccaaggtgttgggaactttacttggaattggaggcgcaatgttgttgacctttatcaaaggggcagaaattaatatctggcctttccacatcaaccttatgcatccacatcagcaccaaaacggccaagtggcgtcattaaatgctgactctgggaataataaattgttgggggcaatttgctccctagcaagctgcttctcttttgctttgtggctcatcattcaggctaagatgagcaaagaatacccttgtcactactcaagcacggctctgatgtctacagcgggagcaatacaggccactgcttttggtttctgttttgagagggatttgactcaatggaagttgggttggaatattaggctactggctgtggcttattcgggaatcgtggcctctggaatagtggttattattactgcatggtgcatacagatgagagggcctctgtttgcgtctgttttcaaccctctaatgcttgtgcttgtggctattaccggttctttgatgttgaatgagaacttatacgtaggaagtgtggttggagcagtgctgattgtgtgtgggctgtacatggttctgtggggtaaaagtaaagagatgaaaaatattactcagttggtgccatcagaaaccatccgagaagctgaagccatagaagttgtcgtcatgcccatgtccacaccaatagattatgaaaaatgtgaccaaaacaaccaaggagaaaggaatgttgacaaagaacattgtgacgatttgacaaaaaacaaggaagatgatattcgcatatag

SEQ ID NO: 1500 - DNA, 2625 bp, Glycine max
  Peptide Sequence Number=SeqID_118278
atggtttattcagctgatgccaggttgaaaccggagaaagcttctttgtcatacgctgattttcatcatgaaattaccaaaaatgtggaagacaactctttaaaaccttaccgaaataagcaaaagcaagcaacttatcgaagggcaagtgaggaagatgagctggttaagtatatgtcgaatctaccaggttacttagagaagggagaaaaaattcccgataaagctttgaatgttggggtgcttgattgggccactctacaacaatggcagtacagccataaacatttgcccttaagtagccggagctcgacatctactggtaatacatcatcttctgtttcagcagaggaattatctggtaattctagcaaaggtcctgtttgttctccttcacgtcaaagaatatttcgtccgtcgctgaaatctcacttcatggcatctccaatgcaagactactctgcatctgtcaaatcctctggagggagttttggaaattgtcagaatcttagaggtgggtgcagtaatattgacacacacggcaaatatgctcaagttggtgatcatctttcccaaaaccatcctgctagtataccaaaaggatgtgacaggagacaactgaatccacatattagtaaagaaagtgatatcttgccaaatgggggaatgtatgaggcagcatcacatactacgactgaaatgagctctcaagatgatagaccagaaaagaaagtggagaatttcagacaaccaaacattgatgctgatgagcaagttatgcttgggaaaagcaaacctattgttcttattttgcctagagacattccccagaataatcattgtgaagttcctgatatgcaaacatccttgggtcaaaagctaggaagtcccactggaacaagattttcagaaaaacctaaggaacctccctgtagatatccaaattccaatatttccaaaacatgtcctctgccagatgaaattagaggaatccgttatcagccggaaaggtcaggatctagttccacagatccagaaggtattaaaattcctgcttctactttatcagcacctgtaccagtcagaacagggataataagtccatgcagatctagaaaggctgaggaaaagaaacacaacattggtgcatcttcatctgcaaatgggtctctcaagggattagatcagaaagtaacaactgagaaaccaagaagttcttcaccttttcggcgatttagcttcagcattggctttacaggtaaaggttctggctgtaaagaggttgcacatgtgccacatcagagctccatagcagcacttaaatctagttcagaaaatgtgagaggttatgctagctcaaaaatttcaggcaatgataaacctggtaatgctgtcaaaagcaggtctagtagccctttaaggagactactggatcccctgctgaaaccgaagacatcagaccatcgctcggtggagtcatctcaaaaagattcagtggtaataaagaagaattgtaggtcagctaatgggggatttgctatggagaaagaactggacagggaccagagggttggttgtacaaatacagcaattaatacagttgatttatcaaagaacaagaagtatgtgccgtcaacgtttcaagctcttctaagaattgctgtgaagaatggtcagccccttttcacatttgctgttgacaataatagcaacattcttgtggccacagtgaagaacttggctgtctcaaaggaagacgaatgcaatcgtatctatacatttttcacctttagggagggaaaaaagaagaacggaagttggatgaatcaagcaagcaaaacccaaggtcccgattatattcatcatgctgttgcccaaatgaaggtttctgattcacaccattatgattcaactagccagaattgtgtggactcctctacatcaaaagagtttgttttgttttctgtaaagttaaagcagggagatgctcaggtcactgactacaaaccaaatgatgagcttgctgctattgttgtcaaatcagctaaggctgtcaattttatcaattatgcacatcagagcagtcgccagaatgacagtcaagatctacatgtaacagttgtgctcccaactggggttcacagttttccaagtaacggaggaccttcatcactgattgagcgctggagaacaggtggatcatgcgactgtggtggttgggatatggcttgtaaacttaagattcttgcaaatgaaagtcaagcatgtagaaaatcaagaatatcaaaagcttgtttcccacatccatttgagcttttcctccaggtgaatgaccaagacctagagaaccagcctgctttcagtttttccccctttaagcctggggtatattcggtagcttttgattcctcattctcacttttgcaagcattctccatctgcatagcgttagttgatggcttgatctcatatgaactttctggatcaagaaactacatcgaaggaaaaaattcgagagaaactctgttggtgcaaacagatgaactaaaggcttttggcaaattagaggacattcctgcaagttatgttgcttatcctcccctctctccagttggtagggtctaa

SEQ ID NO: 1501 - DNA, 174 bp, Glycine max
  Peptide Sequence Number=SeqID_118279
atgcagagaaacggaaggttgtctagcttggagaagaagcaaggagtgtcggtgcggtcgtttggtgtgatagtcaaagagggtggagctgggctgaaggatagtgaaatagggtggggcccacatggttttattatcagacggctgaaagagggtggcgtgatcggacggtga

SEQ ID NO: 1502 - DNA, 390 bp, Glycine max
  Peptide Sequence Number=SeqID_118280
tttatagcttccaaagtaacatgtcagtttcaggcaattcttgcaggtgcatttgctaataaggacttcaacagggccacagcaactgcatcccgagttctacagatgggtttggttctaggattggcacttgcattcattcttggaacaggattgcactttggtgctaaaatatttacacaagatgctaatgtcctccacctcattcaaattgggatcccggttgtggtggcaattcttagcatcatttctctgcttattttgtcatccgctggtggtttcattggaatttgggttgctttgaccatctatatgggtcttagggcatttgctggcttcttgagaattggaacgggatcaggaccttgggagtttctaaggagctcatga

SEQ ID NO: 1503 - DNA, 216 bp, Glycine max
  Peptide Sequence Number=SeqID_118281
atggcttccaacatctcgccttctgcccttgataaagaacagatatttggaatggctgaaaaggagatggagtatcgagttgaattattcaacaagtacaaggagtccgagctaaatatgggtgaaaatagttgcattgatcgctgtgtttcaaaatactggcatgtgactaatctaattggccagctgcttggttctggaaggcctcctatgtaa

SEQ ID NO: 1504 - DNA, 369 bp, Glycine max
  Peptide Sequence Number=SeqID_118282
atgaaggccgatatggaggccatgaagaagcaaatgacgatgatgatggaggcaacgatggacatgagaaagataatgggggctagcattgctacagttgttgctgctagtactgctacagagagggacccagctcacccaccttcttttaatcaagaaagtcacctagtaacggatatggaaggtcaaggaggcgtgacgggagtagccacatatgggcctcaatacacccagagccatacttttccaccgtatagtctgcctcctaactatacaccatccatggccgtaccagtacctgccataaatgttactaatcctacccctatttgtactgagaataacccagctcaacccaatcagacttaa

SEQ ID NO: 1505 - DNA, 966 bp, Glycine max
  Peptide Sequence Number=SeqID_118283
atggctgttgaactacacacttcgcttccttctcactttcttcccgatgatgacgaccacgacgacatcgtttcgtcacagcatagccacagaaacgacatccaccacgccttagctttaaacccgctccccgaggtcccgatgaacgacaacgacgacgatttcatctccgagttaactcaccgcatgactcgcttcttacttccagatgacgacacttccgatttctcatccattggctctcactccatggatctagaaaattcgtcacgggactcaaaacatagtccagaagattcaggttcatctcaggaagcatcaccgcccgctacacctgaagagcgttgttggaaaatcgacatgattggaacgtttgagaagatgaagcctaacgaaacagggaatttcaacaaccagtttcagaactccaatactggactctattcttaccaatctctaattcgggaacagattcgagcaattgaattgtctggggttaagcaggagcatgtggctgtgtctccgaaaccaaaatccaacccgcgtcggaaaagtcaagcgcaagaggccaataaaggaaacggacggagggcacggccgccacaggttccacatcaaggtggtgcggggatgcgggccctatttctggatgggtccggttctagaggtgggaccggcgtcttcttgcctcggggtggtggagctactaccccatccgaatcaaccaacaagcaaggtaaaggttgctccactgttcttatacctgccagagtagtccaggctttgcaactccatttcgaccaaatggctgccacgtctgggcccaaagctggtggcttccctcctctccatgatgttctagtgagtaacagggatggcatgtattcacttcagaagcccgagtcacggaaagcgccggcaagtatccagaatgatacgattctgcctcaagagtggacgtattga

SEQ ID NO: 1506 - DNA, 1001 bp, Glycine max
  Peptide Sequence Number=SeqID_118284
atgtcattccgcagcatagttcgtgatgtaagggatagtttcgggagcttatctaggcgtagttttgatgtcagacttactgggcatcatagaggaaaatctcaaggatcagtgcaggatttgcatgaccaacctctagtaattcaaaatagccgttgggccagcttacccccggaattactatttgatatcattagacggctagaggagagtgagaatacatggcctgctcgaaagcatgttgttgcatgtgctgcagtttgccagtcttggaggaatatgtgcaaggacatcgttaagagcccagagttttgtggcaaacttacattccctgtgtccttgaagcagttatttttagatgttgaccagatgaaagtacaagtgatctttgcactagctggggctttgttagttgaaaatggaaaattcctcctttctgctaagaggacaaggagaacaacttacactgagtacgttatttccatggatgctgacaacatctctagatcaagtaacacttacattggaaagctgagatcaaattttcttggtacaaagttcattatatacgatacacagcctccatactcttctgcccatatatgccctcctgggactgggaagacgagccgcagattttattccaaaaaggtctcgcctaaggtcccatctgggagttacaacatagctcaggtaacatatgaattaaatgtgcttgggactcgaggaccaagaaagatgcactgcgttatgcattcaataccagcttcagcactagatgcaggtggcactgttcctggccagccagagcttcttccccgttccctggaggactcgtttcggagcatctcgttttcaaagtctctagatcattctattgagttcagcagttcgcgattttctgagattggggaatcctgcatcgaagatgatgatggcaagatgagacccttggttctgaaaaacaagcctccaagatggcatgaacagttacaatgttg

SEQ ID NO: 1507 - DNA, 243 bp, Glycine max
  Peptide Sequence Number=SeqID_118285
atgttgaaaccacttcagtttcaggccaaaaagaagagaagctcacttagcgtgttgggaaaccctagaagaggatcagccagagacatgcgcgctccgcgcgccgccaacttacccaacgagtcgtttgtcccttctcgcactcaacgcgcccagctcgctaagccagaattcactaactcacgagcgaggcttcagaatatgaaacatcaaggagcctttaaaacaatgaagtgggcataa

SEQ ID NO: 1508 - DNA, 114 bp, Glycine max
  Peptide Sequence Number=SeqID_118286
tctacattgtctggtacatgtttggtaattgagaggaaaacaatgatgcttgcctggtctggatgttgtgcccatgccaatagagatgtttcacttgtttttggaagatactga

SEQ ID NO: 1509 - DNA, 1257 bp, Glycine max
  Peptide Sequence Number=SeqID_118287
atggcaaaggatcgagagccaccttcaaagttccttaagattgcactttttgtcaagaaatggccacagaaatctcatgcaggtgggcttgaacgccatgctctcacactccaccttgcccttgccaaaagaggccacgatcttcacattttcaccacttccacagactcctctttctccaattattcaattaacaacatacactttcacttctccaaaccaacacctgctggttaccttgaccaagctttggtttgggagcaatttcaagcacaaaactcaactagtaaaccctttgacattgttcacactgagagtgttggacttaggtacacgcgatctcgatatgttactaatttggctgtcacttggcacggaatcgcatacgagacctttcattctgacatcattcaagaactccttagaaccccccaagaaccacagacaaaggctttgactgaaagagctgtgaaggttgttgaagaggtcaagttcttcccaaattatgcgcatcatgttgccactagtgatcatgcaggtgatatcctaaagagggtctacatgattccagaagaaagggtccatattattctcaatggtgtggaccaacacatttttaggccaaatgtttcaaaggggaaggacttcaagaagaggcatggcattccggattcgaagtcattggtgataggactagctgggaggttggtcaaggacaagggacaccctttgatgtttgaggcattgaagcagataattgaagaaaatagcactttccaagagagtagcatggttgtggttgcaggagatggtccttggggtgcaagatacacagatcttggggcaaatatgttggttttggggccattggagcaagctgaattggcctctttttataatgctattgacgtttttgtaaaccccactttaagagcacaaggtttggatcacactttgctagaagccatgctgactgggaagccagtaatggccactaggcttgcaagcattataggatctgtaattgttggcaatgaaatgggttatacatttgcaccaacggtgagtgctctaaagaaggccatatatgagttatgggttagtgggagggaagttctagacaagaaaggtcatgttgccttgcaaagaggtgtgcaattgttcactgccacaaaaatggtgtatgcttatgagagactttttctttgcttgtcaagtgtaactcatgaggaacatttctgtgaataccaaccatag

SEQ ID NO: 1510 - DNA, 225 bp, Glycine max
  Peptide Sequence Number=SeqID_118288
atgcataaattccccatgtgtggggtatcacggtacaaagtgaaggatgatgacaagtgtagcagtgataaaagcacacccccagtgaaggtgttatggtatcttccgaacattctaaggttcaagcgtctgtttactaatgcagatgacgcaaaaaaccttatatggcatacagatagaagaaattgtgatggaatgctccgccattcggttgattcctcctag

SEQ ID NO: 1511 - DNA, 501 bp, Glycine max
  Peptide Sequence Number=SeqID_118289
atgtcagcagatttggagaggtcgacttctaggattcctcaacttgatggaccaattccatatgatgatgatgatgtgctctctactccaaatatatacaactatggagaagtgttcagtgaagactacaacatttctaatacaccagctcctcctgaagtaccagcaagcacccctgctctcttggttcagaatgaagtgggtaatgattttgatgatgatgatgatgatgaacctccattaaatgaagaggatgatgatgatttagatgacatggaacaaggagaggatcaaaatacacatcatcttgttttggcccagtttgataaggtagtggttcagggttggataaatattgtggctctaatagggtttctcttgctacaaattcaggtgacacgtaccaagagcaggtggaaatgcacattaaaggatggcatcatgcacataaataataaggacattctcttcaataaggcgacaggagagtttgaattctga

SEQ ID NO: 1512 - DNA, 306 bp, Glycine max
  Peptide Sequence Number=SeqID_118290
atgggtacttacttggattgtagagaagttacaagcaagacggagacaaagaagcagagaacacgaaagcatagtgcagatgaatgccaaatgattgcaagatttcaaactcatgcacttagcgggacagactcgcttagcccaattcaagaattagaaaacccgagaagtgcaactgtctcgcttagcgagaccccttcagccaatgggtgggggttggcgcacttagcgcaaggtgctacttgctcagctcataaggtaagactcgctttgcacatagggcacgctgagcgagtggatgactga

SEQ ID NO: 1513 - DNA, 504 bp, Glycine max
  Peptide Sequence Number=SeqID_118291
atgagtgaagataaagaatcacataacatctcccctgtcaatgaacgtgctggcagtggtagtggtgaacgtggtcttaattctgatgacatttctgctacctcacccgttgcaaaaaatgaaatcaaggaacatgatgataaggatgacaagaatgttgcaggacttagtggtgtcaaaattggtgacctttgtgctagtgctacctcaccaactggtgccaagaatgaagtgaaggaacatgatgtcggtgagcattccggcagtgataacaagaatgttgcaggaccaagtggtgtgaatactgcctctgacgatgacacttttgttgatgtagttaattttgatgagaatgagaacaatgggcttactgctgcagatattttgatagcccaaatagaagcagaaaagcagaagaaagcgtctagcagtagcagcaatgatgctgaatccagtggtaaaaacaagaatgaaccaacatccaaaagacaaagactcgattaa

SEQ ID NO: 1514 - DNA, 1002 bp, Glycine max
  Peptide Sequence Number=SeqID_118292
atgtttcggaaattaggatggttcgtgggtctgaatcaaaacaatttagcaaccaaaaggttgctcaatgccgaccaaactgcctctgctaggccaaatcaccaacttcctatgctcgatgctgttcacgaagttgccgtttacattcataggtttcacaatctcgacctttttgaacaaggatggtacagaatcaaggttaccttgagatgggaggacggtgaagactcctatcccgggattcctgcacgggttgttcagtatgaagctcctgaagtgggtgctgacaatttatgtggagtttggatgattgatgataaagacaacagtttttcaacaccatcattccggattagatatgcaaggcaggacgtatttcttgctatcatgatctcattctatctatcttatggtggatacgaggggaaatcctctgctgttatcttgaagtttgagctctttcacactccaacacctgaaatgcggcctgagttacaaagttcgttggatggatgtgcagcttcagttcatgagtatagaatccctcctaaagctcttttgggattgcattcgtattgtcctgtacattttgatgctttccatgctgtccttgttgatactagtgttcatatcagtctactaaaatctggttatcacacaccacaactgaaggtaccaagttattctttggcttctaaaggaacatatggtgaagactatgttaggtcaaacaaggctgcactcatcaaagcattgatcgctgcccatgatatcctgcttgatgacctgagaagaataagcaaaggaattaaccaagctattgatttgactggaattacttttgaaccttatgttactaagtcactcaattctacttcaccagcacatgaaaaaagtgctgatgatgaagcatcacttcaactgtctgatgggacacaaatcagtgctgaggttcttaattctggcaatgtgaatgcttcattatctgttatgcctttttga

SEQ ID NO: 1515 - DNA, 744 bp, Glycine max
  Peptide Sequence Number=SeqID_118293
atgggacatcatttagatttacggcttattaggaaccagtggcttttaatagaccccaaaatacaggttcttatgtcagagacaaacgaagataaaacatctgaagacttcagagaaatgggatcacggcttgctcaggaagttatctctttcctgaaaaagaagatggataaagcttcaagagttggaaacttaaaagatatcaagcttagctttgttggccattctattgggaatctcatcatcagagctgctttggcaggttatatgtatagttcgaactctatattcaattcaggattgtggctcttgaagaagatcaagggcacacaatgcatccatcaactaactttcacagatgatcatgatcttgagaataccttcatctacaatctttcaaagaagaagacacttgcaaacttcaagaatgtgattctgttatcctctcctcaggacggttatgttccatatcattctgccaaaatagaactgtgtccagcagctacattggacttttctaaacaagggaaagtgttcctggagatgttaaacaattgcttggaccaaatgagaactcactctgagcatcgtatagtcatgcgctgtgacattaacttcgaaacctcctcctacggcaggaggagcttcaacacacttattggacgtgctgctcacattgaattcttggagtgtgacatttttgtcaagttcataatgtggtctttcccagagctctttagttag

SEQ ID NO: 1516 - DNA, 489 bp, Glycine max
  Peptide Sequence Number=SeqID_118294
atgtgggctttccttaccggtcatcagatcaactgggctcacttggttcggtaccgaatgcataaggcattacgggccaatgcacctctcccttaccctcaattgataactttgtttctgcgtcattttcaaattccgcttgatgatgaaccatttgttcaagtcaagtgttcctttgcaattggtgctggtgcaatgacttcttttggataccgtaaggatcggaatggtcaatggctgaagaaagacgcactccctcctcaagatgagcgaactccttcacctcctcctcagcgagatgattcagcactcatgactgaagttctttccgaattacggggtctttgttcttatgttggtgaacgtttcgactcattggatacacttttgccagaatggatattcgcctcacatagcttgaagaggatgtgggttacattcgtcagagtttcgattttccaccaccacctccaccttcttagaatttag

SEQ ID NO: 1517 - DNA, 507 bp, Glycine max
  Peptide Sequence Number=SeqID_118295
atggtcacacatccaccagagagggtggtgcgacaatttggatacgttcagaccatccctccacagcctacaagtgtcaggttgtcatttgaagatattgacaacaggtggatgcattactctgaacatctagtagcagcggggcagatttgtcttgtgcctgaacagtgtgcatctgactacatggattggttctttaggatctctcatctgttcatgacacccacacaggcagctgatccgcccaaacatccacttgtgccacaacatgacacatatgtggagccagatatcactgaggtcctagtggcaccagaagctggaccttcacatgcaccttttgatgtggagcagcctagacatgcagtggatggttgccaagcaatcgcagaaaggttggagcgtctgctcaacctaaggatagtcactacagacacaaagatacatgaggtcatggaagactgcataaggatcgctaggggtgtcacaacagatggcaatgtttat

SEQ ID NO: 1518 - DNA, 1086 bp, Glycine max
  Peptide Sequence Number=SeqID_118296
atgttcagcactattacatcgggaatcctgtcgcgcctcgcgtggcagaaacgcagtcacagcagcgcaacgctcagttcgctgcaggaggccatcgccatggtcgagtttacgcctgatggtcacatcctcaccgctaacgcgctgtttctggagcgcatgggctacacgctggcagaaattgtcggccagcatcacagcctgttctgcacgccagatatggtgcagtcaccgcagtatcgcgagttctggcagcgtctgaatcgcggcgaaggcttcagcgataagtttttgcgcgtggcgaagcacagccgtccaatctggctggaagccaactacgtaccggtgcaggatcgccacggccgagtgatcaaaatcgtcaagctggcgagtgatatcaccgcgcgcatcatggatgcgcaggagcagcgcgccatgaccaccgccattgagcgctcgatggcggtgattgccttcaacctcaaaggtgaagtgctgatggccaacgataatttcttcaataccatgggctatcgcgctgatgagatcatcggtcgccatcacagcctgttctgtccgcccgaaatgcgcaccagcgaggcctatcgccgcttctggcacaagctcaatcagggtgaatatatctccggccagttcgagcgcgtcaataagcagggcaacaccgtctggctgcgcgccacctataatccggtgtttaacagcgccggcgagctgtacaaagtggtaaagttcgccaccgacgttaccgcgcaggtggaaaagaaccagctggagcgcgaagcagcgcagcaggcatggcaaaccgcgctgcataccagcgaaagcacacaacagggtgcggcggtcattgagaacagcgtacagaatatcaatgcgctggccagcgaactgcacggtatttctggtgatatcaatgatctgagcgactcttccgatcgcatcggcgccatcgtggagagtattcgccgtattgccgaccaaaccaatctgctggcgctcaatgcggcagtggaagccgcgcgcgccggtcatcacggccgcagctttgcggtggtcgccagtgaa

SEQ ID NO: 1519 - DNA, 1983 bp, Glycine max
  Peptide Sequence Number=SeqID_118297
atggcatccttcgctgcccccaacaacattggcagcgccgtgctaccctctcgccagagaaaaccctctcgaccccctcccctcaaatgctcccttctcccttcttccaacaacaacgattcactctcaaacccttcttcctctcacactccgccgctcttcaaagccatcgccatctcctccgccgcctccatcctcttgcaatgcacccctctctcccccttcttccctaaccccctcaccaaactcggcggaggcggtaacaccggtggcggcggcggagatgatgggtggttcggcggccatggaggaggcggcggcggcggaaatggagggttctggtccagaatgttcgccgcggtcgccgacgaaaaccagcctcaggagtgggattcacacggtctacccgccaacatcgttgtccagttgaacaaaatgagtggcttcaagaagtacaaggtttcggacatctccttcttcgatcggaacaggaagacaaaagttggcaccgaggattcgttcttcgagatggtttctcttcggccgggcggggtttacaccaaagcgcagctccaaaaggagttggagactcttgcgacttctggaatgttcgagaaggttgatttggaaggaaaaacaaacccagacggctcaattggggttaccatttccttcagcgagagcacgtggcaatctgctgatggatttcgttgcatcaatgtagggttgatgcaacaaacgaaacccgttgaaatggatgctgatatgaccgataaggagaggctggagtactatttgagtcaggagagggagtacaagaggagaatcgagagggcgagaccctgcctcttgccgcgctacgtgcacaatgagatcctggacatgctcaagagacatggcatggtcagtgctaggctgttgcagaggattcgggaccgagtgcagaaatggtatcatgatgaaggctatgcctgcgctcaggtcgttaatttcgggaacctcaacaccaaggaggttgtttgtgaggttgttgaaggggatatcacacaattggatattcagttccaggataagcttggtaatgttgttgaagggaacacccaagtccctgtcattcaaagagagcttccccggcagctgcgctcaggttacactttcaatattgaagcagggaagcaagctttaagaaatgtgaactcccttgctttgttttcaaatattgaggtcaatccgcgccctgatgagactaatgaaggaggtataattgttgaaattaagctaaaggagttagaacagaagtcggctgaagtcagtactgagtggagtattgtccctggacgtggagggcatcccactctggcttcgctccagcctggtggcactgttagttttgaacatcggaatctgcaagggctgaatagatctattaatggttctattacaactagcaacttcttgaatcctcaggatgatcttgcatttaagctagagtatgtacacccatatctggatggggtgtactattcacgcaaccgtactctccgtgtaagctgcttcaatagccgaaaactgagtccagtattcactggggggccaggcgtggatgaagtgcctccaatatgggttgatcgtactggtgttaaagctaatattacagagaatttcacacgtcagagtaaattcacatatggacttgtaatggaagagataacaacgcgtgatgaaagtagtcatatctgtgcaaatggtcaaagagtattacctagtggaggaattagtgctgatggacctccaaccaccctcagtggtactggcattgatcacatggcatttttacaggcaaatattacacgagataacacccgttttgtgaatggaactgttgttggagacagaaatatgttccaggtgactctcattctacactcagtgcctttgaagttgtacatgtggaagcattacaccttcctatcagttttgtga

SEQ ID NO: 1520 - DNA, 615 bp, Glycine max
  Peptide Sequence Number=SeqID_118298
atggttgtgagagcaaggcgtagcgagtctccgtatgaagttttgggcgtgtctccatccgcaaccgtcgaccaaataaaaaaggcctatcggaaacttgctctcaagtatcatcccgatgtcaataaagaggataaggcacaggagaagtttatgaggataaaacatgcatacaatacattgctaaattctagatcccgcaaaaaatatgattctggaagtcgaggttatgatttttctcaaggaagccgaactaggaatatacaagctgaagaagagttttatggactagaggacttctttaaggatcttcaacaagaattcaggaactgggaagcaaacactgcttcacaaggaaagccaaagagtctatgggaggaattggcggaaataggagaagaatttgtggagttccttgagaaagaactcaatattactgatcaaaatgatgattataaaacgcctcagggaggcaacacatcgaactttcctgggacagagacaccaagcaatagcagtcaaggtcaagctggcaagggaagcagaggcgttgaggataaccttgaggaaatagaagccactctggctcagttgaaaaaggaactaggcttatag

SEQ ID NO: 1521 - DNA, 1182 bp, Glycine max
  Peptide Sequence Number=SeqID_118299
atgcctctgcctgcagaacgcacgtacagatatgttgacacttcaagaagtcctaccgccatcattagcgtggaacaattccttcgagctacaccaggaggggagtcttgtaggaagtcaccaacctactctcccacctcgtcttccccttcctctccttactttgagaagttgaagaaccaagacccagaagaagaccatggcctctatcagaagaaatcagtcctcaccaaagtaaaggagagggccaggaaattccgctacagcctcagcaagagaagaatggatgacgagaacgtcacaccctcttggggtgttagcttagaagaggatgaggaagaagaagaccctgaataccttggagctccaatgtatgaatcagagctggcacctgaggaatacaaagaatatgcaaggcaacatccaagagcaaatccagtaatctctgagaagcatgttttgcacaacgctgtcaaattaggagcggagcaggatcaacagaagtcacgtggtgctgtcagtgccaggttcacgacaacaactccaaacatgacatctgaaaccacagctcagaaactgacacctgtctatgttggagtgtcaaatgcagctaatgctatatcctccaaaattcaagctgtttctagttccacaactgctcctgcagccaacgacatgtcctcacatacctcatcacttccatcatcttcaatgcaaaattcatcatccgcttccctgagtgggaagaatacatcttgccaaaagagtgcttctctaagagataatttgatgaaccagtgtgaacaaggtgatagagcccgaaatgtgcctacaatgcaaaaatcatcatccttatctgcttcgatgactgagaataagaatattacaagcctaatgagtgcttcagttaaagattattcaatgaacaagtctgagccaagggatgatgcaaaaactgtgtctcagcctcaggtgatgatatctgaagcaacgagtcctaagagaacttctagtaatgcaggtgtgatggacaaggtgagaggagctgtgaattcattgctggggaatgaggaaccatcacaacaatatggagtcaaaactcctactacacgcacttcgtcacagcaaactcaacaagttgatcaggaagagaaccgtaggagaattctacaggaaaattga

SEQ ID NO: 1522 - DNA, 267 bp, Glycine max
  Peptide Sequence Number=SeqID_118300
atggctttggatgcaaatggcctctcttcaaatgtctatgttgggatgttatactgcactgaagaagcaattcagcaacttcctgtttccattataaacattgtttcgtcaaagttggtggcaatgaacttgacgccactggcagtgtcgtcgacggcctcacgcgccactatgggtttctccagatgcgggtgggtaggtggatggggaaggggagggcagagggcaaaatggaaaagaggaaaaagagaaaaaagatatgcatag

SEQ ID NO: 1523 - DNA, 384 bp, Glycine max
  Peptide Sequence Number=SeqID_118301
atgttttataaggaagaaacagtgaggaagaaaaagtttgagagaaaaacaaacaagcaaagaagaagaaaaaatgatccagtgcaatgcgatggatggttaagagagagagagagagagagagagagagagagagagagagaccttggtgtcctcgtcgatggtggaattaagatcgaagaggagatcaaagcagaggagtggaaactccaaatcggcaactctaaatcccaaactagtgaatttgtgagagaggttatcagggaaaatctgaatccgaccccgaacccgatcaacgcggtttttctccgtcaaagttggggcaagttcgatttggttcccacgggattggattccactgccatgcctgctttcaaggactaa

SEQ ID NO: 1524 - DNA, 480 bp, Glycine max
  Peptide Sequence Number=SeqID_118302
atgcaatcacagggactcacattacctcctgagtctaaggacccagatacgggtgactcagagaaatgtgggttgtatgtcgatgagattcctccccgcctggttgcccttggaagagtttatgagaggtcgacgaccatccatagcgtccctttgggcaatgatcaaatgaaggttggtgttgaggaagttggagatgttgatgcttgcattcctgtacccactaaagaggataaacaaggagctgagggatcgacaaaacctttagataagccggatcctaatgtcgatcccctatacctgatggcattgaccatcccacagtttttcctcaagtcgttgcaagtgtcgtgggatgctaccatgtttggggtgtataatgataactttctcttgtacataaagcatgaagatctttttgaaatagcacatagtggtcaatgtcttagcatttctgttatacaattgtggattttgtaa

SEQ ID NO: 1525 - DNA, 186 bp, Glycine max
  Peptide Sequence Number=SeqID_118303
atgcagcaaccatggggaggaatgaatccgatgcaagttgttggtgctgtgggcttccagcatcgacgtcttgacattccagatgatatggaccctacaattgctgatattatcaggaaatgctggcaaaccatttgcaatatattttggattgctgaaaggtctgtctcaaacaaaatagtctga

SEQ ID NO: 1526 - DNA, 1500 bp, Glycine max
  Peptide Sequence Number=SeqID_118304
atggataccttgtttagactagtaagttttcatcaacaacaacaacccgatccctccctcaactccacgaccagcagaacctccagcagctccagatcctccagacaaaactactacccttattcttcctatcaagaagaagaagaatgcttcaacttttacatggatgaagaagacttatcctcgtcttcttccaaatactactacccttaccaaccccatcaccaacaacaacaacaacaacaacacaacgtatccaacatttctacaaacaccttcagcaccacccccaacaccgattactcctactccttctcccccaccccacaagttcaagacttcaacttcgaattctcccccaactggtcccacaacctcctcctggaatccgcacgcgccgtcgccgacaacaactccacgcgcctccatcacctcctctggatgctcaacgagctcagctccccctacggcgacaccgaccaaaaacttgccgcgtatttcctccaagccctgttcagccgcgtcaccgaagccggcgaccgaacctacggaaccttagcctcggcgtccgagaaaacatgctctttcgagtcaacaagaaaaacggtcctgaaattccaagaagttagcccttggactaccttcggacacgtggcatccaatggcgccatcttggaagccttggagggaaaccccaaattgcacatactagacatcagcaacacttattgcacccagtggccaacgcttctggaagcgttggccacacggagcgatgaaacaccgcatctgcgcttgaccaccgttgtcacgggtagaacgagtaattccgttcagcgcgtaatgaaggaaatcggaacgcggatggagaaattcgcgaggctcatgggcgttccgtttaagttcaacgtcattcatcattacggagatctctccgagttcaatttcaacgaacttgatatcaaagaggatgaagctttggctgtgaattgtgtgaacaggctgcattcggtttccgccgtaggaaacaaccgcgacgcgttgatatcgtcgttgcaagcgttgcagccgcggattgtgacggtggtggaggaggaggctgatttggacgttgggatcgacggttacgagttcgtgaaaggctttgaggaatgtttgaggtggtttagggtttacttcgatgctttggacgagagttttgtgaagacgagcaacgagaggctgatgctggagcgagcggcagggagggcggtggtggacctggtggcgtgctcgacggcggagtccgtggagcgccgcgagacggcggcgcggtgggtggcgaggcttcacaacggagggctgaaggcggcgccgtttagcgaggaggtttgtgacgacgtgagggcgctgttgaggaggtacagggaagggtggtcgatggcggcgtgctccgatgccggaatattcctctcgtggaaggacacgccggtggtgtgggccagtgcatggaggccataa

SEQ ID NO: 1527 - DNA, 906 bp, Glycine max
  Peptide Sequence Number=SeqID_118305
atggcaaaggaatacggcgtggtctggctttggactccagcaataaacgaattacagcaggaggtggcggaggagggagttgctcatcacatcccccattcattcacaagattgagggggcccctaaccaaacctaatagcttcagaggatccatcatgcccactcaccatgcttccgccgccatttttggtattataggtaacatgatttctgtgatggtgtacttggctccggtgccaacgttttaccagatatacaaaaagaaatgcacggacggtttccactcgctgccatacttgttgtcattaatgagttctatgctttggttatactacgccttcctcaaaattcatgacggcgttgttccccttattacgatcaactcgatcggatgtgtcatagagctcatctacattctcacctacattaagtatgcgcacaaggatgcaaggaacttaacctatacgctattcgcggccatgaatattgccttcttgaccttggtcctttcctcgcattttgctctacatggttcccaccgtgtcaaagtcattggatggatttgtgacgccgtttcgctcagtgtctttgcatcacctctaagcattatggcaaaagttattagaacaaagagtgtacagtttatgcccttctatttgtcatttttcctcacactgaatgccataacgtggtttgtatatggtttatctatccaagacaaatgcatttatgttccaaatgtgggggggtttggactggggctagttcagatggtgctatatggcatttacaggaacggcggtgagagtgagaaggagcaagctttagctgaaggagcgataaacattgttgttgtgaaccccttggggcctgctgaagtcttcaatcgcagaggaagtggatga

SEQ ID NO: 1528 - DNA, 397 bp, Glycine max
  misc_feature (68)..(68): n is a, c, g, or t
  Peptide Sequence Number=SeqID_118306
tgacgtggagttgcacgtgctggtgaggaggatgagggagggaatgagggagtttgtggagacaaagncggagaggttcaaagaggatggtgcgtttggagtggtgatggaaagtctgaaggagaggggtgaagctgtgtggatgtgcagtgtgaataagatggtgagtaataccattgccttgatggatactagggatggtcatggggttgaagcttttgtcactcttgatcatcaagacatgactttttttgaacaacatcaggagctcctacactatgctttgcttaatcctacttctaatgatgaaactggtatagaggagttcttgaacttaggatctagctcaaaaactctggttaaagatactcttagatttgagaagttcatgaattga

SEQ ID NO: 1529 - DNA, 1476 bp, Glycine max
  Peptide Sequence Number=SeqID_118307
atgcataaaccagcagaggcactagactttgctctcaaggagacttcacccaacataggtgcgggtgctgtaatgagggacaagctttcctgtacctatgacctggttgaacaaatgcagtacctctatgttagagtggtgaaagccaaggatttgccagggaaagatgttactggtggtgtggatccctatgttgaagtgaagcttggaaactacaagggccttaccaagcactttgagaaaaattccaatcctcagtggaatcaggtttttgccttctccaaagaaaggattcaagcttctgttctggaggtggtgatcaaagacaaggatgttgttgtggatgacttcgtagggagagtgatgtttgatattaatgaaatcccaaaacgtgtgcctccagatagccctttggctccacagtggtacaggctagaagataggaggggtggcaaagccaaaggagagttaatgttggcggtttggatgggaactcaagcagacgaggcatttcctgatgcatggcattctgatgcagcaactgttggtcctgaagctgttgcaaacataagatcaaaggtttacctttcacctaagctttggtatgtcagggtcaatgttattgaggctcaagacttggtaccaagtgacaaaacccggtatcctgaagtctttgtgaaggctaatctgggggttcagtttttaagaactagagtatctcaaagtaaaaccataaatccaatgtggaatgaggacttgatgtttgttgctgctgagccatttgaggagcccttggttctgactgcagaggacagggttggaccaagcaaggatgagatcctgggaaggtgtgtgattcctttacacaatgtgcaaaggaggttggaccacaagcctgtgaacacaaagtggtttaatctggaaaagcatgtggttgttgaaggggaacagaagaagaaggagatcaagttctcaagtaggatacatctgagggtttgcttggaaggtggctaccatgtgttggatgaatcaacacactatagtagtgatcttaggccaactgcaaagcagctgtggaaggctagcattggaattctggaagttgggattataagtgcacaagggttgatgccaatgaagacaagagatggtagaggaaccacagatgcttattgtgtagcaaaatatgggcagaagtggatccgtactaggacaattgtggatagtcttgctccaaggtggaatgagcaatacatttgggaggtttttgatccatgtactgttatcacagttggggtttttgataatggtcacttacatgggggagacaaatcaggtggatcaaaagattcaagaatagggaaggtgagaattaggctatccactcttgaagctgatagggtgtacacacactcttatcctcttttggtactgcacaattcaggtgtgaagaaaatgggagaagtgcaattggct

SEQ ID NO: 1530 - DNA, 183 bp, Glycine max
  Peptide Sequence Number=SeqID_118308
atgctcctgcataaaatagttctgttggtggggtcgttgtcctacgattcctacggttcttacccctataagagtaacttaacttacactgttaagtgtggtccagctgaaaacggcattgtgtctgttggaaggaaacggacaacgcagaaggaacccttctacactgctacgtttggatga

SEQ ID NO: 1531 - DNA, 297 bp, Glycine max
  Peptide Sequence Number=SeqID_118309
atggatgaaaagagaaagtcatcatcaaagaaggacacgggttcctcttccacaaggtcattattctcaaggagcacctctacttcaaactctcctctccttagaagcctgtctcaaaagagttcttcatcttcctccaaatgcaataacaataatcttcctaggagcttctcacagaagaacccttccattgggcgcaaatgcaccaaattagctaaggaacagaaagcacggttttacatcatgaggaggtgtgttgccatgttggtttgctggcacaagcatggggattcatga

SEQ ID NO: 1532 - DNA, 186 bp, Glycine max
  Peptide Sequence Number=SeqID_118310
atgaagccaggtgccctcatcacttgtctttcccaaagcatgcagttattcaaagagaagaataaaatgtatcttgtacaattagatgaagttaggcataagacaaatatcaaggaaagtagcttaaaccacaatctcatggcttctgtttcactcaagcacaggattcaaaggcttagattctaa

SEQ ID NO: 1533 - DNA, 708 bp, Glycine max
  Peptide Sequence Number=SeqID_118311
atggcgaggcgagagctttcaagcacgttgaagaacttaaagttcatgcaaagggcagctctgagggaggagagaaccaagaaagaagaagaggttaagcctgatgtcagtgttggcacatccactgcggttactagaaagtgtgtggttataatggaaggtgatccccatcctggagcagctaaaggtcgaatgtcatttcaaagtttcaatcctttagttgataaattaaatgaggaagaagcaagactacatcagccagcagctgaaactaccatgtctagaaatcaaaatgcaaatgccaatatcagagaaaataggtctccagtagaaggtccagaatgtggcaacatggacaaaaagattgtggaggttaacggcaatgctaaaaggaaacaatctgattatgaagcacaatatcctaacaaatcaccgaagaacgatcatgatgataaacattcatcgccaagcaatagtttgggctcttttaaaaaaccgagtggagataagctggactggaaagttcttagaccatctagtgttaaacaaaaaaggcttggtcaaccacttgccccaaaatatgaatggtgtgttgtgtacatatatgggcaagaatttgagttagctctaaatgatgattcagtcttgagagttgagaccattggatacatcgtggagaaatacggggacaagtcaaactcaagttga

SEQ ID NO: 1534 - DNA, 1311 bp, Glycine max
  Peptide Sequence Number=SeqID_118312
atgggaatggtctatgctgacatggactctctctctctttgttccaactacggtgtggtttcttctcatcaagataattgctatgtctccaacgggggcacaaactggggttttcccttcatgagggaatgtcccaactttgaggatcaccccaacaacagtgatgatgttgctgaagagggtaaagggtcttatagcagtggtgaagacagtgacaaagttaaccataatgctaataacttcaacgatgagaacagccctaatgagaattctaatagtggcggttccgggcattccaagctttgtgctagagggcattggagaccagcagaagattccaagctcaaggagcttgttgctctttatggccctcagaactggaacctcatagctgagaagttagaaggaagatcaggaaagagttgtaggctgaggtggttcaaccagttggatccaaggatcaataggagggcattcagtgaggaggaggaagagaggctaatgcaggcacataggatttatggcaacaaatgggccatgattgcaaggcttttcccagggagaacagataatgcagtgaagaatcactggcatgttataatggccagaaagtacagagaacagtccagtgcctacaggaggaggctgagccaatcttcttctgtttacagaagagtggaggaacttaacacaacaacaacaacaagcagcactcttgtctcaagaaacacagccgctgcagaacaacaaccaccaccaccctattgtcttaatcttccaaataatggaggacttgccaacaacattaacatgcctagttctccatatgctgcaacacccttccatggaggagtagtggctgttgctccttctagtggggttgagtttggcttattaaatggctcaccccacatgactgctgccaaagaagcattctcaacccccaagctggtccctcatattgccttgtatcctcaacaaacaccacttgatttcttttcaggtgttagaagcagcaatgacatggtgggagagtattttggacagaacgatcatcaccaaccatcatttggtttcaaccctcaatacccccaatatgtgatgctaatgcagcagcaccaacaaaacaatcacaactacggattctcaaattccacagcacagatattaggccacagtgaagcctcactatcatcagtggcagcagaacacagagatcatcaaaacgtgagcagtgatcagtgccccccagatgcaacaacaacaattccacctccatttattgacttccttggagtaggagccacatga

SEQ ID NO: 1535 - DNA, 1974 bp, Glycine max
  Peptide Sequence Number=SeqID_118313
atgtcttctaatttcttggtcgagttcaacatgaactctcttgtgcaaaactttggtggtcctatctcagtattttcaaatcaggaccaagtagagaaggggtttgactttgagtttgatgattcatcttccccttcttccggcacaagctcaggtggagaatccacagaggtaaccaaatattccaacccaatcctcagatacataagcgacatactcatggacgaggaagacgacttggagcgcaaaccctgcatgttgcaggaatgtttgagactccaggctgctgaaaaatccttccatgatgcccttctccatcaaaacccttcttcttgtttctctgatgaaaattatggtcgcactgttagctttgagagctgcaccactgataattcatgtgagtctgaattggtcaacggtgttggtgaatttgattcttctttcttacaactacaaacccctctggttcatgatccatttggggagtcacaagctgctggctattttcatgacggaacctggaatctcttccagtctcagtctcagaccaagccactgatggtggaagagggttcttctgcttcagcaccaagagaaaagagaagccatgggatggatgattatgcttctcatgaacaggaagggagaagaggcagcaaggtttcagccgtcttttcggacgagtcagagtcaccagagatcttagatgaggtgctgctttgtcaatctggaagaagccaagccctcctttgtgctgctactgaaccatcacaaagtgttgatttaggagggtccaatggaaaggcgacacgatcacgttcaaagaaagtgtctgccaaagccggtacagctgtagatttatggacccttctaactcaatgtgcacaggccgtggcaagctttgaccaaaggaacgcaaatgacttactcagccagattaggcaacactcttcagcttttggagatggacttcagcgtttggctcattactttgccaatggccttcagataaggttggctgctgggactccatcatacacgcccctagaaggaacaacttccgccgatatgttgaaagcttacaaactttatgttacatcctctcctttgcagaggttgacaaattatttggcaaccaagacaattgttagtcttgtgggaaatgagggcagtgttcatattattgattttggcatttgctatggttttcagtggccttgccttatcaagaagctgtcagaaaggcatggtggtcctccgaggcttcgtataacaggaatcgaacttcctcagccaggatttcggcctgcagaaagggttgaggagaccgggcggcgtttggcaaactactgcaagaagttcaaggtaccttttgaatacaattgtcttgcacagaaatgggaaactataaaacttgcagatctcaagatagacaggaatgaagtaactgttgttagctgcttctaccggctgaagaacttgcctgatgaaactgtggatgtgaagtctccaagagatgccgtgttgaagttgataaggaggatcaatccaaacatgttcatccatggggtggtcaatggcacttacaatgcaccctttttcctgactcggtttagggaggcactctaccacttctcatcactgtttgatatgtttgaagctaatgtgcctcgtgaagacccggaaagagtgatgcttgagaatgggttgtttggaagagatgccatcaatgttatagcgtgtgaaggggctgagagggttgagagacctgagacctataagcagtggcaggttaggaaccagagagctgggttcaagcaagtccgatttgatcctctattggtgaatgatgaaaaagaaatggtgaagaaggaatatcaaaaagattttgtggtggctgaggatggcaagtgggtttggctggggtggaaagggcgtattctgaatgccatttctgcttggactcctgcttaa

SEQ ID NO: 1536 - DNA, 867 bp, Glycine max
  Peptide Sequence Number=SeqID_118314
atgaaaacgatcacagtcctaacctataaaagctgtaaccgtgtgttcttccgaagcatgcacacgcagaccatcagtcatctttctagtcttctgataactatgagatgctcaatatgcaaacctttgaacagttttatcgttgttaccctgtttccttcattgagaagccagatctggaaaaaggtgataaaattatcatgcctccctcagcccttgatcgccttgatgatggaaaatatgcttctccaagagggagacattgtaaaagtgaaaattgccacccttgcaaaaggaaccttagagactacacttaggagctactcatgtttaacagccggtgacactataatggttccttataacaacaagaagtattacatcgacatagttgaaactataccctctcctgcagtcattataattgaaacagactgtgaagttgattttgctccacctcttgattataaagaacctgagaaacaagcaaaacctgttgtatttgacaggaaacaaccagaagttgaggatgagccgccagcaaagattgcccggttgactccattcactgtttctggaagacatttggatggtaaaccttcagcacaatcagtcgaacaagcatcctcttcagagctaaaacagaaacaaactgacaaagaaatcaagggttctgattctaagtcatcaaataccgtgtctcgtagacattcaggaaagcttgtgtttgggtcaaatgctactacatctgacgttcaaacaacacctaaggtttctcaagaaaacacctgtaaagagaaatctcagaaggaacaagagccaaaattcaaagctttcacgggaaagaagtattcattaaaaagttga

SEQ ID NO: 1537 - DNA, 1836 bp, Glycine max
  Peptide Sequence Number=SeqID_118315
atggtggtgacaattgataataatgatggtggtagcgataaccgtgtgatgactgcaacggtggtcataatggtggtgacgacagttacactgatgattatggtggtggagaaccaagtagcgaaggggtttgagtttgttgattcatcttccccttcttccggcacaagctcaagtggagaatccatggagtttactaagtattcaaatcccatcctcagatacataagcgacatcctcatggatgaggaagatgacttggagcgcagaccctgcatgttgcaggattgtttgagactccaggctgctgaaaaatccttccatgatgtccttctccatcaaaacccttctcctttccgtgatgaaagcgttggcatcatacattctgatgaaatttttggtcgcactccaaaaacccctctagttgattccccagatgcagttcctgatcctccatttggggagtcacgtcctattggttattttcttgatggaacctggaatctctttcagtctcatacaaagatggtagaaaagggttcttcagcttcagcactaagagaaaagagaaaccatcagatggatgattatgagtctcatgaacaggaagcaagaaaaggcagcaaggtttcagctgtcttttatgacgagtcagagccaccagagatcttagatgaggtgctgctttatcaaaccggaagaagtcaaccactctatagttctcctactgtgccatcacaaactcaaagggttgatttaggaaggtccagtggaaaggaagcacgtgcacgttcaaaggaagtgtcctccaatactgagacagctatagatttatggacccttctgactcaatgtgcacaagcagtggcaaactatgaccaaagaaatgcaaatgaattactcagccagattaggcaacactcttcaccttatgggaatggacttcagcgtttggctcattatttttccaatggacttcagataagattggctgctgggaccccatcatatatgcctctagaagtggcaactgctgctgatatgttgaaagcttacaaactatttgttacatcctctcctttgcagaggttgacaaactatttgacaaccaagtcaatcattagtcttgtgaaaaatgagagcagcgtccatattattgactttggtatttgctatggttttcagtggccgtgccttatcaagaagctctcagataggcttggtgatcgtccaaggcttcgtataacaggaattgatcttcctcagccgggttttcggcctaaagaaagggtcgaggagaccgggcggcgtttggtaaacttctgcaagaagttcaataacttgcctgatgagactgtggatgtgaagtgtccaagagatgctgtgttgaggttgataaggaggatcaatccaaacatgttcatccatggggtggtcaatggtacctatagtgcaccctttttccttactaggttcagggaagcacttcaccacttctcatcactgtttgatgtgtatgaggctaatgtgcctcgtgaagacacgcaaagagtgatgctggagaaaaggttgtttggaagggatgccatcaatgttatagcgtgtgaaggggctgagagggttgagagaccggagacctataagcagtggcaggttaggaatcagagagctggtttcgagcaagtccctttggatcctcagttagtggttgatgctacggatattgtgaagagggaatatcacgaagattttgtagtggctgagaatgacaagtgggttttgctggggcggaaagggcgtattctgaatgccatttctgcatggactcctgattaa

SEQ ID NO: 1538 - DNA, 1039 bp, Glycine max
  Peptide Sequence Number=SeqID_118316
gttgtctccatatgtggccaatgctctcgaggctcgcttagttggtgatggaactgccacccaaatattttatatgagctacaagaagttcactactactgatttcctgagagcttaccaagttttcatatctgcttgccctttcaagaaatttgcacatttctttgcaaataagatgattatgaaaacagctgatggggcagaaacgcttcatattattgactttggtatcctctatggtttccagtggccaattctcataaagtttttatcacgcagacctggaggcccccccaagctgcgcatcacaggaatagagtatccccaacctggctttcgtccgactgaaagaattgaggagactggtcgtcgtctagctaagtattgcaagcgtttcaatgttccctttgagtacaaggccatagcatcgcgaaactgggaaaccattcaaattgaagacctcaaaattgagcgcaatgagctgcttgctgtgaactgtctggtaaggtttaagaatttgcttgacgagtcaattgaagtgaacagtcccagaaatgctgttctgaatttaatcaggaagatgaaaccagatatttttgttcacagcgtagtaaatggatcttataatgctcctttctttctcacacgcttcagggaggcactgttccattattcttcaatttacgatatgtttgatactctcatatcccgtgaaaatgaatggaggttgatgcttgagagagaatttttgggccgggagataatgaatgtggtagcatgtgaagctcttgagagggttgagaggcctgagacatacaaacaatggcaggctaggaatactagagctggttttaagcagctcccactggataaggagataatgaccaaatttaggggcaaattaagggaatggtaccacagggattttgtctttgatgaagatggaaactggatgcttcaagaattcatactggatggaaggtcaccttcagctgttgtgaactgtgatgaatattcttcccaggtttgcaccaagtga

SEQ ID NO: 1539 - DNA, 4530 bp, Glycine max
  Peptide Sequence Number=SeqID_118317
atgctgtccaacgcctttcgcagggtcaaatctcccttaccgaaaggccaggcttccttgtctcagaaccaccattccctcaacatcaaaatagacaacatccatgcctccctcaccacccaaatcgagtccctctttgaccgcctcgccgccgtcgcggtccctcactcttcccccgtctccgccacccaacctcccccttccccaatttcacgccaccatcatttgaagcttgatgtcccgcgattcgatggccacgaccccctcggatggatattcaaggtgtcccagtttttcgactaccaggggatcccagaacccgagcgccttactatagcctccttctacatggacggcccggcgctttcgtggtaccagtggatgcaccgtaacgggtatttcccctcctggcccgcgatgctccaggctctcgaatcaaggttcgccccttcgttctatgatgaccctcagggcagtctcttcaaactccagcaaaccggctctgtcacagactacctcaccgccttcgaacgcctcgccaaccgcacgattggtattgctccctcctccctactcagctgcttcgtttccggccttatccccgagctccgccgcgaggtccaggccttacgacccatgtcccttcctcaggccatcgaactcgcccgtcttcaggaggataagttgatcgaccgccgtcgcgggtcccgtcctccgttcccagccccgccgcatccctcccctgccccaccacaatcattttccccaaaacccactacatcacctttccccaaatctcctacccctctcccttccccgcgcatccccgtcaaacgcctctccgccgaagagttagccatccgccgcgatcaaggcctttgctaccactgtgacgataaatggtcacatggtcatcgttgccggtctcgattacacctactcctagctgacgaagatattgagaaccctaatattcccccggaccctaacccagaccctcctctcgtttcccagatcagcctcaacgccatggaaggaacagttgctccccagacgtttcgcctcctcggcatgattggccaccatcaattgattgttcttgttgacggtggaagttctcataacttcattcagactcgaataacgcgcttcttggctctccccactgcccctaccccgccgttacgtgtcatggtaggaaacggcaataccttagattgtgacaccctctctccccaaacccttatctccctccaagggcatgactttgctcttgacctcttccaccttcccctctgcggcgccgatatagtcttaggggttcagtggctgaaactccttgggcccgttaccacggattactccgcgctgaccatgacttttccctacttgggccacactattacactatttgctgacgcaccccccaccttaacctcagcctcggcccatcagcttaaacgttttgcccaaactcacagtatttccgcattataccacataacccccataccggcccaacccatctcacctttaccagcttcaccccctacccctccctccatcaccatcgtcctcaaccgttatgcctccatttttactgaaccagaccatctacctccttcccgcaacatccaacatcacatccatctccttcctaactccacccccgtcaatgtaaaaccttatcgctacccccacttccaaaaaaccgaaatcgaaacccagatttcctccatgctagcttctggtctgattcagcccagccatagccctttctcatccccgatcctattagtcaagaaaaaggatggatcctggcggtgttgcgtggactatagagccttgaattccattacggttaaagaccgatttcccatgcccacaatcgatgagttgttggacgatttgggcaaggcttcatgtttttcgaagctcgatttacggcagggtttccaccaaattcggatggcagcttccgatatccccaagacggcttttcgcactcatcagggtcattacgaatactgcgtaatgcctttcggcctgtgcaacgcaccttcaaccttccaggcggccatgcacgacgccctccggccattcctgaggaagtttgtcgccgttttcttcgacgacatactggtttacagcccagacattcccacccatgcttctcatctggactctgtactctccacattacttgccaaacagttcttcctcaaagcttctaagtgccttttcgcccaatctcagctcaattatttgggacatatcatctcggcacagggcattgctccagatccggataaagtccaggccatgcttgattggccgattcccaccaccaccacggcccttcacggattcctcggcctcaccggcttttatcgtaaattcattcagggatacgcttctgtagccgctcctcttaccgcacttcttcgcaaggaccaatttctctggtccccgacagcatccacggcttttgacaccctcaagaccttaatgacccaagctccagtcctagctaccccggatttttctctgccatttatcctggaaacggacgcgtctgcggtggctatcggggccgttctcctccagcgacaccaccccatcgcctacttcagcaaagtactatgccctcgtttacaacgggcatcggcgtacgtccgtgaacttcatgccattacggctgccatccgcaaatggcgtcattacctcttgggctcttcattcaccatccttaccgaccataggagcctcaaggaccttatgtcgcaagtcattcagaccccggagcagcagacttacctcgtgaaactcctgggatatgattacgacatcaaatataagccgggaagctctaatattgttgccgacgcgttgtctcgtcttcctcagggcgaatgcttttccttctcagtcccacactacgactttatggataagctccgccacacgcttatgcaggatccccagtatcgggacttagtacaccaagttcagtctacacccgcggctcatccttccctgtcggtacacaacgatttacttttccgccatcaccgactttggcttcctttccccactcatttcactgaggtacttatggaggaatttcattccactccccttgggggacacaccggcgccaccaaaactcttcaccgccttcgtcaaagctttgactggcccaacatccgttctgatgtccgccgttttgtggcccagtgtactacctgccaacagacgaagtacgaaccacagaagccaccgggcctgcttcaacccattcccctcccctccgcggtatgggaagatctatctatcgattttataaccggtcttcccctttcgaagggatacacagtcattctagtagttgtagaccgttattcgaagggtgctcactttggtccattacccaccagtcacacggctcatacggttgcttgcctcttctttgacatggtttgtaaacaccatggttttccccggagtttaatctccgacagggacgctctgtttctcagcagcttctggagagaactctttaagcttagtggcactaagttacggatgagtacggcataccatccccagtccgacggccaaaccgaagtggtcaaccgcgtcctggagcaatatctccgctcattcgtgcatcacaagccccatcactggtctcgctttttatcgctcgctgaatggtcttacaataccactgttcattctagcacgggctacacccccttcgaagttacctacggcaaagcacccccttctctaattgactatgtccgcgggacctcccctattgatgctgtcgattccatgctaacggatcgcactgaacttcacaacacattactccggcgtcttcgcaaagctcaagagttcatgacgacttctgcgaacaaacaccgccgtgatctacaattttccgtcggagattgggcttatgtcaagcttcgaccctatcgacagaagtccgtagctcctgcctactccaaactctccaagcgctactacggtccttatcaagtgatcgaacgcatcggctccgtcgcttatagactccagcttcctccgtcgtctcgcatccatccggtgttccatgtctccctgctgaaacgtcaccagggccctctttcccttacctccgctgccctaccaccgtccagcgtggaacatcatcccctcgtcactcctttggcgttcttagattggcaatgggacacctcggttaccccggcggctcgcaaggtgttggttcagtgggcgggtcttcctccagagaacgcctcatgggagtcttggtccgatgtgaagcacacttttaacctcgaggacgaggttccttttgaaggggagggcgatgatagcaacatccaaataacagaacacatagagactgcagcagtcccaaactacacaacagacaacaaagaggaattcacagctatgaatagcagaagcaaacgtgacactcacaggcccaaataccttgcagattacgtgtga

SEQ ID NO: 1540 - DNA, 315 bp, Glycine max
  Peptide Sequence Number=SeqID_118318
atgcttggaaccgatttggctttggtgaaagagttttatgcaaacctatacagctatgagggcccttcaccaaagaaagccagggtcaaaggacatctagtgaagatcgatgctgacagcctcaacacattcttagagacacctgtagtgttggcagagggtgagactttacccacatactctagatactgcaggctgcccacagattacagagagattgaggctgccttgtgcataccaggccgagggttcctcttgaacgctgagggccatcctgggaggattctcaggaaatatttgactatgttagcacag

SEQ ID NO: 1541 - DNA, 861 bp, Glycine max
  Peptide Sequence Number=SeqID_118319
atggatccaaactttatcattagcggctacgactttgatgaatcaaaccactgggatcttaacggacactacgccaaccttctcaatgatgctttttccgatgtgggcccacttggtctttctcagaatgcaattttgaactcggagccctttgtttcatcctctggttccgccgccaccgaccccgccgctaccacggcgactttggctgatccttcacccgaagaagacactgatttctcagaaaccttcaagttcattagtcaaattctcttggaagagaactttgagcagaaaccgtgtatgtgttatgaccctctgaccttgcaacacactgagaaatcattctatgaggctctggaattggaaccatcacttcctctttcccctaatcagcacccgcttgagagccctgatgggaattcttctaattccatttctgattccgccaattctcatgatttgaagccttcttcacccaatacacctgtttctgatgctttgcattcttcttcccacgcgccctcttttgttgttccaccccatgctctgaataaaattaatgatggaaccgtggatttggattcttccgtaaccaagctcttggctgaaaatattttcagtgatactgactctatgttgcagtttaaaagagggttggaggaggctagtaagtttcttcctcggaggcctcagcttttcactgggttggagagcaccgcagtgtctgcagagccaaagggaaaaggtgtagctctgaagatggagaattcaattggggtgaggagtagaaagaatcatgcgcgccaagatgaagaagaagaagaagaaagaagcaacaagcagtctgctgtgtctgcg

SEQ ID NO: 1542 - DNA, 2949 bp, Glycine max
  Peptide Sequence Number=SeqID_118320
atggcgcttcaaacaatctcgcttttgcaagctactaccattgctaagcttcaggaagataagctacgagatagagcaacttcaaattcacgaaactcctaccaacctaagcctttacctagccacatccctaactcaactatgaaagctaagccaccctatgtgcaacgaactccagctgaaatggctttccgacgagaaaaaggattatgctacaattgcgatgagaaatggaatgctaatcatcaatgcaaaggacgagtaatgtttctcatcgctgatgagcaatcaccagaccctgatgcaagtacaccagaattcaaagaggagcaactcgcacttgctagcgatcacactgagtcaccttcagacacaagttgctcgcacatcagcctccatgcactatcaggtttgccttcatcagaaaccttcaggatatatggcactattaagaatgtccggctaaccatcctagttgatagtgggagtacttgtcgaaaatggttctacgttagcttgcaatcaggtttgcctcgaaactttggtcacttaggccaggacatttcgttgactacggatcgtcctaccggaaaatcgacccgagccaaccacgacccaacaccccatcctttccattcagcatcttcttctcaaatacgatcatctatttcagaccccctcgcagctaccaccaccacgccaggtggtacatcgcattactctcgctctgtccacagccctatcgctacccgcatttccaaaagaacgaaatcaagagacagcccgtattcgtcgctggtgctcttagtaaagaagaaagatggcatgcagagactatgcgtcgactacagggcactcaatgtagtcacagttcatgatcatttccccattccgacgatcgatgaactgctagacgaactgggccatgcctcctggttttccaagttggatctccggcaagggttccaccaaatcctgatgaatgatgctgacgtcgagaaaacaacttttaggacgcataacgaacactatgaatacttagtgatgcctttcgggcttagtgagttttatcttaaacaatctaaatgcttatttgcgcaggagaatatcgaataccttggacacatcgtctccggtaagggagttacccctgaaccttcaaagattcaggccatggtgagatggccaaacccgatgacggtcaaggaattatgcgttttcctaggtctcacaaggttctatagaaaattcattaagggatatgccgccattgcagcccccctcacgagcttactatgtaaagatgccttcacatggacgtttgaatctcagatagcttttgaccaactcaagtctgccatgactaacactcccgtgctagctctaccaaatttctcagaacccttcgtgatcgaaaccaatgcctccgggacggccattggtgcagtgcttatgcaaaacaaacaccctctggcatacttcaaacttcatgccatcgttgcggtagtgcgaaaatggaggcaatatctcttgggacgatcgttcactattctcactgaccacaagagcctccgcgagttgatgacacaatacaaggccgacgcaatcaacgtggtggcagacgcactttcacgggctccagaaccaacagggcaactgcttattctctcagttcctcaactagattttctcaatgatataagaaaatcattggaggttacgttggagtttcaacagctcaagaattcgattcaatctaacccagcaaatcaccccaattatacactctgcaacgacttgatcctgtttaaaggaaggatatggttgaacaatgataattcgtgcattcccatcctgttaactgagtaccatgcaacaccactaggtggccatctcggcttggccaagaccacccatcgtatcgaatccagcttcttctggatgaacctaaaacaagatccttctgtaaccattaccgataccggcaggggtgtgggaagacctatctatggacttcatcacacacctacccctctccaatggcttcacggttatatttgccgtggtcgatcgatattccaagggagtacacctaggagctttgcctactggcttcaccgtgttcaaggtcgcaagcttattcttggatatcgtatcaccgcctatcaccctcaatcggatgggcaaacagaggtgatgaaccgcatccttgaacagtacctccactgctttgttcactctcagccggcggcgtggttcagctacttagcccttgcagagtggagctacaacacctccttacattctagctctgggttaacgccatttgagatcatctatggcaagccacctccagctgtacttgattatgttgctggcgcgaccaacaatgaggctacccagtccttgctcacgtcccgccaggcactacattctaagctccaaaagaggttgcaaaaagcccaggacacaatgaagcgttatactgatcccaaacgcgacgatgtctccttcgaaatagggcaatgggtttatgtaaaactacggccaggccgtcaaagctccgtcgtcggacgccaccactccaagctctccaaatgcttcttcggccccttccagatcgaggagcgtatcggtgcagtggcatatcagctccgtcttccacctgagtcccaaatccaccctgtattccattgttctcttctccgagctcatcacggacctcaaccaccagcaaaggaaagcgagccaccagaagacacgtcatgggagccttggctcgacctgtgtaagacctaccaccttgaggacaaggtggatttgggagagggaggtattgttaacaaccaggctcagacgcaacccgcccccacaagaccagctcgaatcaggacaacgccatcacacttgtacgactactacgtagatggattacctgggtcaccatga

SEQ ID NO: 1543 - DNA, 216 bp, Glycine max
  Peptide Sequence Number=SeqID_118321
atgccggaaatcaaaaggaagcattgttacgcaatctgtgaggatgttcctccagaaggcggttgcttctggaggaagcaacctggctcgcctgggcgagctggaaaatccaagctgaggcgcttccgtaacgtttccatgggtgatttcgcgaagattttcaaccgttcttcgtcgttcgtcattcgttcttcgtcgttcttcagtcttcaaccg

SEQ ID NO: 1544 - DNA, 588 bp, Glycine max
  Peptide Sequence Number=SeqID_118322
atgctagtgagacagatatgggagggcttagaacaacaacttgtgaacaaaccccatttacagaatcccatcaatggagctaagaaggttcctagagctgttggaaatggcaaaggtccaccaccaccactaccacaacaggaactaccacaaaaccaaacttcacctcaggcaaggaacaacaggagaagaaggagtagaggtgaaggaagaaaatttgatcaaggagatattttgatgagacctattgtgactagaggtgttgaaaatggaagcatcatgtgtggtgaaaaagatatgagttaccctacttcaagcaagtctttgagctttgcttctagacctggctatggacaagttggaagaaagtgcattgtcaatattacagctgaagtgtcttccaaagcagtgaacaggtccattatagcagaactagtgaggctgtataaagagtctgaccttgggatgaggcttccaacatatgatgacacaaaaagtttgtacactgcagagccacttcctttttcatggagagagtttaagataaaggttgttgatgatgaagatggagttaatggatccaagtaa

SEQ ID NO: 1545 - DNA, 1188 bp, Glycine max
  Peptide Sequence Number=SeqID_118323
atggctgacagtgattctaggggtttgattcaacaacccctgatggacaaggaggtcatttccattggcggttcctcctcagaggatactcattatggtgcctccaacagcgagtcctcctcctcagaaagggagcttgtcccggttactataatcctccccccttctgcttttgagggagtgagaagtagtggcaatggagatgtcaaggcatctccccatgcacgacgtagccatagcgctggatcgccatcgtccccacctactgttgctggctatgacgagcgtcgctactttgtaatgccaagtgaaactgggtggcgtcaggttgtacgcccttcttctttatgtatgggtgcttgtttgagcgtgtccaaaaagctgttcgagtttgacttgaattcctttttccatttcaaggatcgtttcttcaaggtcctagacttgggtgtcatggttgatgagggtggacaaggccatcttggagcagctactgacctcgctagacgcatgggctattttgtcccttccctcgacgagcaatcctctcgctgccttggacggcttgaactaacacttgcttgtgttgttgttgctcattttgcaagaattatgggtaacttcgcctggtggccactcgtaaagctggtcagacttgcaggtgggactgtgccatcatctactgttgctcccactgaagggggtcaacctgttattgaggttgaccctattcttattggtactaccgatatagctctcagtgccccttcctctgtattgtctaagaggaagcaggatgatagtgtagggttgacgcttgttgcgggtcgcacttcaagtgtgcaagatgtgccttcggctccaccgaccgtcgaggctcttgctactgatgttgttgttgttgttgttgttgccgctcctgttgctgctgaagtgagcgtgctagctgctttggctggttttgttgttgcaccctcatccatcattgttgtaccattactgagtgctggtgtggtgaccaccagtgcccctatggtgcctccttcttcatcttcaactccaatggtccctctctccattgcattggcttcgcattccatcttctctaaccctcgtgtttccctggatcacatttacacttccaatgatgctaattccttgtggggcatggggcacaaacccgaatag

SEQ ID NO: 1546 - DNA, 438 bp, Glycine max
  Peptide Sequence Number=SeqID_118324
atgggaaattcggctaaagttgtgataaaacaagacatgaagggaagaacacataaatatgggtttaacaacaacaaacgtgagaaggcacagaagaaaagggtggtggatgatgaaactggcgacagacatcagctggatgaagtcgtggacatcacctacgagaactggaaggagttccctactgctcagaaggacctgatttgggaggatattcaggcggaatttgatatcctagaggcttcttacagtaggacgaaaaggaagttactacagaccgtgggggagagatggaggcagtttaaatcagacctcacaaggaaatgggcccatgcagccgatcaagacggtgtcgaggacactgtctgtgacaaatacagcatcaacaagggaaaatgggtccagttttgccagactcgcagagactcttcttgggag

SEQ ID NO: 1547 - DNA, 297 bp, Glycine max
  Peptide Sequence Number=SeqID_118325
atgaattgtgatttagctggaggagagcatcaccatgacagttgttatttttactctataaataactttgaccaaagacaggaactggccatgtacgactaccatgagaaagaaagaaccccagatcttgaaagtatattggcagacttcatgacataccaagctagctctaaaggttactgttattcaatgcatcagcagggaactctctttgaaagggactattcttctacagattatcaaagagagtcactgttcggcttctggcaagtgcaccggatcgcacaagtagtataa

SEQ ID NO: 1548 - DNA, 233 bp, Glycine max
  Peptide Sequence Number=SeqID_118326
gtgtgggaaggttgaaggaaagggtccctgagttccctgaagtccagaggtccagaaagaagaagatagaagagaaaaggagaagaaagaagagaaaaaaggtcaaaacgtttccgaatcgcatccgtgatcgactcctacaccgttcttcgttcgttctttggtcgttcttcgttcattcatcgtttgttcttcattcttcatccggttggtgcctgtctttaaggatttga

SEQ ID NO: 1549 - DNA, 381 bp, Glycine max
  Peptide Sequence Number=SeqID_118327
atggaatctgactccttcagacgggcctcgagatctaccaccttcttggcaagctcatccttcttcatcgcaacgtcctccaccctgccagccaagttctttttctcttcctgcaagtccttgcagcatttgaacagttcatcactgtccaacctgatgcacaaaaacttggctaacacactgccaactttagaagacagttggtgggcgctccactctctagacagtgcgagcgatcgccctccatttggcaacttcaacctcctaaaaggtcactttgcccagtgtctcttgatgtcgctacccattttcttcaagaattaccagactccgctaaaagaagaccttggtataatccgtagcatgttaaaatccgactga

SEQ ID NO: 1550 - DNA, 319 bp, Glycine max
  Peptide Sequence Number=SeqID_118328
atggcattttcggggctgactagactatcctccataggaaaatccacccgcaatggtgttgattacacctttgatctactgaacaggttcctgttcttgtggagattttcgatcgtgcctttgctgctggtgtctctgtctacctcgaccttccactctatctcttctttctgtctgcttcgtggttcctatgctgcttcttttagtgtcctccaggtctcgtctaaccccgacctgggaggtttcgtcgagggtagcctaatgggtaccttcaaattgaaagattcctttagaattgtagtgcaattgaccgtcaggg

SEQ ID NO: 1551 - DNA, 3489 bp, Glycine max
  Peptide Sequence Number=SeqID_118329
atgaatgctactaatgatgaagagtcttgcttggacaagagtgtcctgagctacataaagcaaatgctgatggaagacgacaccgaggagaggtacagtatgttccatgattccttagccctccaacacactgagagatcatttttggaggctatcaatcacaactatccttctccttcttattcttcttccacacactatcatcttgacaactaccccagcgtggacagccctgagccatgtctctctgcttgctccgctgataacattacttttagcgcttccagtagttgcgctagtaacaatactaccagctcctctgagtttcccttgagaagcctttaccctctacttcctgacactactgatgaatttgttttccactcaaattcaacccaatctaccatcaatactccctttggattcttcgacaatcccctcgctgaaatttttgagagacgtgtagacctaggtactctgttccttcctgccaacacacctttttcctcttctttcacaaaggttcctcatgttgtaattaagacagaagcagaagaaggagatcattttctgacaggaaggaaacaaagggagcgggaagagtatgaagctgcagatgggagaagcaggaagcaatcagcagcacatatggacgagagtgagctatccgaattgtttgataaagtggttctaggcactgacttaagaaaacgggtacctcctaacacaacccataaaacaacaatattaacaaacatgttgtatggtggagatgtctgggaaaatgatgaccaagttgtggatctgaggacactgttgatgctatgtgcacaagccattgcttctgataatccttcatctgctaagcagttggtaaaacagattatgcagcattcttctccaacatgcaatgagactcagaggcttgcacattactttggaaatgcacttgaagcacgcttggatggaacaggctacaaggtttgtagtgctctatcatccaaaagaacctctgccaaagacatgataaaagcttaccatgtatacgcttcagtgtgcccctttgaaaagctagcaatcatttttgccaacaattcaatttggaatccaagtgtggatgcaaaagcaattcacatcatagactttggcatccgctatggcttcaaatggcctgcacttatcagccgtctatcaagacgttctggtgggccacccaagctacgaatcacggggatagatgtgccacaacctggtttaaggccacaagagagggtgctcgagacagggcgtagacttgcaaatttttgcaagcgtttcaatgttccatttgagttcaatgctattgcacagagatgggacaccatcagagttgaagacctcaagatagagccaaacgaatttgtagctgtgaactgcttgtttcagtttgagcatctgcttgacgagacagtggtgttgaataattccagggatgctgttctgaggttgattaagaatgcaaatccagacatatttgtgcatggcattgtcaacggatcctatgatgtaccattctttgtgtcacggttccgggaggctctctttcattacactgcattgtttgacatgcttgacaccaacgttgctcgtcaagatcccatgaggttgatgtttgagaaggagttgtttggacgggagatagtgaacatcatagcttgcgaaggttttgagagggttgagagaccacaaacatacaagcaatggcagcttcggaacatgagaaatgggtttaggctgcttcctctggatcatcgaatcattggcaaattaaaggataggttgagagatgatgcgcacaacaataatttcttgcttgaggttgatggcgactgggtgctacaagtctcctccatcaatattagtaaagaagatgagagtgatgtctccgctgtccttggctacattaaacaaatgctcatggaagacaacacagaggagaactacagtatgttccatgattccttagctctccaagacacccagagatcattttatgaggttatcactcacaatcacaactacccttcttcttccacccaccatcatgttcacaactacctcagcgtggagagccctgaccaaagtctctcttgcactagcagctccgctgagtctcagtggagaaaccttgaccatattcctgatagctttgttttccactctaattcaaccaccaacatgaatactggatttggattcttcaacgattccctgcaggctgggtttcttgattctacatttctacagaaattccagagaggtgtagaccaaggtacccagttccttcctaaacatactccattcattattgccccttctttcacaaaggctcctcatctggtaattaagacagaagcagaagaaggagaccattttcggaccgtgtcaggaggaaggaaaattcgggagcgggaagagaatgaagcagatgagagaagcaggaagcaatcagcaccatacatggatgacagtgagcagtctgaattatttgataaagtactcataggcactggcttaggaaaaggggtgcctcctaacacaacccatgaaacaatattaacaaatatgtttggtggagatgttaggaaaagtgatggggaagttgtggatcttaggacactgctgatgctatgtgcacaagctgttgcttctgctagtagtccttcatttgctaagcaattagtaaagcaaattaagcagaattcttctccaatcggggatgagactcaaatgcttgcacattactttggaaacgcccttgaagcacgtttggatggaacaggctaccaggtttatagtgttctatcctccaaaagaacttttgtcaaagacatgataaaagcttaccatgtatatgcttcagtgtgcccatttgaaaagatagcagtcatgtttgccaacaattatattaggaatctaaccgaggaagctgaaacaattcacatcatagagtttggtatccgctatggcttcaaggggcctggacttgtcggccatctatcaagacgtgctggtggaccacccaagcttcgaatcacggggatagatttgccacaacctggtttaaggccacgacagagggtgctcgagacagggcgtaggctcgcaaattattgcaagcgtttcaatgttccatttgagttcaatgctatggcacagagatgggacaccatcaaagtggacgacctcaagatacaaaggaatgaatttgtggctgtgaactgcatgtttcagtttgagcatctgctagacgagactgtggtgttgaataatcccagggatgctgttttgagattgattaagaatgcaaatcctgacatatttgtgcatggcattgtcaacggatcctatgatgtaccattctttgtgtcatggttccgggaggctctctttcattacactgcattgtttgacatgcttgacaccaacgttgctcgcaagatcccatga

SEQ ID NO: 1552 - DNA, 378 bp, Glycine max
  Peptide Sequence Number=SeqID_118330
atgcccatcaagttgtcgcacacatctgcaaccttgtcgtacgacttcgaatccaacgcagctctcaccgaagagaaatccatcactctcctcttcgatcaaatccctatcccctatagcagaaaaaccatcgaaattcaaataaataaaaaagccactcaacagttgttttacgcaaccaaacacggcactagcgtagccatacctcaattcgatgcgaagagtaaaaaaccagcttctgctcctccagccaagaagcaagatatagtatatgtcaacgacgtcgttcttacttgtgtctatgacagtgagaaaaaactgtgcgctctttttcatgggtccagcccaatgaggccaagtgctgggttaccgttatga

SEQ ID NO: 1553 - DNA, 1350 bp, Glycine max
  Peptide Sequence Number=SeqID_118331
atggggagcacggcggtggagaagacggaggaagaactccgcaacgagatcgatgagcttcttcgccaacagcgcgagattacggagaggcttcgagatcctcgaggtcttcgcagaggttccttggcgggtcctgctctcccctctaacggtgctcgccaacgaccctttattcgtcctgttactggagacaggaatgattctgaagatcaacctcctgctaaacgtcgactttcatctgctgtcgttaaggtggatgatggggagttgcctgaagatgctggtgcaggacaggatgggaagacaaaggattcagcgaacgaagctgtcaatgggactgctgcagtggtccagaatgatagcaaccctttcaattctcaccaaactgtatggtctaagagagataacaatcaaagaacttcaaaggcttctgacattcctactacggaacatgttccaagggtattgccaaagaacgaggatccaagtttggttaataggaacaaaagaatgttgggccagcttttgggaactctcgagaaattcagaaaggaagacaagcaactctcaggaacagaggcatatatgcgaagatctagttccttgcaaagagctgagcaaagggcacgtgaagaaagtgaaaggctcaggaaagaagagcgtgaacagattgctgaaaaacgaaggagagacttgacaatgacacaacgttccattttgattctcattaacaattatattctttttcccccctattcctatcagactcttagggctcgtgtggctgctaagacagaagaaaagaaattggagctgctgtttcttcagtggactgagcatcataaaagactaagcaattttataaggactaaagcagaacctccaatctactatttgcctaacaagcccttggatgaagatcctacattacttgagaagagcaaagaagaggcttttctagaatggaagaatgcaagaagagaggaagtgtccgagtatcagaaacagattggggagcagtatcttgccaatgttgagaaggaattggagagatggcagaatgcaaggaacgcaaggaaagttaacaatgaccagaatttacaggagacaatggacaaagagttggatactcataggctggagcatggtcccaagaaaagaaagatccctgacgaaaacaataatgacgacgatgatgatgtggaagatataaatgtgggagaggatgacatgatggatgatgaattagacgatgattctagtaggaggattgatgaaacaaccaagacggaagcaggtagtgccagttcagatcctgcagctgatgctgataatgcgggagggaagtga

SEQ ID NO: 1554 - DNA, 618 bp, Glycine max
  Peptide Sequence Number=SeqID_118332
atggctggaaaagagaattttttctccatgtacttgttcttagttctgagctctcaacaccatactggcaagacttattggaaagggttccatcaaggatttgctttccagggtaatgttcaacagttttatacatcaaggatgatgctgggacatgaaggggtagaagtcataaatccggagggtagtaaagaggatgcagaggaggaaactcaaagaggaagatggaaaccagagcgccatgggctatatctgtgtactttgcatatcaacgaaccaggaagccttttaaccctatccttggagagacttatgagatggctaaccatggtggaattacatttcttgcagaacagctgcacaccccagttggtagcagctatggacatgtcacatgtcatttttaagattggttataaaggagttgtagatagaattcagggtcataggattgatttttctgaaatcggagccttggtgattgaatgtaaggctcttctttcttcttttccgaacttttctgtgaagtttgtgcggagacaatctaatataactgctcattttaatgcaagggcagtcatcaactatgcttctacatacttagcagtgtgcgtgtaa

SEQ ID NO: 1555 - DNA, 750 bp, Glycine max
  Peptide Sequence Number=SeqID_118333
atggtccctatttctcgcacttggatgttcgacgtgtgtttcgcccatattctaaactggaagcagcttatattaccgtcaaccccctcaggattatcatacggtagcccatcttcatcgggactagggcttctttttgtcgtcaatagcattatcttcatggcactgggtttcgtcattggctacccagttgcttcagcttcaggtgacattgttgtacttgacgaaaaaactgttgagctgcaacgcactatcacaggaggtgaagcagaggttgctgagtttggtgaccgcatgcgacacgcagcaagagcactaatcgttggtaaagttgttgcaacattggaagagtccatagatggcgtcagagaaagcaggaacagtgaagttgttgtggttggtgaaggcaacgaagttgcgagggaggtgaggagccagttgacggtgtttaattttgtaggggaacttgagttgaaagcagacttgcatgagattaaggtacttcaaggtttgtggaggaatgatttagcggcactaaagggttcttgtccaaattgtggagaagaggtatttgcatttgtgagaacggacaaggctaacaactctccccatagagcagattgtcatgtgtgtgaatgcttattggaatttcgcaccgaagttgagcaatcggctttaagattagggagacaatgggtttatgggcgtatttaccttgttcgcagatccagacgccaaagagaaccgtaa

SEQ ID NO: 1556 - DNA, 786 bp, Glycine max
  Peptide Sequence Number=SeqID_118334
atgggtaataaaattggtagggcgataaagagtaggagagggtcaaatttgggagaatccgatgtccatgtccatggttttggttcggtggtggacagtgccataaggacagcgtcaaatgcaggaacagatgtctatagtttttctgagacagtggacaatccgatgaggagtagcggtgcgccaaataaccttcatgtccatgtctctgattttggttcggtggtggacagtgccataaggacagcgtcaaatgcaggaacagctgtctatagtttttctgagacagtggacaatccgatgaggagtagcggtgcgccaaataaccttcatgtccatgtctctgattttggttcggtggtggacagtgccataaggacagcgtcaaatgcaggaacagctgtctatagttttgctgaggcagtggacaatccgatgaggagtagcggtgcgccaaataaccgtcatgtccatgtccatggttttgattgggtggtggacaatgcaatgaggagtagtggaattgatgagtctgtccatggttttgcttcggcagtggacaatggcatcatgagtagtaacttagaggtttctgcttctgctttagttgatgttcacaatctgtcgccaaatggaagtgggtggcaaaagggcgatttcttaggaaatggctcctttgggaccgtctatgaaggcttcaccgagtcagtatactattaccataccatcccttcttatactttcaaacttaattctgcttctgtattttcatatttaccaatttag

SEQ ID NO: 1557 - DNA, 222 bp, Glycine max
  Peptide Sequence Number=SeqID_118335
atggatgcagaattcttaaagagatgtctacctaggagccttcttgaatgggacaacgtcgtcgcctggttttgttccttgtacaataagcccgacaactacttgaaaggcatggtcaacagatgcatgtttttcttaacaagtgctttgaagggatttaatgataaacatggaagtaaatccaaggccaatgctaaatggattccagttaaaagtaagtaa

SEQ ID NO: 1558 - DNA, 6198 bp, Glycine max
  Peptide Sequence Number=SeqID_118336
atggatgcaagtgagcttgaaaaggatttattcagcaaagtagaaacaaatgactactacacaacagttttaaagatcaaagggctggaacgtatgccggttggattttattattttagtgaatatatggaagatcccagcacaattggaaatccagttgccatgcagaaattttatgctgacagtaacatattcttgttctggtcctatggaaactctgctgatattaagggaccaactgtcactgagcttgcaatcaaatcaatagaatccatggggggagaagttcagaatatcattcttcaacgtcgctttaagtattttcctcatgttagcagtcaagatatgagaaacggattctatgaaaagttggagtcagagcttcaaggctcgaggaatacttattatgttggtgggcttatggcatttgagcttacagagagaaattcatcttatgccatggctttgatctgcaagaactttgcaaatagcagtgatttgccagtgtttccttacactaagattttacatacattaagcagtcatgttttccaaatagagctgcacttactagaagagtgtctttggcagagtttgtttcccttgcaaactgatatccagaaaaaggagcctaaagaactagttgaattgcctggagtgcaatttcccaatttgcctgctttgaatagctatttaaagcactggggaactcatccaatcactcaaaacagaactctttatacttggctaaatgaaggagggactgtggttggcaagaggacatatggagaacaacatttaaatgcttcttgcattgcacataagctcttaacaagccaaaagccggttatcaagcctggtgacagggttctcctagtctatgttcctggcctagattttgttgatgccttctttggatgtctaagagctaaagttttaccagtcccagttcttcccccagaccccatgcagagaggtggacaagcacttcttaaaattgagaacattgccaagtcatgcggcatagtggcaattttatcaacggcatcttaccacacagcagtacgtgccggtctagtgaaaagcttgatctcattaactgggaaaaatggtaaatacacagctcaatggccaaaacttccgtggctgcacaccgatacttgggtcaataactcaagaaattcggctgtggaagatgtagatgatcaatgtgaaccccagcctggtgatgtatgtttcttgcagtttacctcaggttcaactggtgatgctaaaggagtcatgataacacatggagggctcgttcacaatgtgaagttgatgagaagtagatacaagagcacctcaaggacagtgctagtgagttggcttcctcaatatcatgacatggggctgattggaggactttttacagctcttgttagtggtggatctgctgtactgttttcaccattgacatttattaagaagccactcttatggcttgaaaccatcagcaagtatcaagcaactcacagtgccggacccaactttgcttttgagttggtggttcgaaggttagagtccgagaaagacaagcttcagagtttagacctttcatccatgattttccttatggttgctgctgagccagtgaggatgaagaccttgaaaagatttcttgatctaaccactccttttggcttatctcaaaaggtgatggctccaggatatggcttagcagaaaattgtgtgtttgtgagttgtgcatttggagaaggatgtcctattcttgttgattggcaaggaagagtttgttgtggatatattcacccaggcgattcagacgttgacattataatagttgatccagagagtggtgaagagcttgaggaagatggaagggaaggagaaatctggataagtagtccaagtgctggaataggatactggggaaaggaagaactgagtcagaaaacttttagaaataagcttcagaaccatcctggacgcaactacacaagaactggagacttgggaagaattatagatgggaagctattcatcactgggagaatcaaggatcttatcattgtggctggaagaaacatctactcagcagatgttgaaaagacggttgagagttcatctgaatttcttcgtccgggatgctgtgcagtcattggtgtccctgaggagattttatcagcaaaggggatttccctgccagatggatcagaccaagttggcttggttgtggttgctgaagtaagggatggtaaaacagttagcaaagatgtgattgagcatattcagacacgtgtggttgaagaacatggagttagtgttgcttctgtcaagttgatcaagccaagaaccatcagcaaaacaacatcaggaaaaatcaagagatttgagtgtctcaaacagttttcagatgaaacactgaacctggttccacaacctattttgacaaagaaatcactgttgaggtcatttactacaggaacatgcagagaaggaagaacacctcgggcacatttggtgagaagtagttctcctctacctattccaagaatcagcaacaaggaaattgtggaacacttgaaaaggattatttctgaccagtctggaatcccggtcaacaatatctcagtcacagacaacatgtcaacctatggaattgattcaattggagtggtcaaagcaactcaaaaactcacagatttcctgggagtgccagttgcggctatagatgttttcactgcatcatgcattcaagaattggctaacttctctgagaatcttctactcaagtctcaacctcaactcatgagcaattcaccacatgctccagaagctgaaattgattttactgaagtggttgtggatgtatccaagtctcgccaatggggtatccgtttacttcaactcctagcacttgtttatatttctatcatgctggtcactcctgcttatctatccatcactgcttttcaaagtttcataccaaatgccagtgaatcggtatatggaatgccttggtcaagctatttgatttctttgactttggcaccactttcttggatcctttgcatagtttccacttgcctttgcatttccttttttgggaattctttcttgaggccaaactatgcccttacacctgaaatatccatttattcaatggattttgttaagtggtgggcgctctataaaactcaggaaatttcttcaaaagttttggcaacacacctcagaggaacagtgtttctgaaatactggtttgagatgctcggtgcaagaattggatccttagttttgcttgacacagtggacatcaccgacccatctctggtttcaattggagatgaagttgccattgcagaaggggttttggttcaaagccatgaggtgaagaatggaattctaagtttccttcctattagaataggtaaaaattcttcaattggaccttattctattattcaaaaaggaagtatcatcaaagaaggatctgaagtacaacccctgcaaaaggttgaaggaggccaacatgtactcaaacctgctaagcataataacgttaaagagaatgccctgttgcttgtttctaccagcaaaatacagtccaatgccatgtaccattttctggggatctatctcactggctttctcagctcccttgcttcagctattgcttacatcttgtacataaggctcttccagatacctgcatcattccaacacttctcatttctttgtgtatgcggtgccttccactggatcccatttaccgttgttgcatatgccaccatgttttctgatgtcccatcaaatcccattgcctttaccatttcatttaccagcgcatatctgcttcatggcctcatactcacctctctcacttgtgctttgacacgtttgctaaaattcaaccaaaatcaaacccatttcaaaacctggcttagacatcaattgaccatttcctgccaccatagatttgcaaagcttctctcaggaacagaagccttctgcttatatttacgccttttgggtgcaaaaattggcaaacactgttccattagagccatcaacccagtttctaaccctgagttaatgtcaataggcgatggtgtccatcttggtgatttcagcaagataatcaccggttttcactattccaatggatatgcttgtggaaaagtagaggttcaggataattcagttgtggggagtcaaagcctaatcctcccaggttctgttgtagaaaagaatgtcattctaggtgcactttcagttgctccaatgaattctatcctccatgagggtagcgtgtatatcggatctcaaacccgagttgcaaccagaaactcttcgtatcatttagatgaaaggatagaggagatggacatggagtacaaaaaagtagttgcaaacatggctgcaaatttagccgtcactactattaatgtcaaagcaagatatttccaccgcattggtgttagtggaaagggacacttgaaaatctatgacaaacttgatggcaatattccactacacaagattttttaccctggaaaaagctaccctatcatgttaagacacagtaatagcttgagtgctgatgatgatgcaaggattgatgcacgtggtgcagctttgaggattctttctgatgaatcaccagattctaataacctgcagcatgcttccctcattgacctgacactaaaaactggcaacgcattttatgctcgcactcttgctgattttgcaacctggcttgtgtgtggacttccagcgagggaggaacttgttaagcgcaccccacatgttcgtgatgcagtgtggaattcccttagacatgcaaactcatacgctgaattgcactactattcaaacatttgcaggcttatgcgcttcactgatggacaagaaatgtacgtgaagtttaagctaagacctattgacacaagcattagtgaggacacaggtaaggttgtaccaactgggattcttccaccagaaacgggtgcaattcctagggatgaaaaggacacacgtcctttgcttttccttgctcaagattttcaacgccgtgtgaattctcctggtggagtttgttatgtgtttcaattgcaactccgagcagtgccagaagatgaagccgcacgtgacattgcactggactgcaccaaaccatgggatgaaaatgagttcccttacattgatgttggagaggtaaacatcaatgagaatctctctacggaagaatcagataggcttgaatttaacccttatctcaaaagccatgagttggatgtgatccctgctacttccaacacccaaagtgcttcaattgatcatggccgttcattgatctatgagatttgccagcacgttcgtaacagacagccactcccagaatcttggaggaacctcgtagagcaatctaacgttaaggtagacttgtcttgctgtcccgtggcagcagcattgcccaaaaaggagacgacaaagaaagttacaacaaccttaaccttgacaagaacctggtaccagacattctcagcacttttcactcaaccgttgctgcaaactgttttgccttacacggtgatgggtttagcagtttttgctcctttgaactttcttgttaaccttaagaacgttgagaaactccaagtgcaatggttctttcctttgttttgggttgtctcgggtgtcatggctgcactggcatgtgttgtgaccaaatgggttctcgtgggaagaaaaaaagagggtgaaaccgtgcccttatggagcaaaagggtaatcatggatagcacgtggcaagcgattagaaccttggttggggattatttcatggacatggcaagtgggtcgtttttgtttgtgatgtggatgaagttgatgggtgcggacatagacatggatggtggtggggcctacgtggacagcaccggggctatgttgaaccctgaaatggtgacgattgagagagggggttgtgtgggaagagaggcattgctatttggacacatatatgaaggtgatgaaggtggaatggtgaagtttgggggaatcaaaattggtgaagatgggtttgtgggaagtagagctgtggtcatgcctggtgtgcatgtggagaatgaggccaatctttctgctttgtctctcgccatgaaaggagaaacagttaggtcaagataa

SEQ ID NO: 1559 - DNA, 621 bp, Glycine max
  Peptide Sequence Number=SeqID_118337
atgaggttgagcagggctgagccaccactgaggaaagaggtggtggaatacatgctagatgtagattcacacatgtggagtatgagaaggagcaaagctaatttcttcagaataaccaaagttctaggagggttgttagcctttggaaggtggtttgatcagatatgcaattggaaaaaccctctcacatccatactcattcatatccttttcataatactggttctttatccagagctaatacttccaacaattttcctttacctttttttggttggaatttggaatttccgatggaggccaagacaccctcctcatatggacacaagactatcacatgctgatgctgctcatcctgatgaactagatgaagagtttgatacattcccaacttcacgatcatcggatatggttaggatgaggtatgatcgcttaagaagcattgccgggaaggtccaaactgttgtaggtgacttggccactcaaggagaaagtagttctctatgtcactcccttccaagttgtgttccttctaattggcttctatttgctaaggcaccccagattccgccagaaacatccttcagtcccattcaactacttcaagaggttgccagctag

SEQ ID NO: 1560 - DNA, 270 bp, Glycine max
  Peptide Sequence Number=SeqID_118338
atggttaggacaatcatttatatacattgtgacgatgaagacgacaatgttggccaccacgaaggtggggaccagccatgggaaccagcgcttgaagaggctgaagtcgcgatcgtgcacggcagggggactcggcggcgacggagagtgcctccgcccccgtccggggtggacggtggtggtgtcgcagcgcggatgaatctgcacctcgacggtggcagaagatgggtccctccccatgattcttctcgtccctttggcaaagattga

SEQ ID NO: 1561 - DNA, 1830 bp, Glycine max
  Peptide Sequence Number=SeqID_118339
atggctgatgatggtgctgatccatttccagtgttgacaagtgtgtatagagtatctggttccaaaaacagtcagctgggctggaatgtagccaattctcagcaaactgttgactccagtgtaaacaactcaaggcagttacagagcatttctgatggcagtgctccaagaccctggttttctcaaaattttagaccaaatgcatgggaagttccaggtgtgattcagaagctgaggccggcaaagcggggtaatgacggattggctttgacgggaagtggaattttgaacgacaagttgcctcctgagtcagtaatatctccaacatcagagacagagagagggacagggttaaattcatctgttggagtcgttacaactacatccaaggattgtgaaaatgttgaatgcaaggacaaggataagagaatcccagaaccccaatgtgaaaacaacaatgatcagattgttgacaatggatctgatattgtttttgatagtgatgatgattgttttttagatgacattgactcagatactggagagagaagccatgaacagtgcaaaaagagcaagtggctcaggaatttctttgataaattaaatgcactcaccaatgaggagataagttcattagacaggcagtggcattgcccagcatgccaagggggttctggtgctattgattggtacaaagggctgcatccccttttggatcattccagaacaatacaaacaaagagggcaagactgcaccggatgtttgctgaaactttggaggaagagtgtttcaggagaagagctccattaacaacagtcagtgacgtccatgatatatgggagggtcttgataagaaagtcaaggatcatgaaatagtttggcccccaatggttatcatcatgaatacaagatacgagcaggacgaaagtaacaagtggaatggaatggggaaccaaggactccttgattgcttctgtgactatgcagcattgaaggctcgacactcgtatggtccacaagggcaccgagggatgagtgccttaatttttgaggaatccacggcaggttatctagaagctgtgcggctccacaagcattttaaagagcaaggaagagatagggaggcttgggattgctatcggaatccatttctcccaggtgggaagcgccaactttatggttacttggcttctaaagaagatttagatattttcaacaagcactctagaggaaagacaaaattgaagtttgaaatgagatcatatcaagagatggttgagagcaagataaaacatattaatgatgatagtcggaagcttgactattataagagcatggtagccaaagaacaaatcaaatcacaagtaggtgcagactctttattgagattaagtgagaagttaagcttgacaaccgaagaaaaccgtgttgatcaacaaaataaggagatggatgcactagaaaaaaatttccagagccaaatcctagacattcaacaagccatagctgcaaaggaagataagtttgtgaaattacagcaggcaatgcaagaaaaagtgaaagagtcctgcggagaatcttctgagaaagaggacaaggtagaaaatatctcttgtttcctgaagccccaagacaaggagatgaagcagtttgaggcagagagagagaaaatcataaaaattcatgaagagaaaaggttggctctgaagaagaagcattggcaagagcaggttgaacttgagaaggagttagagaatgaacggacgcagctcatggacaagtacacttgcaaccagactcaagaagaaaactgttatgtggatcattaa

SEQ ID NO: 1562 - DNA, 720 bp, Glycine max
  Peptide Sequence Number=SeqID_118340
atgggtgctcttgaagttggtaaagtgattcatggacaccaggtttggcggctcttctcttgtatatggttgcacggtggggttgttcacgtgcttgccaacatgttgagtctcgtttttattggaattcgccttgagcaagaatttggatttggtatggtgctggtaattatccttgcattgtcaattcgaattggattcctgtatgtgatatccggttttggagggagtttgctgtctgctctattcatacaagaaggaatctccgtgggtgcttctggtgcattatttggcttactaggaggcatgctatcggagctcttgataaattggacaatatatgccaataagtttgcagcgttattgactcttatagtcatcgttgtaatcaatttagccattggagttcttccacatgtggacaattttgctcatattggaggatttgtctctggcttttttcttgggtttatctttctgattcgcccccagttcaaatgggttagtagtagacacaggaattctcactctacagctgctgcaccttcggtgaaatataaacacaaaccttatcagtatgctctgtgggtcatatccttcatactactcattgccggaattgtaccgccttatccatgtatcacaagattcaaagtcatctacaattcatcacatgatacaagttgtatcaaattgtgctatttgaatcacaattcttaa

SEQ ID NO: 1563 - DNA, 768 bp, Glycine max
  Peptide Sequence Number=SeqID_118341
atggcaataatggagcaaaacaaagccgatgagaaaaaagaaaaggagaaaatgcacaaaaaaattcttgaactacaaaatgaacttgatgccaaacaaaaattggaattggagattcaacaattgaaaggaaatcttcaagtaaggaatcaaataggagaggatgacgaggaggagaaaaataaattggatgcaattaaaacggaactagaagataaggaggaggaattagaagatctggaagcacttcaacaagctctcgttgtcaaggaacgtaaaaccaatgatgagttgcaagatgcccgcaaggagttaatacgttggctgaggaagacaaacagtagtcgggcttttattggtgtcaaaagaatgggggagcttgatgaaaaaccctttttgagtgcagcaaagagaaaatattctggtgatgaagtgaatctgaaagcagtggagttgtgctcacaatacgaggcttatcttagagacccaacctggtttccatttaaagttttaatagataaggaagggaaggccaaggaagtgttagatgaagaagatgaaaaactgagaactttaaaggatgagtttggtgacgatgtctttcaagcagtggttacagctctgaaggagttgaatgagtacaaccctagtggtagatacccgttaccggagttatggcattctaaggaaggaaggaaagccttgttaaaggagggttgttcttttataatcaggcaatggaaagcattaaagcagcgaaagaagtag

SEQ ID NO: 1564 - DNA, 129 bp, Glycine max
  Peptide Sequence Number=SeqID_118342
atggatgtcttgtgtcttgttggaacaagtgtgaaaccaaccaaacacagagggcggatctgccaagacagctaccaccggactttccttgctatggtggtaggcaaggaaagcgtcgattgctgctag

SEQ ID NO: 1565 - DNA, 1434 bp, Glycine max
  Peptide Sequence Number=SeqID_118343
atggcgtgggggatgatggcgactacccgcctaatgtatttacatttgtcagtgcaattcacgattcatgtgaatatgatgacgagccctggagcggtaaagttgtatcttggtgacttgttggtcatggatccgaacccggaaacagcttctttgcatatgcaagggttgatcgacgtccgaactcgtcatcatcatcgtgtcgccattcttccagcgcaagatgttgatgtgtttaagagtgtatgggaaacacgaattcctttgaatgtatctgcttttgtgccgagggaggaatctatggagcatttgatgttcagctgtacattttcatcaacatctggaataagtattatgcttggttggggatacatactgcccaacaaaaatgcacccaaggcaacatttgtgtgggatcttatgaaagaagttggtggtgaaatggatggtggtatggtgcacagtggtgtggtctctatggtcacagaaaatttctgttttttaaggatggaaacattgatggtgaacaggtttgtaggtggctcaatgaaaattcaagtagcagttcatggttacagtgatatcaagactgaagcagcagcagagccttgcacaacaaggcttccttttgttctctgtgatggaaggaagttacatgtcaatactggcagcatagtccatggtaataggacaaattcaatattcatgtccagcaacatcataaagaattctgtttcgatgtctggtagacgagaacgagtccgggagtctgactttgaatactatgaacgcgtgtattatgaagacttgaagagtggttactataagctcaaaatctccaagtcatcatataagtgtcccttttgccaggacaagcgggaatactcattgaatgagctttcgaagcatgcagtaagatttgaaagggactcacggagcatgaagataaaagatttagccaagcactctgctcttcaattgtacattaaaaagtatcttgatgtctatgataaagtaggaagtgttgtccatgataaagtagaaagtgttatccatgataaagcaggaagtgttgttcatgatagaccaggaaaagtggtcctagatagatccggaaaagttgtcaatgatggatccggaaatgtttacagtgatagatttggaaaagttgtgaatgatagaccaagaaatgttgtcattgccaatgatagatcagaaaaagttggcaaagatcaactatttgtctggccttgggtgggcattgttgcaaacattgccactgaatttaaaaacggaatgcgtattggagacagtggttccaaactaagggatgagtttactttgaaaggatttcatcctttgaaagttcaaccattatggaaccgttatggacattcaggctttgccattgtagattctccaaagactgggatg

SEQ ID NO: 1566 - DNA, 390 bp, Glycine max
  Peptide Sequence Number=SeqID_118344
atggaacgcagtgaaaggattatcaggctgacttacgtctggggtttaagcggtgagcgcgccccagcacgggctggacgacacgcagcggcagcagtttctcgccctctgtccacgccagctggaaaaaacgcagcgctggctgcaacaggcgcaacatcatctgattgcctgcaccgatgcacattatcccgcccgtttgcgggaaatcagccgctatccggctgccctttatatagcgggcgacctctctgcactcgcgacaccgcaactggcggtggtcggcagtcgtcactgttcgccgtatggcagagaatggggcagctggtttacccagcagctggcgctaagcggtttgaccatcaccagcgggctggcgcgcggtattga

SEQ ID NO: 1567 - DNA, 954 bp, Glycine max
  Peptide Sequence Number=SeqID_118345
atgtcagttttgcaggtattacatttccctgacgatcgccttcgcaaaattgctgcacccgttgcggctgtgaatgctgacgttcagcgtattgtcgacgatatgtttgagaccatgtacgccgaagaaggcattggtctggcggcgacgcaggtggatattcaccagcgcatcatcgtgattgatgtttctgaaagccgcgaagagcgcctggtgctgattaacccggagctgctggaaaaaagcggcgaaaccggtatcgaagagggttgcctgtcgatcccggaacagcgggcgtttgtgccgcgtgccgagcgggtcaaagtgcgcgcgctggatcgcgacggtaacagcttcgagctggaaactgacggtctgctggcgatctgcattcagcatgagatcgaccatcttgacgcgcgtcatctcgacgcgctgcttgcttctgagcatcaggtggttggcgtctttactcagcccgaccgccctgccggacgtggcaacaaactcacgccgggcccggtaaaagtgctggctcaggcgcatgatattcccgtgtttcagccaaagtccctgaagccggaagagaatcagcagctggttgccgggctacaggccgatgtgatggtggtggtcgcttatggtctgatcctgcctcaggcggtgctgacgatgccgcgccttggctgcatcaacgtacacggctcgctgctgccgcgctggcgcgatggacgtggggtctggataccgggcgatatgctgcacaaaataacctgcccgattaatgccgacgataccagcgcatcgctgtacgacaagctggcgcaactgggcccgcagggaatgctgaccacgctcagtctgctggccgccggcagcgcgcagcccgaagtgcaggatgagaccctggtaacttacgcggaaaagctcagcaaaagaagaggctcgtcttga

SEQ ID NO: 1568 - DNA, 1869 bp, Glycine max
  Peptide Sequence Number=SeqID_118346
atggtttcatttttcccaggttttctaactaaaggtagcgatgttcagaagctcaaggtggagctctatgaagcaattgcaccccttgaccgaggtgccgaggctactcctgaggaccaacaacgtgtggaccagattgctcgtaaacttgaggctgtgaatcctgttaaggagcctctcaagtctggtttgctcaatgggaaatgggagcttttctatacaacatctcaatcaattctgcaaacacagagaccgaaactcttgcgaccaaatggaaagatctatcaggcaattaatgtggataccttgagagctcaaaatatagaaacttggccgttctacaaccaggccactgccaatttagtgcctcttaactcaaaaagggtggctgtcaagtttgacttcttcaagattgctagtctgatacctattaaatcacctgggagtggtcgtggtcaattggaaattacttatttggatgaagatctacggtcagggatgggtccctgtatctgctcctcccatgctcagcgtctcccctatgcagcaaatctaaaccctaattcttctattctccgtcgacgcgcacaattcatcagcttcgcctcgaattcttctccacctcaagacgaggaggccactgccaagaaatcgtttgccgtggcgaccggcgagctgtttctagggctggcgacgcgcctgattaagagccgaaacaagggaagcagcagcctcgcagaagattcgggttcggtgggcatgtttgagaataattctgaggagagaatcggagcggtggtggaggacgagattgatcccgacgtggtttgggagcaaagagtgaaagacgtggaggcggagcgcaataggtatagccgcctcgtcaccagccctggctttagtttctctgccgctggacttctcttcccttaccatcttggtgtcgctcaatttctcattcaaaatggttacattaaggaaacaacaccgttagccggttcctcagctggagctatagtttgtgctgtgattgcttccggagctagtatggaagaagccttgaatgctactaaaatattggctgaagattgccgcaatcgggggactgcattccggcttgggccttacaccgatctttctcttgatacgtgtattatgtgcttctctagtttgagaacaactcaacacttgtcttgcactgtaaggtatcctcctctatatgaaatagtttgtttgagatgcttggtgagcagcagtagctgttcccgttcacttgggaacaatttctgctgtctaggtttgaaggctgttctacgtgatattcttgacaagtttttgccagatgatgttcatataagatctaatgggagagttcgagtcttgctgtgcctcaactatgtaccttctgtcgcagttgctgtgacacagcttctttggagaccccgaggtttgttggtagatcagtttgattccaaggaagatctcatcaatgcagtttttacctcttcctttattccaggatatcttgcaccaaggccagcaacgatgtttcggaatcgactatgcattgatgggggtttgacattgtttatgccaccgacatctgctgcacaaacggttcgtgtttgtgcttttccagcaagtcgattgggattgcaagggataggaattagtccagactgcaatcctgaaaacgtgtgtagcccacgacagcttttcaactgggcacttgaaccagccgaagatgcaattcttgaccgattctttgagcttggatatctagatgcttctgtctgggcaaaggaaaacccagttgaagtaatagttcaagatgatagtcctgcgtttggaagtagcagtgcgacatag

SEQ ID NO: 1569 - DNA, 1065 bp, Glycine max
  Peptide Sequence Number=SeqID_118347
atgaatgcttcaataaatccagtgtccttgagtgtgctgaagtcatctttaattgaactgtttctcaagcaaatcaatctgactttgacatcatcaatatttgggaatgcatcaatatttgagatcttgaagtttcctggagggttaactgtaataccagtgcagtctgcttatatttggcagatgcctgagattttgtttaattttactcttaacaattcgatatctgaagtattggaaagttttgatgacttcaaggatgaattaaagtttggattgcatctaaactctgacgagaatgtgtatgtgcaaataacaaatgcaaatggctcaacgataactcctccagtagtagtgcaggcttcagtcatggcaggctttgggagcctcttgcctcaaagattaaagcaattagctcaaacaataacaggttccgctggcaaaaatcttggccttgataactcagtttttggcagagttaaagaagtcagattatcttctttcttgaagaatacactacatgcttcctcaccttctccttctcctgctcccgctccatctccacagttaattgatcactctgagccatcaacttcaccacatcatgctaatccttactctccaatatcaccagcagcttccgagcaacctccttgttttgaatgtgaagtatcctcacctgcaccttctatggtgcctgcgcatcctccagatccctgtccatatagtgacttccttcatcatccaatcccatcgccaaaatcttattctaaaccatcctttccccctgattattcccctgctgctgcccctacctcaaattctgccagccacactagtgaggaagcttctgatctgtcacgtgtagccgaggtgtcccatggatccaagcttccgcagggtgaagagacatctaataaattggtgtctcagctacttgctccatcctctttatttttgggagatatcttgtgtatgacggaatggttcttaaacccaggcctgggttcttttgattctgatacacttgatggatttagagtagggtatcatgatccagattag

SEQ ID NO: 1570 - DNA, 8289 bp, Glycine max
  Peptide Sequence Number=SeqID_118348
atggcttctccctcggaatcctccctcatctccaagcttcagtcctccgattcccccggcatccacgcccttgtctctgattacctccgtcccctgtcagatcttaagccaaccaaaaaatccaaccccgaccaaaccctaattcgctcactcgccaagcgttttctctctttcctcaacgcctccttatccatcctcccaaaacggctccccgaggtctccaagtctaacaatgccgtctccctcctcgagttgctccgcgtttacaggctctgcctcgattgcttggacgccgtcgcttctcagttggcttccaagcccttctccgtcgagttccagcgacttcgcctgattcactgcctcgagtcatgtggcctgtttgacgaagcccaacttgagggtttaggggttttggagaagcttccacccgccaagaggaagggtaagcttctccctgaaatagacaagggcagtggagagggtaaagaattgtgctctttggtcgttgatattgttgtgagcctcctgaggtgtgcagccgcgggtttggctaaagaggatgcccatttcaggaaggtgcttcagttggtggaggaagtaaacccttggcttaggacgccatttccggatagagacttggtgaccttgttttggtgtacaacgttgactgaatatgtgaaatctcccatcaaagatcaagtctacaagattgccctcagggtatgctcatcattgtttgcactgagggataataactccttgtatatcatggatatactggactccatagttcgcgagtgcaaggttgaggagggaaacacaggaactgactttgttgaacttgtatattactgtgcaaataaatgtcaaactgcaaatgcaagtttttgtagtacatttgcagcatatttgaacaaaatagcagaacatttcaaacaggttatgacacccataaattcaatactgaggctttatgctgctggattgctccttgttagttgtaatttgaggtccagaactggagatctagcatcctctggcagtgcaaaatttgagtgtttgcttggaactttactagaaaacgagaaaatactacagaattcaccaccattgcttggttccttgcatatttgcagcaaaagtaattgtatgtcgtccagcgtagaagaccaatgttttgctggtcacccatgtgcattatcaggtttcgatggcgaggcttctatgacttacctgtcaggttacttagaggcattgaaatatctatgccaaccacttgctaaatcaattaattcagaaaggaaagagttagttaccaaagtggacgatgcttctgctatgactatgatgtccactgtccaagatgcattccatatcctttgtcatcttattctttctagtacaagctctatgcctaaaaacaatggagatggatttgatgaaaagagtaaaacagtgcttaatttagttgtagcagccttcaccctttccatcagaaccaatcttaaagtccaggagagcaaacaattaattaatcagatcattgctagcaaatggattgaagcagaaggattaaaatacataattgcttgtctctacaatattgctgtagttttatacagaaacaggctactgaaaaaggcttcaaaggtgctaaacttgtgttgtaaagcttcatggctctgtattaaatatcattctgctaatctgtcagaaggtgctttgaaagagtttgtaatggaggcttgcaccagaagtgctctccttttagatattatccatgatgtcaacaatctaaagataaacaaaaaaatgattgacatcctgaaaaactggttcactgctaatgatttgtttgaggggcttccagcacctatacctgtagtaaagcagtgggtaaagatagaatgtaaacgtgctacgcaggtggatgagagaattgattctcttaccttgtatagcctgctgtcatcttctttggaattgtcaaagaggaacattgccatgatcttggagcagaaggcacaaactctagtgagaaagggaaaagcaattagggttaggggcataggtggtctcagggactgcattcagtgtctgtcagaagcaataactattatgcaaatctttgaagatgtcaaggctgctttggatctatggttgagcatttctcatcttaatcgctttgaagagggagattcttctgcattatctgacaatataatgattctactctataatgtagttgatttattacaattgaagggtttcatggaactgttcaatgatgcatatcaattgttgattaaaatgtttaaacggaagaatgtcccaattgagaagtggttgcccctaatgtgggaaagtagaagtctaagtcacgccctttgtgtttcacctgttaacgaggaattcatcatgaattcactggatgagtttagtgaactttcaaatattgatttctggatacgttatcttcagggaaatcaatcatcattgatagggtttcagcagaatttttctttcttgtttgctagctctcataggaattcttgcagtcatgggagctcttttcaaacggacatcacaattgatgaagttcaaaaagcagcacttgatctgatttcaaatgttcctgtcccaagtcattctacatttcttgctgggtgtcttttttatgatttgtgcccaagacttgttgcaaatggacagttaatagaggctctttcatctgcaaaagaagctcatagattacatgccaaactcttccaaaggaagtttacacataatgttcagcagcagaatgaagagaaaaatgtaatggttgattcctcaaagaatcttatggatggtgttgaaaatattggactgaacttatcagttgccagggaagttttgctatttgattctatatcatgggacttgaaagacagttatcttagtgcatggaaagttatgcaatgctatcttgagagcactcttcagctaggaatcatccatgaaatgattggagatggagctgaggctgaaacctatctcaagtggggcaaagccatatcctcagaaaaagaactactgagtgctgaacagattttaaaggaaagcaacacacccttttgttgctcaaagtgtaaattgaagctcgaagttactctgtatgagtatcttggagatttgtgtcagagtaaatttgacacttgtgatggggttatgtctgaagaaactgcaaaaaattggtatacatcagctctggataaactaaatctttctgagtggaaaaatcctcttagctgtccagaagatggcagtgatggaactgcaacagacataaaatgtcctgctggtaagacttgtacttgctttataatgaatgaagtaggtgaaagtgtaaagaaatccatgaaagcggggcgagaaactgagattggggcaaaacaaaatagaaagaccaaaaatgcagcaaaggttttaccaaaggaaccaaacttagtggttgagaataaatcaaggttaactcgttctagatatcgatcttcacagaaccaatacacaagcattcacgggaagttagaagtccatgaaagtctggaggggaatcatgtttctgattcatctgatatgcttagtcagaatgggtcagttttgagcaacataggttgcacttttgcttcaagggagatcccgggagatgtatttactattgaacgtgcagaaatagttcatgacatatgctggtattctttgaagaactatcattccaagtttgcgaggaacattttctgtaatctgtccttcatcaagtttgaagacctggcttcttggctgatggtagcttttgtactctctcgtgaggttcctgtaatttttcaaaagggttcatatgttactggatcttctagcatcaaagagtgcacatctgacttactcaggcttgtgcctgataccactgtagatcttgcagagtatgtgaagaagtttttggctggtcttccatcaacgactataatcagtataagtttgcttggacgtgattatactagtttactacaggaattgttgtcttatcctacatgtgttcaagcatggatgctggtgtcaagactgagctttaagaacgaacctgttgtaatgttactgccacttgattctattttacaagcttcatgtgagggtgatctgagtactggttcgggaacttctcccaagtgtgaggagcatagtgaaaaatggcattgcccatggggttttacagttgttgatgatgtggctccaacattcaaaacaattttagaagaaaactacttgtcaacaaaatctcctcttgaagatacaacacaaaataggatgttatggtggaagcggagaaagaaccttgatcactgtcttgataaattactgaggaaccttgaagagtcgtggtttggttcatggaaatgcttgcttcttggagaatggttgaactgcaaaaattttgacttggtgcttaagaatcttgtgaatgatttaagatctaaatgcaaattggatgtaaatgagggtcttcttaaaattattctcggaggctccaaatatgtttgtgatgggaaaacattggtttcacaactatgctcaaagaaagactgctacattgctaaagtaggctattgtgatgaagcgaggagggggatattaaattccgccaatggaattggagtatcatctgaggttgcttttgaactgttaagtgaggcattaaatgtgctggaagtggatgactctgtgaatagagaacctataattcttgtgttggattatgaggtgcagatgcttccttgggaaaacttgcccattctaaggaaccaggaggtttatcgcatgccttccgtgagctgcatttctgctgttcttcataaaggcagcaaccataaggagcaagtgggaaggaatttagggccttttcctttgatagatccactggatgctttttatttattaaatccagatggagatcttggtggcactcagattgaatttgagaattattttagagatcaaaacctggagaataatcatgctttcttttctcctcttgttacttcacagggaaaggctggtttgagacccaccatcaaagaattggcttcagcattggaaagtcacgaccttttcatatattttggacatggaagtggaggacagtacattcccaggcatgagattcagaaactagacaaatgtgctgctacgcttctaatgggttgcagtagtggttcattgaccttacctggtcaatatgcgccacaaggtattcccctgtcatatctgctggctggttctccagccattgtcggcaatctgtgggaagtgacagacaaggatatagatcgatttggcaaggcaatgcttgatgcatggttgaaagaaagatcagatatgccaacagaatgcttgcaatgcaatttattgtctgaagaatttgaggccatgaacttgaagggctgcaagggtagagcaaagaggaaggctccacgaaagaaattactagagttggctgagagtgagtcacctaagaactgtggtcacagacgcaaaattggagctttcatgggtcaggcacgggaggtttgcactcttcctttcttgacagttggaatcacgacagttccacgcaagggaaagacaacccttgtcatgaaaacggactccttcattcccccggcgccgcccactccgctggacttccaccaccgccagtactcctcccgcgactccgacgtcagcagccgcccctcctccgtcggcatcggcagacgccccaccctagacctctacaatgagccttcctacaagcaaacggtggtttccaccatcaactccttcctctcctcccacaacttcccaatcaccttcaaaacgacgctcccctctgccaaagacatccacgaaaccctaaaatttctcctctctctcctcgacttccctttctccaaactcgaagaggatctccctcccctcctcaaacgcctcaattatccttttaaactcaacaaatccattctccgttccccagccgcgcctcaccaatggcctaccttcctcgctctcatccactggctcgtccagatcgccaaattccacctccacctctcttcttcccccaaacagcacaactccctctaccaatacaccgtcaacagctacatgcacttcatccacaacgaggacgacgccgttgaggacctcgaccgcagcatcaaggataagctccaccacgagaaggccgccgccgaggaacgcctccaggccacgcgccgcagcgccgccgagctcgaggcggagctcgagcggctccggtccgcgccctcactgaaggaggcgctggagaaggagaaagcaatgctggaggacgacgtgaagaagttccacaagatgatcgaggagttatccctgcggatcgagcaggcggagagggttctggcggagaaagagaagcaggtggaggcgaagcaagcggagaacgagaagatctgcgaggagaatgaggagctgaagcgtcgcgtggaggcgcagagcttcaacgcgagggacgtggagaggatgaagagggagttgcaggcggtggagagggacactgcggaggctgaacttgcaaggaatgcgttggaggagcaggcgtgggatctcgacaccactctctcacacaaaatcaaagacctcgaggctctcggcatggagtgcaaccaagcccttaagaggttgaagattggtaatggaattcaatatctgctgaatgccaagggtactactcctgctgagataatgggaatcgatcacaaacttgtgctgaagcctgcacttagatccttttctgatgaaatcaagaaaagttctatggaaaaactggaggagtccatttcttatcagcagaagtctggtgaaaatgctgttaggcttgaggggaaaagaaatcagcttgcggcagtgcaatcacgtattgatgaaatgggtattggaaagaggaataatgttgcctgtgaggacttctgtttcacattcctttctgctgcttatcgatttatctaccagatggaagctcaactgaacaggataaagaaggaaacacatgaatacacaagtagagcttctgctgaagctaagaaaatgttggaggatgtccagctggcagatcatgaaattgacattatggaaagagaggcagctgaggttctcaaggaagtgattaaacaaagtgaagaagaaattcaaatgcatgccagggaactctttcagctggttgattccgtctcaaaattcaaagaacatgtgggttccaaaatttcagagattgggagggatctatctgaaactgccgctgctgtctcagatacatataggggagcttgtgaaccgttgttgaaggatacagtggttgaggagggtgctgggggctctgacgagacgctgacgtcgataaggatcaacgaatataattttgtacatccttcatcttccgcattgcctccaccttcttcccaccctcctccttcagtgccaccaccggcggatcattctgctcacgacgttgtaggtggtggttctgaggccgggcttcagtgcgtacacgacgtcgaaggccgcggtgagagagggggaggctcctccgaaagttcatttgggtttgaacctgaaagcatatctggaatagttgattttgacgatttcggtctttctgattttcatcgtttcttttacactagaataacagtgttggcaaggaacctaggaagtgggaagtgcggtatcatttggaacagaggaaaatggagagaaggaatctggaatccgaaagctgtgttcgtggccttcggcactaaaggcgatgtctaccctctcttgcagtcagctattgctgcagcttttgcttgtgaccagaaacagtgtgatgtgatgctaataactcactcagcacacgtgaaaaagaaagttgcaatagctcataggcaagaatgctatgctttaattgaaaggatatttggagatggcccaagcttggacggtgatctggtaattgaggagattttcatgatggttcaggaaggatggagccttgcagaaagtttttgtgtccgatgcattgtagctgctccttatgttgttccatacagatacacagagcccgtttggcatactggccacctccaaatggccatcatcaccaatggaggtggacagaatgccaaaatgtctatggaacaaggcctctgggaaaccctagagagcaaaagaaaattaagcagaaggaagttgtag

SEQ ID NO: 1571 - DNA, 792 bp, Glycine max
  Peptide Sequence Number=SeqID_118349
atacggtaccctgatagcttcagagttgttaaaggggctgttttaattgatgatccttctacgtcatgcatcaaagagaaggatttaaatagattcaggtctttaactggtgtcagaactttcaagttaaatataagtgaatgtcaatgttttcaacttgatcgtcggtcaagcaaggaagctgatggtagttgcatgaacaaaatgccagagacttttccaaacgggggatgccaatcagagaaattccaacaagagcgcaagaggaagtatactgatgacacatcgctaatgctggaatttccagatgtcctccctacagaacataatgccaaggtagaaccttccaggaaaaagtgcaaatctgatgggccaacattcatgcctcttctccctattcctgatgttgatgactgcaatcgagattcttctcttattttaacaggggcagccagaagagggccatttggtccatctgttggcgttgtagacattggtattagtaaagtggcatatctatttcgaatttccttaccaggggtcaagaaagattgcacaggtcagttcagttgtgatattgaatctgatgggagggttcagatcagaggggtgctaactggtggaagtactataactaaacaatcacgtgtttttaagatgaaaattaggcagttatgctctcctggaccatttacactttcattcagtcttccgggacctgttgatcctagactcttcgcacctaacttcaggcctgatggcatttttgaaggagttataatcaagcagtag

SEQ ID NO: 1572 - DNA, 309 bp, Glycine max
  Peptide Sequence Number=SeqID_118350
atgacttttgaaagtgggactaagtccatagacgtgcaaaacactctgcgcaatggaattctaagggaccactggaatgttgaagatagaatgaacgtgtatgataggcacatggaattaattactatgccaaattcaagaaacttatcaggggctgaaaatcatgcttccaactccagcatgtactttgttagacaaggttttatacaaaggttgctaatatgtcagactgacatgagtcctacatatgaaatctctaacttgattattgagcacgtagatcaattagtacagattgtttcaatttaa

SEQ ID NO: 1573 - DNA, 2571 bp, Glycine max
  Peptide Sequence Number=SeqID_118351
atggcagcttctaattcctcatccacaaatgaggaacaagaggctttgcttcagagcaaatggggaggtcaaaatatctcaaattattgtaaatggaatggtattgtgtgtaatgaagctcaaagtgttacagagatttcaactacgaaatatttttacattcctccaacagaagctcatattcagaatttcaatgtgactgcattccctaatttaatccatctagaccttagtcgattgggactcaaaggaaaaatccccactgaaataagctttcttaaaaagcttatctatcttgatctatcctctagttgtcttcaaggtgagttgcctagttctctttctagtctcactcaactcgagacacttaatatttctaacaattttcttactggtgtgatccctcctactttgggtcaattgaagaacttgaccctactttcccttgactcaaaccaatttgaaggccacattccagaagaactagggaatttaagagggttgaagcagttaactctttcaaataactccctcaatggctcaatcccttctactttagagcacttgatccatctcaaagttttggatctttcttataataagatttttggtgttataccagaggggatatctgcactgacacaactaacaaatgttcaactatcttggaatcaaatatctggtttcattccatctgggattggacgaatcccaggacttggaattttagatatttccaacaatcagcttgagggacctattccatatggtgttctgaaccattgtagttatgtgcagctaagcaacaactctttaaatggaagcattcctcctcaaataggaaatatttcatatctagatcttagttataatgatctcacaggaaacatacctgagggactccattctgtgccttaccttaatttgtcttacaattccttcaatgattcagataacagtttttgtggttttccaaaagactcattaattggtaataaggatttccaatattcatgctcttctcagtcttctggagctgacatttctttagtaatgataattgtcttttctaccttcaatggaatggttgtttcaatagtccttgtatgttggggcattcatgctttctgtcccccccataatgagtttggaagtgaggaaagaagaaagaatggagacatgctttcaatttggaactatgatggtaagatagcatttgaagacataattaaggccacagaagactttgatataagatattgcataggaacaggtgcttatgggactgtgtacaaagcacagcttcccagtaacagaattgttgcactgaaaaagcttcacaaagcagaatctgaaaatccatctttttacaagagcttttgcaatgagaccaagatcttgacagaaactcgccatcctcaagagttgaattggagcaagaggataaatattgtaaaaggggtagcctatggcttggctcacatgcaccatgattgtactccacccattgttcatcgagacataagcagtaacaatattttgttgaactcggagttacaagcttttgtctcggacttcggcacagcaagacttcttgattgccattcatcaaatcaaactcttccagctggtacttatggatatgttgctccagaattggcttacaccttgactgtgactacaaaatgtgatgtttatagctttggagtggtggttttggaaacaatgatgggtagacatccagctgaattgatttcttctttatcagaaccatccattcaaaacaagatgctgaaagatatattggacttgcgaattcctctaccattttttcgaaaagatatgcaagaaattgtgcttattgtaacattagcattggcatgcttgagcccccacccaaaatccagaccatcaatgcaggaaatagctagcacaatgatggctgaggatctcggcgtggaggcgaaggaggccgcagttcgcgaggtcgcgaagctgctgccgcttccggagcttctccaatcgatctcgtccatcaaggctgattacatttcgcgccaacaggccaatgatgcacagcttagtacgatggttgccgaacaggatattggcaacagggatttaagtgagacctcaactgatgctctgtcgttattttgtctagatttccttgaacttgctcttgatattgaattaactgaggcaccaaatctcatatcttcgtgtgctttgtcaaaaatacttctgcaggttgagcagtcacaggcaggactaaaatcactctccttctctgagaggacaataaatcagcttcgtgaaaactttgtctccattgagaagtatgatgtagaaggtatgatgtctatctctgatgaggcagcagaggctcgggattctttgagcgatgacaaagaaattgtcaacacttacgagaggttaactgctttggatggaaaacgaaggtttgctttagcagctgctggatctcacaaggaagaggttggaaggctaaggtttgtgtcttctttagtgcactgtcacattcattggctgggtgagcaagaatcctga

SEQ ID NO: 1574 - DNA, 1929 bp, Glycine max
  Peptide Sequence Number=SeqID_118352
atgcttgtgtgtgccactagttgctcatcacaccagccatgggcttcacccattcccacactcaccacactcccaaaatgcacaaccgcagaacacgtgaaccagctccacgcacgcatgatcacaaccgggttcctcaaaaacccttccctcaccgcaaaactcgttctttcttgcatttcctcaccccgtgagcctcttgtcgagttcgctcgctacgttttcttcaagcaccacgcttttcgcgatttccgtgatgacccttttctctggaacgctctgctcaggtcccactctcacgggtgtgaccccagaggggccctagttctgctctgcttgatgatcgaaaatggggtgcgtgtggatgggtactcgttttcgttggttctgaaggcttgtgctagagtgggtttggttagggagggaatgcagaattgtttgattgggttgtttgtgagatgcgggtgtgttgagcttgcgcgccagttgtttgacagaatggctgaccgggatgttgtttcgtataactctatgattgatgggtatgtgaagtgtggggcggtggagagggcgcgtgagttgtttgatagtatggaggagaggaatttgattacttggaattcaatgattggagggtatgtgaggtgggaagagggggtggagtttgcttggagtttgtttgttaaaatgccggagaaggacttggtttcgtggaacacgatgattgacggttgtgtgaaaaatgggaggatggaggatgctcgggtgttgtttgatgagatgccggagagggattcggtcagctgggttaccatgatagatggttatgtgaaattgggtgatgttcttgctgcgaggcgattgtttgatgaaatgccgagcagagatgttatttcttgtaattcgatgatggcaggctatgttcaaaatggttgttgcattgaggctttgaaaatattttatgatatgaaaagggcaacaaatgtggtgcctgatgatactacgttgttgattgtaatcacagcgtttgcccaattaggacacgttgaagatggagttgtgatacatcattatttgatggacaaggggtactctctgaatggtaagcttggtgttgctctaattgacatgtattcgaagtgcggtagcattgataacgctatctcagtgtttgagaatgtcgaacaaaaatgtgttgatcattggaatgctatgatcggtggtttagctattcatggaatgggtttaatggctttcgattttctcatggagatgggaaggctttctgttattcctgatgatatcacattcattggagtgttgagtgcttgtaggcatgctggcatgttgaaggaaggactgatatgttttgagctcatgcaaaaagtatacaatctggaacctaaagtgcagcactatggatgcatggtggacatgcttagtcgcgcagggcacattgaagaagccaagaaactcattgaggagatgcctgttgaacccaatgatgtgatttggaagaccttactcagtgcttgccaaaattatgaaaacttctctataggagagcctatagctcagcaattgactcagctatattcatgcagtccaagttcctatgtgctcctgtctaatatttatgccagtttgggcatgtgggacaatgtaaagagggttaggacagaaatgaaagaaaggcaattaaagaaaattccaggttgtagttggattgaactggggggaattgttcaccagttctctgtacaagataggacacaccctcaggtgtctaaacatgtagtgctgatgcagcaattttccaagaccaaggtctgttcggatatggcttatgcatccaaaatagtcatggtgcttctgatttggcaaaaacagcaagctgaagctcttgcattggctgaagctctttattga

SEQ ID NO: 1575 - DNA, 321 bp, Glycine max
  Peptide Sequence Number=SeqID_118353
atggcacctagctctaatgttcttgctgcttatgttcctacagaagtagtagcaacaattggcaacaatgtgatgttatctagtggctacaatttgctgtctggaacatccatggcatgccctcatgcttctggtgttgctgctcttttgaaagctgcacacactaaatggagtgctgctgctataaggtctgcactagtaaccacagctagtcctcttgataatacacaaaatccaattagggactatggttacccttctcaatatgcttcccctcttgccattggagctggttcagaggttgagccagtgacttgttga

SEQ ID NO: 1576 - DNA, 1026 bp, Glycine max
  Peptide Sequence Number=SeqID_118354
atgcatgctcattgcttgatagtgctggaatgctctcagaacttcaaaacattctctggtatgacaacttttgtgctgaactgtaagcgacctgttctgaaatgggagaataatatggcatggcctggcaaacttactcttactgataaggcaatctattttgaggcagttggcatactgggaaagaagagagccatgagattggatcttatacatgatggattacaggtagagaaggcaaaggttgggcctttcgggtctgcactttttgactctgctgtttctgtttcttctggctcagagttgaatcggtgggtgctggaattcatcgacttaggaggcgagatgaggcgggatgtttggcacgcatttataagtgaagtcattgctttacacaggttcatacgcgagtatggacctgatgattctgatgagtcattgtttaaagtatatggagctcgcaaaggaaaggatagagcaacaaccactgccattaatggtattgctagactccaagcccttcaacatttgcgaaagttgcttgatgatcccaccaagcttgtgcagttctcatatttacagaatgcaccacacggtgatattgtcctccaaactttagctgttaattattggggaggtccactagtttcaggatttataaatacccgcaatcagccagaaattcgcccttctgatgaaatatctgatagccgcagccatgtgtttgacatagatggaagtgtctacttgcagaagtggatgaaatctccatcttgggggtctagtacttccactaatttttggaagaacacttcagtaaaaggtttaatattaagtaagaatcttgttgtggctgatttatcactcacagaaagaacagcaaaaacatgcaaacaaaagtaccacgttgtggagaagactcaagccaccattgatgctgcaactctacaaggcatacccagcaacattgatcttttcaaggttgggatgcttaacttgctcatcacctttgataaatttaagtaa

SEQ ID NO: 1577 - DNA, 240 bp, Glycine max
  Peptide Sequence Number=SeqID_118355
atggaactgattgaaaacatggcagccagcgaccatgccatattgcgtgatagaatgcacattcccacaaagagaaatgatacatccaaagaggttaactacatggcaaatcagaataggcaaggatttcatctaggtggctttgcaaggtatcagcaagggggaaacttttctcataaccacggtcaaggttggcggtctgttgagactttggcaagtgtaccaaatcgctctaagtag

SEQ ID NO: 1578 - DNA, 1323 bp, Glycine max
  Peptide Sequence Number=SeqID_118356
atgaagggcggccagtacggtgccttcggtgccgttaccttggagaaatccaaactcgatttatcccaaaagcaaacaagctttagccccgagctagacattgggggaggtggaggagacattggaaagaaaatcaatcatggtggtggtgatggaggtgatgatgatggggatgatgacgattactttgatgacttcgatgatggtgatgagggagatgagggtggcttgtttaggagacggatactttttgaagagctatttgaccgaaaatttgtggatgctgtgttaaatgagtggcaaaagactatgatggatttgcctgctgggcttcggcaagcttatgaaatgggcttggttagctcagctcaaatggtaaaatttcttgcaatcaatgccaggccaaccaccagtaggtttatttcccgaactctgcctcaagcactatcaaggtctttcattggcaggttgcttgcagatcctgcattcttgtataggtttctattggaggaggctgcaacagtaggttgctctttgtggtgggagataaaaaatcggaaagataggataaagcaggagtgggatcttgcattaatgaacgtgatgacagcagcagcatgcaatgcactagttgtttggtcccttgctccttgtcgatcatatgggaacacttttcggtttgatttacaaaatacattgcagaagcttccaaacaacatatttgaaaagagctatccacttagggaatttgacatgcaaaagagaattcaatgctttctgttcaaggctgctgagttgtgcatggttggtttgagtgctggtgcagtacagggtgcgttgtcaaactctctggctagtaaaaaggagggaagattatctgtgacagtcccaagtgtgagcagtaatgcgcttggttatggtgcctttctcggaatttatgccaacctgagatatcaactgttatgtgggtttgatagagcaatgatgacccattttgatgttattggagttgccttgttcttcagcacaacattcaggatcttgaacgttcaattgggagagacttctaagcgtgcctggcttggagttgaggcagatcccctggctcagtcggatgacctcttgaaagtgtataacaggacttctgagaatgtagaaaagtcatcctcaaaatggtttatatcaaaaaatgcagttgtttctgggcttgggctcttgggcatcaaacaaaggaatacagacgggtctggtgcagaatcttcagctcctaaaactcgccgaaaaaggattgttcggaagaaggttgcggcgggttctgcttag

SEQ ID NO: 1579 - DNA, 426 bp, Glycine max
  Peptide Sequence Number=SeqID_118357
atgatgataacaaaaggtgatgacaaaggtgatgacaaaaagctcaaagatcaatcaaagaacaatcaagtgaatcaaagatcaatcaaagaacaactcaagtacatcctttgtggtacaagtagagggtacatctacttgggtttgactgagaacaagagagggtacatctcttgtggatcagttctagtggagggtacatccactagggtttcaaagagaacaagggagggaccgcaggtcgcttggggattggagggtacatcccttatggagcactcaaacccgatgacccccaaggcctacactccgaagagtccgtcagggcctctccctcttgattcaggtccaacccctaaaataattttgcatgcagacactactcatgaattatacaatacccacgacctcacactcatgttttaa

SEQ ID NO: 1580 - DNA, 1145 bp, Glycine max
  Peptide Sequence Number=SeqID_118358
atgggaagagacgggcgcgttaaagcaacgctccaagtgaacggtggagtcagtttcgacgtgggcggtgattttgagagtgttgaagtcgtcggaggaatacgatcgcacgctgacacggagaacacagcgtctgtgactgagcgtgggaagcatgggaatgggagaaccgtgaggttaccctttacaaacaatgatggttctacgtgcccctattgcttccaccaactgcgttatgagcttgatatctcaaggccaaggcttctcatgaacgtgccaaataacttggagccttcacaagccactcaactaatgcataacttggctctcattcttgatccacctcttaggaggcaaaacaacaaccatttgaacacaaccccacattgggaaacagaaaatgaagatggtttaaatcctcaggcttggattacactccgatttccaaggccaactcgtcctcctaggcctatttccccaccacaaaatttggttccccagaccaatgacactgatcatgacaccctttttgagaacacaatattagatgacttcattgatggggtgattcagaacaataatagaccggggccacctccagcaacatcttcagccattgcagcattgccgatggtgaaattgacacaaacccatttggcaagtgaccccaattgcccaatttgcaaagatgagttcgagcttgatatggaagccagagagttgccatgcaagcatttctaccattctgactgcatcatcccttggctgcgcatgcacaacacttgccctgtgtgccgctatgagctacaaggtgttagtactagtggtaatgctaattactaccgtttacaaaatgatgagaatgacatgaggtttgggtttgaggatgctgcaagcagcttggtctgggtttggaaccaattgacttcgtttaggcctatccgttctgttctagattggacacggtcctactttaatttccaagaagatcatgttcgtggtcgtagagttgcaagtttaaaggctgacaaaggtgtcatgaaccagcaggtagctcttggtggcgagcattgtaaaaggtggacagcaactcatttcaagaacacggatggaattgatacagaagttctcataggctacttctg

SEQ ID NO: 1581 - DNA, 252 bp, Glycine max
  Peptide Sequence Number=SeqID_118359
atggcaagcttacagaaaaatgcacacattgaagtcataaacttgattgactattcaagggaatatgctaatacttacaaaacattggcagcaaggagaatttctgtccatttccttccattaaatggatctttaccagacatcttggagttggaaatcccagcctttccaaagcggcctccatctcctcccccattaaagaaggagaaactagttgaacatgaggaagtcaaatcgccagttgatagttga

SEQ ID NO: 1582 - DNA, 210 bp, Glycine max
  Peptide Sequence Number=SeqID_118360
atggatatgaatgtgttgaatttgaagagagatccgaggaggcaggaaaggaaacgaaaccttgacggaaatggtggagttgttggaatgatcattcccagtgtcgacgacagcgtaatcgcccaaaacgacgacgttgttgtggatttcttcggaaacgcacttggtgctgaaaggtggtacggtgacccagagagccccagaggttga

SEQ ID NO: 1583 - DNA, 1260 bp, Glycine max
  Peptide Sequence Number=SeqID_118361
atggatcctctccctgatgccattcttcaatacatcttgtcccgtatcaataacgctcgcgatgtggcagcttgcaattgtgtttctaagcgatggaaggactcaatggcttacatcagaactctctacttccctcgcaactcgtttgataacccttctctccgtgaaagtccggacgacatagtgaaaagaatggtatcaatggttgtgcgattagaagagctagttgtatacggccccttctccccttccggccttgcttcgtggctatcacttgttggtatgtctctttctcagcttgagcttcgaatggacaatcttgctgacaaccaagcctcccatgaaagcccttcaaaattggattgcattggtgcagcaaggaatttggaatctctaaaactatggggtgtcttaatgatgcattccccaaaatgggatgtcttccaaaatcttagaacccttgaaatagttggtgcaagattggaagaacctgtattgactgtggtgtttcagtcatgtccatatctgagaaggttgaaactgcttggatgtgaaggggtaggatcaatctcaattgaccttccctatttagagcagtgtaagctggatttttatggtctggggaactgttcacttacgctatcctccccgaaaattgaatcccttgaggtacaaggctgtagttggattagggttcctgaaacccagcatttgaggaatctttcaatatccaatagcgcagggagagtatatatggtggatttcggaaaccttccagctctggagttcctgactatgaggggggtccagtggtgctgggatgcaatatgcaaaatgctgaaaatggcaagtgaggtgaagcatatttatatgaaggtggaattcactggggactatgaggctcttcaaccctttccagagattgattttgttgattttttcaacaaccatcccaaactgcgcaagtttgacattcatggagccatgtttgcagcactttgccagaggaacagcctgaaacatgtggatccaggatttttaattccatgtttggaggaggttgtgatcacagtgagatcaccactaaatgccgaacaaaaaatgagtactcttgaatccttgttgaagtatggcaaaaatctaaggactatggttatcaagattcttcagatgaagagctcccatagcagcgctgatgatttttttgatgagatttgccggttgagatacatgaaccatggaatagttcgaatagaataa

SEQ ID NO: 1584 - DNA, 408 bp, Glycine max
  Peptide Sequence Number=SeqID_118362
atggggtcaaagtttccgatgacccagttggggatatcgcccagatatgtgatttatccccacagtgcatacaactacaagtattccagaagaatattctcagagcaaaagttcccgttcaagttcgtggcgcagtccttaggggataaatggaagctaaatgacataagtactagttctatccaagaaagatggaatgtattgatgtcgaggacccaaaatttttggaatgaagttacctttccacttgcaaaacctggtcaaactaggaagcctgatcctgaaaatgattgtggatttcaagttatggaagacattttaatgatagagaagacaattgaccgcagaacaccatgtggggttctttctctagctgctgtgatttgtattgaacaattcagcaggtga

SEQ ID NO: 1585 - DNA, 207 bp, Glycine max
  Peptide Sequence Number=SeqID_118363
atggggaaggagatgcaacagttgatctgtgcgtttgtgctaataactttgagtttcatgatgttttctgcagaggccagaaacctacatgcttttcagcaacaggcaatggaagaacctagtgccgctggggagcaattcccccatctgggccttctacaccaactcactcctactgctgctgctactactacagctggtcgctaa

SEQ ID NO: 1586 - DNA, 402 bp, Glycine max
  Peptide Sequence Number=SeqID_118364
atggagaacatatcaattggtaatttcgccttcacaactcgagagagtggaaactacctagcatgcttctgggtgggtcatagtgaacgagctggtggagacgttagtgtgaaccttgattggaaaactggaattgcagccaaggattgggattcagttgctaaaaaagaaaagattgagggagtagagcttcagttgagaaagctagaaggatcagttgaggctgtccacgagaatttgatctatctgaggggcagggaagcagtggtaaggaacgtgagtgaatcaaccaatgccagagtggtgtggtctagttttatgtccttgggtgtgtgcattgcagtttcagttctgcagttgtggcatttgaagcgatacttccacaagaaaaagcttatctag

SEQ ID NO: 1587 - DNA, 822 bp, Glycine max
  Peptide Sequence Number=SeqID_118365
atggccttatcctctcccttcctcatttcagctgtgaacgccacatgttcagtaccccatttccatttccatttccatgcacagccactttcactttcttcttctcacttcccaattaatattagaccctccacccatcatcacgttcatgtctctcacaatcacaaatggagagcaaaagtttcatttttcacttccttcttgaagaaaggcaaagatgctaagatcatcaaggaagaaatgcttgaggccattgcaccgcttgatcgaggggctgatgccactccccaagaccagcaaacaattgatcagattgcgcgggaacttgaggcagttactccaataaaggagcccctcaaaactaacctactcgatggaaaatgggagcttatatacactacctcgcagtcaatcttgcaaaccaagctaataaaccatccaaggactaagatatgtttagttagatattatgatttgatgcatctaatgtttgcaagcatgttgcagcagagaccaaagttgttgagatcagttgcaaattatcaagcaatcaatgtcgatactctaagggcccaaaatatggaatcttggccattcttcaaccaggtgacagcagatttaacacctttaaatccaaggaaagtggctgtaaaatttgatactttcaaaattggaggcattatacctattaaagcccctggaagagctcgtggggaactggaaataacatatttggacgaagaactgcgggtatcaagaggtgataaaggaaacttgttcatcctgaaaatggtggatccatcttacagagttcctgaatga

SEQ ID NO: 1588 - DNA, 381 bp, Glycine max
  Peptide Sequence Number=SeqID_118366
atggacttacaacatcaagcaccccctcctctggtggtcttagaggccagggaatttgccatgagttatcaattagttggcatgatgaatggattgactgggaagaaaatgcagaaaatttttgaagcacttgtgcctgaatctgtatataataatgcccgtaatttggttgaatattgctgctttagatttttgtcaagggatggttctgatattcatccttccctccaggaccctgcattccagaggctgatattcataaccatgcttgcctgggaaaatccttacactaatgacctttccagcaatgcagagaaggcttctttacaggttcacttctttcctttagttagtgtacttcaccttcccttcaagcattga

SEQ ID NO: 1589 - DNA, 327 bp, Glycine max
  Peptide Sequence Number=SeqID_118367
atgggaagtgagggatatgaacaggtggtgggtgctgatagggtgttttttcattgctcgattgtgacatttgcttcttcatgtgataaaagatggagcacacaatggcgaaaaagtcgttctatttcaccaagaggtcacagaagtccttctacaactccaagacgtggtagaagccgatctccatctgctaaacgatacagaagacatagaagtaggagttcctcattgtctcctactcgtaaatcttccagtccaagtcttgtgtcagtagagcacaaaagtgccactgaaaaacaaaagaaagaagaagagaagaaaaggtag

SEQ ID NO: 1590 - DNA, 552 bp, Glycine max
  Peptide Sequence Number=SeqID_118368
atgactagttttaaaactgcagcatgttacttgaatttcttcttcacaggcttgtctgaagaaaggcgtcaactagaagcagagttgaaattaatagaagaagagactgcaaagagagttgaagaagcaatacgtaagagagttgaagaaagcttgaaatctgaggaggttcaggtggagattgaaaggcggttggaagagggacggaagagacttaatgatgaagttgcagctcaacttgaaaaagaaaaagaagctgcccttattgaggctaaacagaaggaggagcaagcccgtaaagagaaagaagatcttgaaaggatgcttgaggagaaccggaggaaggttgaagaagctcagagaagggaagctttagagcagcaaagaagggaggaagaacgatataaagagctggaagagatgcaaagacagaaggaagaagccatgcgaaaaaagaaacaggaggaggagcaagaacgtctaaaccaaataaagttgttgggtaaaaacaaatcccgaccaaaattgtcatttgcttttggatccaaatga

SEQ ID NO: 1591 - DNA, 1809 bp, Glycine max
  Peptide Sequence Number=SeqID_118369
atggagaaggatggaactggtgctggtgtcattgacatagacaagaccacgacgacattggaacaggaaaaacctactagtggtgggctctatgttcctggcaaggatagagtggtttacgtgcctcaggagagaaaatcgcgtttaggactcgatgcccttgccagcgcaaaacggtctcaacatgatgtgggcttcaaggtgccaaaagaaagaaccatttccattgcagcatctgcagaggatgaagataagtccgagtcatctgtttctgaagaaagtgggcatgatgggattgtcaacagacgcagacacactaataggagataccgtgatacgaccaacgaaacatctcatgcagaaagttctgtgaccgaagatcactatggtgataccaaccgaactcctttaacagagcacaagggttcagatgttcctgcatcgccttctagatatgacagggaggatcataggagtgagaggaggcatcacagggatgattcaagaagcggtagtggaagagtgcggcagtgggactactatgagagtaggggatcttattcagaaagggattcacatagtaggtatgaccgtgagtatggcaaaaagcgaaacagatatgaaggttccaggagaacgcctggcaggtctgactgggacgatggccgatgggaatggggagacactccacgaagggacagtgtctctagttctagacgtcatcaaccttcaccatccccaatgtttgtaggtgcctcacctgatgcacgattagtttcgccatggttgggaggccacactcctcattcatcctttacttcatcttctccttgggaccatgtttctccgtctcctgtcccaatacgtgcttctggatcttcgaccaaatcttctgtctctaaacataatggaaggtcacatcaacttagtttttcatctgaaacttcaaatagatatgaggatgaagtggctgataagtctgacttgggtgaagaacacaagtatgagattaccgaaagcatgcgtttagagatggaatatgatgctgaccgagcatggtatgatagagaggaaggtagcacatttgatggcgataactcatcactttttcttggagacgaagcttcctttcagaaaaaagaggctgagttggccaaaagactggtccgaagagatgggaccaagatgtcccttgctcagagcaagaagttgtctcagctcacagctgataatgctcaatgggaggatcggcaactgctgagatcaggagctgttagaggtaccgaggttcagactgaatttgacgatgaggaagaacacaaagttattcttcttgttcatgatacaaagcctcctttccttgatggcagagttgtttttactaaacaggcagagccaattatgccattaaaagatccaacatctgacatggctataatatctcgcaaaggatctactcttgttagagaaatccatgagaagcagagtatgaacaagtctcgccaacgcttttgggaacttgcaggctcaaaacttggtgatatcttgggtgttgaaaaaacagcagagcagattgatgcagacactgctgaagtgggtgaagatggtgaaattgattttaaggaggaagctaagttttcacagcatatgaagaagggagaagccgtgagtgactttgctaagtcaaaaacccttgcagagcaaaggcaatatctgcctattttttcagtgagagaagagttattacagggcagtgtttggtcaaaatgtaaggaacatatgggaattcaatctctcgagttgaagtag

SEQ ID NO: 1592 - DNA, 231 bp, Glycine max
  Peptide Sequence Number=SeqID_118370
atggttaggtctcctcaggaacaggtgcaggagatggctcagggctcaagaggggagagctcatcctccccctatgctgctcggaaagcgcaccagatcgtcaagtatttaaaattaaaacggatgaattcgagtatcgaactcagggaaccagtcttagacaggattaaattcagaaataaggcgttgttgaaagaaacattgataattgatgatttagaacagaattaa

SEQ ID NO: 1593 - DNA, 339 bp, Glycine max
  Peptide Sequence Number=SeqID_118371
atgtcactcagttctgtgataaggaaatccatctcccctttcaccagccttacaacgttattgccaatgatgaactctggggcatacgcaaacatcatagtgaatctcaacgctagggaagaaaaagttgtagaaaacatggacttccaagaggaagtttgtgaggctagtgatgtgcctgtacagtacagacttgaaaattctgtctggtggaatgacagagcttgctctgctcacagttttattgaatttaaaccccaccctaattatagtaacaagtactcaagaaatttctggactcctaaccgaaatctcaatatcaaggtttctcacaactag

SEQ ID NO: 1594 - DNA, 1416 bp, Glycine max
  Peptide Sequence Number=SeqID_118372
atggaagatagtggaaggtttgatgagaagtccttttcaaatggggatgtctacataggtatgatcaagggcatagtgcctcatgacaagggaaagtacacatggtcagatggaacggtatatgagggcgattgggaaggcgagaaaatgacaggaaagggactgattgtgtggtcatcaggagcacaatatgagggtgaaatctctggaggttacctacatggttatggaacacttacaacatctgctgggtgcatttatagaggaggatggaggatgaatgctcagcatgggattggacggaagcagtattccaattctgatgtttttgagggtttatggaaagaaggagttcctgaagggagtggcaggtatacttggaataatggaaatatgtatgttgggaattggaaaaacgggaaaatatatggtcgaggggttatgaagtgggttaatggtgatacttttgatggtttatggttaaatgggcttatgcatggaacaggagtttatagatttggagatgggggcctttatattgggacatggaataaaggcttaaaggatggaaaaggagtattctatcctgcaggtagtaaacatccatccttaaaaaagttgcatagccctcgtgatagtgatcataacggtttcttgttgaatgtagaaaaacaagaggctccaaaagccagagttaagcgtagcctttctgaaaacatgccggtcattagtagattcaaaagtttccgtcaaatatctcacaggacttcatcattgaaaataaatttgatccgtagtgattctgctcaagattgtgtatgtcatgattcttctcttacattatccaatgcgttggatggagatcaatctgaggcatcgggtgaaagtactttggtttatgaaagggaatatgtacaaggagttctaattatggagagaatttgtgagtgctctgagtcatcacgtgaaaagaaacagcaaaataagtttagtgtgaagcaagtaaagaagagttcatgtttggacatttttgaaggccggcgaagctattatcttaagcttaatttgcagcttggcatcaggtataccgttggcaaaattacaccagtgcctgcacgcgaagttcgatcatctgattttggggatcgagcaagaataaggatgtacttcccaagggctggttcaaagcttactcctccgcatagttcaataaacttctactggaaagattattgccctatggtcttcaggaatttgagagagatgttcaagttagatgctgcagagtacatgatgtccatttgtggagatagtggtctaagggacttgtcttctcccggaaaaagtggcagcattttctatctttctaaagatgatagatttgtgataaagactgtgaataaatctgaactaaag

SEQ ID NO: 1595 - DNA, 1299 bp, Glycine max
  Peptide Sequence Number=SeqID_118373
atggatccggagcagactttcatacgcgtgcaggagaggttttctcagatgctgacgcccaaagtcagagttgctttggagtatctctacctgttcatcgccataaccttattctgcattctcgttgttatgcacgccaattacgttcaacagcctgggtgttcaagtgagctatccggagtagtgacatcagaagcccaacttattcagattaagataaccagtgccggcctgtggtctcataatgattctgaatcaaacagaatagatccccctgaaacagaaattgtaaaagacaaaatggagatttctgatgtcagtggagataaattgccatttttggcttccaagctttggtggaactggattggttcaggtgctaggagaggaaaattggtattcaagttttggaaaactgacactgagtttcttgaacatcaagctgaaacctctacaagtaatcaaaacaccaggccagtgggtgaagatgctgtcatcaaaattgataaagaggacccaccaaaaagttttactttatcagccaaagagacattaaaagcagcaattatacattttggtaaaaagtggtataggcgcatctcattcatttggaggcacaccatgcagatcatcggaagttttcagaagctatggaatattgctggtgtacacttaaatcttgatattcccaaatggatgcatatccttcgtttggacaggcttaacaccaatgcagtgcaatggcttaacaagaaaggaaagttatttgaacccacatatctttatactatggaaaaggggtatttcttgttacctgaaagtgctaaatctcatcataatatacgtactgtgaatgttagcatatcagcttggcactcctgctttggaaacaggtggcagcaactactcataaacagatttgtcggatatgatacgattttaatcaatagtttattgagttctcctggtcaaggttatctttataactatcaaacaaaggaattctataaccttagttatgcacaagaagttccggaaggcccagctaggtttggagggttgagacctggttttgatcaatcaatgccccaaaatggaccaggagttgccgatcctcaagatcggtcagaaaataatcgagacagggttgcgaaccctgcccagattcctgggcaagctgacattcaacaagcagaaagggacgtgagagagcaaggacaagtttttaatgaaacacctggggctggggctggggctggtgatgaaagccgtgagaatcaggataatattgacagatag

SEQ ID NO: 1596 - DNA, 3138 bp, Glycine max
  Peptide Sequence Number=SeqID_118374
atggcgcagtctctggagctgttgctgattcagttcctgatgcccgacaacgacgctcgccgtcaggccgaggaccaaattaagcgcctcgccaaggacccccaggtggttcccgccctggttcagcacatgcgcaccgccaaaacccccaacgtccgccagctcgccgccgtcctcctccgcaagaagatcaccggccactgggccaagctctctccccaactcaaacagctcgttaagcagtccctcattgaaaccatcaccatggagcacagtccccctgttaggaaagccagtgccaacgttgtcagtatcgttgccaagtacgccgttccctccggcgagtggcccgatttgttgccctttctcttccaatgcagtcagagttcgcaggatgaccatcgcgaagtggcattaattctcttcagttctttaaccgaaacaattgggaatgctttccggccgtattttgcaaatctgcaagctcttctgctcaagtgcttgcaggatgagaccagcaaccgggttagagttgctgccctcaaggccgtgggatcttttctggaattcactcatgacgaggatgaagtgattaagtttcgtgagttcattccaagcatcttgaatgtatcgcggcagtgccttgcctcaggagaagaagatgttgccatacttgcttttgaaatttttgatgagctgatagaatctcctgcacctcttcttggagattcagtgaaatctatagtgcagttctcccttgaggtttgctcaagtcaaaatttagagtctaacacacgtcatcaggcaattcaaatcatttcatggctggcaaagtacaagtccagcactttgaaaaagcataagttgatcatacctattctacaagttttatgccctttgcttgccgaatcaactaatgaaactgaagatgatgatcttgcaccggatcgggcagctgcagaagttattgataccatggctttgaacatcccaaagcatgttttccaaccagtttttgaatttgcttctgtaagctgtcaaaatgcaaacccgaagtttcgggaagcatctgttactgctttgggtgtcatttcagaaggttgtttggaactcatgaaaagtaagctagaacctgttctccatattgtcctgggagctctgagggacccagaacaaatggtcagaggggcagcttcctttgctttgggtcaatttgctgagcacttacagcctgaaattgtatcccattatgagagtgttcttccctgcattttaaatgctcttgaggatgtatctgatgaagtaaaggagaagtcatactatgcgttggctgctttttgcgagaacatgggtgaagacatccttcctttcttagatcctttgatgggaagactgttgacagctctccaaaatagttcccgagtcttgcaggaaacatgcatgtctgccattggttctatagcttctgctgcagagcaagcattcattccttatgccgaaagggttttagagttgatgaaaagtttcatggtgttaactaatgacgaggatcttcgttcccgtgcaagagcaactgaactagttggaattgttgcaatgtctgtagggatagcgagaatggaaccaatatttcctccttacatagaagctgcaatttctggatttgggctggagtttagtgagcttcgggagtacacccatggattcttcagcaatgttgctgagattttggatgccagttttgcaaagttaaaatttggtattggtaaacagtatcttcctcgtgttgtgcctcttgcattttcttcctgcaatcttgatgatggctctgcggttgacattgatgagtgcgacgatgaaatcgctaatggatttggaggagtttcatcagatgatgaagctcacgatgaaccaagagttcgaaatataagtattagaactggtgtgttggatgaaaaggcagctgcaacccaggcccttggcctctacttggacgagacactaagaatcttggttaaacactccagttattttcatgaagatgttagacttcaggctatcatttctttaaaacatactttaactgcggccaatgcaatcttccaaagtcaaaatgaaggggctgctaaagcaaaagaacttctcgatactgtgatgaatatttacatcaagactatggttgaagatgatgacaaggaagtggttgctcaagcttgcactagtgtggctgacatcattagagattatggttatgcaactcttgagccttacttgtcccagcttgttgatgcaacttcattgttgcttcgggagcaatctgcctgtcagcagatagagtcagacagtgaaattgatgatgttgacagtgcacatgatgaagtgcttatggatgcagtttcagatcttctccctgcatttgcaaagtccatgggtgctcaatttgctcccatttttgctcagctatttgaacctctaatgaaatttgctaaatcttctcgtcctcctcaagataggactatggtagttgcctgcctagctgaagttgctcagaacatgggttctcctattgcaagctatgttgatagggtgatgcccttggtacttaaagaactagcatcatctgaggcaactaatagaaggaatgctgcattttgtgtgggagagttgtgcaaaaatggtcatgaacaagctttgaaatactatgacaatatattacgtggacttcatcccttgtttggtgagtctgagcctgatgatgcagtgagagataatgccgctggtgccgtggcaaggatgatcatggtacaccctgaatctatcccattaaaccaggttcttcctgttttcttgagagttcttccattaaaagaagaccacgaggagtctatggctgtctatagttgtgtcttctctcttgtattctcatccaatccccagatcctctccctagtccctgaattagttaatctttttgctcaagtggtggtatcacctgtggagacgcctgaagttaaagctgtagtaggcagagctttttctcatctaatttcattatatgggcaacaaatgcaacctcttctgagcaatctcccacctgcacatgcaaacgcattatctgcatttgctcaacggagttga

SEQ ID NO: 1597 - DNA, 165 bp, Glycine max
  Peptide Sequence Number=SeqID_118375
atgtggcgcaagggacctctgggaccaaagactttgtgcaatgcttgtggccttcaataccttaagatggtgaagggtacaggcagtggcctccctgcggcagtttcagatgaaggtgatgcttctgtcccagctgaaaccgtggaaagggattcaaatctctaa

SEQ ID NO: 1598 - DNA, 1314 bp, Glycine max
  Peptide Sequence Number=SeqID_118376
atggttcagtttaagcttatgacaatggaagctcttctatccaaatactttcctttctataacctatctgaaggctcaatctctgccacagaatccttagcagtcatagcatcaattctcatattactttgcttctgtttcagatcttcaagtatctaccttcttgactatgtttgttatatgcctcctgataatctgcgccttccttactctcatattgtagaacactttgaattgtgcaattttgaccctgaactcataggctttgaattgaaagtattggaaagatccggtattggcgtggaggcttgtgtgccagaatcagttcatgagctccctccggatgattccatgaagcgtgcacaggcagaagttgaatcggttctattcagaattgtcaaagacctcctttcaaaacacaaagtgcatcctaaaagcattgatatccttgtgtcaaactgtagcctattctgtcctacaccatccattacatcaatgatcattaacaagttcggattccggagcaacgtaaagagtgtcaacctgagtggaatgggttgcagtgctggattgctgtcaataaacttggccaaagatctgctgagagttcacaaaaactcattggctttagttcttagcatggaggctgtggctccaaatggctacagaggtaataccaagtccaagcttattgccaatgtattgtttcggatggggggagcagccattttactatctaacaaaaaacaacacaagccggtggccaagtacaagcttgagcatcttgtgagaacccacatgggatcaaatgacaaagcatatcagtctgtttatcaggaacctgatgaagatgagattgtgggtgtttccctctcacggtcacttctaagtgtagctgcttcagctttgaggaccaatataacagacttaggccctcttgtcttgccctattccgagcagctgcgctatggatggtcagtgatttccaggaaaatgtgggcaagggggaacaaggaaatgtatgttccaaatttcaggaaggcttttgagcatttctgcatacatgctggtggtaagtcagtcgtagatgccatagaggagagtctgaagctgcacaagaaagacggtgaagcctcaaggatggcattatacagatttggcaatacttcatcttcttctgtgtggtatgagctctgctatttggaggcaaaaggaagagtaaagaaaggagacagggtctggcaaattgcctttggaagtggattcaagtgtaacagtgcagtctggaagtgcctctctgatattgatcctaat

SEQ ID NO: 1599 - DNA, 2211 bp, Glycine max
  Peptide Sequence Number=SeqID_118377
atgagaaaacgcagcatttacgcatggctagtagcacttgtttgcttcctcctactcatgatcgtcaccccagccattccccagtcacaagaataccatgatttcgccgaccaccgcaccttcctcggtattcccaatgcacttaacgtgatatccaatttcccttttctggttattggcctcgttggacttgtactctgtcatcatggaaattactttaggctcagcttgcaaggtgaactatggggctggacatgcttctatgttggcgtggctgcagttgcagttggatcttcatactatcatctcaagccagacgatgctcgccttgtgtgggatcgcttgcccatgaccgtcgcttttacatcaatcatggcaatattcatcattgagcggattgatgagaggaagggaacggtttctattatacctctagttttggcggtccaatttgtgccatgcattgtcattcctctaatggctattttgttgcctccaatgtacacacattcaacatattggctctgggctgcagggtcttatcttctagctaaggtgctagaggctactgatgatgtgatctatgaatgggcgcaacatattgtcagtggtcacacacttaagcatctggttgcagcaatggttcctgtcttcttaacattcatgcttgctaagaggagtgttgaacctgagaggattttggttagggtttacgaggagaagaagataacagaaccaaagggtttgggaagatgggaagaagtaacggtcgaagctcttaattccaccgcaaagcttaatcacgctcgcacacccaagcactgcaaaaacgacgatgacgacgacgaaggaaaggctcaaagcgcgtctcgaaagcggcggaagaaaatcgataggagtgaggagacattgcagaggatggaagcgttgcacgtccgaaggaaggtgcagggatcttcctcatcgtcctctgcttcggagtgcgacgatgaagatgaagagggaaccgtgtcgacttcggaggacacaatttacggggagaaggtggagcccgagtttgatttgatgaagacaacgctgcgaaagtcgtatacgccgaagaaggttgccacggaggaaaagaacgttgaattggaggtggggaatagcagtaaggacactcttgtgaatgaggaaatggggaatagcagtaaaggaactagtactcttgtgaacgaagaatggaaagaagtgaagggttcgtgttggggttcggtttcgaatgggaaggatggaccgaggtttaaggatttgggtgggatgaaggaggttttggaggaaccgaagaatgaagtgattgtgcctttgttccatccccaattgcctaggcagttgggagtgaggccaatggctggcattttgttgcatggaccacctggctgtgggaagactaaacttgctcatgctatagcaaatgagactggtcttcctttctatcatatatcagatcctcttgatacaaagtcaggatttttgctttatggacctcctggttgtggtaaaacactgattgccaaagctgttgtcaatgaggcaggggctaattttattcatattaagattgacactttgacaaccaaacgtggtaaagaaggtggttgggttattgaacgactattgaaccagttgcttgttgggttagatggcgcagaggaacgaagagatgtttttgtggttggtgctacaaataggcctgaggtgatggatcgtgctgtactactacggcctggtaggtttggtaaacttctttatgttccacttccaagcccagatgaacgagttttgatattaaaggctcttgcaaggaaggaggctgttgatgcctctgtggatttgagtgacatagccaaaatggaagcttgtgaaaacctaagtggcgctgatcttgctgcattgtactacaactacaaaggttggactatagaaaaagtggtagtcagtttgagagagatactgattttatggactatacagatgaatgaagcagcaatggctgctcttgttgagaatttggactcaattgagacaacttgtgatacattgaccatcaagagtccaatcaagagacaccattttgaggtagcactgagtatagtctctccgtctgtatcagacaggatatggcttattctgctatatctctttcacatgaaatatgatgccttgtggtga

SEQ ID NO: 1600 - DNA, 2367 bp, Glycine max
  Peptide Sequence Number=SeqID_118378
atgggaaaggacttggtttcttctgaccagaccactgttcaaattcaggacaataatccaggatgcatgtggggcatgcttcaaattcttgattaccatcgttggcgcgtaaaaaaggtgtttcctcacaaaaggagaaaacatgccacatataagagaaaacccattttgtatgaccaacatgaagaccaacaacatggagttacagaagcagaatccctccttgtcgggcaacatagcgaaaaattgcatgctgcaggcagaagttctcccaagaatcgcaaaaaggaaccatgcactgagaaaaaggttaacaacgaaaactccaaaggcggtagaaccatggactactcaaggaaaaaccaagccagtaatgagtatgcacttcatctggagaaagatggcaagacaacagaagatgaccttaaccataagcctatggaaacaaacaagcataacagaaacatttccaataaatttgagaaacatactgatgttttcgagttacttagagtggagaaggatttattactcaaatttcttcgagacacagactttggtgggaaaaaagtccaacaagcatcccacatcaatgcaagattgacaaaatctgggtcatttcctttagcctcaacttcacagatgagaaacataagctctaggtccttaaaacacaagcaaaacgaaatttgggcccttccaaagggagaaaagttgcatgctggtactcaagaatcaaacatgtcagtgtccagttctgtgaaagataattcttatgagaatccaatgcctttagcgagtgatcttggtgtggatagtaccatgaaacaaaaagcattcttttctttaaggccttctcagggatcaaatcacaaaggttggaatcaagcggttcttcatcatttcaaagttataaaacagaagataaaacatgctcttgtggaattcagaaaaagcggttgccaagctacttctgctgaagcaattcaccatagggattcacctgaatatagcatgaacaaaaatgaggaagagatctcacaaagcttagaagatggtgtggttcaacaattcaaaagaagtaaaagctcaaatgaaactagagcttctgattatgattccaacaagcatgatgctcgcctcatgcgaagaacatcctctctgaatgaatcgttggatagatatactcagttgtttgagaaaagcttcagcgaagacactaagtggcaaagctcaaagtctaaaagcttaaaattgacaaacgaggataagatccacaagaatgggcacactcctaggttttcaagaagcaatttgtctatgcctaatctcgagactttaggcttcattctacaagatgcactttttgatacaaatgatatagggaataaagtggaagcttataatcgtgttcatagaaaatcagtgagtcttcctttgaagatagacaggtcacttgatcattttaaagaggctgaaattgtggaaacagtagaagggagtgagagagatgtaaatcccaatcttttatcagataagattatggagaaaattgatgaagaagttacctgtgaccagaaggaggacatgaatgagccagcggtgggagatggaagttttcccgaagaaaaagaggaaatgagtaatatgactacctatcttcgcaaggaggtgatggcaactcttgaaactagctttgaggacactaaaaccagccatgaagtcaattttccctctcttaatatttgtgctatgaacaacaacagaggtacaaaattgaattcactaagatctacattggacgaattagagactgatctatcatattcatctgacagaaatgctagtgtgacagctgaagacacagacaacacttccgatttcaaatatgtgaaaaatattcttgaattttcgggctacttgagaaatgagcacactcagatgccatacacagtagaccagccgctaaagccctccatattcaaagatttggatgcaactttgcgccatgaaattgaaccctctgaagaagagacaatcaaccaccagcttctttttaacttagttaacgaggtgctgcttgaaatatatggaaggtctccaacttacttcccaagaccattctcattcaacccccgcctccattcaatgcctaaagggaactatcttctgaatgaagtatggaatagtgttaattcatacctgaacttgaaacctgagctagatcagacactagacgatgttgtcggtcgtgatttggcaaaaggaaaaggctggatgatccttcaagaggaagaggagtatgtagcacttgaattagaggaaatgatcatggatgagttgttagatgaatttatcttctcatga

SEQ ID NO: 1601 - DNA, 1146 bp, Glycine max
  Peptide Sequence Number=SeqID_118379
atgggagatcacccacgttctcaaccattggatttgcaccacctctttaagattaaaaataaatccttgaaagacgttagcaaggcttacaaatcgcttgtatccaaaagacaccaccatgacaagaaaaaccccgaggagccaataacacccccaaggtttgaggaaaatgataataaaagagtggatgaagacatttggagtcctaaatttttgtcaagggctgcaagtagaagatctaaaacaccaacactaaaatcaaggcctatgtcaaggcatggaagcaggcgatgcacaacaccaacctctctatcaagaagttcttctagttctggtcgaaggagtgccaccgaaattgctgcatcatctctcaaaaggattatgagcagaaggggttccccggcttctttgtcaagtaagttgaacatctctgaacctaagttaaccaaccatgtagcgtctccaacaaaagatgcagatgcatgcttaaagaccacccgaaagcctgaatacatccctgcagtctctctgtcaagcaatctgagttgtaggttaacaacacctatcatattttcacagacaacagctagaaggaaacccccagaagttgagagaaagctgcattgcacgctcgagaatttatgctttggatgcataaaaaagattaaagttactagagatgtcatcaaatatcccggggtaattatccaagaagaggagattttgaaaattgaggtgaagccgggatggagaaaaggaacaaagattacatttgaaggagtaggtgatgagaaacctggatacctcccttctgatatagtattcttgattgatgaaaaaaagcaccctttgtttaggagagaaggcaatgatttggaaatatgtgttgagattcctctagtagatgcactaacaggctgcttcatatcaatccctctattaggaggggagaatatgggtttgtcattcgagaataatgtcatatacccaggatatgagaaggttatcaaaggtcaaggaatgccaaaccccaaaaataacgggataagaggtgatcttcatgtcaaattcttcattgaattccccacagaattaagtgaagaacaacggaaagaagctgctagtatcctgcaagattgttgctaa

SEQ ID NO: 1602 - DNA, 561 bp, Glycine max
  Peptide Sequence Number=SeqID_118380
atggattttacagagacagaatttacaacagaattaggaaaaatagaactaggcctaggagagcttgtcttgacagtaaattctgctaaatctattgaaaaggatcttaaagcattgaaggctaaacttagtgatgaagaaatattggagaagtcacttgaggccaaattggttgaaaaacagagtaaagttgagcagatggaagaatcgaggaagcaattggagaaagagtccaatattatgtgggaagaagcaactaaatacttaagtagtacgaaatcagatgttgaatctaagagatctgctacagaaacaaggcagaaaaatgttgaggctgttttatctgaggtggcatttcttaaggtggatgccataagtagtaaaattatatcagtaaaagaagctggagcagttaaagtggcactgttagtgcgcaaatgtgaagagctagtagaagcgtttcacaactatgcgaatccgattgcacgcgtgattgaatctgagcaaagaagactcggggccactaaaggaggtggatttggcatttcagatccggtttaa

SEQ ID NO: 1603 - DNA, 849 bp, Glycine max
  Peptide Sequence Number=SeqID_118381
atggcggagtcgaattacgagtacccaaggctacggcggccggaaatagtcacaatcctagcgcagttgcagatcgcgaacgtgaccgagcaggacttcaccaaccctaaccctgatttcatctccgatctctacactcgcgtcctcattcatctcgacattctcctcgagtctctctctctttctattttcttctcttttcgcaccttcttcgattctacattcctcgctcagattcttattcttttcattttccgcagggaagacaacgagcaactcgagttccacgccctagagcatcttgaaaaccctgatttccacctggattccgttcgcgccgtgaaactctacaaccagatcaacgaggttctcacgacactcgagtgtccgcgcaaattcaccctcgccgatcttctcatgccggatcctcaccgaaccgacctcttccttggctctcttctcaatttttgtctcgatagggacgcgagaatgaactccgtctcggaaattgtggaggaagtgaacgctctagaggcgcagcgaacggagttggaggagaataggattttgcagttgaaagcggaaatttcggaatgcaatgaggcgaaggagagggagatgcctcttgttgaggaggtggaggccaaagttaaagagctcaagcaaacgattgcggtgctgaacagcaaccagagttctctgagaagtactttgaggaagttgaaggagaagaccggggaaacggatgagaagatttcaaatgctgaatttacattggtacaaaatgtccaagaaaatgcaaatctacgttcaaaaatcagtcaatcacctgataaagtacaggcataa

SEQ ID NO: 1604 - DNA, 588 bp, Glycine max
  Peptide Sequence Number=SeqID_118382
atgaattatgtgcaaacagtcccttggaacagctcttcctgccaaaacttccaacccttggcatcacaataccaaacaagaacaagtccttgttgccaaactcttctatccctctttggaataacacttgcacaaaacctcaagaaaaactctcttttccagctccctaacctccctacctccatctcttgtcttcaacacttccaatccaacctcacatttctctcacttcccaacaaccttgtctcctcatgctttgatccatttcaatttgtcatcactccaaacatctgtgctcacattcaaaatatagaagattggcacaccaggcttggtcctacagcgcagctcaacaatgcctgtggaccagacctcgctgatcctaaccaatgcagaaagtgtgtggctgagggggacaaggttcagcagaggtttctttctattgatggtaacgattcacattccctagattgcttttacttcacaaaactttacttggctggagttgtcaatgagcttggccctgcaagcataggaacaaagcttcagcctaaggctgaggccaaatgcagtgttaacttggtttga

SEQ ID NO: 1605 - DNA, 1014 bp, Glycine max
  Peptide Sequence Number=SeqID_118383
atgtcactcatgttgaacaagaacaacagcagcaaaatgagcatacctttgttccatgagtttaaaaagcaagcttctttcttcctcaaggaaaaattcaagaccgctaggttggctctcaccgatgttacccccacagagctaatgacagaagaagctacaaaaggaaattcatgggccccagatcccccaacacttagatcaatttcaagggctgcttttgagctagatgattatttgagaatagtagagattctgcacaaaagactccttaaatttgacaacaagaattggagggcctcttacaattctctgattgtgctggagtacctgttgactcatggaccagaaagtgttgcagaggaatttcaaagtgacaaagatgtaattggcgaaatgaaatgctttcagcatattgatgacagtgggttcaattggggtctagctgttggaaagaaatcagaacagatattgaaactgctggaagaaggaactctccttaagaaagaaagaaaccatgctcggaggttgtccagaggaattcaaggttttggaagtttcggtcaacattcaactcaagcacaaggtgttctgcaggaaaaatcattgccaaccacatttgacagacgtaactcagacttcaataaccatgaaaatcaggaaaaccaatcctttggctcaaaccattgtctggacacagcagcagttaaatctgctagtccaagctctcaaggtggaattttcaagtccttggatgatagtgcagaaactgagagccacctcgatgatcagggaaacattcaaatgcaccagaaatctgaaacaagctctgaagaaaacatgacacctagcaaggaggaattccatctatggaacttgaaaggggagtctaatccacttttggatggtagccaagagaatgattctagacttgggatgttcatagccgaagatgatcacccctttgactctacagaaatgcctgccacttcttccctactttcttctacgtga

SEQ ID NO: 1606 - DNA, 2274 bp, Glycine max
  Peptide Sequence Number=SeqID_118384
atggagcttttgaagcctttgcaccctcaccatgcacccattttgcgaattccctttcacgctgtcccctcttcatcttcttctcaatctcagtctcaggttcccctccctatgatttctaaggttcatgtcgctgttgggaaatcgctcgacaaagttgttcctctgcttcgatggactttaaaccactttcggaacgcggaaatcgtcattgttcatgcttatcaaccttctctcaccatccccactctattggggaaattgccagcatcacaggctagtcctgcagtggtgtctgcttttcgaaaagtcgaaagagaacaaatcatgaagctcttagacaagtatttgagcatttgccgcgcagctagggttaaggcagccattattgtaaccgaagctgaccaagtccagaaaggaattgttgatttggttattaagcataatattgagaagcttgtcattggagcagtaccagaaaattgcatgaaagtgaaaaggaattccagtaaagcaaattacactgccaaaaatgctcctcctttctgtgaagtatggtttatctataaaggtaaacacatttggacaagagaggcttctgaaacaccatgttcttcatcctcatgtactcaacccgagattgccaccacagaaagcttgagatgtagatcttttcaatatgaggtcatggaagaaagaattaacaaacaacttattgaaaccaagagagaagctgaggcagtaacagacgaagccttcacagagctattaaagtgtgagaagttagaagttgaagccatggaggctattaggaaggtcaatttgtttgaatctgcccatgtgcgtgaagtaaagctcagaaaagaggctgacgatgcactgagagatacagtacaagaacaacaaaagctcttgaatgagagtgaagaaattgctggcgagctacaaatgaccatgagaaatattgccctgctagatagtcgtgctcaagaagcaaaccgtaggcgggatgaagctgcagatgaactatcactaattcaagaatccatctcaaccctgtggcaagaaaggcagcagattaggagacagaaaacggaagccctacgttggcttgagcggtggaggagtcgtggacaagttggagcagctcattgcaatggggtcattgggtttgccgaagaattacctgagttagcagaattttcattatcagatcttcaaaatgccacatgtaatttttccaatagctttaaaattgagcaaggtggatatagttgcatatacaagggggaaatgttgggtaggactgttgctataaaaaagttccatcaacataacatgcaaggaccattggagtttcgtcaagaggttcaagttcttggtagtctccagcaccctcatttaatcactttgcttggtgtttgccctgaagcctggtcaattgtatatgagtacctccccaatggaactcttcaagactacctattccgaaaaagcaacaattcccctttgacatggaatacccgagcacgaatgattgctgaaatcgctagtgctctctgcttcctacattcttttaagcctgaaactattatccatggtgatctgaagccagaaactgtactacttgattcttcactgggttgcaagatgtgtggatttgggctctgcaggctggtgagcgaggagtctctcctccgtcctagtttccgcttgagcactgaaccaaaaggtgctttcacatatacagatccagagtttcagagaactggaatactaaccaccaagtctgacatctactccttcgggctcatcattttacaacttctcactggtaggactccagttggattagcagttttagtacgcaatgcagtttcatgtggaaagttgtcttcaattcttgattcttcagctggagaatggccctcagctgtggcaatgcaattggttgaactgggactgcaatgctgtcaacaataccatagagacagaccagagttaacacctacacttgtgagagaattggagcagttgcatgcttcagaagagcgacctgtaccatcttttttctcatgtccaatccttcaggaaataatgcatgatcctcaagttgcggcagacggatttacctatgaaggagatgccatacgtgaatggttggaaaatggacatgatacttctcccatgactaatttgaaattaagtcacctgtttcttactcccaattacgcacttcgacttgccatccaagactggctttgcaaatcttga

SEQ ID NO: 1607 - DNA, 363 bp, Glycine max
  Peptide Sequence Number=SeqID_118385
atggatgttgatggtgctaaaggtggttcagatgatgaaaatgaagtacttggaactggtgtacaagatgcagaaattgaaatgatggacaatcaagtgatacattggcagatagttacccgtttgaagaatttcagtcccttcctaatagtgatgatgaaggaaacaatcttcatacctccacctatgtcaactgcatttagaccacctccacttaggcctccaacaccaattcgaattataatgctagatggagtatctcataacaagaatcaatcaaattacatgagattcatacccatgaacttcatacctaatgtccaaccgccaagattcaaagaactaaaatataggatagattaa

SEQ ID NO: 1608 - DNA, 156 bp, Glycine max
  Peptide Sequence Number=SeqID_118386
atgcctatgcactgcaggacaacatcaaattctggtggccagttggatcagatgatgttcttcatttggtcgtggttaaaggcttatcgaaaggactttgcggttttgttccagcagtggcatatggatcctgctctgggtctgttacatggatga

SEQ ID NO: 1609 - DNA, 207 bp, Glycine max
  Peptide Sequence Number=SeqID_118387
atggtgacgttttgtggatgcaacccaagcatgtttcagaacatgtttggaatgaggaaccagacagaaaattacatatcagacgagcagtcccgacgtatcaaggtgaagaacaaatatcataggaaattgttcctctgctttggcaatctgggttttattgataatgaagatgggatacctaaagataaatgcggcattaattag

SEQ ID NO: 1610 - DNA, 604 bp, Glycine max
  Peptide Sequence Number=SeqID_118388
ggtgagtgttgacaaagttatagaaggtgacgccaaagtgcccttcccgacatcagagattcaatatgagtctgatactagtccaaagaaacttcctgaaacaaatgaaagggggacgaatgattttgaccatgatccgttgcatcaactgattaagagcctatatttcatgtacgacacacctgttgagttgaagtgggatggcagcaaatttgagctttcaaatgttgatgcttcattcttcttgacattctctgatgtaaatgaaatagtagctggatacaaatgtttgaacatatctatactacagttatggatgtttatcaatttttatgtatattttatcaaagcagatttttggatgagtggagctcaactttgggtcatgcttccgtgtatggattccttgagccacaatcgatacacaatgcaaaggatcaacgtgttgaatgtgagcattacttacaagcatgactcaaggaatcgcaacgagaggggccattggcaactggtagtactgtgtcctgcgaccaatgttgttgcatggttttgttcgttacgtaagaagcctgatactcatatcaaaactgcaattaacaagtaa

SEQ ID NO: 1611 - DNA, 249 bp, Glycine max
  Peptide Sequence Number=SeqID_118389
atgcattgggaatgcaaaaattttccaacatgcttctgggggagatacttatctaatgattcaagcagcacacatatattgttgaagatagaatcagatgttggtgagaatagaaggatacctgcaatcaagatattgcttaatttcatcttgatttccaagagaagctgtgatacggtcagaatctttgttgatgtatttgaacagatatttaatggatgtactttgattacaccattccatgtttaa

SEQ ID NO: 1612 - DNA, 249 bp, Glycine max
  Peptide Sequence Number=SeqID_118390
attatggttagaataagatatttgagtcgggctttaggtagggttataagaagagtcttagggaaagaacctaaagaagtagttgttaatgatgtagttactgatgccgagggttttccagacaggccccacgacacatcggttttgattggctatgttcatcatgttgtaatgattgtttggaatgaagaggaacgtcctgagttgaagtcatcctcccatggaaggttttgtagagaggtggcataa

SEQ ID NO: 1613 - DNA, 252 bp, Glycine max
  Peptide Sequence Number=SeqID_118391
atggccaacaatcataacattgttgttgagattgacgctactagagaaaactggaaaatatgtgttagggttgttcgtttgtgggtgaggatagagtgtactctattcagagaatatgttgacaagttgaatccttccttgcttctagagaaggttaatggcttgatttgttttgggagtgtcgggtatgtgatcttaggttcggatttaatttatctcgacaatatgaggctaaaggaaacaatggtgtga

SEQ ID NO: 1614 - DNA, 311 bp, Glycine max
  Peptide Sequence Number=SeqID_118392
gatcagcatgcaccactggtctctcaacaccaggtggtctagtggacaacgatcgtagacgtgaggctttgcgtgtccgcttcacggcagacgtcgaagccaatgcgtccgaagtaggaggaggaggaggaaaaagaaagaggggaacgagcaacaatttgaaggttgtacattcaggaactaaagaattcaaaatagctagtaatatgagggatttgtttttgggattttctgagcaccaacagcggctacgcaaaaagcttgcacttgaggagggaaagatatttgcagctaatgaacaactttcttaa

SEQ ID NO: 1615 - DNA, 1272 bp, Glycine max
  Peptide Sequence Number=SeqID_118393
atggcggtggagtaccagtgttgtgaaactcagtttttcatacgcttattgataattttgctgcttgtgttgtttgctggattgatgtcagggctcactttaggactcatgtccttgagtcttgttgatcttgaggttctcgctaagtctggcacccctcagggtcgcaaacatgctgcgaagatattgcctgttgtcagaaatcaacatttgttgctttgcacccttctaatttgtaatgctgcagccatggaggcacttcctatctttcttgatggtcttgttgtggcatggggtgctgtcttgatttcagtaacattaattcttctgtttggtgagattataccacaatcaatttgttctcggtatggtttagcaattggtgcaacagtggctccatttgttcgggttcttgtatggatatgctttcctgttgcttatccaattagcaagttgttggattatttgctggggcatcgacatgaagcccttttccgcagagctgagttgaaaacacttgtaaatctgcatggcaacgaggctggaaaaggtggagaactgacacatgatgaaaccacaatcattgctggagcgcttgaactttctgagaagacagccagtgatgccatgacccccataactgaaatattttctgttgatattaatgcaaagcttgatagggatttgatgagtctaatattggagaaagggcatagcagagttcctgtctattacgagcagcctacaaatatttttggacttgtcctggcaaagaatttattgacaattgacccagaagaagaaatacccgtgaaaagtgtgaccatccgcaggattccaagggttccagaaacgttgccactttatgatattttgaatgagttccagaagggccatagccacatggctgttgttgtcagacattttgagaagacaaggcaacagtcttccaacaataatgccgatgtgagagatgtaaaggtagatattgatggggagaagactccccaagggaatattttgaagaccaagaggtcactccaaaagtggaaaagctttccaaactcaaataattcgaataggggtggttcccggagcaggaaatggtcaaaaaatatgtactcgtatattctagaaatagatggaaattcacttccaagtttgcccgaaaaagaagaagctgttggaataattacaatgaaagatgtcattgaagagcttttacaggaggagatctttgatgagacggatcatcattttgaagactcatga

SEQ ID NO: 1616 - DNA, 405 bp, Glycine max
  Peptide Sequence Number=SeqID_118394
atgggggtggagtatacgtgctgtgacatggagttttacaaacgcatactaataattgtgctgcttgtgatgttcgctggattgatgtcagggctcactttaggactcatgtcattgagtatcgttgatcttgaggtccttgctaagtctggaacccctcaggatcgcaacaatgccgcaaagatattgcctgttgtcaggaatcaacatttattgctttgcaccctcctaatttgcaatgctatagccatggaggcacttccaatttttcttgatagtcttgttgtggcgtggggtgctatcctgatttcagtgaccttaattcttctgtttggtgaggaatatcttggcatcaagttattcagctttgttaaggaatattctctaacatctgcttacttctga

SEQ ID NO: 1617 - DNA, 228 bp, Glycine max
  Peptide Sequence Number=SeqID_118395
atgcagcagaaagtaccaattttttttgctgaaagagagttgaagtgcgcggtggtggtggaggtggctgcggcaggttccgatgtcgaagtttctcttcgatcagtgacggtggcgccgctcgtcgcgatccctgtcagagagagagagagagagagagaggtggtcgaattttcttttggctggaggtctcggcaacggatcctatccctagttgggtttctttaa

SEQ ID NO: 1618 - DNA, 1008 bp, Glycine max
  Peptide Sequence Number=SeqID_118396
atgccttcagactggaaggttttcacgattgtgttgaggggggaggaggcagacgtaagtgaaggcgccaacgagaccgcccgcgacaacgtcgatgagggcacgatcgaggacgaaaagggttttgaggaggggctttgggctgggccaggcccatttggaggtggaggcgaagggaagagtgggggtgtgggaagaaaagtgtgtgaggagagaagaaaaatcgatgagaaagagaagagaagagaaaatttggaatcaagggaaagaaaagctgtagatacggaagttggacaagggtgccgtcaagtttttggagatattggtaatttggaggtgcctagaatcactgaagggaaattgatttcaaggccaataaaaaggaacttcaatgcaaaactgttggcaaatgaagaaaatctggcaaacgtgttagaagttgaagctaacaagcaaggagctacacaggggaagaaaaaccttattgtacctgcactcgacaatgctgcaattgttcaccaagaacatggcgcagaagattcaacgcacaagccaaatcctgaacctgtagatatggttaattttgaagctgaagatagcgctaattttgtttgtgaaagagggtcaagggaaagatctcgtaggaatgtcaagacgctgacttcagaaattatagcacagagcaagaaagcttgcgtagtattgaatgacactaaggaagagcctgttgacatggatgcagatgatcctaatgaagtagttgtagctgaataccttgaggatatatacagattctttaacctaacagaagtaccagctatcctcaaatcttattcatttcatatctatgtcttcattctcttattattgcaacttatgatgcagcaagagactgactatcaagcttcagattacatgaaaaagcaacatggaattaatgataagatgagatctattatagtggactggctggtcgaaaacccacatgagatttcaattaatgcctga

SEQ ID NO: 1619 - DNA, 510 bp, Glycine max
  Peptide Sequence Number=SeqID_118397
atggagaaagcaattctggagaggctagaatggaaattgactgtcccaaccccctatgtcttcttagttagattcaccagaacttttgctctatcaccagatcagcagatgaaaaacatggcatttttcttagcagaacttggccgtgtgcactacggaaccgcaaatttgttcctcccttcaatgactgccgcagcagctgtgtatgctgctcaatgcacactcaataggaaacccctatggaatgatgaaatcctaaagaacatggcaggctacaccgcaccacaaataagggattgcgccaaacttccaatgaagttacacccaagtgttccagagagtcaagtgatagcagtgcacagaaaattctgcactgtatgcagagtgcagaggaggtgttgtttttctatcatcaccgaaggatatataaaattagagaattatctcgtttttcaacataaactcagttgtgcagatccatatgggaatatacctgatgaaataagatga

SEQ ID NO: 1620 - DNA, 738 bp, Glycine max
  Peptide Sequence Number=SeqID_118398
gctggaaaaggtggggaactgacacatcatgaaacaacaatcattgctggagcactggaacttgctgagaagacagccggtgatgccatgacccccataactgaagcattttgtattgacattaattctaagcttgacatgtatctgatgaatctgatattggagaatgggcatagcagggtccctgtcttttatgatcagcctacaaatattattggacttatcctgatcaagaatttattgacaattgatccagaagatgaagcacccgtgaaatgtgtgaccatacgcagaattccaagggttccagaaacgatgccactatatgatattttgaatgagttccaaaagggccatagccacatggctattgttgtcaaacactgtgacaagacaggttatcaatcttccaataataatgcctatgactcagcgagagatgtgaaggtggatattgatggtgagaagcctccccgagagaaaaatttgaaaaccaagatgtcatgccataaacgtaaaagctttccaaacgcaaacaacttaaacaagggtagtcctcagagcagaaaatggtcaaagaatatgtactcagatattttggaaatagatggaaattcaattccaaagctaccagaaaaagaagctgctgttggaataattactatggaggatgtcattgaagagcttttacagggagagatctttgatgagacggatcatgattttgaagtctcgtga

SEQ ID NO: 1621 - DNA, 875 bp, Glycine max
  Peptide Sequence Number=SeqID_118399
atggctgcaactgcaaccaacaaccctcaaataacaagggaggaaatccaaactgccatagccaaagcagtggaattaagggcccttcatgctgcattaacacaaggaagtagtccaggcacaaacaatgctagatttccatcaccttcccctgcttctcacttctctgcccaagactaccctgttttcacaccaagttatgaagatgaggcacaccagaactcaacaaggagcagaacaatatcagaaagctgtgatgagaatggggtagaaggaggagagaacagcatgaccccctcagattacaaggagaaatcaaattcaagaaagggactaccttttggatttggcaaccttgactctcacatgtgtcctgctgatgatgataccaaatctgtgactggttcttgtgcaaatcacattactgttctccaaacatcaccggcggccaccgcgaatgactacttcaaatccaggaggacaaacagtttgggggactcgaagcagcccctatcttcctgcaataggtgcaaccctgctgtcataactagtgaatatgagaacacaaggaacaacaagagctccaacattgttgtccccctcacagactcccatgcctctttccaaacccaaccaagaagtaaagggctgatttcatggctgttccctaggttgaagaagaagcataataagaatgtgagttccccaagcagaacagaatctgaggaagtctctcaggttctcaaggacatggggatagtgtcagttgaggcactgaagagggaactgatggatgcaaatgagagtagagatgctgccttggtggaagtttctgagatgagatcttcacttggagaactgaaacaaaagttgga

SEQ ID NO: 1622 - DNA, 690 bp, Glycine max
  Peptide Sequence Number=SeqID_118400
atgggagtgccaactgccacggatcgcgatccgtggcttgagcgtaggaaacacttaaaccgtcgattgaggagctcatcaacggtcctagttttcgtttttccccacctgctcaatcacattcaccaaatcgaaaacatttcaaaattcgcgctccacctcttctcacaatatatatacccccgaaacccaaaccaatttggcatagcaaaatcgtttctccaatttaatcaccattgtacaacccaattcccttcgtcgttttcgattaagagagcaatggcacgtaccaagcaaaccgctcgcaagtccaccggaggaaaggctccgaggaagcaattggcaaccaaagccgctcgcaagtcagccccggcgaccggcggagtgaagaagccccaccgcttcaggccaggaacggtggctctgagggagattcgaaagtaccagaagagcaccgaacttctgatccgaaaactcccattccagaggctcgtcagagaaatcgctcaggatttcaaaaccgatctccgctttcagagcagcgccgtttcggctcttcaggaagccgcggaggcttatctcgttggactctttgaggacactaacctctgcgctattcacgctaagcgagttaccattatgcccaaggacattcaactcgctcgcagaatcagaggcgagagagcttaa

SEQ ID NO: 1623 - DNA, 333 bp, Glycine max
  Peptide Sequence Number=SeqID_118401
atgtctgctgggaggccaaacaaaacactccgaagagaagtggttatggcggaaactcggtgtttggcaatcatcgacgaagaagaaatagaggtagacgacgacatctacgagaacattgaagctcccaagttcgtcgacctcaccgcacctgattctcgccgccccgacgatgaccgccactggttctgcttccgcgttggatgtgaccaaaagcatgagcaagagttggactctgaggcaatttacaagaattttgttcttcgggttatggcagctagaagtcccaatgtacgcctcagaaaagctttgaacagaagagaagcaaggtag

SEQ ID NO: 1624 - DNA, 1251 bp, Glycine max
  Peptide Sequence Number=SeqID_118402
atgggttatgagtatattttgggaggcattatagcttctagcttggtgcttgtgtttgttatatatggttctgtatcaaagaggaaggccaaaagttcagtacatgcagaaagtaatggtggtagtattataaggacatcaccagaaaatggaaaccaccatcaagaaatctcagaaactacggacgtcatcattgtcggtgctggggttgctggcgcagcccttgcttacacacttggcaagatatatgcaaaacttatgttgaggatcaatgatgttggtctatggttcttgcttcaggaaggaaggcgagtgcatgttattgaaagggacttgactgaaccagacaggattgtgggggaattgctacaacctggggggtatcttaagttaattgaattgggtctccaagattgtgtgggtgagattgatgctcagccagtctttggctatgctctttacaaggacgggaaaaatactaagctttcttaccccttggaaaattttgcctctgatgtttctggaagaagctttcacaatggccgtttcatacaaaggatgcgcgaaaaggcttcatctcttccaaatgtaaaattagaacaaggaactgtcacatttctactagaagaagatagaatcatcaaaggggtaaacttcaaaaccaagagtggacaagagctcacagctaaggctcccctcaccattgtatgtgatggctgtttttccaacctgagacgttctctttgcaacccaaaggttgatgtaccatctcattttgttggtctggtcctagagaactgcaatcttccatatgcaaaccacgggcacgttatcttgggtgatccttctcccattttgttttatcccatcagtagcactgagattcggtgtttggttgatgtgcctggccataaattaccttcccttggcaatggtgacatggcccgttatttgaaaacagtagtagctccccaggttcctccagagctgcgtgactcttttatagcagcagttgagaaaggaaacataagaagcatgccaaacagaagcatgcccgcatctccttatcccacacctggtgcccttctcatgggagatgccttcaacatgcgtcaccctttaaccggagggggaatgactgtggctttgtctgacattgttttgctaaggaaccttcttagacccctgcatgatctgcatgacgctaatgctctttgcaaatatcttgaatcattctacaccctacgcaag

SEQ ID NO: 1625 - DNA, 798 bp, Glycine max
  Peptide Sequence Number=SeqID_118403
atgaataagcttgaactcaatggagtgaagaagaatggagaaggaggtagcaactcattggcagtggctacctggaaaaaacaattgaggggaagagaggttaaaagccgtgtgtttgattccttgtattctattaatcgtaaggaaccagaaaccaacacaaagacaagtttgatggagaagaaagtaaaaaaatgcatgcagaaacgccaggttgctgtgcctcatgaaactgacactagtgatatggagatagatgaaaaatctaggtgtggctctctagaaggatgccatgaatcaggaacttcaggaagtggtggtgaattgtctcttggagatgaaaaatcccatgaatcaacaagaggagagagttcagttccagttttgtcagaagcttctagaggtgacattacctggctttcaagtctgaacaatgaaaagaacgagactacagaaaggagtgaaaaagaagagacaaagaactcagtttctgataagggaaaagtttctgaaaccaagaagagaagggctgaagaaaattcattggcttctgatgacaaagaaaatgagaggcaactcactgagaatgatgacaaggaaaatgtttcagcccctcatgagaacatagagatgagtaccaatgatgatgtgcaaaaaaaaagggctattcttgggagcaaacatgaggatttgagaaaaacacaaaagaaatttacatcgccctcaactactcctcaagttctgaaatacagaaaattaaagcccacaagtcttaagccttttaagctgagaattgat

SEQ ID NO: 1626 - DNA, 216 bp, Glycine max
  Peptide Sequence Number=SeqID_118404
atggctttgaggcaaattatgactcttttgggacctcgaaggcttttcttggaagaaatgatagagggtattcaaagctttgatgcaaatgttgtatgccttggatttggtttagaggagcaaacatgggatctcgctggacacatgtggtggtgggtcatagtcaaaaacgtgtcatacttcaaaataaggaaaatctgtgataatggaatttaa

SEQ ID NO: 1627 - DNA, 189 bp, Glycine max
  Peptide Sequence Number=SeqID_118405
atggtgttgttttgcactggactcgctagcagcaatgacgatttagggccagttggttacgccagtttgactggcgatttacccagggtcaggcctgaagcttgcagagcagcagcctttcagaggtgcagctggttacgccagtttgaatggcgagaagcgtgcaacaggtctcgcaagttggaatga

SEQ ID NO: 1628 - DNA, 315 bp, Glycine max
  Peptide Sequence Number=SeqID_118406
atgtggcaaactaagaatcttacgcaaaatatttgtttgactccaggagtgggttttggccctggaattcctggtttccaagttggttttggatttggagctggatgtggagttggttttgggtttggctatggtgtggggaaaggaattgcacaagatgagaacaagagatactcaaatgttggaaatcctttccgtggttctagaagcatcatttctgaggatgatattactgcacttgtggacgaccttgtcattaatactaaaaagtttatcaaggcaacatcgaaagaaattgacaagtggagaagataa

SEQ ID NO: 1629 - DNA, 1485 bp, Glycine max
  Peptide Sequence Number=SeqID_118407
atggggctgccgctactttcttctgcattatgggatccttctcataactgtgtttcctccagtgtggagtttatcaggccccttctatcagcttctaagtcatattctcttggtttgaagctctcggttgctattcctgttagaatgtcccagtatacctgttgtactgtttcaactttcaagggtgtcccaggaataaaaaggttagctcctctgatggtgcactttaattctactcagtcctcccttcatatgataattgaatttgttattagttccaacttccaatttaactgccaacaattttgcaagggaagatcaaaattgccaggagttttagtttgtgccagtcgaaggcccaaaggaactgtgtggagacgaaaaactttaccacaaaatgaggatttaccgccaattttaccaaagaataagaaaaagccataccctattccctttaaggaaatcaagcaggctggaagggaggacaggaaacttgcacacatgggaatagagaaacctcttgagcctccaaagaatggattgcttgttccagatctagttcctgttgcctatgaagtatttgatgcttggaagcttttgattgaaggtcttgcccagctcttgcatgtcattcctgcacatggctgtagtgaatgctcagaagttcatgtagcccaaactggtcaccacattcgggattgttctggcactaatggtcggcagcgtcgtagttctcatgcatgggtaaagggttcagtcaatgatatacttgtccctattgagtcttatcatctttttgacccctttggtaggcgtattaaacatgatacacggtttgaatatgaccggattcctgctgttgttgagctatgcattcaagccggtgtagatatcccagaatatccttcgcgccgaaggaccaaccccatacggatgttagggaggagagtaattgacagaggtggaaatttagaggaacctaaaccgtggcgctttgcagacccctcttcactcaatgactttgatacttacagagcttctgagcgatttccacgaccatcgttgtcagatctacctaaaattgcccaagaaacaatgagtgcatatgaaactgtcaaaaagggtgtcaagaagttgatgaggaagtacactgtgaaagcttgcggttattgcactgaggttcatgtgggtccatggggtcacaatgctaagctttgtggtgcatttaagcaccagtggagggatgggaagcatggttggcaggatgctactgtggatgaagtttttcctccaaattatgtgtggcatgttagagaccctagggggcctcccttagcatctgcactgaggagatattatggaaaggctccggctgtggttgaagtgtgcatgcaagctggtgcacagataccagaagagtacaagcccatgatgaggcttgacattataattccggacactgaggaggcaagaatgattgcatga

SEQ ID NO: 1630 - DNA, 363 bp, Glycine max
  Peptide Sequence Number=SeqID_118408
atgacatcacgagcttcaactatatatgagtatgcctatacttgtagggtgacagagaagaatgatgtttacagctttggggcagtgctgatggagttggtaacggggaagaggcctatggagccagagtttggagagaatcatgacattgtgcattgggtatgcaacaatattaggagcagagaagatgctcttgaattggtggatcctaccattgcaaagcatttcaaagaggatgccatgaaggtgttgaaaatcgcaaccctatgtatgcactgggaaaattccagcttcaagaccctcaatgagaatgttggaagaggcagatccatttaccacaaccaaaatgattgtgaccattga

SEQ ID NO: 1631 - DNA, 210 bp, Glycine max
  Peptide Sequence Number=SeqID_118409
atggagccgtgggaccataagcacagagttgttggacacttggaccctactgaatcaacctcaaggggtgcaggagcttgcttttcagaaaagggagttgcaactgccattggcgagttgcctgcaagttgcaactcccattggcgggttgcacaagaagaaatagccatcaccaatggcgatttgttggctataaataccagtgctcac

SEQ ID NO: 1632 - DNA, 594 bp, Glycine max
  Peptide Sequence Number=SeqID_118410
gtggaaagcgctgatcttattgcatatggcctcataccagagtttattggacgattccccattttagttagcttgtcagctttaactgaagaccaacttatgatggtcctcactgaaccaaaaaatgctcttggcaagcagtacaagaaattatttagcatgaacaatgttaagttacacttcacagagaaggctctaagactgatagcaaaaaaagcaatggccaaaaatactggtgccaggggtttaagagccctcctggaaaacattttaactgaagctatgtttgagctatcttcaagtatcacaaactatcactcttctctacggttttgtactaacatatacgatgcttatttgcaccagattcctgatattaagacaggaagtgaccgagttgatgcagttgttatcgatgaagagtcagtaggatcactaactgctcctggatgtggagggaaaattcttcgtggagatggtgctttggagcagtaccttgctaagatgaaggattcagcggtgaatgttgacgtaggtgaatcagatttacaagagggggatttggagctttcatcaagagccatgagcttgtga

SEQ ID NO: 1633 - DNA, 483 bp, Glycine max
  Peptide Sequence Number=SeqID_118411
atgaagccctctgtgctgcgtttgtcactgcttgttttcgttcctctgcttctctccctcttctatgttgcgctcatgccaaagaaggaaacctctatgaaaacctatgaggtctttggagtgaagatagaaaagaacccatctcagtctaaacttactgatcttggagtctcaacttggcccatgtgggaaggtggtccaaccaaaattccatggtcctttaaagaagaagagactatgtatctgctggagggaaaagtgagggttactgttgaagggtctgttgaatcttttgaaattgggggtggtgatttagttgtcttcccaaaaggaatgaacattacttgggaagtgattgaagctgctagtgttgatcggtatttggaaattgaggctgatgatttagctgtctttcctagaggaacgatcatgacttgggaaattattgaggctgggaataatcggtgcaacatggaaaactaa

SEQ ID NO: 1634 - DNA, 381 bp, Glycine max
  Peptide Sequence Number=SeqID_118412
atggcgatttgcagagccattgggaaccgccagtcaaactggcgagttccaacagctgagggtgcctgccatggcagtgaagggcagagcgcgtcgcgtcagtcaaggccaaatcgccaatggcaatggcgatttgccttgggcatggatcgccagccatgctggcgggttgctcctaaatatgcttcttccattataaaagctcagtccgagagtgcaccagctacgcttccttcgtggctcagtccgagagtgcaccagctagcttccttcgtgcctttgcttccattgatccttccattgctttgcttccattgctgtgctattttcttcataagtttctcagtgcgtttttgttattttggtttagttagaatgtga

SEQ ID NO: 1635 - DNA, 497 bp, Glycine max
  Peptide Sequence Number=SeqID_118413
atgaaagataaaggtgaggattttgagtcctacaaaggcgagaactttgagttctatgaaggcataaaagcgaggactttgagtcctataaaagataaggtgaggactttgagtcctataaaagatcaagtgaggactttgagtcctataaaggagaggactttgagccctgcaaagtcaaaaggaagcattgttgcacaatccatgaagtttcgtgacatgccggaagtcaaaaagtcaaaaggaagcattgttgcacaatccgtgaagttctgtgacatgccgaaatcaaaaggaagcattgttgcacaatccgtgaagtttcgtaacatcccagaagccaaagaagggatgattatgggtgtgcaaatagcaatcaggcccacttgggccttccaggaagttccaccagaaggcaccgcggtgccttctggaggaagcaacctggctcgcctaggcgagctgggtggcaagcttctcccctattttcacttaaa

SEQ ID NO: 1636 - DNA, 585 bp, Glycine max
  Peptide Sequence Number=SeqID_118414
atgtgcgtgatgccgaagtcggcgtcgtcaacgacactggtgaatgtgtacagcggcgtgccgtcggcgcggatcagcacagggtccgagagcgatccgatatcgaccgtctgctcgccgcggacgagatcatgccatgagacgagtgtcggcaatggcgcgagcccgcgcgaaggatcggtattcttcagcagcagccgccaatacggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 1637 - DNA, 818 bp, Glycine max
  Peptide Sequence Number=SeqID_118415
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccgtattggcggctgctgctgaagaataccgatccttcgcgcgggctcgcgccattgccgacactcgtctcatggcatgatctcgtccgcggcgagcagacggtcgatatcggatcgctctcggaccctgtgctgatccgcgccgacggcacgccgctgtacacattcaccagtgtcgttgacgacgccgacttcggcatcacgcacatcgtgcgcggcgaggaccacgtcaccaactccgccgttcagatccagcttttcgaggcgctgggcgcgacggcgccgaagttcgcgcatcacagcctgcttgtcggtgccgaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 1638 - DNA, 369 bp, Glycine max
  Peptide Sequence Number=SeqID_118416
atgcttagagatttcattatcaattacgagcgtttcgatatattacgggattcattcggacatcagagtaaaaagttgtcatcgtttgattttgctcagagcttctattcggaatttcaagggtctcgatatactaagctttcgtcatcaattacgagttactcgatatactacgggattcattcggacatccgagtaaaaagttattatcgtttgattgtgctcagagcttccgttatcaataacgaggatctcagtatattacgggattcattcagacatctgagtaaaaagttattgtcgtttgattttgctaagagcttctattctgaatttcgagcgtctcgatatattacgggacacagttag

SEQ ID NO: 1639 - DNA, 285 bp, Glycine max
  Peptide Sequence Number=SeqID_118417
gcaaagggtcactttggggcagttgtagctcacccaggcaagttgaaacttagtgctgaagcaatgagctcccccaggcaagcaggtttcttcaccatgaagctatatggtggcccaggcgagctagaggctagcctgggcgagctagggtccaagaaaaccaaggaaaagacccttttgccccattttttggtattctttgcattcttgatcaaaatactgaatgatcatctatttcgcactataactggcgttcaacaccgtaagttgactagcaaggattaa

SEQ ID NO: 1640 - DNA, 1623 bp, Glycine max
  Peptide Sequence Number=SeqID_118418
gtggaaaacattactgtgcaacgtttgtgtcgtcaacaagtgatcactgccgtcaatggaaccctgccaggaccaacaattaacgctcgagagggtgacactgtagtcgttcacgtattcaacaagtcaccctataatcttactattcattggcacggaatttttcaatttttaacaccgtggtcagacggtcctgaatttgcaactcaatgcccaatagcttctggtagtagttacacatacagatttaacctaactggacaagaagggactctttggtggcatgcacactcatcttttctacgtgctacggtctatggtgctcttctaattcggccacgactaggacactcgtacccgtttcctaaagtttatcaagaaatccctatactagttggagaatggtggaatgctaatgttgtagaggttgagcaaaatgcaacagaaactcaacagccgccaattgaatcagatgcatatacaattaatggtttacccagcgatctctataactgctctcaggatggaacataccaggtcaaagtaaagcaaggaaaaacctacttgttgcgcataatcaactctgcactcaataatcaacacttttttgaagtagccaaccatacattaaccgtagttgccattgatgctacctataccaatcactacgacaccaaggttgtagtgcttgctcctggccaaaccgttgatgtcctcctaagaacaaaccaaagtgtgggttcttactacatggccttcactccataccattccgctccacttgtacaaatcaacgccaacatgactcgaggagtgataatttatgagggtgccacgtcagcaaagcccatcatgccagatctcccggcccaaactgacactccaacggcccacaagttttacaccaacatcacagggttggccggtgggccccactgggtcccagtgccacgtcaagtggatgaacacatgtttataacttttgggcttagctttgacatatgtcgcagtgatacaggagtttgtcctgggccagtacccttattttctgcaaacatgaacaacgagtcctttgtgttgccacatggcaaaggggtatcaatgcttgaagcgtttttccggaacgatgttactggggtgtacactagagattttccggatcagcctgcggttgtgtttgactttaccaacccaaacataacgtcgtcgccagatacacctcgtgaattcctaatcgcacctaaatcaacgaaggtgaagacgttgaagttcaattcaacagttcagattgtgcttcagaacacggccatcattgccgctgagaatcaccctattcaccttcatggcttcaattttcatgttttggctcaagggtttgggaattacaacgccactagagatgaacccaagttcaattttgtgaatcctcaaatacgtaacacaattgctgtgccggtcggaggatggtccgtcattagattccaagcaaataatccaggtgtttggcttatgcattgccatttggaaactcatttgccgtggggactatccacggctttcgaggttgaaaacgggccttcaatcagagtgcctccgccaccggctgatcttcctaagtgctaa

SEQ ID NO: 1641 - DNA, 411 bp, Glycine max
  Peptide Sequence Number=SeqID_118419
atgaccctaaacctggtcctccgaatgaccatggttgccaacaacatcctctccctctaccacctctcctcaccctccaatgccccaaaccacaatgtcttcacattttgtcttccttcttgcaacctcgacacaaactccaacctcttcctccaacaacttgcagttgagctagagggaatagttgcaggtgaggtcatagccactgaagacgacgtggaagacactgagttccttggcgacggtggcgatccagccaaagaagatgctggagatgatttgaagtttatgtttatggttttggacaagtatgttttggatgagggttttgaaggggatgacgtcaatgttctctgtgttgggagggaggctgtggttagaggagtaggatttggaagaggaagaggatga

SEQ ID NO: 1642 - DNA, 1455 bp, Glycine max
  Peptide Sequence Number=SeqID_118420
ggtggcggagaaaaagaaaagggttaccaatcggtgaacctttgcccaagttgcaaaactgcttattactttcgcccttatgacactacacctttgcaaggtacctttgtggagattggtagggtcactagtactaaaaataatggtgttaatgatttaagtggtaaggggcattctcctaggaggatcacacacgggaagggtggtggcaaagagggtggtagtagtactagtaagggagaggaattttggggtaggagtaataataatgcaagtaaatggcttgaagtgtcattgtgggagactttgatgacttacaataggggcgctggcagaggtaatggtagtaatggcgagccacctgagtcgtggccgctggcaccagatggtagtaatgggaatggaaatggattggctgtacatactcctccaggcccgccttttccacctgggattaatgttatccgggctacggggccacggaatggtggatcgggtggtggaggtgggggcaagggcgagaagactgcctggggagggtctaatttggggaaggattttccctcgccgaaggagatctgtaagggtcttgacaagtttgttattggccaacaaagagccaagaaggtgctctctgtagctgtttataaccactataaaagaatataccatgccactttacagaaagggtcagccgcagattcaggagtttcagaagtattagatgatgacgataatgtggagctagagaaaagtaatgttctcttgatgggtccaacagggtcagggaagacattacttgctaaaacactggctcgatttgtgaatgtgccgtttgtcgttactgatgcaacaaccttaacacaggcaattggctcacttgtccttagacaaagttttgttgttattgacctaaacaaggtttctactttgcaggctggttatgttggagaagatgtcgaatcaatattgtataaactactcacggcagcagattttaatgttgcagcagctcaacaaggaataatttacattgatgaagttgacaaaataacgaagaagtccaagagcttaaatatcagtcgggatgtttctggtgagggtgttcagcaggcattattgaaaatgcttgaaggaactggtttagtaagagcagacatgattccttggagtacaatattcttttctattaccataaattatgtgttcacgatttcttcttcccaaatagtaaatgttcctgagaaaggagctaggaagcatccacggggggataacattcagatggacacaaaaaatattctttttatatgtggtggagcatttattgatcttgaaaaaaccatttcggagagacgacaagattcttctattggttttggagcaccagttcgtgccaatatgagagctggtggaataacagattctgcagtaacatcatctttacttgagtca

SEQ ID NO: 1643 - DNA, 537 bp, Glycine max
  Peptide Sequence Number=SeqID_118421
atggttggaagtcatttgggttggcgttatgcattctgggtagagtctttgctgatgattccatttgctatttcaggactttttatgaagcctctgcaattgagaggtcttgttcctgctgattcaaaaaaggcactgacacctgagacagttgcgtcaggagttcaagttatggaggcttcaaatggaagagatgagtcactgtccttgaaggcagagcttagggataaaagctcaaatgatcattccaagtcaaaatctgcaacccaaatatttgagcagttcttgagatttttgaatgatatgaaagaactttggcttgataaggtttatgttgtcaatgttctaggttacatagcatacaactttgtcataggtgcttactcatactgggggcccaaagctggctataatacatatcacatgactgaagcagatttgatatttggaggaattacaattgtatgtggaatagcgggcattttagctggaggctttgttctggattatatgagtaacaccttatcaaatgcataa

SEQ ID NO: 1644 - DNA, 1371 bp, Glycine max
  Peptide Sequence Number=SeqID_118422
atgcaattgggaaaggttaaactatcacctctgttatttaacattgctgctgaaggacttaatggcctaatgaccaatgctatagagagaaggttatataggggattcttatcaggcacaaacaaagtggaaatcagccttctccagtatacagatgacacaatattctttgggaaggcaactatggagaatgttagagcaatcaaagccattttgagggcttttgagcttgcatcgggcttaaaaattaattttgctaaaagtagttgtggggcttttggagtgtcggatcagtggataagtgatgcagccaattacctccactgtagcttgatgattcctaaaaaggtggtggacaagctagtgagactacaaagaaatttcctatggagtggtgcatctgagcaaaacaaaatttcttggatcggatgggaaacgaggaggctaaatgaagcaccgagagccattaatgaatctatatggtggagggatctgaagattctatctcaacatccacagcaggggcagttgttgaatggttcgatattatggaaggttgggtgtggggataaatttaaattttgggagaacaattggaaaaggggagataatcaattattagagaagtatcctaggttatacaccatatcggctcaacaaaatcaattaattcagcatatgggagtttacaaagacacaggatgggaatgggatctcaagtggcggagaccattgttcgacagtgagatagatctggcgggggtgtgggaggcagacccaagtggacagtattcggttaagagtgcatacagtgtgcttagacagcacgtatcaggggaggcccatgatgaagagttcaaggaattatggaagcttaaagttctgtctaaagtggctgtgtttgcatggaggttactcaaggataggctaccaactagagacaacttgaggaggaaacaaattgagttgcaggattatttgtgtcccttttgcagaataatggaggagagcatagaccacttgttctttcactgcagcaaagtacttccgatttggagggaatcgctgtcctgggtgaatttggtgggtgtcttcccacatcacctaagacaacattttatccagcacatgtaccaaacctatgaaggaatgacggcgactagatggaaatggtggtggttagcattgacatggactatttggaagcacaaaaataatatagttttctccaataacactttcaatgcaaataaaatgatggatgaggcagtgtttttgctatggacttggctgaaatatttagagaaggatttcaccactcattataatcagtggtcttcaaatcttagatacggatttcgccgtagttga

SEQ ID NO: 1645 - DNA, 2340 bp, Glycine max
  Peptide Sequence Number=SeqID_118423
atggagtgcaataaggatgaggctaccagagctaaagaaatttctgagaggaagtttgctgcaaaggatacattgggtgcaaagaaatttgctttgaaggccctaaatttatttcctgatcttgagggtatttctcaaatggtagcaacacttgatgtgtatattgctgctgcgaataaaacaaatggagaagcagattggtacggtgtgcttggtgtggaccctcttgctgacgatgatacagtcaggaaacaatacaggaagttagctctccaacttcaccctgataagaacaagtccattggagctgatggggcctttaaactcatctcggaggcatggagtttactatcagataaggctaaaaggggagcgtatgataagagaagtggaagagaacggaaagtttctactaagtttggaggttcatcatcacaaaaagggactaatggtggtttcaatttcactaagactgccccttcacgtgcaactcctcagaagaatactgcaaaagaccacacttcatcttctacttataagtcaaaatcaaatacattttggactgtttgccgtcgatgtaaaatgcagtatgagtatcttagagtttatcttaaccttaaactcttatgtcccaactgccatgaggcatttgtggctgtagaaactgctcctccacctgcaagtggtattagacctgctactcaatggagttttccacacaagcaaaattccagccgccaatctaataaaagcaaatctaatgctggaaagaataacatggcagccccaaatgttggaggagggtcttgtagtaagactgactcctatgaaaaagccaatttccagtgggctccattctcaaaagcatctggtgtttctaatgttgctcaagctgcaagtgtggttcagcaggtatatgataaggtgaagcgagatcgtgaagaggcacaagcagctagcaaaagggaagaggccttaaaaaggaagcaacatgctactaaaaagggttactataatcctgctaagagaagaagaggagggggcatggaggatgctagtgcaagtaaccatggtaagaaaacaaacttatccagatctaaacagggtaattttgaatataatagcgttaatggaatcaacaagactggccatgtgggagatatctccccagttcaactgaagaatcttcttatggaaaaagctagaaaagaaattagcaataaactcaggcaagttcagtcaaatgctgttgataaaactgcgatgaaagagaatggaaatgacttccaagaagtgagtgagaaaggagaaaaatgttcaagaaactctgagatgtgtgctcaagataacattgagaagtcagaagatagaaagagcggatcccgagccatcaagccatttgcaggtactacaattgctaaagttagcagaaaatttttggaaacaacacctgtagatgtactagatcctgatttccatgatttttgcaaagatcgaactgaaggatcttttggtgaaaatcaagtatgggccgtgtatgataacgatgatgggatgcctcgattttatgcgatgattcaccgcatcatctccctgaatccgttcaagatgcagatcagttggctcaacccaaataccaacagtgaactggaccccctaaattgggttgcttcaggcttttcaaaaatttgtggggatttcagaacaagcagacctgaaatttgtggttcaaccaattttttctcccacaaggttaggtggagaacaggtgctgatggagccatttgtatatatccgaggaaaggcgatgtttgggccatatacaggaactggtctcctgactggaatgagctaactgcagatgaggttatacacaagtttgatgtggttgaagtacttgaggattttactgtagggcatggtatagatgttattcctctggtcaaagtggctggattcaggacagtgtttcaccaccacttagatccaaaagaaattaggatcattccgagggaagagatgtttcgattctctcatcaaataccttcatatgtactcactggtcaagaagctccagaggctccaaagggttgcagggtgctggatccagctgctactccatttgaacttcttcaggtaatagaagttgtgaagaagggagacggggcagacaatgaagatagtgatgttaaaaagacaagtgatgacatgaaaaaagataacaatgaccaaatgatcgatgctatgggaaaacatggggaagaaaaggaggcaaaggacgaagagatgcaggaagtagaaacaagtgatagcatgaaaaagccaataatgaggaaatga

SEQ ID NO: 1646 - DNA, 378 bp, Glycine max
  Peptide Sequence Number=SeqID_118424
atggccacaatcccaccacgaaaaccaagcttgggatggagagtgaagaagggggtggcagaaacgaaaagagtggtgggagtaacggactttggggggaaaatggtggaaggagaagaacgaagaagagttgagaaaatgggtttggatttggaggaagagataggagtggagatggaagtggttctcagaatattgaagcccatggcgatggtgtttgtgttcacgaatcacggcagtgggagtgctgacaggggagtggtagtaaggatggatggtagtggtggttgtaatggtggtggtggtagtgtagctagtggtagctgcagtggtggtggcaatagaaagagagagagcagttgcacagtgtggggatga

SEQ ID NO: 1647 - DNA, 849 bp, Glycine max
  Peptide Sequence Number=SeqID_118425
atggaggggtcattatgtgattctgggactgtggaaattattggacccattgcttcaacggtggaggatgtcttgctagtgtattctgcaatgttgggtgcatcacctgcaaatagaatcagtttgaaaccgtcaccaccttgtttgccaagtctgtcatccaacgataattcaaatgccttgggatctttaagaattggaaagtacaccccgtggtttaatgatgtgcattcaactgaaatctctgataaatgtgatgaagcacttaatctgctgtcaaaggcgcatggttgtgaaatgatagaaattgttataccagagcttcttgagatgcgaactgcccatgttgtttccattggctctgaatgcttatgttcactgaatcctgattgtgaagacgggaaaggtgtaaatttgacatatgatactcgtacaagtttggcactttttcggtcatttacagcagccgattatgttgcagctcaatgtattagacgaaggagtatgtattaccacctggagattttcaagaaagtggatgtcatagtaacaccgaccactggcatgacagcacccataatacctcccagtgctcttaaaagtggtgaaacagatatgcagactacagctaaccttatgcagttcgttgttcctgcaaatcttttgggattccctgccatttctgtcccggttggttacgataaagtaggacttccaataggtttgcaaataatgggtcgaccatgggcggaagctactgtactgcgtgtagccgctgaagtggagaaactctgtggtgagtggaagaaaaaacccgcgtcgtactatgatgttctgaaggctaaatga

SEQ ID NO: 1648 - DNA, 306 bp, Glycine max
  Peptide Sequence Number=SeqID_118426
atgaaggccgataacaattccaccacggaccagtcaatgtcgaagtttttccttctggcgaacaacgccacctttcatgaagccgagcttccacctttgttgagcaatgtaagggagattatggttgtcaagatgcacaccaccaccgctatgcgtggtttgaacggcgacgagaaggagcagcaaggtcaagaactagaagatgcagaaccaagtagaaatgcagaatcaaacaaggaagaggacagaaggccaaaaagggaaatcaacaagccatattacctcaaggatttcgttagcaaatag

SEQ ID NO: 1649 - DNA, 263 bp, Glycine max
  Peptide Sequence Number=SeqID_118427
atggcttctatgatggatgccatgctggggatgaaacaactaatggagagtaacgtggccactgccgttgccattagctcgactgccgaggcagacccgactctctcgactgttgtgcaccatcccattccaaacatggtgggacgagagagaagcacaccggggcatattagcaaccccatccggggtacaactgaggtacttacccctacggtttaccacccaattacacatcaccagccatacatgaagacatgggtcac

SEQ ID NO: 1650 - DNA, 1258 bp, Glycine max
  Peptide Sequence Number=SeqID_118428
ccacatcgaagcctctagccatcataactgcccgatctgagaatcacgtgcatgccacggttaaatgtgccaaatcaaacggcattcaagtcagaatccgaagtggtggccatgactatgaaggcctttcatatgtctcagacgtgagttatgtcgtacttgacatgtttcctcttcataagattgatttggacatggaaagtggcacggcatgggttcaggctggtgcaacacttggtgaactttattaccaaatagcaaacaaaagcaatgtgcttgctttcccagcaggggtgtgttcttctttgggaactggtggccacttctcagggggtggttatgggaatttgatgagaaaatatggtctttctgtggataacatcattgatgccatattggtcgacgccaatggtattctcctggatagaaagttaatgggggaggatcttttttgggctataagaggaggtggtggggccagttttggtgtcattgttgcatggaagataaaattggtccctgtgcctccacaagtgactgtgtttagagtgaaaaaatccataaaagaagatgcaacagatgttgcataccaatggcaacttgtggcaccaaatttggacaaagatcttttcataagagtccagcctgatgtggtcaatggaacagttatagtctctttcataggccagtttttgggcccaattgaaaggcttcttcgtttggtgaatgagtcattccctgaattgggtttgaagcaaagtgattgcacagaaatgccttggatcaattccactcttttttggtatgatctcccaattgggactcctattgaagccttgctaccaacaaatcaggagccaccttcaatctacacgaagggcaagtcagattatgtgaaaaaacccatcccaaaggaggctctaaagtccatttgggatttgatgattaaatacaacaacatttggatgcaatggaacccttatggagggagaatggctgagatatctccaaaagcaaccccttttcctcacagggcagggaacttgttcctcattcagtactctgtgttttggactgaagatggtgctgaggccaataatcgttacttgaactattcaagatcgttttatgagttcatgaccccttatgtttcaagctttccaagggaagcgtttctcaattatagagatattgatattggtgctaaaaatccaagcacttcaaataacttggtcgactctctcaaatatgcaagcaa

SEQ ID NO: 1651 - DNA, 171 bp, Glycine max
  Peptide Sequence Number=SeqID_118429
atggtggacattaattttcaggaaattcccttgggaagatgggagttcagaagcaaaagcagtaatgattcatgtagccaggaaggatggtgtagagggtacatgtttgccttggaggtgactgaagaacttgagacttggccagagcagaaagaccataatcgccaatgg

SEQ ID NO: 1652 - DNA, 246 bp, Glycine max
  Peptide Sequence Number=SeqID_118430
atgaaggaggttggagaactagcgcgagggcgaatgagggtttcgcaaggctgccgtagcacttccaggatttgggaggtggagaatgaggggttaggaatgggtaatttggcagtgagtctcaaagatgatgttttggagctgcatcctagacgtccgattaatagaaaagagaagagcaattgcttcagcatcatgagactgtggtgtaccatatggaaccatgacgttgcagcagaaatgtaa

SEQ ID NO: 1653 - DNA, 303 bp, Glycine max
  Peptide Sequence Number=SeqID_118431
atgccaaagataggtaccattccccacgaacagcaagcaccctccagagtccagactcaactcaactcaacattggtgaaagaagcttcggaagaaagagaagctgcacaagagtattcttgccctcgaatcacgccacgtgtgaaaaaggagggtgttcttgttgagatgagtgagatcaaatatggctatccatacccagctcaaggtacttatcaggggccgcctccggtggcggcacctccacagtactatgctgctccaccgcctagaagagaaccgggtttccttgagggatggtaa

SEQ ID NO: 1654 - DNA, 309 bp, Glycine max
  Peptide Sequence Number=SeqID_118432
atggcgatagtgggaacactattgcacaatacccatcacgaaaccattgtgaggagaaaaacaacggaagagagtgaagaagtgtatgaaactgagctggcacaattgttttcagaagaggatgaagtgcaagtgttttttgcaaagctggatggagagcttaacaagataaaccaattctacaagaagcaagagactgagttcattgagagaggagaaatgctgagcaagcagcttaacatcttgctagaccttaagcaaattctcagcgaccgacacaagaaaaaatccgtcgctaaagccttctaa

SEQ ID NO: 1655 - DNA, 1251 bp, Glycine max
  Peptide Sequence Number=SeqID_118433
atggaattcagattaggatccgaagtggtggccatgactgtgaaggcctttcttgatgtagacattgaaagtggaacagcatgggctgaatctggtgcaacacttggtgatgtttactatcacatttcagagaaaagtggtgttcatggtttccctgctggggtttgccccactgtgggtgctggtggccacttctctggtggtggctatggaaatctcatgagaaaatatggtctttctgttgataatatcattgatgcaaaattggttgatgtcaatggtaacattcttgacagaaagtcaatgggggaagatctgttttgggctataagaggaggaggtggtggtagttttggtgtcattctttcatggaagatcaagttggtttatgtgactccaaaagtgactgttttcaaagtgatgagaaacttggaagatggtgcaaagggtcttgtttacaagtggcaattgattgcaacaaaattgcatgacgatcttttcataagagtgatgcatgatgttgttgatggtactcaaaaggccaagaacaagaccataaaggttacttttattggtttgttcttgggaaaaagtgatcaaatgttgagtttggtaaatgagagttttcctgaattgggtttgaagcaaagtgactgcattgaaatgccatggatcaattccaccctttattggttcaattaccctattgggacccctattaaggctttgcttgatgtgcccaaagagcccctttcatatagcttcaaaaccatgtcagattatgtgaagaggcccattagaaaaagtgctcttaaatccatgtggaagcttatgattaaaagtgagagtgtgaggatggaatggaatccttatggtgggaagatgcatgagatttcaccatcagaaactccatttcctcatagagcagggaacttgttcttgattgaatacttaaccacttggggacaagatggggttgatgctgctaatcgttacctgaacatttcaaggtcattctatgaatttatgaccccatatgtttcacactcgccaagggaggcatttctcaactatagggaccttgatataggttccaattttccaagtaatgcaacaaacatgaacattgctcaaagttatgggagcaagtatttcaaaggtaactttaaaagattggtgagagtgaaatctaaggttgatcccgagaacttcttcagacatgagcagagtataccacctctttcccattag

SEQ ID NO: 1656 - DNA, 309 bp, Glycine max
  Peptide Sequence Number=SeqID_118434
atggaaatctttattcagtcaattgatcctgttgcatggaatgctattgttaaaggaccattcataccaactaaagaagtaaatgggcaacgcgaggctcacgggtgtgtcttccaaggaaggaaaacatgcggagtcgccaccaacgtttatttgaggaaaaacgttagaaaaaccaaaagtggatctatgagctttaagaataaaaggttcaagagttgtgttttttacgcacggggaaggtcgacaaaagcggggcttttgctcctacgtatcctcaattgtgatgaggaactcagacctatgtag

SEQ ID NO: 1657 - DNA, 405 bp, Glycine max
  Peptide Sequence Number=SeqID_118435
atgggagagttgaaattctttgtcagactacaaataaagcagacacccaatggtgtctacattcatcataccaagtatgtgaaagagctattgaagaaattcaacatgaatgatgcaaaagaaatgaagacactcatgcatcttacaacataccttggattggatgaagaatcaacaaaggaggatgggactcaatatagagcaatgattgggtcactgctttatctcacatcgtccagacttgatatcatgtttagcgtttgcctatttgtaaggaagagcgcaagtggaagctatcactttattagtggtaacttagttacatggatatgcaagaagcaaggttcaactacattatccactactgaagctgaatatatgttagcaacaagttgttgtgcttaa

SEQ ID NO: 1658 - DNA, 526 bp, Glycine max
  Peptide Sequence Number=SeqID_118436
gactacacgtcctcgccttagaggattacacgtcctcaccatcagagggctgcacgtcctcacctttagaggactacacatcctcaccttcagaggactacacgtcctcaccatgagagggctgcacgtcctcaccattagaggactgcacgtcctcaccttcagaggattgcatgtcctcacttttagaggactacacatcctcgccatcagaggactgcacgtcctcaccttcagaggactacacgtcctcaccttcagaggattgcacgtcctcaccttcagaggactgcaggtcctcaacttcagaggactacatgtcctcgccttgagaggactatatgtcctcgccattagaggactgcacgtcctcaccatcagagggctgcacgccctcgcctttagaggacaacacgtcctccccttcagaggattacatgccctcgccttcaggggattgcacgccctcaccatcataggactacacgtcctccccttcagaggactacacgccctcaccttctga

SEQ ID NO: 1659 - DNA, 661 bp, Glycine max
  Peptide Sequence Number=SeqID_118437
atggcaccgccgacggctggcgggtgccggtcggttcttcccctgcttccggagcctgacgatgctgctgttgctgcttgcctacctcgggggcgcgctgaccctgctcagcccctgcatcctgccggtgctgccgttcgtgttcgcgcgtgccgaccgcccgttcctgcgcagcacgctgccgttgctgctgggcatggcactgaccttcaccgtggtcgccagcctcgccgccgtgggcagccaatgggtggcgcaggccaaccaggttggacgctggatcgccctgctgctgatggcgttgttcgcagtcgccctgctgtggccacgactggccgaccatctgctggcaccgttccagcgggtgggcgcacggctgagcgcgcgcgccgatgcggccgatgccgccgggcgtggcggcgcgtggacctcgctgctgatcggcatcgccactggcctgctgtgggcaccgtgcgccggaccgatcctcggtctggtgctgaccggcgccgccctgcacggtgccagcgtcggcaccagcaccctgctgctggcgtatgcgctgggcgcgatcaccgcgctggcactggcggtgtgggtgggcggtcgtgtgttccgtgcgctgcaggcgcggcttggcctcggcgacgcactacgcaag

SEQ ID NO: 1660 - DNA, 338 bp, Glycine max
  Peptide Sequence Number=SeqID_118438
aggttgcttgttgggtgtccaccgaggagagacaagcagcaagaataagaggcttatacctcagagcaattttatggcaagatatcagcttctttgacaaggaaaccaatactggtgaggttgttggaaggatgtcaggtgacacacttcttattcaagaagccctgggagagaagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 1661 - DNA, 207 bp, Glycine max
  Peptide Sequence Number=SeqID_118439
atgagaatattgagatcgattaagccctccactcaagtgaaagctacacaatcacatgcccgtgaacaaaggccaatcttggagtacaacagtatccatccagagcttacccatttactcctcaagtttactcataattttgatagcatcaggggcacccaagcacaggggagaagcgatcgattcagcattagggctctaacctaa

SEQ ID NO: 1662 - DNA, 942 bp, Glycine max
  Peptide Sequence Number=SeqID_118440
atggcttccgccgtccttgctaatcggaacgaacctaattggcaacggcatagaggcggtggagctggattcatgggaaaaacacctttctctaaccctaattctaaattagcgaatagcaagaggacccaatcggcatccgatgatgcttcctctatcaaccggcgatcgaacgacgccctaactcactctcagtacgttaccttcaacatcgcttcgtgcacgaagaaggagctcaacgacttcaagaatctcctcgtctcagagctcgaacaaattcggaagctaaggaatcaaatcgagtccagcgagtttcaacccgggcagagcctcaacggccatccgaagaagccgtcgagcaagaaagtttctggcaacaagcggccctggccgtcaaattccgcgaaggatttgaaacggtcgcattcggaggctgggaacttgatgaagtgttgctcccaggttttgcagaagctgatgaaacacaaacatgggtgggtcttcaacgcccccgtcgatatagtcggattgaaactccacgattactgcgatataatcaagcagccaatggatctgggtactgtgaagtcgaatctctctaagaacgtgtacgccacgcctgcggattttgcctctgatgtgagattaactttcaacaatgcactagcttataaccctaagggtcacgatgtgtacaccatggcggagcagcttctggcgaggtttgaggaactatatcggccggtgcatgagaaattcgaaggtagcataagtcatgatcgcgaatctgaggaggaattgcaagccagttcgtggagccacgtcgagccagagagggtgaagaaaaaggagaagcctcctcctccccctcctgcgaaattgcaacaagagcctccggttccccctgcaagttcttcaaaccctccattgctgcagtctccg

SEQ ID NO: 1663 - DNA, 195 bp, Glycine max
  Peptide Sequence Number=SeqID_118441
atgagcaactataaaacaaacttcagttgggttgaaaatcatctagctagcttactatacagaattgaatacaacctggaaaacatcacaagcaaagcagttaaagaagagatgttgcagaatgatattcttctacagacagaggtctatgcacaactgtttatggatcaaggcacagtggaatctttaagttaa

SEQ ID NO: 1664 - DNA, 465 bp, Glycine max
  Peptide Sequence Number=SeqID_118442
atgtgggtcggacaaagcataggcgatgagatctgcccgtgggtgcttcgggaagctttctctgccattgatgctttcttgatttatgatccgacggatggcgtcgattactcgaccgtcccgaaacctgaccgtggatctggcacggagggtgatgatttcgtgatgctgccacgtgtctttgtcagagcggaaggatggaggaggcccttgtttggatttggatttggatttgaaggtttgacgggggggtgggcccacgttgatgacgtggatggaggccaaactaaagtttccagcgtgtgggcgaggaaaacgcgtgtcgatgtgaagggtagtatcgtaaaagaacagtgcagtttgagagaggactggttcttcttcttctccttcttccattccctgtgttttcacttaattataatatcaagcgtattagcgcttttgaatgatgaattttcatga

SEQ ID NO: 1665 - DNA, 191 bp, Glycine max
  Peptide Sequence Number=SeqID_118443
gcgtcgaaggtagcctgaggtttgagaagtgtggtaggtgttgccgtgctgcacaaggttatcagatcaggggaaaggggacaaggggcgaaagggtgttcacagtggcgaaagagtgtttgttgacggtggaggaggaggggaagaagtcggtgccggtcaggatatttgtatccattcaggtcttttga

SEQ ID NO: 1666 - DNA, 609 bp, Glycine max
  Peptide Sequence Number=SeqID_118444
atgagtcttgaggagaaacacaagttggggttagggttgcagagtttgccgccagaaaaaatggaacaggtggtgcagatcatacggaggaggaatggacatttgaagcaggatggggatgagatcgagctagacattgaggctgttgacacagagaccctttgggaacttgatcgattggtgactaattacaagaagatggttagcaagattaagaggcaggcattgatgggcaacactaacaacaacaacaacgatgcgcagtctaacaaaggcaatggggaattgcctgctagcgagaaggttgatggggcgccagttgaggtgaagaaggcaaagaaagtagaagcaggggaagaggatattgacattggggatgagatgccaacgagtatgtttccccctgtagagattgagaaagataaagatgttgctggaggccgtggaagtagtagttctagtagctctggcagttcaagtagtgattcctcatcgtcaagtgttgaagctatttctgtgaggaaaaacttaagtttgatcgccattgcagattcggattcggggagttcctcagggagtgattctgaagcagacaacgggctttcgtag

SEQ ID NO: 1667 - DNA, 786 bp, Glycine max
  Peptide Sequence Number=SeqID_118445
atgaagtttctggctgttcagggtctcttcactgcatcacttggctctgaggtgacttcgtttgagttacaggagaaattcaggtggccaaaatctcccacatcgaatgctctttgtaagatgtgtatagaccagctgcaattgttgttagcaaatgctcagaaaggggagggcagttgtcctttggccaacagcgttgagccaaatgatcttggttcatacttcatgaaattctttggcaccttatgcaacattccttcagtttccctcttccggtctttagatgatgtggatcaaaaggcagtaaaaaaattgcaggcaatggaaactagattatcgagagaggaaaggagccgtgactgtagcactgatgctaatagattgcatgcactgagatacttgcttatccagctgcttctgcaagtgcttcttcatccaggggagttctcagaagctgcatctgaactcgtcatttgctgtaagaaggccttttcaacttctgatcttcctgagtcctctggagaagatgatgtggaggttgatgatgcccctgaattgatggacgttcttgtggatacattactgtctctgcttccacagtcatcagctcctatgcggtcttccattgaacaggactggtcagatttcacatattctattaaaaatgaaaaagatgagttacctggatttaatggatggtatgaacatgctatccaaaaatggatgcaacctgtgacttacctggctatgagtgataataggggagacgttgaagtactttgttga

SEQ ID NO: 1668 - DNA, 766 bp, Glycine max
  Peptide Sequence Number=SeqID_118446
atggagaatggggtaggcgaggagatggatggtgaaacttcagcacgggttcccctcagggagcgccgagtctaccctgcccatccttcaggcttggtgaggaagagagcttatatatttgattgcatggggaacttttatcataaagattgggatctagcagacctttttctaaaagaagagaaggaatctggtgtaggagaaggtcgagggaacgagttttcttggtaccatgttgaactaccgaaaggaaatcaaaagttgtcacaatctgcacaggacctgattggtgttttctgcccacctttgaaactccaagacattctttcacttgttagcaatggacccttttgtgcacatgtagatggggcacttgtcttccgtgttaattcgcccggtcctccctccagcgacttcacgtttaggattgctgctagagttacggagcattcagtaattactgtgtccttgggacgtgttcccaggttaggcttctcccgtgtgggtgaatctctactttccgagattcctagtgttgagagtttctctcctttaagaggtcagcagcaggaaaggacagtgatcaaggagcatgttcttgaattcttattgactatgaatcactctgaggaagctgacaaccctgtgcctagatctgtctcaaatcttgtagtacacataattgacacacatgtagatcagattcaagaccttgtgacgaagcttgagatggagttggactccgtggagcttgacttggataacg

SEQ ID NO: 1669 - DNA, 2040 bp, Glycine max
  Peptide Sequence Number=SeqID_118447
atgggtagtagcagtaagaaaaggagctccgctaccgaggaacaaaccctcgccgccgccgatgctcccaaaccgctcattaagaaaccgaagaacaccactaccgacgatgatagtcaacaacaacaacaaccttccgtcaagcccatggagaggaagaagaagcgtaaagccttggacaaagagaggcgccgaaccacatcccaacccgaacccgaacatgcagcttcggagcccaaacctgcgcctccgtccacggattcacctagctctagcggcggtgttatgccggagttccacattggagtgttcaaggacctcgcggcggcatccgagtcggcgagggaagccgccgcgaagcaaatggtgacggagttgaaggcggttcagaatgcttatgattcgcgcgaggagaaggagagtggtgagggtggattgaagttggaagcagagaaagacgatggattggataactgtgcttcgtctgtgagatacgctgttcgtaggctcattcgcggtgtttcttcatccagagagtgtgcacgacaaggttttgctttaggtttaactgttttagctggcacggttcataacattaaggttgattcattccttaaacttgtagtcaatttgctggaagtaacttcatcaatgaagggccaggaagcaaaagattgtctgttggggcgcttatttgcttatggtgctctggctcgatcaggaagactcacacaggagtggaatatggagaaaagcactccatacattagagaatttatcagtgtgcttatctctcttgcaaataaaaagcggtacttgcaagagcctgctgtctcaataattttagacttggttgaaaagattgtctacagccattgcttgtatcctggtacatctagttgtgagaatgattggattgctagtacattttctatgtcagatccctgtatgcatatgtccatgtgcatagatcctcataggcacctgcaaacaactacttgcatcattgaaagtgtctatgctatgagtggatcactttctcataggttacctgttgaagcattggtgaatcatgttcttgaagctcctgggctgcaggagtggtttgaagctgctatagaagtaggaaatcctgatgctttgctcctcgctttaaaagttagagaaaagatttctattgatagctctgtatttggtaaacttctgccaaatccattcagctctagccagcttttctctgctgatcacctgtcctccctgagtaattgcttgaaggaatcaactttttgtcagcctcgtgttcatagtgtctggccagttttgataaatattctgttaccaaatactattttgcaattagaagatgctgcatcagcttcaaactcattaaagaaacacaaaaagagtcgaaaatctagctcctctgatgaagaaattgcgaagaatcttcagaatttttgtgaaataattattgaaggttcccttctcatctcatctcatgaccgtaagcacttggcttttgatgttctgtttcttcttctccaaaagctgccggcatctttagttccagtggttctgtcaaacaaagttgttcagtgcctggtggatgtactatcgacaaaaaacacatggctgtttaaagtagcacagcattttctgaaacagctgtctgattgggtgggggacgatgatgtcagaagagtttctgttatagtggctatccagaagcacagcaatggaaaatttgatcgtataacacggacaaaacatgttaaagatttcatgtcacagttcaaaactgaacctggttgcatgcttttcattcagaacttaatgaacctctttgtggatgaaggtaatgcccttgaggaaccttcagatcagagtcaaactacagatgaaaattctgaaatagggtctattgaggataaggattctcctaggaccaatggaaattctgattttttgaagagttgggttatagaatcccttcccagtattttaaaattcttgaagctggatcatgaagagaagttcaga

SEQ ID NO: 1670 - DNA, 564 bp, Glycine max
  Peptide Sequence Number=SeqID_118448
atgaggactgttaccatgactggaatgacagtgattgcccatggagagcaagtatatctccgagtcaaagaaaaatgctcttctaaaagatggtttgccagtgatgaccttaactcccttgaagaactaattggaaggttaaggaggctgaaggagaatgtggggtttatagtaaatcgtgtcacagcaattcaggctggtctagacagctggcagtcagagcaaataaacaggaagctgtactatctttcgttcctttcaataatattcctccctttgtccatcataacaggagtctttggcatgaatgttggaggagttccatggacaggtcaaaatgctccagagctaaaagacggttttcgtaatgtcatattactttgtgttgctatgttatttcttgtactactctgcttcattttcccggccctttatacccgtatagcggcttcctggcgaaataagagagctatgggaagaagctggtcactgaacaggaagtcattgctcaggagatcattaagaataggagagcaggagcgagggggctatcttcggatttga

SEQ ID NO: 1671 - DNA, 561 bp, Glycine max
  Peptide Sequence Number=SeqID_118449
tctgcaaacccgataccgttctgcaaacgagaacaccattgcgctgtgggcgaaaaatgcaggcatcgggaacatccgtgaagagaattactgcgatccggctgattcgcttgccgatacgctgccagtgcaaggtcttcattttacttttttgcctctgcccttgccgctgtataacgtcaatgagcctttaccagcgaaagtggcgcaactgaccacgatctggaaggaatttgctgcgaaaaaaatcgttatccgggatctgcgcttagtggcgttgcccagccagttattgcttgcgggcatacctgacacgcctgcgattgccatgcgccagtcattctgcgacaaggttctggattcagactggaaaaatgaattgctgatgcggcatggcaacagcccgttgccggcacccttctggcacagcacattactgcgctacagcgctgagtttttacccgcagttttgcgtcagttcttttatgaacatcggagcattaattttggtgcggtggcgggagaactgatgctggcgaagactaactacaactggacgaa

SEQ ID NO: 1672 - DNA, 174 bp, Glycine max
  Peptide Sequence Number=SeqID_118450
atgcgaggagtatacggtggattctggtcgattttcgttgccagagaagaagagatggatgaagaccagtggatgtatgatagtatgatgtctcaagaagttgaaatgaatgttaaaaatgcgcaagatgctggcattaaagttgattgctttgatgcctttaatacttctgag

SEQ ID NO: 1673 - DNA, 228 bp, Glycine max
  Peptide Sequence Number=SeqID_118451
atgatttttgagggggagactgctgctgatgatgaatgttgtaagctactagaagatgctgcaggggagcagaagcagaaagctgatgtcacgagagatgtcttgacatcctggagaagacttgtagatttgcaacttgaagaatttccgctgtgcttgattactctgataatggaagttgctgatcccacttgcttaactgctcatacctgctcaggaagtgtctaa

SEQ ID NO: 1674 - DNA, 666 bp, Glycine max
  Peptide Sequence Number=SeqID_118452
atggatctgatggcgctgctgttccgcctgctggccaaatcgcgccagcagggcatgctgtcgctcgagttcgatatcgataatccgcaagaaagtgaaattttttctaattatccgcgcatccttgccgataacaccctggtggagttcattaccgactatttacggctgatggtgagcggcaatatgaatgcgttcgagatcgaagcgctgatggacgaagagatcgaaacctacgagcaggaaagcgaagtgcccgccggcagcctggcgatggtgggcgactccttgccggcgttcggtatcgtcgcggcggtgatgggggtggtgcacgccctggcttcggccgatcggccggccgcggaactgggcgcgctgatcgccaacgccatggtcggtactttcctcggcattctgctggcctacggcttcatctcgccgctggccacattgctgcgccagaagagcgccgaaaacgtcaagatgatgcagtgcatcaaggtcacgctgctgtcgagcctgaacggctacgcgccgcagatcgccgtcgagtttggccgcaaaacgctgtataccaccgaacgtccttctttcgttgagctggaagaacacgtgcgccgcgtgaaagcgccggcgcagcaggcgacggaagaagaagaagcatga

SEQ ID NO: 1675 - DNA, 1635 bp, Glycine max
  Peptide Sequence Number=SeqID_118453
atgtggaaacgacttacccactacgtaggagacttggtgggaatggctacggtcgaccttaagaagcagcagcatgtgacccatgatgaattttatctttctaaacaagctttgcatgagaaagatgaccaccgactttcacgggcaaagttcttctttattgcactatcagttacagctcagcagatagggtcaggcatgaggggccttggagttggtgccctcacacttgattgggctgccgtggcatcattcttgttcagccctctaatctcacccttctttgccattgtcaatgtttttgtgggctatgcattaattgtctacgtggtcattcctgtatcatactggggcctcaatgtgtacaatgccaataggtttcccattttctcctcacacttgttcaccgcccaaggtcaaaaatacaacatacctaagattgtagacaaccattttgagctaaatgttgcagagtatgaaaagcaaggtagaattcatctcagtgtgtttttcgctctcacttacggctttggatttgccaccatagcatccaccctcacacatgttgtctgcttctatggaagggagattatggagcggtatcgtgcttcttccaaaggcaaagaagatatccacacaaaattgatgagaagatacaaagacataccttcttggtggtttcattcattgctgctcgtgacacttctggtttctctcgcactatgtatctttctaaaggaccaggttcagatgccctggtggggacttctctttgctggagtgctagcttttggatttacccttcccattagcattatcactgccaccacaaaccagacaccaggattgaatatcatcactgagtatgtctttggtctcatttaccctggaagaccaatagcaaacgtatgtttcaaaacatatggttacattagcatggcgcaagctgtttctttcctcagtgatttcaaacttgggcattacatgaaaatccctccaaggtcaatgttcttagttcagttcataggtacaatgcttgctggaaccattaacattggggtagcatggtggttgctgaactctatcaagaacatatgtcatgacgatctccttccagaaggcagtccctggacatgcccgggtgaccgtgtattctttgatgcatcagttatttggggtctggtgggaccaaagcgtatctttggttctcaaggaaactacagtgcaatgaattggtttttccttggaggtgcagtaggacccataattgtttggctattgcacaaagcatttcccaaacagtcatggattccactaatcaacctcccagttctattgggagcaactggaatgatgccaccagcaacaccattgaactacaatgcctggattttcgttggaacgattttcaacttctttatcttccgttacagaaagaaatggtggcagaggtacaactatgttctgtcagcagcacttgatagtggggttgcttttatgactgtcttgctctacttcgcactgggtttggaaaacaagagtctaaattggtggggaaatgatggtgaacattgtccactggcagtttgcccaacagcaaagggcgtaatagttgacggttgccctgcaaactag

SEQ ID NO: 1676 - DNA, 1473 bp, Glycine max
  Peptide Sequence Number=SeqID_118454
atggggaacatcatgaggaagaacagcgatgagcttgggcaatttcggagtctgaggaacagcagagtggaccctgaggtgttgaagtccatggggaatgaagcgtacaagcagggaagatttgaagaggctttggctttgtatgacagagccattgctgttgactccaagaaagcaacatatcattgcaacaagagcgcggctttgataagcttgggaaggtttctgcaggcaattgttgagtgtgaggaagctatcaggttggagccttcgtatggcagagcccacacccgtttagcaacaatttatttcagattgggagaggctgaaaaggcactgaattgcaatgaaacaagcccatgtgttgattccgtacttgctttccaggctcaggctcttcaaaatcaccttagcaaatgcactgaagctcggaaagtcaaagattggaaagttatattaaaggaatcacaggctgcaatatccttgggtgctgattcagctccactggtctattgtttacatactgaagccttgctgaagctcctaagacatcaagaggcacacgctacctacgagaaaatgccaaaatttgaccttgattattctaacaaattatttggcccggttcgtagtgcttacctattgatgataggcacacacatttacttggcaaccggcaggtttgaggatgcagtgatagcatctcagcaagcatctaagttagatccaagtagctttgaggtgaatgcagtggtaaggagggccagagcagtggcatcagccagaatgagtggtaacttactcttcaaggcatcaaaattcacggaagcatatgctgtatacaatgaaggactagagcatgatccattcaactcagttctgctatgcaatagagcagcatgtcgttctaagctaggtcaattcgagaaagcaattgaagattgtaatgtggcacttatagttcagccaagttatagcaaggcaaggttgaggagggcagattgcaatgccaagttggaaagatgggaagctgcgattcaagattatgaaatgctgttaagagaaaagccaggagatgaggaggtggccagggccctgtttgagacccagctccaactcaagacgttgcgtggtgaagatattaaggacttgaaatttggctcaaatttgtttttcatctcaagcaatgatcggtttagacattatgtaacatcacctgggatgtctgtggtgcttttctgtaacaaggcaacccacaaacaagtgttattggtgttggagcaaacctgcaagagatttccatcagttaattttcttaaggttgagattgaagaccacccttacttggcaaaatcagaaggtgtgaactgcatcccagcttttaaaatatacaagaatggatcaagggttaaagaaattccaggcagcaaccacgacttgttggaaaaattagttaaattatatagcaactga

SEQ ID NO: 1677 - DNA, 1842 bp, Glycine max
  Peptide Sequence Number=SeqID_118455
atggataggggcagtggcgaatcaggaccagggaacagtgggcatggcccagcccaagagcaaaagcccaatccattcgctaaaacccttggggcagtttttctctccgagcttaaacctaaaaccgtaaaacgcctccgtcgtcacttagccaccaccgtctcgttcaattccgagttgatgagtttgatatcccaaaacgctcggtctaaaaatgaggtcaataagaacaagagggaggttgaagatgatgtcgagaataatgatactctggaagtgaagaagaagaagaaagatcacgagagggaacagtcgacagtggaacaagtgaaagagatgaagaagcttgagaactttttgtttggttctctatattccccccttgtgtttggaaaggatgatgatgaagtggaacctcggaaggctgccgaaaaagtttctgatttgttcttcactgaccgctctgcggatagtgttctcacggtttaccaggaagaagatgctgacttgtctgagggaagtcatgatgatgatgaccgccccttgcagaggaaacctgtctggatggatgatgaagaagaaaatgccactgtgaacatagccaaggttaacagattaaggaagttgaggaaggttgaggatgaggatttgatctcgggtttggagtatgtgtcgagattgcgggctcagcatgttaagcttaacccaggtactgaatgggcacgggttgattctagaatagatagatcctctgatgatgagtcgacggatgatgaaaatgaagctgttgtgagccaaggttacggggatatggatgtggatgatgttctcaggacaaatgaagacctggttgtgaagagtggctcaaaattgttgccaggacatcttgaatactcgagacttgtgaatgcaaatattcaggaccctgctaatggtcccataaattcagtccagttccatccgaatgcgcagttgtttcttgcagctggattggaccggaagcttagattttttcaaattgatggcaagcggaacaccacaattcagagcgtcttccttgaagattgccccattcgaaaagcctcttttttgccagatggatctcaggttatagtatcgggaagaagaaagttcttttatagttttgatttagttaaggctagagttgataaaataggtcctctggttggtagggaagagaagagtttggaggtttttgaggtgtctcctgattctcaaatgatagcatttacgggtaatgaaggatatattttattggtatcaacaaaaacaaagcaattggtcggtactctaaagatgaatggaacaatccgttccttagcttatactgagaatggacaaaagttattgagtagtggtggtgatggtcaggtttaccactgggatctgagaacaatgacttgtctgcataaaggtgtagatgaaggttgcatcaatggcacaactctttgtacttcaccaagtgggacttattttgcagctggttcagacagtggaattgtgaatatttacaatagagaggaatttcttgggggaaagagaaagcctatcaggaccatcgagaatttgactacaaaagtggatttcatgagatttaatcatgactctcaaatattagcaatctgttcaggcatgaagaaaagcagcttaaaattaatacatatcccatcgtattctgtgttctccaactggccaccatcaaacacgagcttgcattacccgcggtgtattgattttagtccaggtggtggattcatggttgtgggaaatgcttcaggcaaagtgttattgtataagttgcaccattaccagcatgcctaa

SEQ ID NO: 1678 - DNA, 1500 bp, Glycine max
  Peptide Sequence Number=SeqID_118456
atggatgatgatttcgaaaagggccatgaagtactaggaagtgcaacaagtaaatttgcagtcagagaagcttggacaagagagtctcagcagggggttaaggaatatgcaactcaagttaagatcattaggcaattgaggcacaagaatttgatagctagtggaagaaaacccatttacctaaatgccaaggagggtcaagtaacaatagttgagtgggtttgggagctctatgaattgggagagatacttaaagtagcagacccaaagctatgtggagcatttgatgaggagcaaatggaaaggctgcttcttatatccgttatagtcaactcagcttctgtgagttttgctcctagcacttgcaaccatgaaataattatgtcatctgcagctttgatgattgatgactttggtagaaaaattatgagttccaaaggtgttggtgaagattgcctgggatgggcagcaagagatgcatccggagttctatcaccttacaaattcagtcgcaggactcctgggaatgaagatgttcttattaaaattacacactgtggtgtttgcttcgccgatgtagtttggacaaggaataaacatggtgactcaaagtatcctgttgtgcctggtcacgagattgctgggattgtgacaaaggttggctccaatgtccaccgttttaaggttggtgaccatgttggagtggggacttatgtcaactcatgtagggattgtgaacattgtaatgacagagaagaagttcattgtaccaagggatctgttttcacttttaatggtgttgattttgatggtacaattacaaaaggaggatactccagttacatagtagtccatgagaggtactgcttcacgataccaaaatcctatgcattggcttcagcagctcctttgctttgtgctggaattacagtttattcaccgatggtgcgccacaagatgaatcaacctggtaaatctcttggagtgattggtcttggtggcctcggtcatatggcagtgaaatttggaaaggcatttggtttgagtgtgacagttttcagcactagcatatccaagaaagaggaggcactgagcctgcttggtgcagacaaatttgttgtttcatctaatcaagaggaaatgacggcattggctaaatcgttggactttataatcgacacagcatctggtgatcacccgtttgatccttacatgtcactgttgaagacatatggtgtttttgtcctagttggtttcccaagtcaagtcaaattcagccctgcaagccttaatataggatcaaagactgtagccggaagtgttacaggtggtacaaaagatatacaggagatgattgacttctgtgctgcaaacgagattcacccaaatatagaggtaattccaatcgagtatgccaatgaagctcttgagaggctcatcaatagggacgtcaagtaccggtttgtgatagatattgagaactccctgaaagaaaaataa

SEQ ID NO: 1679 - DNA, 2001 bp, Glycine max
  Peptide Sequence Number=SeqID_118457
atggccacataccaatactgtatctgtaagtgttctcatttacttccttacttgggcataaccatagcaattttgtctttcttgatccctcatgcagctccattagactttagctttcagcagtttctcaacaaggaaagtaccttgaattttgaaggtgatgtttcttatgacaatggactcctccaactcacccaacttaagaaagacagtgttggcagggtcacatactacaaaccactgcatctttgggtcaaggactcaagaaaactcacagacttcacttccaatttctcattcattataaatcaaccaaacaaaacccatattggagatggcatcacattctttcttgcaagccccaaatttccacttcctgtcccaccagatgggtctggtataggccttgtgagtggtcaacaaatggcagatccaaattacataaatgagcatccatttgtagcagtggagtttgacaccttttggaatcattttgatcctcaatatgaccatgtaggtatcaatattaaaaccatcaagagtcctttcactacagaatggtttagtattaatgatgggagagtacatgatgcacaaattagctacaattctagcacatgcaatttaagtatcatcttcacaggatatgaggataatgtcacagtgaagcaacactactcccaagtaatagatttgagagaggtcctgccggattgggttgagtttggcttctcttccgcaacgggattgttatctgagatacatacactttgctcatggtctttcagcgccaatttggacttgaaagtgcacaaggatgaaagtaagacaaggatggtgataggtctgagcattggaggaggtgttttagttgttggtattggattagcttggcttctgaagttgaagatgaagacaagaggcaaggaagatgacttggatcttattatggacagcgatttcgaaagagggactggaccaaaaaggttttcatacaatgaacttgttagaacaactaacaactttgcaaatgaactgaagctaggagaaggaggttttggtggagtctacaaaggatttataagagaattaggtgtggaagagtatgcctctgaagttaagatcattagtaaattgaggcacaggaatttggtgcagctcctaggatggtgccacaagaaaaatgatcttttacttatctatgagctcatgccaaatggaagcctagattcccatttgtttggaggcaaaagcctcctgacatgggcagcaagatataacattgctggaggcctggcctcagcattattgtacctacatgaagagtgggaacaatgtgtgctccatagggacttaaaatcaagtaatgttatgttggattcaaatttcaatgcaaagcttggagactttggattagccagattggtggatcatggcaaagggtcacaaacaacagttttagctggaacaatggggtatatggctcctgaatctgctaccagaggcaaggctagtagagagtccgatgtatacagttttggtgttgtggttttggagatagcttgtggaagaaaaccaattgaactaagagccagtgaggaacaaatagttatggtggaatgggtttgggaactctatggcatgggtaatctgctagaagcagctgattcaagattgtgtggagactttgatgagcaagcaatggaaaggttaatgatagttggcctatggtgtgctcacccagattactctgcgaggcctacaattagggaagcaatgcatgtacttaattttgaagctcatttgcccagtcttccatcgaagatgcctaaagccacctacattgttccttcaattactgcatctgcatcttcaaaccctccatcgtctagtgctgatgcttttgggcctaataaaaccgagcttttgtcaagtggctcttacactggctccccagaatccaaaacatctgctgcacttctgcattctattgagtattga

SEQ ID NO: 1680 - DNA, 1254 bp, Glycine max
  Peptide Sequence Number=SeqID_118458
atggctccttgccatgttggtctccgtgcaactaaccatctgttctgttatgcaaggggaatcagtttcttacttatgattacttttgtaaacccactttcatttcattaccaagggtttgagtatgatgatgccaggattgaaggagatgccactttggcacattcagaaatccaactcacttcagccactaagtaccaaagcaatgcttacagtgttgggagagtcacaagttttaatgatgagaatgtgtctaatcaaatacctccaatggcagcctcaccagtccctaatccttcaccaactgccactgctaatattagccctaaacaagaggccaacaaaggtttattgaaggggatagaaataggtataggtatagctgcaagtttccttattttaggcatggatgatgaattccaaaagggcattggacccaagagattttgctataaagaattggtaagtgcaacaaataactttgcagaggcacaaaagattcgacaatgtggttttggtggtgtttatagaggctatttaaaagacttaaactccaatgttgctataaagaggatatcaagagaatctaagcaaggaataaaggaatatgcaaatgaaattaagatcatcagccaactgaggcataggaatttagtacaactaattggttggtgccacatgaaaaaagatctccttatatatgagttcatgcaaaatggtagcttagattcccatctatatcgtggaaaaagcatcttgacatggcagatgagggatattaaatccagcaatgctatgttggactcaagtttcaatgctaagcttggagattttggtttagctgggctggttgaccatgacaaaggaccacaaaccactgttttagcagggaccatgggctacatagcccctgaatattgcaccacagggaaggctaggaaggaatctgatataatacagttttggggttgttttgttggactctatagattgggaaagttacttaaagtagtagactcaaagcttgggggagcatttgatgaggagcaaatgggacatttagtgattgctggcctttggtgtgtcaatccagattatacatccaggccatctgtaaggcaagtgattcaagtgcttaaatttgaaactcctttaccagttctcccacagaaaatgccagacccattttgccgttctccaacaatgagtactatttttgcttcagtttcttctccctctctggctttatgctag

SEQ ID NO: 1681 - DNA, 306 bp, Glycine max
  Peptide Sequence Number=SeqID_118459
atggcactagagggtcgagctttggcttggtttcaatggggaattgagcaagagcttttcatgtgcattttcttgaacttattaaatgaggaaatacgagtggaggtgacactgtatgagccacgttctctcagaattgataaagaaggcgttgatgggagagaagaatcaagcggtggcaaagactgggtttctggtggggccattctgaaaattgttatagaagttacattggcccaagaacagtctcgattgaggctaaaacaaaaggtgaacgaatggagactaaagcgggtggaaatatga

SEQ ID NO: 1682 - DNA, 1020 bp, Glycine max
  Peptide Sequence Number=SeqID_118460
atgcagactctgggtttgttggtcgctcctgttctcggtttctaccagaggttccttcgtttctctctccgcttccttcttctcatgttcatggatttcccttccacgttcaagttcatcacccaagccagtgaactcggttgcggcttcctcctcctcggttacttctcgcgtctcttcaacctcctcggcctcctcttgatcttcttcttctgcctcaggtttctccgctctcctcttctcctctccaaccacgagaaatcgtcgtcgtccagagacgagaattccaaggaagaagagagtttggaggacgaggtgttcgacgtaatgtcgctgaggaagatggtgaaggaggagcggcagcggtacaacgcggcgtgcgcggagatcgagcaggagcagggggcggcggcgtccgcggcggaggaggccatggccatgattctgcggctgcagagcgagaagagcgccgtggagattcaggccaagcaattccggcgcgtggtggagcagaagcaggagtacgatctcgaagtgatcgagtcgctccggtggacagtagtgcaggtggagtcgcagaagaaccttctagaacgtcagttaggggttttgagggagaggcttagacagttcgtcaatgatcaagaaatacagcagcttcaagaagaacaagaactacaaggcacagccagtgatgatgatgatgatggtgatgaagatagcagtggattcttgaatttctcaattgaatatgatgatgtagatgcttcttcttctagcaaccactcacccacacacacaccacagcacttctacacaatatgtgttaatatgcgtgtgtctgttgtcatggtggggaataggtttaaagttggttcagggatttggcatctcatgaatgagaaagcaacctggtactggagtttgaatcaatcagatgggccagttggggcttgtcgggtaatgtgggaagcactcattggagaagaacctttcttctctacgttattattactctaa

SEQ ID NO: 1683 - DNA, 1353 bp, Glycine max
  Peptide Sequence Number=SeqID_118461
atggcaaattctcatttatcaacaccttctgagctattttcaagacaacataagccccctagggttccaaatcttattgggggcagttttctggactcaaaatcgttaactttcattgatgttatcaaccctgcaacacaagaggttgtttcacaagttccttgcaccacagatgaagagtttaaagctgcggtatctgcagcaaagaaggcatttccatcatggcgaaaaactccaatcacaaaacgccaacgtgttatgttgaagttccaggagcttatacgcagagatatggataaacttgccctgaatgtgaccactgaacaaggaaagacgttaaaggatgcacaaggagatgttttccgtggtttagaggtggttgaacatgcttgtgggatggcaactctacaaatgggagaatatgtttctgatgtatcaagtggaattgatacttacagcattagagaaccacttggtgtatgtgctggtatttgtccattcaattttcctgcaatgattcccttgtggatgttcccagtggcagttacatgtggcaacacctttattctaaaaccatcagagaaagttccaggtgcctctgtaatgcttgcagaattggcaatggaagctggtttgcctgagggtgtcttaaatatagttcatggaacccatgatattgtgaatgctatttgtgacgatgatgacatcaaagccatatcttttgttggttcaaatgttgctggaatgcacatatatgctagagctgcagctaaagggaaacgtgttcaggctaatatgggggccaaaaatcatgcagttgtaatgcctgatgctagtgttgatgctactgtaaatgctttagttgctgcaggttttggtgctgctggacaaagggaaagtaaacttgtggagcatgccaaagctcttaaagtaaatgttggaactgaacctgatgcagaccttggtccagtcattagcaaacaggtcccaggatatgaatctggcaattttattggcccaaccatcttatcagatgtcaccgccaacatggagtgctacaaggaggagatctttggaccagttcttcttctcacggaggctgataacttggaagaggccataaacattatcaatgaaaacaagtatggaaacggtgcttctatatttaccacatctggtgtggctgcaaggaaatttcagaccgagattgaggcggggcaggaagtacacgcgctaagcgcagagtgtcacgctaagcgcgcctacgaaggcccaaagcccacttcagcagctataaatagagagtcagtccaagggacagaacacacaccaccacagaaccccctctcctag

SEQ ID NO: 1684 - DNA, 938 bp, Glycine max
  Peptide Sequence Number=SeqID_118462
tctctgcacattttcacactgacctaatacgccagaaatgtgcaaacaacagtgacacaaacacccctttggatttcattcccgggttgtctaagatgcgagttgaagacttgccagaggatgtgatcaacagtggcagtgaagaggagactctgttttcaaagacactagcttcgttgggtagtgtgttacctcaagctgaggaagtggtagtgaatttctttgtggaactagatccaacctcgttggtgcatgacatgaggtcaaagttgaagtgttttctctacgttggttttctgactctttcattgcctctaccacccttgcctccatcagacacagacgcaacagggtgcttgtcatggctggatcacaagaagaagaagaatggtgggtcagtggcatatgttagctttgggacagtggtgactccacctccacatgagattgtggcagtggcagaagcattggaagcaagtggttttccctttctttggtctctcaaggagcatctgaaggatcttctgccaagagggtttcttgagaggacaagtgagaatgggaaggttgtggcttgggccccacagactgaggttttgggacatggttctgtgggggtgtttgtgactcactgtgggtgtaactcggtgtttgagaacatgtgcaatggggtgcctatggtatgcaggcctttctttggggatcatgggttgactgggaggatggttgaggatgtttgggagattggtgtgagagtagaaggtggagtgttcaccaaagatgggttggtgaaatgcttgaggctggttctggtggaggaaaaagggaagaggatgaaggaaaatgcactcaaagtgaaaaaaacagtgctggatgcagctggaccacaagggaaggcagcacaagatttcaaaactttggtggaagtggtcacttga

SEQ ID NO: 1685 - DNA, 528 bp, Glycine max
  Peptide Sequence Number=SeqID_118463
atggtggttttaagtcccaaaattgagcaagatttggcaaattatgcagaagtatgcttcagggaatttggtgacaggcttaagcactggattacattaaacgagccagtgctatataactccggaggttatgagatgctccaagcttctcagaaaggtcaaattggggtaacactgaattctgcctgggttgtgccacttgttcaatcaaaagaggacagagaagctgcatatcgaggtcttgcttttatgtatgactgtgttgttaaatggcggccatggcggcgccatggcggatttttgtggcggattttcgaaaaaacgccaccgaatagcggtggcgtggcgggtttgggatggcggtgccatggtggccgccatagccatggcggtcgtggcggttatggcggggtgacggaaatggcggttttttttttgctttttgtccgcggtaggagttgggctgacccgacccaactctacccggttattcattcaactaaaagaccctcccacgtagctctgtga

SEQ ID NO: 1686 - DNA, 1725 bp, Glycine max
  Peptide Sequence Number=SeqID_118464
atggccttcttcacccgacgccttctgaccacagtggcccccacatgttcttccccttccaaccagatcaaaagcttcctctcaaaggtcatcaaggcaagctcctctgcccaatgtcatacttttggcacacagcttcactgcttggctcttaagacaggctcccactctgaaacagttgtgtccaactctatcatcactatgtattttaagttttcagatgttggatcagcacggcaagtgttcgacacaatgcctcacagagaccccattacctggaactccttgattaatggttatctgcataatgggtatttggaagaagctttggaagcgttgaacgatgtgtacttgcttggtcttgttcccaagcctgagttgctagctagcgtggtatccatgtgtgggaggagaatgggttcaaagatagggagacagattcatgctcttgttgttgttaatgagaggataggacagtcaatgtttctgtcaacggcccttgtggatttttactttaggtgcggtgattctttgatggctttgcgtgtgtttgatgggatggaggtgaaaaatgtggtttcatggactactatgatatctggatgcattgctcatcaagattatgatgaggcttttgcatgctttcgagcaatgcaggctgagggagtttgcccaaatagagtgacatcaattgctctgttatcagcttgtgccgagcctggctttgttaagcatgggaaggagatacacggttatgcatttcgtcatgggttcgagtcatgtcctagtttttcatctgcacttgtaaatatgtattgtcaatgtggagaaccaatgcaccttgctgagctaatttttgaagggtctagttttagagatgtggtgttatggagttcaatcattgggagcttttctcgaagaggggatagcttcaaagcattgaagctttttaataaaatgaggactgaggaaattgaaccaaactacgtaactttgttggcagtcatctctgcctgcacaaatttatcttcactaaagcatggatgtggactccatggctatatctttaaatttggattttgttttagcatctctgtgggcaatgcacttataaacatgtatgccaaatgtggttgtttgaatggttctcgtaagatgttcctagaaatgccaaacagagacaatgttacttggagtagtttgatcagtgcctatggccttcatggatgtggtgaacaagctttacaaattttttatgaaatgaacgagagaggagtgaaacccgatgcaattaccttccttgcagttttatctgcttgtaatcatgctggccttgtagctgaggggcaacggatattcaaacaagtacgtgcagattgtgaaattccattaactatagagcattatgcatgcctagtcgatctccttggaaggtcagggaagctagaatatgctttggaaatacggagaacaatgcccatgaaaccaagtgcaagaatatggagctctctcgtgtcggcttgcaaacttcatggcagattggacatagcagaaatgctagctccacagcttataagatcagaaccaaataacgctggtaattacacgttactgaatacgatctatgccgaacatggtcattggcttgatacagaacaagtgagggaagccatgaaactacagaagttaaagaaatgctatggcttcagccgcattgaggcttga

SEQ ID NO: 1687 - DNA, 492 bp, Glycine max
  Peptide Sequence Number=SeqID_118465
atgccagtttcccgagaaaattcattttgggcggttcggaatcgggctcgcagctcttgccgctacgcagtcgcagtcctctccgacaccagagtgtgcattgccggttacgtcctcgtgctcttcatcatctacacgaaacaacactccgatctcccctcctactccgattccgatgcgcatcgtcgcacgttgccgttctcctccggcgtcttccactctccggaggaggctttccgcttcgactacgagaagatggaggaggagttcaagatcttcgtgtatcccgacggagatcctgaaacctatttccacacgccgaggaaactcaccggcaaatacgccagcgaaggctacttcttcaagaacatcagagagagtcgattcttcaccgatgatccgcgtcgagctcacctcttcttccttcctatttcttgccacaaaatgcgaggcagagtatgtcctcctcttcgagattacgcattgctttaa

SEQ ID NO: 1688 - DNA, 408 bp, Glycine max
  Peptide Sequence Number=SeqID_118466
atgaatatgcaggggttgactatcgagcgtatgattgatgaagtagagaagtatgtggagcacctaaagttgaagtacccttattggaacagaaccttgggtgctgatcacttttttgttacttgtcacgatatcggtgtcaaggctactaaaggagttccacatctgacgaaaaattcaattcgagtggcttgttcatcaagttatgacgacgatgattatgttccacataaggatgttaccctcccacaagttcaactgccattttttcaccctccaggagaaaatgacatcaagaataggaacacatttgctttctgggctggtcgttctgattcaagattgaaagatgatctaatggctatgtgggacaatgatactgaacttgacatacagaacaagagttga

SEQ ID NO: 1689 - DNA, 1509 bp, Glycine max
  Peptide Sequence Number=SeqID_118467
atgggaagcaactttctctctccaccagctaagcgctccgcacccgacccgtatccgtttcatccaaacggaccttcaaagcgctccaggcaatccaagcctccgcctccgctgtccgtgccgcccggccacgtggccttccgcctcctctgcaacgcctcccgaatcggcggcgtaatcggcaagtccggctccgtcatcaaaactctccagcaatccacgggcgccaagatccgaatcgaggatgcgccacaggagttgccggaccgcatcatcctggtaattgctgacgccgcactcagcggcaagattctgctgagaaacgaagaggtcattgaggtgtcgaaggcgcaggaagcgctgctgaaggtgttcgataggatcctcgaagtggcggcggagactgtaggccacgacgttggggacagggtgatgtcttgccggctcgtggcggacgcggcgcaggccggctctgtcatcggcaagggagggaaggtggtggagaggatcaagaaggaaaccgggtgtaaaattagggtattaactgatgatttgccactttgtgcctccgcttccgatgaaatcattgaggtatttttgcttcctgctcttcttcgctttagcatttgtcattcaacatttagaatattgcttcgtgatgtcagatgtcagaaaacatacttggatattttagaagttgaaaagatagaaggcagagtgtcatccgtaaagaaggcacttgttgcggtctcccaacgtcttcaagattgtcatcctgttgatagaacaaagatgatggggagcaaaccttatgaaatagttcagtatgaagctttagatgcacttcctcgtgcaacttcaactgcagctccacgtgtgactttaactgcagctccgcgtgggactttaactgctgtacaacatgagactgtagatcatcttttgctgaggagctctgcactgtctactttatccagttcctctaacagctatgccaccagaattcattcactgccaacagaagttaatagagtctcatccttggaaccaaaagcacttaagcaggaagtcaccttcagaatactttgttcaaatgatagagttggaggagttattggaaagggaggcaatattgttagagctcttcagagtgagacaggggctacaataagtattggtcctgcagtagctgagtgcgaggatcgattaattactattgctgcttcagagaatcctgagtcaagatattcccctgcacaaaaggctgctgtgcttgttttctccaggtccattgaggttggttttgagaaggggctagactctggattaaataaggggtcaattgttactgtacgtcttgtagtcccatcaagccaagttggttgtttgataggaaaaggtggagtaatagtttcagaaatgcgaaaggcaactggggctaacataagaataattgggactgatcaggtgccaaaatgtgcatcagataatgatcaagtcgtacagtga

SEQ ID NO: 1690 - DNA, 216 bp, Glycine max
  Peptide Sequence Number=SeqID_118468
atgtttgtattaatcggtgctttgaaaggatttgatgatactccacaaagtaaattgaaggttgttgctaggtggattgttgttaaatgtaatagaaaaaatggaaacattgagtgcaggcactacgtcatgcactggatgtcaactataatcttaggaagtttcaagaataattgggaaacgaccattggaaccacaaagaacgaaggcacttag

SEQ ID NO: 1691 - DNA, 780 bp, Glycine max
  Peptide Sequence Number=SeqID_118469
atgcagcactccagcgccacgctgagcacgcgcggcaacagtaacggcagttttcagctgccggccgagggcgcgtggacgctgtgcctgtgcgtcaagccgaccagcattgaactgcagctggcggatgcgcagctggtggcgcagggcgactatcagcaaatcagcatcaacgcgcagacgccagagcagctgctggcggagattgaaacggtgtggcgcgcgacctgtaaacgctggccgaagcggcagattaatctggcgctggcggtgcacgggcaggtcgatccggtaaccggtgtctcgcagcatatgccgcaggcggcgtggcgcagcccgctgcagctgaagtttctgctggaggagaagctggcagttgacgtccgcgtcgataacgactgcgtgatgctggcgctggcggaaaagtggctgaaccgcaatgcgctggccgaattctgcgtcatcaatgtcgattacggcatcggctcatcatttgtcatcaacggtgagatctttcgcggcaacctgtacggcagcgggcagattggccacaccattattgatccgcgcggggagcgctgtaactgcggacggcagggctgcctggagacggtcgcctcgctcagcacgctgaagcggctggcgcatcagcgcgcgccgcagctgtgcagcccaccagccgtcagctgctggccgcctggcagccggcgagccgtggatcgtcgagtgggcgcagcgcagcgcggaagccatcggcatgagtctgtacaatttccttaa

SEQ ID NO: 1692 - DNA, 414 bp, Glycine max
  Peptide Sequence Number=SeqID_118470
atggaggttgagctaagcgtgccttgctacgctaagcctaagggtcattttggtaaggctgagctaagcgcaccatgctgcgctaagcccaaacccttttctgttttgaaaattatggcttccaagaagagaaagtcttctgcttcttcctctacccaagcaagatatgacagatctaggtttcattctcaagaagcttgggagaggtacactgatataattgtgcctaggaaactgcttccagagaggaatgtggtagtatattacactgagtttgatgatttcaaagaggaactcgagagaaggaaatgggatgaagaattgactaattttgatgaaggcagcattgatgttgccatagtgaaggaattttatgccaacctctatgacccagaagacaattcacttaagcag

SEQ ID NO: 1693 - DNA, 1956 bp, Glycine max
  Peptide Sequence Number=SeqID_118471
atgggggagggatgttgtacgcagtcttacccttgcatatgcaaagaggctgtttccggattcgaacccatgaccaacaagtcaccaaggcacaactttaccgctgcaccagggctcgccctcttcttgaggttacattttattcccccatgcagtattgatgaagaaaacaatggaaatatttctgcattggggaaggactgctttttctctcaaaagcattattttcccaactttgatgaggcttttgatgaggttatttatccgatgggggagcctgatgctgtttctattagtatgagagatattgagcttttacagcctcagacattcattaatgatactatcattgacttttatatcaagtatttgaaaagtaaactcccaactgatgaacagaacaggtttcactttttcaatagcttcttctttcgtaagcttgctgatttagacaaagattcatcaagtgcttgtgatggtagagcagcatttcaacgtgtacgcaaatggacaagaaaagtgaacctttttgaaaaggattatatcttcattcccgtaaactacagcatatggattttgttgcctctcaagaattatatgtgtcttgatgacagtcttcactggagtttgattgccatttgtcatccgggtgaagtgacatgcttcaaagaaattaatgaatcttccaaagtagcttgcatcttgcacatggattcccttagaggaagtcataaaggtctcaagaatgttttccaaagttacctatgtgaagaatggaaagagaggcacagtaatgtggtggatgatgtttcttctaaatttttacatctgagattcatctcacttgagctcccccagcaagaaaatttatatgattgtggtctctttttgctacactatgtggaacgttttctggaagaagctccaatgaactttaaccctttcatgataacaaagtcctccaactttttgagcagtaattggttccctccaccagaggcttctctgaaacgatctcatatacagaacctaatttatgatatatttgaaaataattctttgcatgcacctcctactgattgccttgacaaaggtcatccctctgaagatccttccattattgtcaatcccaaagtggaagaagattccctaaggggttgttatccagccttgtggcatgggaaaaatccttcgaattcctctactgaactggagactactgatattcagtatccaacagcttcacacataagagttccaatatgtttgacaggttctggacttgtttccaaggacttacaagcggctgttgtaacttcacattctgattgtctgcagatgccagcatgtcatcagaggggcttcctgtcaccattagaggaaattgaagagtctggtgaggagactgctttatcattagagagagaaaattctcaggttggtatattggcatatgatttcccatctacatatgtcagcaatgatcatagagcatcagaaacatttcaggatggattctctgtaaattttgtggaagctgttgagagccattctcattcaagaacatcgaatacagctactcatgaagaccagcctcttgagaaaatcgaggagtccagcattccagacaagatagtacttgagtatttatcaacctctggctctggtgatgatgttaaagactacattgttccggattctcctgacgcaaatgatgttgatgtgagtgttaagtctcgttcctcagtccggaataatatgaattcagcagcccatcaaatatttgatttgactcacaatgcaagtgttgaagataatactttagttagcaaggaagagccactagcatttgattctgatgaacgagatgccaagaggccaaagcttatgaatgcaggtggtccaagtcgcagattcactagaagcatgataaaaagaacgtgtaatgtcgtgtaa

SEQ ID NO: 1694 - DNA, 453 bp, Glycine max
  Peptide Sequence Number=SeqID_118472
atgggaaaaaagggtcgcaatgggtggttccaacataacattgggagggaagtgggcttagggagtgaggtaagcttttggcattctaagtggctaggggaggaaagtctatgctgtaaatttaatagggtgtatcttaattccgagcaaaaagataatagtgttttggaagttgggtattggcatgatgtgttggcatggaaaagggcatggtttcaatgggaaactccaattgtccaacagttgtggaatatcattgagaattttttacctaaaaagacaccaaagatagatgggtttagaattaaatgggaacaaaagctatgtggtcaaggaggtttacaatgtccttcaaagggagggatcttcggaaattgggaaaattttctcatatatttggagattacctattccttccaagatcaaagggtttatatggaaaatagctcataa

SEQ ID NO: 1695 - DNA, 1426 bp, Glycine max
  Peptide Sequence Number=SeqID_118473
atgtcagacaagaacatggttccctcaagatttatattttgtgtaattgtcattgctgtgttccttttggtgctgtcttcctttttcctcatccacttgagcaatcactcattcattcctagatcagtttcggaacttgttcttgttaacaacacatcccttgatttcaaacccaatttcaagagggaacaagttcaaccacaaagctgtcaattttccaattctagccacaaaccaagttccccaagacagcagaggaagataccatgcgatccaaccaatgctctcttaagggtgttcatgtatgacttgcctccagagtttcactttgggctattggattggaaagggaatgtgaaccaaacatggcctaatgtgaataacccaaaacacattccaccttatccaggtggccttaatttgcagcatagtgtggaatactggctcacccttgatcttctgtcctcaaacatcgcggaaaattttcggccttgcactgcaattagagtgcagaattcgagacaagcagatgtggtttttgtgccatttttctcatctttgagttacaaccggcattccaaaatccatgggaaggaaaaagttagtgttaacagaatgttgcaacagagattggtacagttactaatggagagggaagaatggaaacgttctggagggagggatcatgtgattgtggcacaccatcctaacagcattctgcgtgcaagaagaaagttgggctctgccatgcttgtgcttgcagattttggaagatacccttctcaattagcaaacattaagaaggatataattgctccatatagacatctagtaagtactgtaccaagagctgagtcagcttcatatgaggaacgttctacacttctatatttccagggggcaatatataggaaagatggaggagctattcgccaaaagctatattacctcctgaaagatgagaaagatgtgcattttgcatttggaagcatcagaaaaaatgggattaatcaagcaagccaaggcatggccttatccaaattttgccttaacgttgctggagataccccatcctcgaatcgcctctttgatgccattgtgagccactgtgttcctgtgatcattagtgacgaaattgagctaccatttgaagatgttttggactactcagaattcggcttgtttgtccatgcctcggatgctgtaaggaaaggctacctgctcaatctccttcgttcaatcaagccagagaaatggacccagatgtgggaaaggctaaaggatattacacagcactttgagtatcaatatccaagccagcctggggatgcagtgaatatgatttgggaggaagttgcacataagatatcttcattacaattcaatttgcacaggaaaaaccagataccagagaccttagcttctt

SEQ ID NO: 1696 - DNA, 201 bp, Glycine max
  Peptide Sequence Number=SeqID_118474
atggtgagaaggaagataccgatcaagaagatcgacaacgtaactgcgaggcaggtgacattctcaaagaggaagagtggtcttttcaagaaggcacgcgagctctctcttctctgtgattctgagatagcactcatagtcttttcacctggtggcaagctcttcgactatgctagttcaagtgagaatgtaactcagtag

SEQ ID NO: 1697 - DNA, 411 bp, Glycine max
  Peptide Sequence Number=SeqID_118475
atgtcaagcatgcaacaaacacttgaaaggcgtaatcagcattcagggattcaaggattggataatccatctattggtcaacagccttctgcatccttaattacctctggaacaatgaaaaaacttggaagtgactcctttggcatgctgccgttgcgcaaggaaatagaagataagactaatgaactgagtcagttgaatgaggaagagttgcaaggattgaaaataaaagaattgcagaaactggaggacattcttcaaagacgttggaccactatttcaaaaactaaggacgaaaaagttatacaagagatcaaccaccttaaaacaaagctatttgtgggtaacctaggtgaggaagtaaattggaacttgcaaaaggttgctaaaaaaactttagagggtgtttga

SEQ ID NO: 1698 - DNA, 1107 bp, Glycine max
  Peptide Sequence Number=SeqID_118476
atgaacttcaatcttgcattagtgattatagtatccacaattttgggaattgggcttgaaggatgcgatagcaaggttgtgcagttcatttttggagactcactctcggatgttggaaataacatgcatctctcaagaagccttgcccaggcaagcttgccttggtatggtatagacatgggtaacgggttacctaatggaaggttcactaatggtcgcacagtggctgacataataggtgataatatgggcctccctaggcctcctgcattcctggacccatctgtaaatgaagaagttatacttgaaaacggtgtgaactatgcttctggtggtggcggcatcttgaatgaaactggcgcctattttatccaaaggttttctctggacaaacaaattgagctgtttcaggggacacaaaagttaattagaggcaaaattggaaaaagggccgcgtacaagtttttcaaggaagctagttatgttgttgctttagggagcaatgactttatcaacaactacttgatgcctgtttacactgattcatggacatacaatgatgaaaccttcatggactacttaataggaacattggaaagacaactaaagctacttcatagtttaggagcaagacaactggtggtttttgggttgggtccaatgggttgcattccccttcaaagggtgcttactacaactgggaattgtcgagaaaaagcaaacaagctggctcttaccttcaacaaagcttcaagcaagttagttgatgacttggcgaaggactttcctgattcaagttataaatttggagatgcatatgatgttgtttatgatgtgattagcagtccaaataagtatggattccaaaacgcagactcgccctgttgttccttttggaatattcgacccgcccttacatgtgtacctgcatcaagtctgtgcaaagatagaagcaaatatgtcttttgggatgagtaccaccccacagacagtgctaatgagctaattgcaaatgaactcatcaagaaatttggactttcaaatactaatcaaggaagtgtaccttccccagcacctgctgttgctccatccccagatgaccaatga

SEQ ID NO: 1699 - DNA, 324 bp, Glycine max
  Peptide Sequence Number=SeqID_118477
atggcaaatgatagggatgtagggaaactgaatgaaaagatacttggcttcccaagagtattgtttgttccaattagctttcattcaaaaccttcttctcaaccatttaaggtttctggcttgagaagcaaagatcttgctctgagatgggatgagggactattgccatttgttagaagttttcgtgtcctaaaggctgaagcagtggaggatttgcaatcaaaggtgaagttggcaccttcaccttcaatgacctttgatcctaatcaatcaaacaaaaggacagttagaaaaggaccagatccaattcacaacagaagttga

SEQ ID NO: 1700 - DNA, 834 bp, Glycine max
  Peptide Sequence Number=SeqID_118478
atggagtctcagtcactcatgggttggagctctttctacgaaatagatgaaaaaccatttccatttacgtgccaattttcttacagcggaaacagtgaagtgtatccctcactggattggccttacggttttcccatacaagactactatcttgatgctgttcctcttatggattattacccttcagatccattatatgaaacattaacactcgctactactgaaccaacacaaagcgtgcaagactatgacttttatgacattaaaaagggtttatctggctggaacgaagttgatgctgtgtttgattcacaaaaagtatttttgtttggcaacaacgaagaaagtggtgggatcgagaagcaaatgatggaagaagatggaaaagtgaacaaccaagggagagaagagagaatcaacaatagcagttgcagaacgttatcaaggaagaccatatctcagtacttctacatgccaatatcacaagcagccacagaactcaatgtgggcataacacttctgaagaaaaggtgcagagaggtgggtattcgaaggtggccccacaggaagctcatgagcttgcaaactctgataaacaacgtgcaggagctagggaaagaggaggggggagagagtgaagagaagttaagaagtgcgattgagatattggagagggaaaagaaggtattggaggaaatgccagatactgaactcgaagacactacaaagaggcttagacaagcgtgtttcaaggccaactacaagaagaggaagctcacagtcacagggcggaggaaggaaccacgctcttcttcttcttcttctttgcattga

SEQ ID NO: 1701 - DNA, 1179 bp, Glycine max
  Peptide Sequence Number=SeqID_118479
atggtttcctattacaacaccatgatcagggcgtgctccatgagtgattcaccgcaaaaggtcttgtataaggttataaggtttttgtatcttcttggcggagttcagagaggtggtgatgcgtgtaaggtgtttgatgagatgcctccgagggacactgttgcttggaatgtgatgatctcttgctgtattcgaaataataggactcgggatgctttgagtttgtttgatgttttacagaattcgagctataaatgtgagcctgatgatgttacctgtttgcttcttcttcaggcttgtgctcatttgtatgccttggaatttggagaacggattcatggttatatgatggagcatgaagtgtttaagggaacggggaataaaaatgtggtttcatggagtgcaatgatctctggtttggcaatgaatggatatgggagagaagctatcgaatcatttgaggagatgctgagaattggcattcggcctgatgatcagacactcacgggggatgtgataggttctggaattcgaggtccagtgcctcccgagagcagaataagcaaaaggaagcgagaagaagaaggattaaggatgtcattttttgaccgtatgagcagagagtttggagtaactcccaacgttcatcactatggccagactccacaacgtggaggaccttgcttggtgcttgcagaattcatggccatgttacacttggtgaacgactggggacactgggaaaaggtagcagaagtgagaaaattgatgaaaaataaatcaatccaaaccacacctggttgtagcacaattgaactgaaaggagtagtacatgagtttgttgtggacgacgtttcacatactagaaaccatgagatttacgagacactggatgagattaatcatcagctgaggattgctggctatgttgttgaactttcatctgagttacataagatggatgacaaagaaaaggggtatgtgctctctcatcacagtgaaaaattggctattgcttttggggttcttgctactccacctggcacaacactgagagtggctaataatctccgcatatgtgttgattgcttcaattttctgaaacatttttctggggtttacaacggtgatggtgctgctcgtgtagcaactattggtaggaatatcatgagctggtga

SEQ ID NO: 1702 - DNA, 603 bp, Glycine max
  Peptide Sequence Number=SeqID_118480
atggaagactcactacgggaatcaatcaatcgagtaagcctacaaaaagaaaatttaggaaagcaccaactcatttcactggaatgtgctaaccaggaagggatgacattacctttgatgatgacaagtttacaagaatcccaacctctatcttggcttttgaataatgataatcatcagttgatgttacccaacgaaccaaaatttctatcctttagtgataataccaatagagatgttgagtgctcaactgacatttcactcccaaactattttggtcatattgggagcaacaaacttgaagttggcagttctccccaagtcactactatgggtcaaggaggtggtaccatgaatgagttaaacggaactacttacttaaatgtacaacattgtgaccagtttgcataccctcctccaccagatattgaggaagtgaaacatttcccttcaatggacaataaatcgaacattgttgattaccaagttaataacaactttgatcttcccagatcactgtttgaaaatggacatcaattttggaattctgcttctgggtcatgtgggatagccatgtataatgagaatgactaccataggtaa

SEQ ID NO: 1703 - DNA, 865 bp, Glycine max
  Peptide Sequence Number=SeqID_118481
tcactttgtaccggattgtcaaacatgctctcagttagcggcatctatttattccttgcctatgccttctgcttttaatttcctcacaacttctctgcttccctttctccctctctatcgaggaaacatggtatttttgggtgttctcttggtggggtttctcttaggtgcttatggggacagtgatggttggatggatgctcatgctaccttctatggagggggcgatgcctctggcacaatgggtggagcttgtggatatggaaacctgtatagccagggctacggaactaacacggctgctttgagcacggccttgttcaacaatggtttgagctgtggggcttgctttgagatcaagtgtgtcaatgaccaaaggtggtgccttccagacacagttgtggtcactgccaccaatttctgtccaccaaacaatgccctcccaaatgatgcaggtggctggtgcaaccctccccttcaacattttgatctctctcagcctgtcttccaacaaatagctcaatacagagctggcatagtacctgtggcttacaaaagggtcccatgtcaaaagagaggaggcatcaggttcaccatcaatggccattcttacttcaatctagtcctaatcaccaatgttggtggtgctggtgatgttcaagcagtttcaatcaaaggttcaaggactaattggcaaccaatgtccagaaactggggtcagaactggcaaagcaacacttacctcaatggacaaagcctctcctttaaggttaccactagcgagggccgcaccttggtctctaacaatgttgcccctgatagctggtcctttggccagaccttcacagggaaacaattcaattaa

SEQ ID NO: 1704 - DNA, 1633 bp, Glycine max
  Peptide Sequence Number=SeqID_118482
gcagaagaagaagaaaagaaaagaaaatctaacagaggccacaagaacttgtggcctggaatcgaaacctcggtctgacgtggcacctgactctgctttaaacggatcaaaatcctattcgtcgtgctccactgacacttcacatcaaaaacccaacacaagtaacgaagaagtcactgccatctcgcaagtttcgatccccagaaggaaaataaaaatgcacgaaattagagaccctgcaattcggctcttcggtcagaagatccctttccctgaagatgttgacaaagaagaagagagtgctgaggatagagaacaagagatggaagaacatgaagacgaaggagacaaggatactagagttgaaaatgttactaaggaagagctagaagctgatcctcctctagatgctgaagagactaagatttcaggcacatcccctgaggctattgtgaaccccaaaacaccttccatagaagaagaaacagcaaaatcaaaaggtggcaaatcagagaaggaacaaggcgatgcagccaactcacaagagaaaaccctgaagaagcctgataaagtgctaccatgcccccgctgcaaaagcatggacactaaattctgttactacaacaactacaatgtcaaccagccgcgttatttctgcaaagcctgtcaaagatactggactgcaggtggcaccatgaggaatgttcctgtgggggcaggacggcgaaagaacaagaactctacctcgcattatcgccacatcactatctccgaggcccttcaagcagcaagaattgatgctcaaaatggaactcatcttccaactttgaaaggcaatggtagagtcctcagctttggattagatgcacatgcacctatttgtgattccatggcatctctcatgaatcttggagagaaaaaggctcttaatggcacaagaaatgggtttcatcatggctttgaggatcaaagactccccgttccttgcaaaagtggggaaaatggtgatgactcttcaactacatcctccattacaatttcaagtcccaagggagaaaataacaaaagcaccttccaacaacaaccattgccccaaaatcatggtttccttcctcaagttccatgcattcctggtgttccttggccctatacatggaattctccagttcctccacctgctttgtgtccttcaggatttcccctaccattctatcctgctacattttggaattgtggcatgcctgggaattggaatgttccatggttttcctcaagttcacctgcttcaaacctcaagtctccaagctccagtcccaattctccaactttggggaagcactcgcgggacagtgacatgattaagcaagactctttgcacaaagaagaagcttcaacgccaagaaacgggagtgttttggtcccaaaaacgttgagaattgatgatccaagtgaggctgcaaagagttctatatgggcaactctaggaattaagaatgagtcagtgagtgggggagctatgtttaaggccttccaatcgaagaagggtgaaaagaatcatgttgaagcctctccaatgttgatggctaaccctgcagctttatctagatccctcaattttcatgaaaactcctga

SEQ ID NO: 1705 - DNA, 267 bp, Glycine max
  Peptide Sequence Number=SeqID_118483
atgacgagaaagaagatcccaatcaagaagatcgacaacataaacgcgaggcaggtaacattctcaaagaggagaaaaggtcttttcaagaaggctcaggagctgtcaactctctgtgatgctgagattgctctcatagtcttttccgccactggcaagctctttgagtacgctagttcaagaaaataccaaggttttaaaatacagtatgctatcgcaactttgaccgcaacatcaaagtttttggagcagtactgtctacaataa

SEQ ID NO: 1706 - DNA, 684 bp, Glycine max
  Peptide Sequence Number=SeqID_118484
atggtgggcatgttggagatggccagaggctatgtagaaggagagaagcttggcgacgatgaagttcttttgagagaggccgttgagaagtacttgggtgtgaatttgaaggaggtgagatttatggttggtgtggtagttgttgtttacaagggtagagaatttgaagggtgtagattgtttgcctggccagtagccactattgtagtgttgcacagggtgtgcactggggccctgacaggagctatagctggtgctctagcagctaaggccactaagagtggtcttctccggggagtttcattgggtgccattgccggctctatactctctgtggaggtgttggaagcttcccgtgcctattggtgtatggagcaaactggctcacggagtgcatcatctatggcagatttcatagaggaacttgttcgtgggaggcttgttgaggaatcccttacacctgctattttaactgcttacaatttgcaggttggcattgcgaatacaggctatgttgagactcatgatgttcatggcttagttgcacccagaggactgtcaggagattcattgaagaggttaccccaccatatgatctcaaaggcagagaatacctgctgtgcaatatgtttgcaggggaaattgcaagaagcttacctcgctgtcaccatacatttcacttga

SEQ ID NO: 1707 - DNA, 180 bp, Glycine max
  Peptide Sequence Number=SeqID_118485
atggagactgagaaaatcacagagcagaggacgaaggaagcgacgaagaagcccatcatactcatcaaagagagggtgaaggaacatttagtgtccaaatccgaaggtaagagtgagagtttcttcatcagaacaagtgcagtgactggaaattaccgacttcacaatttggacatgtaa

SEQ ID NO: 1708 - DNA, 1233 bp, Glycine max
  Peptide Sequence Number=SeqID_118486
atgccgccctgcacgaaccctcatcactcacacccctcttgcaaatcgcacaaactctacaagatttggtcaatgaaacctcttgtagattttgtcaatgaaacctctgattctgttgagctgcaacaagataaactgcttggtggccttctagctgatggatttgatgatgaagaaacttgtctcagcagtggattagggaataggattttgaccctagcttctgcatttctctatgcattactcacaaaccgtgttctagtggttgaccctggaacggatatggttgatctcttttgtgagccatttccagattcttcctggtttctccctagtgattttcctcttaatgttcagtttaataatttcagtcagaattctgaccaatgttatgggaaaatgctgaaaaataaagcagttactgattctactgttgcatcttttgtctaccttcatatagcccgtgattatgatgaccatgataagcttttcttctgtgatgaagagcaacgttttctccggaacatgccgtggttaatgatgaaaactgataactactttgtaccttctgtattattaatgccatcttttgagcaggaactgaatgatctcttcccaaataaggaaacagttttccatttcttgggtagatatctgctccaccccacaaacaatgtgtggggacttgttgtcagatactatcaagcttatttagctaaagctgatgaaagagttggcatacaaattagagtgtttgacaccaaacctggtccgtttcaacatgaggatgctaccaattcatcaggaattcccaagtcaaaagcggttttgatgacatccttaaactctggttattttgaaaaggtgagagacatttactgggaatttcctacggtgacgggagaagcggttggtgtttaccagccgagccacgaaggataccaacaaacacagaagcagatgcacaaccaaaaagcttgggcagaaatgtatctgttaagcttaactgatgtgttggctactagctcatggtctacttttgggtatgtggctcacgggcttggaggtttaaaactgcggattctgtacaaacctgagaatagaacggtcccagatcctccctgtccatgtgccatgtcaatggagccatgtttccatgctccccccttctttaactgtaaggctaagagaggaacttacacaggtgaacttgttccatgtgaggcactgtga

SEQ ID NO: 1709 - DNA, 570 bp, Glycine max
  Peptide Sequence Number=SeqID_118487
atgggtaataccaaagtcattgctgctgtttatggccctagagaggttcggtgtgagtacagcatggctaattttagcactggagatcgcatgaggaaacctaagggcgacaggagatcaactgaaatttctctggttattcgacaaactatggaagcttgtatactgacacatttattgcctcgttcccagatagatatttatgtccaagttctccaagcagatggaggaactagatctgcttgtataaatgctgcaactttggcccttgccgatgctgggattcctatgcgtgatcttgtaacttcctgtagtgctggataccttaatagcacccctctgcttgatttgaactatgtagaagacagtgctggaggtcctgatgtaactctaggaattcttccgaagctggataaagtgacacttcttcagatggattctaaactaccaattgacattttggaaaatgttatgcaactggcaattgaaggctgcaaagcaatagctaactatattcgagaagttttactggagaacacaaagcaacttgagtatcgacgaggtgtataa

SEQ ID NO: 1710 - DNA, 1293 bp, Glycine max
  Peptide Sequence Number=SeqID_118488
atggacaacccaacaaccaccgtttggaaccacgtcattagaggctatgcccgcagccacacgccttggaaagccgtggaatgttacactcacatggtgtcttctaaggctgagcctgatgggttcacgcactcgtctctgttgagtgcgtgtgcgcgaggtgggttggtaaaagaaggggaacaggtgcatgccacggttttggtaaaagggtgtgccgatttcgatggggctaggagggtttttgacgtgatgccgtgcaggaatgttgtgtcttggaccaccatggttgccgggtgtgctcggaatgggaagagcagacaggctttgttgttgtttggggagatgaggagagcatgcgtggagttggatcaggtggcgttggtggcggctttgtccgcgtgtgctgaattaggggatttgaagttgggaagatggattcattggtatgttcaacagcggtttgtggcgaggaactggcagcagccctctgtgcgtttgaacaatgcactcatacacatgtatgctagttgtggaatccttcacgaagcttatcaagtgtttgtcaagatgcctcggaaaagcaccgtatcttggactagcatgatcatggcttttgcgaaacagggactcgggaaggaggcccttgatctgtttaagactatgctcagtgatggtgtaaaagtagatggagtaaggcctgatgaaataaccttcattggagttctttgtgcttgtagccatgcagggtttgtagacgaaggacaccaaatttttgcatccatgaagcatacctggggaatcagcccgagtattgaacactacggatgcatggttgatctcttgagtcgcgctggattattagacgaagcacgaggacttattgaaactatgcccttaaatcctaatgatgcgatatggggtgcccttctcggtggttgtcgaattcacaggaattcggagctagcatcacaagtggaaaacaagttagtacctgagctcaatggtgatcaagctgcgggctatcttgtgctcttgtcaaacatatatgcttttggtcaaaggtggcaggatgtcattacagtgagacagaagatgattgagatgggtgtgaaaaagcctccgggcagaagttggatccaaattaatggagttgtccataattttatagcaggtgacatgactcataaacattcatcttttatctatgaaaccctgcgtgacgtcaccaagcaggccaatttggaaggctatgacagagagataattgttttcttggatgttgaggtgtag

SEQ ID NO: 1711 - DNA, 492 bp, Glycine max
  Peptide Sequence Number=SeqID_118489
atgtctatgcgacacagatctttactagccatctttcttgcttttgttggtgtttttcctttctcagtggcagcttcatattcttctatccatgaacttctccgaagccatggcctaccagcagggctgttcccagagagtgtaaagtcatacaatttggaccaaagtggtcgtttggaggtgaacttggatggtccttgcatgaccaagtatgaaacaagagtgttgtttgaaactgttgttcgtgcaaaccttagttttggtcagctcaaggggttggagggtctgtctcaagaagagcttttcctatggttaccagtgaaggatatcattgtgaatgatccatcttcaggtcttattctcattgacatcggtcttgcacataaacagctctctttgtctctctttgaagatcccccagtttgtagatcccaaggtctttcactaaatattgctggaaggaaaagcattggatttcaagaccagagatga

SEQ ID NO: 1712 - DNA, 438 bp, Glycine max
  Peptide Sequence Number=SeqID_118490
atgaatagaggaacaattattgtagatgctatcacctacattgagaagctgcaacacgaagtccagcgtctgagccaagagcttcaccaattggaagcaacttcagagaaaacagcagaggcaaaagtagatgaaattgatgctgtggaggatatgaagcattgggggatacaggctgaggtcagagtggcacagatagatgagaataaactctgggtcaagatcatcattgagaagaagaggggaagattcagcaaattaatggaggccctcaataattttggcattgagctaattgacaccaattttacaaccacaaaaggtgcatttctgattacaagctgcatacaggttaaggatggtgaaagacttgaaattcatcaaagcaagagtttgttgcaagagattatcaatgacatatcaagcaagtccgaatag

SEQ ID NO: 1713 - DNA, 198 bp, Glycine max
  Peptide Sequence Number=SeqID_118491
atggcgggcacagtgatggtggagaagatttgcacccacggagcctcaaaggtggagatcgcgcgcaagcaagggctctgggcaacagtgattgaggtggtcggtggtgacgatggttgttcaactatggcagggaagggtggagcagtggtgggttgggtgagagtaaggtgggggcgaggggagtgggtgagatga

SEQ ID NO: 1714 - DNA, 909 bp, Glycine max
  Peptide Sequence Number=SeqID_118492
atggcttatactggctatgactacaatcaaccatattatggatatgattctagtctatattatgcttctaattaccctgctgaaaattgccaaaccatatcttactctgccacaatgtatagtgacccaaaatctgttttgtatgatcccaattacggtatgagtcagcttgtgatctcttattctaaagtgaaattcaatgtgcctgagtttgatgactatgatccaacaccttatggtggtggatatgacattgatcagacctatggcaaagccttaccaccttcagataaaatttgctatcctcgttctgagtcaagtccaattactgagccacccttttccgagtccatagttccattgcctactatagaagagggaattgaagagaaagcaatcacaccccagaatggggctatagtccaaacaaaaactgaagagaagcctcagtcacaagatagtggcaaagatcagcctaaagaagtagaagacaacaactttaacactgagagtgagggaagtcaccaagaagatgataactattctgagtctggtattgtaagtgggtttattgagggctacaaagagcatgagaagcaagtggttcctgttgttcctcaatatcctagtggatatgggttggaggctatggacatttgtgaaagcttgtttgggtattggccttgtttggaacgtatgaagaagagggaatgctgttgtgaggaagtgagttatagagggaacaattgtcaggagaacatgtggcaaggtactgcaggttatctatttggcagtccaaatccctatggtgggagtggctatggaggagatgttgtttatggctatcaaaggcattatccaatgcaagtacaacacagacagattgattatactgatggatcgtggtga

SEQ ID NO: 1715 - DNA, 282 bp, Glycine max
  Peptide Sequence Number=SeqID_118493
atgccaggaaatctcatgttggttggtttacctccacaacatgttgttcacgtggcggataaagggaaagaaaaggtccaccgtggtggatccgtaacacatccaagcaagatgagattactggaagagccaaaactatcagatcctatgagtaacgaggccgaagatacaactattgggacacttcaaataatggaggattatatttttagaggtttacgtgatggagacacagacaccaatgacatagacccaggaccttttggctacatttcaagatag

SEQ ID NO: 1716 - DNA, 234 bp, Glycine max
  Peptide Sequence Number=SeqID_118494
atggaggaaaagtttctagatgatatgatcacaaaaaaaggaagaaaaaaaaacatgagagagaaagtgagaatccttgcaatagcagaagaagggcttaagtggtgtggcagggtgaaagagggatctgaaaccaaccttgatatcatgaaggcgggcagtgaaagtggaacagaagctgatggggtgtgtgatcagtcaacactagaagaacaagaagagtgttggcagtaa

SEQ ID NO: 1717 - DNA, 1494 bp, Glycine max
  Peptide Sequence Number=SeqID_118495
atggatggtcacggaggaggaggaggagggagcagaggagaagcggagctctggctttacacagcgaacaaggttttaagcgcacgtgacctgcacggggcccgctcatttgcgatccgggctcgagactccgacccgagatacgagcccactgagctccttttagcggtgattgataccctcatggccggcgaggcccggatcaacgaccaactggactggtacgctattttgcaagtcctccgttacactcagaacatcgactacatcgccgcccagtaccgccgcctcgccacccaactcgaccctcaccacaaccccttcgccttcgccgctcatgccttcacgctcgtccacgacgcgtggaccgtactctccaacccaactaaaaagactttctacgacaaccaactccggctcctcactcaaccccctcctcctcagccaccaccaccacctcccgctcctcctgccccggtggccttctttcctattcagccgccgcaaccgaacctaaaccccaacccgattccgaacctagtccctccaagggaaagccctaggcctaggcctagggtagaggtggagccgccaccaccggcaccgccgccatcgagtcagctggacaatgcgaccgaattgactcgggcgagtgaggccgagagcgaaggggcgagtttctggaccgcgtgcccttactgttacgttatgtacgagtatccgaaggtgtacgaggattgtactttgcggtgccagaattgtcggagggggtttcatgcgatggttgtacgttctccgccaaaagatggtacttttggctcgttttgcagttggggttttttccctgtgggtttttctggggattttaaggacattaacgggtcttcttccaagtggaaccctttctcccctttgtttccttgcgccttgaagggggccgagcagaatagtaggtaccagaaggggccttgggttttttacgatgatgacgcgtctgcggagttcgtcgaggctggttccgacacgacggaagatgattccgatgatgatgactggcgtggcgggaatcagaaggggaccacgaggaggaggaaaagaaggaagaggagaagcaatgctggtggtgatgttagaagggtacctacaattgagaggcctagaagacgggttcagaatagtgacggtaatgacagtgtggggaatggtgaggctgtggatggtggtgcccttgccgtgccggtggcaccggagtctagcaagaaggctgtggcgttgggtggatcaaggaggaggagtgagaggaacttggggaagttggatttaaatgttgagtttagcaatgaggtggaggagcctgtgcatggagcaggtgaagggaatgggaatgctgaggataatattgaagggattgggttttttgaggggctggatgagttccttagtagcttgcctattctcaatgttgttgcagatgataaggttaagggtcattag

SEQ ID NO: 1718 - DNA, 690 bp, Glycine max
  Peptide Sequence Number=SeqID_118496
atgatgagagttcgttattcttcaattcctgtcgtagtggctcctcatggaatgactcttggtggcggctgcgaaatgaccatgcacgctgaccgtgtagttgctgctgcggaaacttatatcggtctggtagaaaccggagttggtgtaattcctggtggtggtggtactaaagaattaactttaagaacttcaagagaattccacaccgatgatgtgaaaaataacagattacgtgaagctttcatgaacattgccatgggtaaagtagcaacttcagcctacgaagcttatgatatgggaatccttgaaaaaggaaaagatattgtttccgtaagtaaaaacagacaaattgcagaggctaaaaagattgcaaaattattagcagagcaaggatacacacaacctattgaacaaagcgtaaaagttttaggaaaagatgcattgggaatgttctatgtaggaacagaccagatgttaaccggaaactttatttctgaacacgacaagaagatcgcagataaactggccaatgtaatggtaggtggaaatctttccgaaccaactgttgtaaccgaacaatacctgttgaatcttgaaagagaaactttccttcaactttgcggagaaagaaaaaccctggaaagaatacagtacatgttgcagaacggaaaaccacttaggaattag

SEQ ID NO: 1719 - DNA, 591 bp, Glycine max
  Peptide Sequence Number=SeqID_118497
ctgccttatttagcgcagggctggctggaagacgagcagggcaacaagattcaaagcccgttgacggtgctgccgccggtgcagcgcattgagccgggcaagccaagccaggtgaagatccaggcgttgccggcggccaaacagctgccgcaggacagggaaacgctgtactactttaacctgcgtgagatcccgccgaagagcaacaagccgaactcgctgcagatcgcgctgcagacgcgcatcaagctgttttatcgcccggcggcgatagcgccggaacgcaacgctgcgccgtggcaggagcaattaacgctgaccaggcaaggcgataaatacatagtcaataacccgacgccgtattacgtcacccttatcgatgcggccagccgtaaaggcgctgcgggcgcgcaaaacttcgaaccgtttatggtgccgccgaagggcagcgcgccattgtcggtgaacgccgctaccctgggcggtaatccagtgctgacctatatcaatgactatggcggccggccgcagctggcgttcaattgtcaggcggacaaatgcagcgtcgtaccggagaagaaaagctcgtga

SEQ ID NO: 1720 - DNA, 273 bp, Glycine max
  Peptide Sequence Number=SeqID_118498
atgatcattacacaggcgttatgcaacaaatacactaagactcaatcttatatgcaatctggtatcatgtcagtgaaaaacctcgtcaagtgcctagaagtacatgataagacagaccacacattgggagaccagtcaggatcacactattttgcaagaatgctccaaccgtgtgggattagcacagacttaaaggagcactcaaaccggatgtatttactcccaaggcctagactccaaatagtccgtcaaggcctctccctcctgattcag

SEQ ID NO: 1721 - DNA, 489 bp, Glycine max
  Peptide Sequence Number=SeqID_118499
atggaccatttcaagtgcttgaaagaatcaatgacaatgcttacaaagttgagctacccggtgaatggagaatccgatttgaggacaaatccttctaaagagggagagaatgatgaggacatgaccaagagcaagggcaaggatccacttgaaggacttggaggaccaatgacaagggctagagcaaggaaagccaaggaagctcttcaacaagtgttgtccatactatttgaatacaagcccaagtttcaaggagaaaagtccaaggttttgtcgcaacctacccttttacgggcgagcgaggcgaggctcacgggtgcgtcttccaaaggaggaaaatgcgcagagtcgccaccaacgtttatttgtggaaaacgtcggaaaaccaaaggaaccggtcatgaagatattccagattcaggagttgtatttacgtttgaggatggtattagcacctctcacgtttgtcccaaaggacaacatccttag

SEQ ID NO: 1722 - DNA, 609 bp, Glycine max
  Peptide Sequence Number=SeqID_118500
atgagggacggtccatcactttcattacatagatgtggattgccccgcgaaatagcaatagaacttttccagacatttctaattcgtggtctaattcgaaaacattttgcttcgaacataggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgatctttag

SEQ ID NO: 1723 - DNA, 585 bp, Glycine max
  Peptide Sequence Number=SeqID_118501
atggttgattatgagtatttgaagatcgttgttgggggtggagtttctagcgggaataattctatatcagtcgatccagatgatactgatgcaacaacttttgagccagaaaatagaactgttgggatagaagaattttcatatgatcctaatagtgatacattcataacaccaaataactatgaaccaacatatcagcctccatcaccaaaccaaccaagtccaccatcccacccccctttagattcagaggttcccatagaaaaacaaaactgtcacaagcgaaggagatccgaatatggagggagttcaagcgttgttgggatcaacaatcaaggcaacgttctggaaaatctttctgttggcattgggactattgctgtgaattttgaaaaaatatccgacatgatggagaaaagagaaaaagatagagatagagatagagagctcgagggtattatttgggatgttataaaagaaattccaaatttggatgacataacgcgtttcaagacagctgaattgttaaatactaaagcaaaaaaggattttttcttgaagatgtcaccggaagaacgctcatga

SEQ ID NO: 1724 - DNA, 234 bp, Glycine max
  Peptide Sequence Number=SeqID_118502
atggcggcaatggcatgggaggtgaaacgcgaagttcacttgggaggttcgaggaggttcacggcaacaatcatgacaagaatgaagaagatgcagaaactcaagaagatgcagaagaatgaagaagcacaaaggtttgaggaagaagaaacatacggcgcgggagagagagaggtaaggtaccctagaaatgtaggatttttcagcccttgtattttagggcacctagactag

SEQ ID NO: 1725 - DNA, 307 bp, Glycine max
  Peptide Sequence Number=SeqID_118503
cctctccgtcagagggttgcacgccctcacctttagaggactacaagtcctctcctgcagagggccgcatgccctcacctccagaggacaacacgtcctcgcctttatagggctacacgccctcgcctttagaggactacacgtcctcaccttcaaaggactacacatcctcaccttcaaaggactaaacgtcttcacattcaaagggcaaaacgtcctcgctttcagagggctccacatctgcaccttcagagaactcaagatatccgtccgcaagacactcagtggacccgaagaagtccaatag

SEQ ID NO: 1726 - DNA, 156 bp, Glycine max
  Peptide Sequence Number=SeqID_118504
ggattaagagactgagagtctcttattgtagaggattcttgaacacaagggaagggttatccctgtgtagttcagactttgtaaaaggagttttacaaagagagtggaaaatctcaagtgggttgcttgaggactggacgggaagtgaccgaaccc

SEQ ID NO: 1727 - DNA, 132 bp, Glycine max
  Peptide Sequence Number=SeqID_118505
atgcggaaattgattaaggaaaggatggaaaataaggtggttaatttcgtgggtcttaataaggttaagcggtggctggacaaaaatatagaaatggcaataactcaagctacagggctccaaatgaggtga

SEQ ID NO: 1728 - DNA, 390 bp, Glycine max
  Peptide Sequence Number=SeqID_118506
atggatgaatattttagggtgtcaaattgcaaaaatgcaaaagatatgtgggataccttacaggaacatgaaatggaattgatgagattgaatcaccatgaggagaatgataagaaaaagaaaggaattcctcttaaagcttcatcttcaacccaagaaggaagtgataaagaggatttaaatgaaatagacgaagatgatgatctcagttattttgtaaaaagattcaacaaatttctaagagtcagaggaaatcaaagaagatcaaatttcaaatcaaagaaaagggcagaagattcatcctcaactccaaaatgttatgaatgcaatcaacctgaacatctgagggttgattacacaattttcaagaaaagaatagagaaatcttaa

SEQ ID NO: 1729 - DNA, 735 bp, Glycine max
  Peptide Sequence Number=SeqID_118507
taccctggtcttcagaggactacactcctcgccaacagagggctgcacgccctcaccttaagaggactgtgtgtcctcactttcaaaggactgcatgtcctcaccttcagagggctacacgccctcgccatcagaggactgcgtgtcctcaccttcagagggctacacgccctcgccatcagaggactgcatgtcctcaccttcagagggttacacgccctcgccatcagaggactgcatgtcctcaccttcgtagggctacacgccctcacctttagaggactacacgtcctcgccaacagagggctgcacgccctcaccttgagaggactacacgtcctcgccaacgtagggctacacgccctcacctttagaggactacacgtcctcgccaacagaggggctacatgtcctcggctccgagggctacacgccctcaccttgagaggactacacgtcctcgccttgagaggactacacgtcctcaccatcattgggctacacgccctcacctttagaggactacacgtcctcaccttcgaagggctacacgccctcacctttagaggactacacgtcctcaccaacagagggctgcacgccctcacctctagaggactacacatcctcgccttgagagcgctgcacgccctcacctttagagggctacgtgtcctcattttcagtgtgctccacatccgcaccttaagagaatttaaggtcctctgtccttaa

SEQ ID NO: 1730 - DNA, 429 bp, Glycine max
  Peptide Sequence Number=SeqID_118508
atggtaaaaccattatctgaaacaaccaaaactattaaggttttccctccaggattgatgacccaaactcctgcacaaatccttgaatatgctaagtctcattacttccattttctgcttgaaaccatgagattcaaatacactccagtacaaatacttgtgcctgagataccctttggagtacaatattcaatcctcatcgccctaaaacctttgatgacatacaacatcctgacaaatccatatcaagatgaatatcttttatggacaatgttagagtggttatcccctttagcatggtggcatatgaagctgaaacaaattctagacattgagagacaaagaggaatctcagaagatcacataagaaaactagtttctattgtgattattcacagtccttactttatggagcaaagacaactctag

SEQ ID NO: 1731 - DNA, 799 bp, Glycine max
  Peptide Sequence Number=SeqID_118509
aggactacaagtcctcaccatcagaggactacacgtcctcacgttaatagggctacacgcactcaccttaagaggactacatgtcctcgccttaagaggactacccgtcctcgccttcagaggactacacatcctcccgttcagagggcttcacgccttcgccttcagaggactatacatcctcgccatcagaggaccatacgtcctcaccttcagaggactacacgtcctcgccttcagaggactactcgtcttcaccatcatagggctacatactctcgccttcagaggactacacgtcctcaccttcagagggctacacgccctcgtcatcagaggactgcacgtcctcccattcgtagggctacacgccttcaccttcagaggacttcacgtcctcgccttaagaggactacccgtcctcgcctttagaggactacccgtcctcgccttcagaggactacacatcctcgccttaagagggctgcacgccctcgctttcagagggctacacgccctcgccgtcaaaggactatacgtcctcaccttcaggggactatttgtcctcacctttagaggactatacatcctcacctttagaggactacgcatcctcaccttcaaagcactatacgtcctcaccttcagtggactacacgtcctcgccattagaggactacacgtcctcgccttcagaggaatccatgtcctccccttcagaaagctacacaccttcaccttcgtacgactacacatcctcaccgtcagagaactacactccctcgccttcaaaaggtga

SEQ ID NO: 1732 - DNA, 747 bp, Glycine max
  Peptide Sequence Number=SeqID_118510
atggcttctaagaaacacaagagtattggttcaagacccacaacacaatatgatacaaggagatttcactccttagatgcttggaaccagtacacagataatgtcctggggagaaacatcttgcctgagaagaaggtggaactctaccacactaaactagatgattttaagactgaattgaagaggcgtaatttccataaacgcctcaccaatttggttgatgggagcaaagacttggctttggtgaaagaattttatgcaaacttatacagctctgagggcccttcaccaaagcaagccatagtcagaggccatttagtgaagattgatgttgatagtctcaacacattcctagagacacctgtggtattggcagagggtgagactttacccatatactccagatactgcagcctgcccacagattatagagagattgaggcaaccttatgcataccgggccgaaggttcattttgaacactgagggccatcctgggaggattctcaggaaagatttgactactttagcccaggtgtggagtgctctctcatactccaatatgccccccacatcacatacctctgatctgacagtggacagagctaggctgatctttggcctagtctctcgcatggacatgaacaaaggagctcttatttctggccagatgacttctatagcccagtctaacacttctagacttgggtttcctactctgatcaccgccctatgtagagccagaggg

SEQ ID NO: 1733 - DNA, 573 bp, Glycine max
  Peptide Sequence Number=SeqID_118511
atgaggtccttcaatggtgatttccaccatgaagatgcagcggaagataaaggagaaaaggagcttcaccaccaagagagtgccctggataacaagcttaaagaggaagcttcaatggaggaaaagaatgagaaagagagaggggggcacgaaattgaaggagaaaaagagggagagaagttgaactttgaagattgcatcatctccaattcgttggtcgtaatttctcatggtggttttgcttctgtcgacttggtgaagtactcgatgacgactagtaggtatttgactgctcctggggcctttagcaatggtcctgggccaaggggagctcagactgtgaagattgtcaagaggaaagcgtggcatgtctgcaaactgttggcatcgtctgcacctcctatacatttcgaaacatctgaaattgtcaatgagagtctttgcgatgtgataatacttgagcaacaccatttccttggtctgggtgatattgttagggacttcaaggatgatccatgccctacttccttttacgttggaaacatcgtcaacgtaaagggtctaccagtctag

SEQ ID NO: 1734 - DNA, 150 bp, Glycine max
  Peptide Sequence Number=SeqID_118512
atgggttttcctttgccgacagtcatttatcttgccgaaaatttatctggtttcagcattcgtcatttgctctcccttgaggagattccgctgtcctttgcttcggaggaaaggatgaggattctttttataggccaaggttcaaaatag

SEQ ID NO: 1735 - DNA, 279 bp, Glycine max
  Peptide Sequence Number=SeqID_118513
gttcaaaggagtatttacgaagtacaaagctaagacaagaaagaggacttcgagttattgggcaattcgaactggtgtatggacgagtcgaagtcgaggcagcaagagttctggacttagcataatttctgaacaaatcttcactaaaccagttcgacttcgagcaagatggataaccgttctaaggagcagttatgtgcatggtcgcaaatcatttctacagaatccttatacactcaaagtatccagcgcagagagaaacgagtacacaaggagaat

SEQ ID NO: 1736 - DNA, 147 bp, Glycine max
  Peptide Sequence Number=SeqID_118514
atggtccatgacatctttgtcaaggtgaaactggaagtaacagggacattgacagtcctaaatgtgtttggaagtagacgaagcagcgataaatgggtttatgatcccaacatgggttggctcatggtacctaacacatgcaactaa

SEQ ID NO: 1737 - DNA, 825 bp, Glycine max
  Peptide Sequence Number=SeqID_118515
atgcccaaatcttgtgaatttgggatgattggccctcttgatgagtcgatctcttgcttactcataaggttggacccttgggtactagtacgtatcgccatcagaggattgcacgtcgtcgcctttaaagggctatatgccctcgcctccagaggactacatgttctctccttcagaggactacacgtccttgccttcaaagggctacacgccctcaccctcagaggactacacttcctcaccttcagaggactacacgtcctcgcctccagaggactacacatcctcgccttcaaagggtcatgtaccttcgccttcggaggactacacatcctcgcctccagaggactacatgtcctcgccttcagaggactacacgtcctcgttttcagagggccacacgccctcgccttcagaggactacacgtcctcgccttcaaagggtcatgtaccttcgccttcagaggactacacgtcctcgccttcaaagggtcatgtaccctcaccttcagaggactacacgtccttgccttcagagggcctcacgccctcacctttagaggactacacgtccttaccttcagaggactacgcgtcctcgcctttaaagagtcatataccttcggcttcagaggactacatgtcccccttttcaaagggctacactccctcgcccttagagggcaacacgccctcacctttagaggactacacgtcctcgccatcataggaatacactccctcgccttcaaaaaggcaacacgtcctgaaacttcagagggctgcacgcccccgcctttagagggctacgcgtcctcactttca

SEQ ID NO: 1738 - DNA, 270 bp, Glycine max
  Peptide Sequence Number=SeqID_118516
atggaagttaatgaaggatcatatctggatgtcacaacctaccctacgacgggagtatgggcaaaaagccaaaggtgcgtcttccaaaagggaaaaagcgcgggagtgaccaccaacatttattcgaggaaaacattagaaaaaccaaaaagaggtatgcaaattttgaatacaagggttcgggagatgtttacgcatggggaagatattagcatcccacgcgcctgtcacaagggacgacaacctttaattgagtgtgcaaaaacgtga

SEQ ID NO: 1739 - DNA, 105 bp, Glycine max
  Peptide Sequence Number=SeqID_118517
atgtataaaaccttgcctcaaaacagatttttgcaagatgaaaatttccgatgcctcctaaggtgtctagttcctccggcagaggaggaagatccagtacaaaag

SEQ ID NO: 1740 - DNA, 495 bp, Glycine max
  Peptide Sequence Number=SeqID_118518
atggatctggaacgtgcaattgttcaaaactctgataagaggaaagaatcatggaaaacggtgctaactctggcatatcagagtcttggagtagtgtatggagagattagcacttcaccactttacgtgtacagaaacacatttgctgaagacattggtcactcagagaccaatgaggagatttatggtgttttgtctttggttttctggactctcacattggtgcctttggttaagtatgtgttcatagtgctgaaagctgatgacaatggcgaaggtggcacgttcgcactgtactctttgctgtgccgccatgccagggttggcttgttgcctaattgtcaattggcagatgaggagctctcggagtacaggaggaacgactgcggcgtggcaccagagagaagccttgccttcaggctcaggtccttgttggagaggtacaaggtcttgcagaggattttgctggttcttgctttgttagggacttgcatg

SEQ ID NO: 1741 - DNA, 867 bp, Glycine max
  Peptide Sequence Number=SeqID_118519
gctgaatttgatatccctgaagcatctgatgtgagggaaaaaaagaaaatacttcagattgtaagggagcggtggagacagtttaagtctgatttgacttcaaaatgggcatttgcagccgacaaggacaatgtcgatgacactgtatgcaaaaaatacggaattagcaaggagaaatgggtccaattttgtcaaagccgcagagacccctcttgggaggatgtgcggaaaaaggcacaggccatccagaagcaaaacactgccccccacgtgttgtcttgtgggggttatgaatatttagaaaagaagtcgatggttgagaaaacaaaggaaaaactagaggaaactgctcaatccagaagcactgaggtcgtgattgatcctctatctcccatcaaacggcacgtgaagtggaagatggcccgcaccaagaaaactggcaagatgacgtttgaggtagcaaaggaaattgttgagaaggttgtaaaacaccttggtcatgtgcgtattgctggagtcggtgtgaccatcaagcaatactttggaccagctccacggacctcccgcacttcttcctccacggctcccgaagaactagagcagctgactcaacagatcagggaccagctggaggagtcgatcacagaaaaaggacttgcactgcctccagagcctgaggttggtccttcagctgcttgtgtcagcactaaggagagttgtgttgatccctcagggaatgatccagacacgggtgactctgacaaatgcgggttgtacatcgaagaaaatcctccctgcctagttgccctaggaaaagtttatgagggattgacaaccattcacaacatccttttgttgcaagattaa

SEQ ID NO: 1742 - DNA, 832 bp, Glycine max
  Peptide Sequence Number=SeqID_118520
gtcttggcaagccgttggttgaaattttgccccccggtcaacttcgtggtttttgcccgttgttggcttggctagggtcggcggtgctgggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgccttttgggggggccgaggccccctactgctggtcggcaaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgg

SEQ ID NO: 1743 - DNA, 129 bp, Glycine max
  Peptide Sequence Number=SeqID_118521
atggggcatacagatttaattcagttgcctttccattcaatactccgtgatgttcttgatactccgcaagagctcattgaatacttccttgacactaaagctcaggagaccgtggttcctactttttaa

SEQ ID NO: 1744 - DNA, 570 bp, Glycine max
  Peptide Sequence Number=SeqID_118522
atgacggtggagatggaggtggcagtgatggtggtgatggagacaatgaaggcggtggtggtggaggcagatgtagttgaggtctgtgggtatactcacaacaacgtttacctcccctcatcctactcatcctcctcctcctccggcgacgaaaactcttatgaattcaagtccagtacttattcaccctcctacactttcacgtggtcttcctttactttcaacgacaacaagaggttgtggctacttagtgtgtgttgtgtgctccctcttccacttccacgtggcctttctgaccttctcgcaacagtaggagtccaggttagatgggtagctccgaatcatgggtgggtttgtctaaattttgatggagctacaaggagttcccaaaatatgacagggcttttgctggctagatctaagagctttggtgttgcaagtggattcaactgtctgctaatgcaacaggatggtgtgtgttttgtgaaatcaagaagttacttctctttgactggcaagtccagattgtgcacatcttcatggaaggaaatagatgcgatgatgctctag

SEQ ID NO: 1745 - DNA, 627 bp, Glycine max
  Peptide Sequence Number=SeqID_118523
atggctaaaacacaaaattcattccacattctcatggtttccctttgttttgtgttgctgatcaacaatgtgaagtctgattcactttcattgcgcttccccaatttcgcgccgagacaaaactccaacatcggtttccttggcgatgagcgtccattagacggtgcaattcaattgagaagaagagacaataatggaccttatcttatggcactgccaatattcgcctacccagtgttgccccgaaaccactttcaacgcatacaaaagccaaatcgtggctacagctttggaaatgaatgggatcccaaacctgtccctgtggctcttcatattggaattgacatcaacactcttgaatcggtggaaactgtaggttggcctattaattatgttcctcatggttctgttggacaagctagcattaggtattacgctgatgttaaagaattgagtgttgttgttggctattttaatactcaacctgccactattgttcgcgtcttacaatccattgatttgcgggctgttcttccggaatcggttagaattggtttctctggtgccactggtgataaggttgaaacacatgacattctttcttggtctttcaattcacgcatctag

SEQ ID NO: 1746 - DNA, 1344 bp, Glycine max
  Peptide Sequence Number=SeqID_118524
atggcaaggattcctgacaagattaattctattgatgggtcaaaagaggcgcttaaacttgttgtgagaatcacggatctttggttcgttgggactcccaacaagtctaagcaagcgaaaatggttattgttgattttgagggtgatcaaattcatgttgtttgtaaagcagaccagctaaagtgttggaaagctaatttgaaggaaaattccacttatgttatgcataatttcaaagtggtgaagaatgatggtcaatttagagtgtgtgaacacgagtacaagttagtttttattggagtgactgttgttaaagaagctgatttgcatcagctgccttttaaggaatttagatttgttgaatttggaaatgtcgtgggtggaaattttgtggctggtctgttggttggtgctctttcggcatgtctcatcaaaaaataccagggttgttttaaaatgaaggatttgagtggtgaagttttatcttgcacactttgggaaaattattgtatgcagttcttagcctatttgaatgaatgtgggaatgatgggtcgatcgttattattttgacacatgccaggataaaagatgcgcagggaagttatccagctttagtgagcaattcgttcaagacctcaaaattattaattaatgaacatgtattggaaatccaagaatttagggagaggctattagatttaggtgttgaggtcagcccagttttggcacctggcgatcaaggaagttcacaactttcatgggatgttgtttgtgttatggtgggcactattagcaaaatagtcatggatagtcattcatggtgttatccagcttgcattcaatgtcatagaaagactgacatcgaaacaggaccattcacatgcgaatgtggcaaagataatgatcagcctgttctaaggtatagagttgaagtaatggacggtgatgttgatttgaatgcttctcctcaagcacttgataggctgttgggttatgtctttgcttttaaggttaggattcaatcaaaattcaggaatgttgttgttcttagatactcaaatgaattagatttgatcaatgttgtgctcgacatgctggctgatactgaggcatgttccaaaatagatgcttcaaacgttgattgcaataatgctacacatcctgaatgtcaatctttgtctgtgatagcagatcatgatccaattgcaggattccctttaacgctcaaaaaacggctatcatctgatgaagttgatgatgagctaggaagctcccagatttccccagcccaactatcatttaacaaattaacaagacattttgataagagtgaatttagctga

SEQ ID NO: 1747 - DNA, 588 bp, Glycine max
  Peptide Sequence Number=SeqID_118525
atgtcaacaggagatgttattgtgcaaaatggggcgaccaacatggttggccagtctggggtcgacgaagtaaaagaaaggcttaagaatttgggtgctgatgaagttttcactgagagcgaattggaagtgaagaatgtcaagagtctcctgggtggtacacctgaacctgttttgggatttaactgtgttggtggcaatgctgcttctttggtactcaaattttttagacagggaggaactatggcgacttatggtggaatgtctaaaaaacctgtcactgtgtcaacatcaaccttcatatttaagggcactgcacttgtcagaacttggaagtggttcaatgtaggtggtttcaactttcaagttaagaagttgttgagaatgttttggggtcgggttcagaggccagggatagagcccattatatatcgagaccttttcctgttccgcactttggcttcattcttaaatggcattaacatacagaaattgggatgtaatgctgagctgattgttgatgaatttggtgaaaagcttttggaagagcttgattataccctgcagagtaaaaaacctttaagatga

SEQ ID NO: 1748 - DNA, 846 bp, Glycine max
  Peptide Sequence Number=SeqID_118526
atggctaaaagtaaaacacaaactccattccctactctcttggttttcctctgttatgtgttgctactcaacaatgtgaagaagtccaattcactttcattcaacttttccaatttcgtgtcgggaccaaacttcgacattggtttccttggcgatgcgcgtccattagacggtgcaatacaattgacaagaagagacaataacggaccttatggcactgccaatattcgccagcacagtgttggtcgtgcagtttatattccaccagtgcgcctttgggacaaaaccacaggcaaactcgcagacttcgaaacagacttctccttcgtcgtagattattattccgctggttcgcaaatccacgctgatggcctgtcctttttcatcatacctttcggtgctgaccccagaatccccaagaactcatctgggggataccttggactattcagccccgaaactgctttcaatgcttacaaaaaccaaatcgtggctgttgagtttgacagcttcagaaatgaatgggatcccgagcctgtcccggttgctcctcatatcggaattgacatcaactctcttgaatcggtggaaactacagattggcctatcaattctgtgcctcaaggtgctgttggaaaagctatcattagctatgattctaatgctaaaaaactgtatgtcgccgttggctatgatacccaacctcctactattgttgccctctcacaaaccattgatttgagggttgttctaccggaatgggtaagaattggtttctcgggtgccactggtgatatggttgaaacacatgacattctttcttggtctttcacttcacacatctag

SEQ ID NO: 1749 - DNA, 771 bp, Glycine max
  Peptide Sequence Number=SeqID_118527
atggttctgtccaactcaaagccctttttcttgcttctggttcaattcctaatgctacatcgaaactgggacgacacatctttcaacttccccaacttttcagggccatatccaaacaccgttttaaccttccaaggcgatgcccgtataataaggggtgtaatagatccaacaaatttcgtaaaaaatgctgaaattgtgccaagtgcgggaagagccacctatgctctccccgtgcgtctttgggattcaaaatctggtaaagtcgcaagtttcactactaccttctctttcaaaatatcgaatggtccaaacaccggagacggaatcgctttcttccttgcaccgttcggatccaacatgccccgagattcggctgggggatacctcggactcttcagtcgcgacactgccctaagaaatacgaacaaaaaccatatagttgccgttgaatttgacatgcaccagaatgaatgggacccagctgctactccccacataggaattgatgttaactccatctcttcggtagcaactgtgcgatgggaaattgaagagctcggggttccaacagtatctgccaccgtttcctatgactccaaaacccaaatttttggcatggctttaaatgacggaactgttgttgcctatgaaattgatttgaggaccgttctgccagaatttgtcagcgttggcttctccggtgccacgggagtgctgattgaagatcatgagattctatcttggactttcagttctagcttcgattag

SEQ ID NO: 1750 - DNA, 834 bp, Glycine max
  Peptide Sequence Number=SeqID_118528
atggctaaaacacaaactccatttcctgctctcatgatttgcctattctttgtgttgctactcaacaacgtaaagtcagattcaatttcattcagcttctccaatttcgagccgggacaaaacttcgacatcggtttcctcggcgatgcgcgtccagtagacggcgcaatacaactaacaagaagagacaataatggaccttatggtactcccaacattcgccaacacagcgttggtcgtgcagtatatattccaccagtgcgcctttgggacaaaaccacaggcaaacttgcagacttcgaaacagacttctccttcgtcgtagatttcgctgcttcccaaatccacgctgatggcttgtcctttttcatcatacctttcgatgctgaccccagaatccccaagaattcatctgggggataccttggactattcagccccgaaactgctttcaatgcttacaaaaaccaaatcgtggctgttgagtttgacagcttcggaaatgaatgggatcccaagcctgtccccgttgctcctcatattggaattgacgtcaactctcttgaatcggtggaaactatcgattggcctattaattcacttcctctaggttcggttgggaaagctagcattagctatgattctaatgctaaacaattgagtgtcacggttggctatgatagtaatcacccacctatttttgttgggttgaaacaaatcattgatttgaggggtgttcttccggaatgggttagaattggtttctctggtgccactggtgaaaaggttgaaacgcacgatattctgtcttggtctttcacttcacgcatctag

SEQ ID NO: 1751 - DNA, 420 bp, Glycine max
  Peptide Sequence Number=SeqID_118529
atgaaggaccacacaaatttagatcacaaattcgtcggatcaacagccaagaaggttcaacttataatactttatccaataaactccacaaatcacacaaaacttccaatcgagctcgatggcacgacatcaaagcaagaactttatgggagaggagagcccgcaaaagaagaagtgacaatgacgagtttacaaagaaacaatgaggccttgagggaggaaacaagtgtgttgatcaagattcaaatagaaaaggaagtggtgatagaggtaatggtggttgagctttgtttgaggcagagaagcatcgacctcgaggatgtcgtcctcatccatcaagcgatcttccttgagctcgaacctaaggtttttctattgactgctctacctctacttctcaacacacgacacaaaggttaa

SEQ ID NO: 1752 - DNA, 258 bp, Glycine max
  Peptide Sequence Number=SeqID_118530
atggttgaaccaccgtcaaattcgcagcacaaacgtggtctgttttatttttctgatccatggtggttcatcttcccactccacactcgagcacctcctcgactgccttcacatatcgccaacattcgtcatctgcacgtggttctcttatgggttgtcactgttgggaaacgaagggcgaaaatctttagtgactggaaagatgcgttcatgattacggtgagagagaagattagagtggggtgggaaagcacttga

SEQ ID NO: 1753 - DNA, 795 bp, Glycine max
  Peptide Sequence Number=SeqID_118531
atggccataataaaaaacacaagggctcaatctaaaaccccaatctctattctcatgctcattatttccttccttgggttggtccacaacgttaaatcagtttctttctcattccctagttttggctcctacacaaacgacatcaccctccaaggcgaagcctatgttaattcagaaggtgccataaagctcacacctctttcccccaacaacgttggtagagcctcctacgctgcacccttgcacctttgggacgccaaaaccggcaagctcgcaggcttcaacacaaccttctccttcgtcgttgcgccgagcggacccggactctttggcgatggcatcgccttcttccttgctccgttcacctccaacctccccaacaattcaagtggcggattcctcggactcttcagccctaactctgccctaaacgtgtacaaaaaccaaatagtggccgtcgaattcgactccttcagtgggaacccctgggaccctccctctgcccatgtgggcattgatgttaactccattgcttctgtgacaacgaggaaatgggaaactgggaattcgtttgaagttgcatatgccactgtgaactatgagcctattggcaagagtttaaacgtgcttgtaacataccctggaagcagtttgaacacgactagcctctcgtttgtgattgatttgaggactgttctgcctgaatggattagagttgggttctcgggtgccactggacaattggttgaaacacacaagatttattcttggaccttcgcttctagcttctattag

SEQ ID NO: 1754 - DNA, 153 bp, Glycine max
  Peptide Sequence Number=SeqID_118532
atgcaccactggcaacgatggtgttggaatgataatgacaatgttttgaatcctggaccaacccagctagtcagaccgattcgaccgcgatctagaggtgataatggtattggtggtgggggcggcagtgcggtggtgaggcggcaacgatga

SEQ ID NO: 1755 - DNA, 210 bp, Glycine max
  Peptide Sequence Number=SeqID_118533
atgggtggaaatgaagaagccttggtcggtggcagcggcatagtggataggtggtggcgacaacacggtgcagttgcgtgcggtggagatatggtgcgtttaccccgaataaacgttggtggcaactccacgcattttccttccttggaagatgcacctgtgagcctcgcgtcgccctcccgccaaagggtaggctgcgacagttggtga

SEQ ID NO: 1756 - DNA, 567 bp, Glycine max
  Peptide Sequence Number=SeqID_118534
atggagattattgataacatacttcttctactttttgccgctcatgatacttctagatcagtgttatcattggtcatgaagtatcttggacaattgcctcaagtttttgaacatgtcttgaaagaacaacttgaaattagtcaagggaaagaggcagggcagttgttgcaattggaagatgttcagaaaatgaaatactcttggaatgttgcatctgaagtcatgaggctatccctacctgtgagtggtgcttacagagaagctaaagaggatttcacctatgctgattataacatccctaaagggtggaattgtaagacaagtgcatgtatgctgaaaggagaaaatcttgatgtcgctgcacttaagcttgcaaggagcctcaatgccatcgtgctcacactcggagggaatctcgatgccgctgcactcaagcttgcaaggaacctctccgctgcacccatagggagccttgacatcatcatcacatttgcacttgcaaaaccctcactgtcacaacttctccgcttcctccaggagccaatcacagcacctccatgttgttag

SEQ ID NO: 1757 - DNA, 801 bp, Glycine max
  Peptide Sequence Number=SeqID_118535
atgttgaaatgtgaaaacatcggttttcaccaaaaccgatgttacaacaaatactacacaagatattgctttaaggttgggttggccaactacaccaaaagggttctactttggagcccatgcacattacaactatctgacttcaccactaaattctccttcaccaccaacactctagccaatagtctattcttcgctgacacaataaccttcttccttgctcctattgggtttaaaatctcttcatattcattaagtgttggctttctcggcctattcaacatcacaaccgttgtctcacccaataatgatattgttccagtggggtttgattcaaatgtgaatgctcactgtgaaatagaatctctcaaaacatgggattcaggtggaagcgaaagaaatcaacaatctttagtgaagataatactaactgttgtggggggcattttgattctagaacttgtaatcgccacaactagtgtaatagtatggaggaggtggaacaaaacaataatcaaaccacacttgagatcttataataattctttgattaatgatgtggagattggaaggggagcagcagcaacaccaagaatgttctcttacaaagaacttgttgtggctaccaacaacttctccatggaaaacaagttgggtgacagagggtttggtgctatttacaaaggcctcattgtagactcagatttggaaattcctgtgaaggagatatcaaggagttcaaggcaaggcaagaaagagtatgcaactgagataaacatccttaaccagcatagacattga

SEQ ID NO: 1758 - DNA, 291 bp, Glycine max
  Peptide Sequence Number=SeqID_118536
atgatgtcaacatcagcgataaagatactagtgatgattgcggtaacaatggtgatagagatggtggtgatatcaatagtgatagtaatagtagtaaaggcgattgatgcgatgatgactgtgataggtggtggtgctagcagtggtggcaatgacattgatggtgacaaccaatgttggcgtggtgatggtagtagtagtaatgtcgatgatggtgatggtgatagtgatgttggtgattggaaagacattggtgacggtgatgaatgtagtattgatttatggcgatga

SEQ ID NO: 1759 - DNA, 507 bp, Glycine max
  Peptide Sequence Number=SeqID_118537
atgatcggcgtcggaaagatcaagcagtacagtaacgtcctcgacaagcccctcaccaagggcaagcaagaggttagtttgagtgcattcgcgttcttgttctcggagcttgttcagtacaaccaaacgcaggtcgacaacattggcgagctcgaacgaagactggaggatgctggatatgcggttggggctcgagttcttgagctgctttgccacagagataaggtagctgattcactggagaaaggaactgaacatgaagatgaatacatgatcagtgaaaaggagctcctagtaaacaaattcatttctatcccaaaggacatgggaacgtttaactgtggagcatttgttgctggaatagtacggggcgttttggatggtgccgggtttccagctgttgtaacagctcattttgtccccatggaaggtcaacaacgaccacggacaacaattttgataaaatttgctgaagaggtgttacgaagagaagcaagattaggctga

SEQ ID NO: 1760 - DNA, 297 bp, Glycine max
  Peptide Sequence Number=SeqID_118538
atgtatcctcttgaacacaagaatgatagttccacatatcctcctaaacacgatgatcataatcccacgtatcctcctgaacacgacgatgatagtcctacatatcctctcaaacacgatgatgataatcctgtgtattccccaaacatgaggatgataagttgcaaggctctcacaaaggtctgcatcccttgtttgcatgctatcttctcttcatatgccttcgaggaagttgatgttgatccccaaattgctagctatttcgcctaccctcccgagatttctcctattccatga

SEQ ID NO: 1761 - DNA, 456 bp, Glycine max
  Peptide Sequence Number=SeqID_118539
atgtcgaaaatatctctcccagtctctagcaaaaaagaggtcgaaatgatgagtttaagagtcttgtttttggaggaaagctcaattcttgagaaggacggagaatggctacacgagcttgctttgaataatacagttcttgagactctcaatttttacttgacagacattgctgttgtgaagattgaggaccttgaacttttagctaaaaattgccccaacttagtgtctgtgaaacttactgactgtgaaatactggatcttgtgaacttctttaagcatgcctctgcgctggaagagttttgtggaggcacctacaacgaggaaccagaaagatactctgctatatcattaccagcaaaccgtactaaaaaaattggatctcctctatgcaatgctagacacggaggatcattgtatgttaatccaaaggtgtccaaatctggaagtccttga

SEQ ID NO: 1762 - DNA, 383 bp, Glycine max
  Peptide Sequence Number=SeqID_118540
ggggagattggcattgtggtcactgggcagaatgttgctaaatagcaatgtcatccatatccaagtaagagtggtcaagttggtgtgcatgatccgcactcgtctttttgcagcggcacgggtgaaatcttgcactggtatgcatagtagatgcgtgatagcctccctctctggatgtgctcgcacagttggtcgccctccaatatcagggggtggcccaggaactgataaaaggaaactactggcgaggctcaagggtgcgctttccaaaagaggaaagacgcgcggagtcgccaccaacgaaggtattagcacctctcacgtcgacaagagcggggctcttgctcctacataccctccatcgaagaggaaatcagacctac

SEQ ID NO: 1763 - DNA, 252 bp, Glycine max
  Peptide Sequence Number=SeqID_118541
atggccccaaaccagcactttactaatggttttcaaagcactactacggtatctgatataaccttaattgaacgcaacaaagaagtggccctagaagaaacacatgatgacgagtacttaccaatcgtgtccgaggtagagaatgcgaaatgcgagtgttgtggaatgtgtgaggagtgcacccgcgagtacataaggcgggtgcgtgacatgttctcggggaggttaatatgcgggttgtgtgctgaagct

SEQ ID NO: 1764 - DNA, 189 bp, Glycine max
  Peptide Sequence Number=SeqID_118542
atgggcctcggcgctggcctcgccgttggcgctgttgctggggctctcggcgggcttgctctcgaagaggggcttaattacgaagaggacaaaatcgcggagagggttgagaacgacgtcactgctgctaatgttgctgctgcgcgcgacaattacagcgattaccgattcgacttggtgttggattga

SEQ ID NO: 1765 - DNA, 516 bp, Glycine max
  Peptide Sequence Number=SeqID_118543
atgccaattctcttatatatgctatttgtgtacctaagtatcattggtattgtttgtaacttgcccggtagaaatcacttgtccaagaaaatttgctcatctgccagacctcaacaacagcaaatctcagtctcaagcaatgctgatcaagaacttaaaatgaaatattaccggcaggttctggtcgttaggcaagacctaaagatgaaatctggaaagattgcatcccaatgtgctcatgctgccactggcatgtacgctgaattaatgcaaagtgatcggtatcttttgagaagatgggaacagtgtggccagcccaaaattgttgtgacttgcaggaatcaacaagaaatgaataaactagcggaagcagccgagagtattggccttcctacttttgttgttgctgatgctggacgaacacaggtttcggcaggatcaaagaccgttcttgctgttggacctggaccaaaatcttctgtggattcagtgacagggagattgcccctgctttga

SEQ ID NO: 1766 - DNA, 294 bp, Glycine max
  Peptide Sequence Number=SeqID_118544
atggcttctcgttatagatctgtttcgcaaccagcattctccctaatcaaatccaccatcaccaaaccggcctcgaagcccgtcccctcatcttttcttctcaaaactcgttcacccgttacggccaggcaagtccgtttcgggggtgggtgggtggtgagctcggttgcctgcagtctctgcttccccttcactcggcggtgtcatcagcgcgcctcacatcttgtctgggcattgattccagtaggtcgaggtcgctgtctcaggtatagtccaaatatgttgaagcactaa

SEQ ID NO: 1767 - DNA, 231 bp, Glycine max
  Peptide Sequence Number=SeqID_118545
atgagtaatggagtcatggtgagtcttcacggtgtcccatttagaatcgacaaaaatggacgggtcgggttgacgcgatctaaattgattcatcgggtcaaaaatatatttgtcaccatagtttatcgtgttattcttggcaaaggcgtttgtttggtggtagccactgatctgattgacagaaagtgcagttggcgatacgatttgtctcctggttgcgcatctctttaa

SEQ ID NO: 1768 - DNA, 183 bp, Glycine max
  Peptide Sequence Number=SeqID_118546
atgaacagcagaaaccaatcaaggtacttaggaatggatgcaagtggggatggggtcacaaccgaccgatcattgccccttctctgcgctaaacaagcagagaacgccgcgcaaggcatcccagtatcctttggattcacagtattttactaccattgtttgtttttagtaattaacgcctaa

SEQ ID NO: 1769 - DNA, 441 bp, Glycine max
  Peptide Sequence Number=SeqID_118547
atggttggtatccgagattacaatttatcatcaaagggcatttcagacaaaccatcacaaagttcatacgacaatatgatagacgtgccttgcctcttcacaggaggaagcctatcaggttggccatgtcctcatcctcttaggcttcgtcctcacctccggaggggctgggatcctggccctactggcgtagagtgtactgatagaaactctcatttagccacacctgacccctatggttggtggtcgcagccggcaagtgcaccagatcacacaagtagtataaaacgaaagaaaatcacgcagatccctggtgaaaatcacgactgtggttatggacaggttcctggtgctaaaaaggatgttctctatttaacaatgctcatgcgttcctatgttgtctcctggactgctagaccccgattcctcatgatagcctag

SEQ ID NO: 1770 - DNA, 624 bp, Glycine max
  Peptide Sequence Number=SeqID_118548
atggccccaaaaaagtttcccactaagaggtctaggaaggacaccaccggagaaggctccagcgctgccccacaagctgacacgaacttcgacaggcatcgatttcagagtgcagagcatcaacatcattttgagaccatcaagggatggtcattcctcaaagaaagacaggagatagcccgcaagcactgggcaccacttgtgacacccatggctaaattcgatccggatatagtcatggagttctacgctaatgcctggcctaccaaggaggggagggccagcagtgtgagtatagccagaggaggagacaggtctctggctttgatgaggaggctattgcccaactattatgcatactgggcaagattttgcccagactgccgcagggagacgggtgcggatcatgcgcaccagcatgaccatccttacacaaatatggatgacgtgagtgttgcacccacgagataccctattgaccaagagaagtccaacagggccctggggtttcccactctgatcacgggcctctgccagttctacggagtgcccatcacccccaacaaggtcatccagccacctattaccagagccttcatcgagaagtactgcacccttaagtag

SEQ ID NO: 1771 - DNA, 438 bp, Glycine max
  Peptide Sequence Number=SeqID_118549
atggagacaagaagaataatgtgctacaactttctagtggcttcaattttgctactctcttgtttggtttgcgtgaaaagcaggcctttgtttctgtttgatgcttcaactcaacaagcattcttcaaacagtcttccacattagatgatgatcaaacaaccagaattcaagatgtctcaaaacatgtttttgacactacacaggggaatgaaggaaaaagaatattaaaagcaaaggccaatgagtataaagaagcattgaggggactgagcaggctaggatcaacaccgccaaggtgtgagcacaaatgtggaggctgcattccctgcaatcccattcaaattcctaccaacaatgatcttctgggtgctcagtacgcaaattacgagcctgaaggatggaaatgcaaatgtggcaattcttactacaacccttaa

SEQ ID NO: 1772 - DNA, 303 bp, Glycine max
  Peptide Sequence Number=SeqID_118550
atgagggggactgggtttggctccatcttaagaaggataaattccctactaagaggaaatccaagcttagtcccaaatgggatggacctttttagctcttggagaggatcaataacaatgcctataggttggacctcccagaaaaatggagctaatattaaggaggaggaaccaaaatatttgaggtcaaatcctcttcaagggggaaaggatgatacaatcctccctaggaagggaccagtcaccagagccatgagcaagaggctccaagaggattggctagagctgctgaagaagccctag

SEQ ID NO: 1773 - DNA, 498 bp, Glycine max
  Peptide Sequence Number=SeqID_118551
atgtttggtggtgtttcaatgatgagcaatggtggagattgtttagatcaacaagtgcaaacactagttggatttgtagcggagtctcaagtcccttcgttttgctcccaagttaacttgcaaaatgttccaatcaatgaagatataagcttgagtggttgtgtagattctaaacaaaggtttagcatggatgaagataaactacttatgaatgcatggttgaatgtttcaaaggacccaattgttggggttgatcaaaagggatggcttttgaaaagtgagagctctgaggatgatgtcatcaatgatgccttagccatttttattcgagatcaaggagaagcattcaaatatgagtatgcatgtcgtgaagcgaggaaccaagctaaatggcttgcagtgtacggtgaaggttcttcaaaaagaacaaagaaatcggctttaagggcatacacgtcatcatctcaatcagacataacaacaaattcagaaatttga

SEQ ID NO: 1774 - DNA, 1497 bp, Glycine max
  Peptide Sequence Number=SeqID_118552
atgaaggcaaaaataccaaatgggattccttttacaaattatttacctaaatggcaaattgaacatgtcatcaaatcccacaagcttcaacgatttgtcgttaatccttcaattcgtcagcgttatctcactgatgaagatcgtgttgcgaacaaagtgaatctcgcatatgaggcttgggaagtccaagaccaaacgctcctcacatggcttcaatcaacattgtcgaagtccgttctctctcgagtcattggctcgcttcactcgtatcaagtctgggataaaattcatgagtactttcatatgcagacgaaggcacgtgcccatcaacttcacactgaccttcgctccaccacccttgacggcaagacaatgcgtgagttcttatcccaaatcaaaaatattgttcatgaacttgcaagtgtcggcaatccggtacctcatgacgaacacgtcgatgccattcttgaaggcctaccacaggattatgccccagtgatctctgttattgaaagcaagtttgagactcctccggtctctgaagttgaggctctcctttttgcacatgaactcgagccaactgatttcgtaaacactcatttgccccctctgtcaattactctcaagggccgtggcaacaacagtggtcgtcgtggcggcggtcatggaaggggccgtggaggatgctttgcgaacttccaatgccaaatttgcttgaaatatggtcacactgctaacatttgtttttacagggctgattcaaattatcaccctcatgagtcgcttgtgctctatgatccccatactctacaatctgtgcaaattaatccttcgcaacccaccaacagaacttccaacacttgggtgaatcccaatttgccaaactcccgacaggatatcaatgtcacttcagctactcccagtgccatgcttgcaaatgtctcttctacaggtgctgcccattttgcatggatccctgactcaggtgcatcacttcacgtcaccggtgagccacagaacatccatcagctaggtcactttgagggtccagaccaaattttcattggaaacagtcaaggtttgcatattaatggttctggttcttcttcctttttgtctcccattaactcacatgtttgttttaggctaaatgacttacttcatgttccatctattacaaaaaatttgttaagtgagagtaaatttgctaaggacaattctattttctttgagtttcacccacatcattgtcttgtcaaatctcaggagactcatgaaactttgcttcaaggtgttgttggtgttgatggtctatattcctttcccaacctaaagcttcaagagtcatctatgttgctgtcctctgcagccacaccatcttcaaattctgtagctttgtcgtctagctctagggttgtttttaattctggtgatgaaagtcacaccaactcccttcatctagttctcaaactatatactctactccattggaattaa

SEQ ID NO: 1775 - DNA, 289 bp, Glycine max
  Peptide Sequence Number=SeqID_118553
gcattgcttccacagaaaccacttcagtttcaggctaaaagaagagaaggttcaagaagctgatgtcttgctaagcgaggtatatgcgcttagcgagtggcatccgctaagcgaggcatgcagctcacttagcgtgttgggaaatcttagaagaagattagtcagagatgtgctcgcccagtacgccgcaagctcgcccagcgagtcgtttatctcttctcgccctcaacgtgtccagctcgctaaggcaaaattcacttactctcgcttagcgagccaatcttgctaa

SEQ ID NO: 1776 - DNA, 870 bp, Glycine max
  Peptide Sequence Number=SeqID_118554
atgagagcactgcttctgcttcagcttcaggctttgacaagtcgggtttcactttcctcctccacctttgttcgcggcaaaagcttgtggttcgatgcaaatagagataattcccaagtgagaaggatatggtcttccacccctgtttgtatgggccgccgttccagcaagattgctgggagaaagggtgcccaagatgcaaagaaagcaaaactatactcaaggataggaaaggaagtcgtgtctgctgtaaagcgaggtggtccaaatgtaacatccaactcagttttggctgctgtacttgagaaagccaaggagcttgatgtgcctaaagatattgttgagcgcaatatgaagagagcttctgagaaaggacaagaggcttatatcgagaaagtctatgaggtttatggttatggaggagttagtatggtagttgaggtatcaactgacaagatacatcgttctgtggcaaagattagagaagtgataaaggactatggaggaaagatggcagattctggatctgtgacatttaagtttaaacgtgttcgggtagtaaatattaaagccactaatgctgacaaagatcagctgcttgccattgctttagatgctggagctgaggatgtaattgatcctccaacttatgaagatgacactgaagaggataggtcagacaagaactattcatctatactatctaagctgcgagaggagggcatagattttgagcctgataatggttccgagcttctcccaaataccccggttgaggtagatgatgaggctatggacttgaacaaggaacttatgagcaaattacttgagcttgatgatgttgatgctgtttatacagatcagaagtaa

SEQ ID NO: 1777 - DNA, 1425 bp, Glycine max
  Peptide Sequence Number=SeqID_118555
atggctcatctcttcagagacctctcattgggccactccaagagagactccacgccgccgccgccgataatgcctcccaagccctccgccgtcatcgccgccgacgacctcccctctccgctcggccagctcgccgcctccctctccgattccgacctcgcattaaccgcctacgagatcttcgtcgccgcgtgccgcacctcctccggcaagcctctcagttccgctgccaaccactcctccaccaattcgcccagtcagaactcgcctaactcgcccgcgctccagcgatccatcacctccaccgccgccagcaaggtcaagaaggccttcggcctgaaatccccaggttctgcctccagaaagagccctggctccggttcgggccagggaaagccgaaacgccctctcaccgtcggcgaactcatgcgcaaccagatgagggtttccgaagccatggattcccgcgtccgacgcgcgctgctcaggatttccgctggccaggttggaagaaggattgagtctgtggtagttccgcttgagttgttgcagcagctcaaggcttcggattttactgatcatcaagagtatgatgactggcagaagaggaccttgaaggttcttgaagctggtttgattttgcatcctcatatgccgttggataagtcaaattctgcggcgcagcgactgcggcagattgttcatgctgcattggataagcctatagaaaccgggaagaataccgagtctatgcaggttcttcgtagtgctgttatgtctcttgcaaataggtcgtacgaagggtcttatgctgattcatgccactgggcggatgggattccactgaatcttcggctttatgaaatgcttctgcaatcctgctttgatgctaatgatgagtcgtcaattattgaggaatttgatgagctaatggaacaaatcaagaagacctgggcaatccttgggttgaatcaaacactgcataatctctgtttcacttgggtcttgtttcaccggtttgttgtgactggccagctggacttggacctgctgtctgctgctgatggccagctgacggaagttgcaaaagatgcaaagacgacaaaagatgcagaatattctaaagttttgagttctacattgacttcaatattggggtgggctgagaaaaggctccttgcttatcatgaaacttttgaccggggaaatgttgaaaccatgcagggcattgtctctttaggggtagcagcagctaagattttggttgaggatatctccaatgagtatcgccggaggagaagaaatgaagtcaatgtggcacgtgagagaattgaaacttacatcaggtcgtcactacgtactgcttttgcccaggcaagttctttctgtctgccattggcttttccatttagtaaaaggtgttag

SEQ ID NO: 1778 - DNA, 1722 bp, Glycine max
  Peptide Sequence Number=SeqID_118556
atggctttcaccttctcgccttcaatcagaaactccatttcatggccaactatgcttgttcctgacatgcctgatatcaatatctcacttcgaaataaaggcatctacaaagggaaacgcaatattaatctgcgagacttgaccaaggcaaatgttgcaagtccatcattacctttgattgccccaccaacacccgaggaacgcccaggaatcacccatgactgccaccaccaccaccatgttgcatggactagtatcccgcaagagagatgggaaggagagttacaagttcaagggcaaataccattatggctggaaggaacgtacctaaggaatggtccgggcatgtggcacataggggactacaacttccggcacctcttcgacggttacgccaccctggtgaggctcggtttccggaacggccggctagtcgcggggcaccggcaaatcgagtcggaggcgtaccgggcggcgaagaagaacaagaagatatgttacagggagttctccgaggtgcctaaggctgcgaatttcctggcctacgtgggggagctggcgagcctgttctctggcgcttccctgaccgacaacgcgaacaccggcgtggtgaaactcggcgacggcagggtggtgtgccttacggagactcagaaagggtccatagtgatagaccctgagacgttggagacagtggggaagtttgagtacagtgactcgttggggggtcttattcactccgcacatcccattgtgacggatgaagagtttttgacgttgttgcctgatttggtgagagcagggtaccttgttgttaggatggagcctggtaccaatgagaggagggtcattggaagggtcaattgtaggggtgggcctgcacctggttgggttcattcttttcctgttactcaacattatgttgttgtgcctgaaatgccgttgaggtactgtgctcagaatttgctcaaagctgaacctactcctttgtacaagtttgagtggcaccctgaatccagagcttttatgcatgtaatgtgcaagactagtgggaaaattgtggcaagtgtggaagtgcctctgtttgttactttccatttcataaatgcgtacgaggagcaagatgaagatgggagggtgacggccattattgctgactgttgtgagcacaattcagatactaccattcttgataggcttaggttgcagaaccttcgttcgtttaatggtgaagatgttctacctgatgctagggttgggcggtttagaataccactggatggaagtccatatggaacattagatgcagcattggagccgaatgaacatgggagaggcatggacatgtgcagcataaaccctaattatttagggaagaaatacagatatgcatatgcttgcggagcacaaagaccttgtaactttcccaacaccctcaccaagcttgattttgaattaaagaaggctaagaactggcatgaagaaggtgcagtgccctcagaacccttctttgtggcacgaccaggagcaacagaggaagatgatgcttatagcctatttttccctcgtatggcaggcgtagtcatctccattgtcagtgagaaaaatggagaaggatttgcgttggtgttagatggttccacttttgaagagattgctagggccaaattcccctatggacttccatatgggttgcatggatgctgggttccaaaagagtaa

SEQ ID NO: 1779 - DNA, 792 bp, Glycine max
  Peptide Sequence Number=SeqID_118557
atggcaaagaaagttccaggtacctcgaaacaccccacccaggtggctcaaagtgacccgaaacatgcatgtgggcaagaacccgcagggaggaaaatcgggagaagaacgcctggtgctcctgcgaagaataaaaaagataaaggttcatatgatgagagtttacacttggtgaaatttcatgctactagtagtaactcaaatgacccatttcattcaggagggggtgtggccaatccggagggatttggtgtttatggaattcagtggaaagtagatattcttcaaaatgaccatcaatgcgtgcatatgaaagtgggatggaaaaatcaacctgcttggttcctttcggcagaccttggccagtcattggagatttcaatactattctccaataccatgatcaaagtggtggttccagcaatccctcttggaggggtgctcaagactagctttcaggagatgatctcagaaacggagcttattgatgcggggtttcaaggtccaacttacacatggaagagagggaattcactaaaacgtcttgatcgtgttctaataaatttagcttggaggatccgggcaaaatggttatcctttggtgaccataatacgcgttactttgatggagaaactgctgtgagaaggaaaagcacctatgaggctatgcaagatctcaatggcaattggataactgatggtgaagctttagagaggagtaaggacttacttagtacactccaaccccaacttccagatgttgatgctcctattgacgcaaatgctttctag

SEQ ID NO: 1780 - DNA, 312 bp, Glycine max
  Peptide Sequence Number=SeqID_118558
atggagaatggttctgaccccaattataaggaccacaatgtcgccgccgctatagtggtgctgcagacatggtgcgatggttcaaggagcgacatcgaccttatgaaggaggtagtgtacacatggtggaaggggaaaatagaaagacagaagaggaagttaaacaaaaagcgccgttgccggaaatcactttcgttggcggccaacgacgacacttatgttgctttgaataacagccatgtcgaagcagcattgggcaagagcatggcagttcccagtggctcgaatcggttaagggacttatgggattaa

SEQ ID NO: 1781 - DNA, 409 bp, Glycine max
  Peptide Sequence Number=SeqID_118559
atggcttccactccttcgaacctcgtttctcagtcgttcccaaactccattgccgaaaaacttgatgactcaaactatcttcactggcgtcaacatgtagaactagttatcaaatctcacaagttgcagtgtttcgttgtcaatcccgccactccacctcgctatctcacagaggatgatcgaattgctgatcgcgtgaaccttgattatgaagcttgggaggttcaagatcaagcgctccttgtttggtttcaatctacacttcatgagtactttagcctccatacgaagtctcgatatgttgataaacatgctggcgttggagttcctgttcgtcacaaggagtatgttgatgcgcttctcgaaggactactgtcagattacgtgccagtaatctctgtaatcgaga

SEQ ID NO: 1782 - DNA, 4200 bp, Glycine max
  Peptide Sequence Number=SeqID_118560
atggcgtctccgtttcgcaacgacggcgcgtttccttcttctcatgtcaaactctcacatcttatctccatcaagcttgatgataaaaatttcaagcagtggaaacaaaaaattgacggtgttgttcgtggccacaagcttcaacgcttcgtcacggttccggtgattcctcatcgttccccttctacttccgatcctaatctcagtgaggtgaacgatgcatatctggattgggaacaacaagatgctctcatctgtacgtggcttctctccacgatctctgattcgctgctcccgaagcttgttgactgcacgcacgcgtggcaggtttggactgaagtgcatcgttacttcgccacgctcctcacgacgaaagcacgtcagcttcgctcagaattgcgtcgtctctccaaaggtactctcacgattgagtcgttcatggagcgtgttcgcgaaatcaatgaatccttgatctcaattggagatcccgttcctcttcgtaacctaattgagatcgtccttgatgcacttcccgagaaatatgatcctatcgttgctgctgtcaatagtaaggaagatcttagctctttggatgaacttgaatcctgtctccttgcacacgaatcgagattggagaagcatcggaaagcaattctcacagaaccagtgtcagtcaatttaacgcaggctcagccgtctgattcgtcttctccgatggaactgtcgtctcctgctacagagttgtttcccactggcactagtcatgttactgctcatgctgaaaacaataattataacttcagaggcggtcgttctggccgtggaggtggccgttttggccgtggaggtggccgttttgctgcacccagaccttctccaccacaagcgtttatgggcagttctgatccaaccttcagcaaccaatggtggtatccagattcaggtgcatcgcatcatgttacacctgattcttctaatgtgtctgatgctcactctgtgactggttctgagcaagtgttcatggggaatggccaaggtttgtctatcaactctataggttccatgaattttacttcccctaactttcctcacaaaccactcactctacacagtttactccttgtacctcacatcaccaagaacctcattagtgattcttctgaggtgcttcttcgtggagttgtagaagctgatggtctttacaagtttcagagtccctcgtctcaagtgtccaagttcaagtctctctctagcctcaattctagtgtagccttaggttcaaacaattgtaatcctagtacatcatgtaatactttacttcattctaatgctcaaagtgattgtattactgattgtactccttctgtttcaatgaatacaagcaatgtttcctgtgttaattcacctcttgttcatgctactacatttaataattctcaatctccacaacattctattgttcctaatattatacctaccagcaaatatgctttgtggcatacaaggttaggccatcctcattaccaagctcttgcagaagtgctaaaaacttgcaatattcctataccccccaagtctctagctgaattttgtactgcctgctgtttaggcaaatctcacagactgcctacctctttatccactattgtgtatgctcaaccttttgagttagtagtttgtgacttatggggaccagctcctatccaatctttaggaggttatacctacttcttgacttgtatagatgcctgttccagatttgtttgggtcttccctttgagacttaaatctgacacacttactcaatttgtccaattcaaaacaatggttgaacttcaattcaactgtaaaattaaagttgttcaaagtgatggaggaggtgaatttaggcctttcaccaggtatctcaataaccttggcattactcataggtttacatgtccccacacccaccaccaaaatggcatagttgaacgaaagcatcgtcatattgttgaaacaggcctagctttattagctcactctaacttacctctcaaaatgtgggatcatgcttttgtcacagctgcttacctaattaataggatgcctagtatgtctcttgccaaccagtccccttatttcaagctacttcacaaaatacctgactattctcatcttagagtccttggttgtgcttgttttcccttccttcgtccctataatgctcataaattggactatagatcccaagagtgcatattccttggttattctaccattcataaggtcagttctgttcctgctacacccattacctctgtttctcttagcagccctatgtctgctcctattaacactgccaattctcctattataacaccttccaatgatgcttcccctgcttctgaaaattcttctttacactctcccatcactccctcttctctcacccctatcacatctgatattgcagaggccagcaccatttctccatcctctattccagccaccagttctcctctcagccctgtaccaaccccccaacaaccctctatccatcctcataacactcatcccatgcaaactcgagccaagagtggcattaccaagcctaaaattcatcccactcttttactcactcatatggaacctacttcagttggtcaggccttgtcttctccccattggtttcaggccatgaaagatgagtatcatgcattgttaaagaatcagacttggaccttggtgtcgccatttgtttctaggaagccaattggctgcaagtgggtttttagggtgaaggagaaccccaatggctccattaacaaatataaggccaggctggtagctaaaggcttccatcagcaagctggcactgattttacagagacattttctcctgtggtgaagcctgttactgtcagaactgtccttactcttgctgttactcacaagtggcctatacagcagattgatgtgaacaatgccttcttaaatggcacccttgaggaggaagtttttatgctgcagcctcctgggtttgaagctgctgacaagacacttgtatgtaagttgaacaaagcaatttatggactaaagcaggcccctagagcctggtttgataaacttaaaggatcccttctgcatcatggttttcttgctagcaaatgtgaccctagtctatttctccttcacactgcaagcttaactataatggtgctcgtatatgttgatgatatcatcataactggcaattctgcatcctttattactgctttaatcaagaatccgaatactgatttttccctcaaacagttgggtaagttggattattttcttggcatagaggtaacacacttgcctaatggctccctccttctctctcaagccaaatatctgacagatttacttgctaaaattaacatgctcaatgctaatggcatgcctactcctatggtgtccacaagcaaattgtctaaaattggttcgccggctgtttcagatcccactcagttcagatctgttgtgggggctcttcaatatgccactctcaccagacctgaaatctcattttctgtcaataaggtttgccaatttttatctaatcccttggaagagcattggaaggcagttaaaaggatattgaggtaccttagtggcactctgcatcatggcttgctaattcagcctgcctcacctcaccagcctttgtctttgcttgggttctgtgatgctgactgggcatcagaccctgatgacaaaaggtccacctcaggagcatgtgtgtttcttggtccaaacttgatatcttggtggtctaagaaacaacggttggttgccaggtcaagtgctgaggctgagtacagaagtatggctcaacttgctgcagaaattctatgggtgcagtctctccttcaagaacttaaatgcagacttctcactcccacaattctctgtgacaacctcagtaccgttacccttgctcataaccctgtgctgcataataggaccaagcacatggaattggatatattctttgtgagggaaaaagtgctctccaagaatctcattgtgaagcatgttccagcccaagatcaatgggcagacttactaactaagcctctctcagcagtgaaatttctccctctgcatgacaaactgcgtgtgatcaacaaactcaatctgcttgatgcaccctcagtttctaagggggaataa

SEQ ID NO: 1783 - DNA, 219 bp, Glycine max
  Peptide Sequence Number=SeqID_118561
atgccgattaacaatcctccgtatgaaccatacggtttgatgatccgaagaagaagaatagtggcacgagaagtggaggaagaaggaaagaagaaaactacaaatgcatgggaagtggaggaagaagaagaaccacaaccacgaagaagaagaagaatggtgataggaacaccggaagaggaacaagcgaatcagaggaagatgaagaagtggccgtag

SEQ ID NO: 1784 - DNA, 213 bp, Glycine max
  Peptide Sequence Number=SeqID_118562
atggcaggaattgcacccgagggatcacagtttgatgctcgtcaatatgataccaagatgaatgagctgcttacgtccgatggtcaggatttcttcacatcctacgatgaggtttatgacagttttgatgctatgggcttgcaagagaatctcctgagaggcatttatgcatatggtagatttaactttctttatgtcctcttacttttttaa

SEQ ID NO: 1785 - DNA, 441 bp, Glycine max
  Peptide Sequence Number=SeqID_118563
atgtcactcagggaatggctcagttccataaccaaaggcaactcctctgtctcaacttatttacactcaatccgcaatattgttgatgaattggctctcattggtcatcctattgataaccttgaaatggttattcgtgccttgaatgatcttggaccaaccttcgaagaatttactgcttccattcgcactcgtgattcaccaattgctttcaacgaactctatgacaagctggtggattttgagatgtttctacaatgtgaagaacacatctcaacaccggttcctattactgcataccttactcagtgccattataatcataatgctcgaggacactatcaaactagctgcaacaataattaccatggttatgctcctactctctccaacaccaacaaagccaccaatcaacaatcctaccatttttcgatactgtga

SEQ ID NO: 1786 - DNA, 441 bp, Glycine max
  Peptide Sequence Number=SeqID_118564
atggaacagaatcagcaaaagcttagaaatgctgtctcggacgtgtcgaaggaaattggaagatactataatgagttggagttggagaagaaacttggtgctattgaagaggtggaacaagctgaatgccaatgttgtgggatgaaggaggattgcaccacagtttatatcacagaggttcaagaatgttattgtgggaagtgggtttgtgggctttgttctgaagttgttaaggaaagagtagggcgaagtccgaaggtagccatgcaagatgctttgaactctcacagggatttctgccaggaatataacgccaccaccaggcttaacccacaactctcgttaactctttctatgagggaaatagccaaaagaagtttggagaataggaaatctgtgttaagcataacaaagcttagtcgggccattagttacccctga

SEQ ID NO: 1787 - DNA, 507 bp, Glycine max
  Peptide Sequence Number=SeqID_118565
atgtcagcttctcctctggattcaactgcacagaccggacagtcaagtgggggtgattggcaagaacaagtgtatcaacatattaaatctatgaaagaaagttacttgccagagttgaatgaaatgtaccaaaagattgctacccaacttcaacagcacaattcccttccaacacaaccaaagttagatcaacttgaaaagatgaatgtatttaaaatgctggaacgtattatagcattccttcaggtttctaagagcaacatctcacccaatttcaaggagaaactaggttcatatgagaaccatattataaacttcataaatagaaaaagacataagaaagctatgcctccaatgcagtcaaggcaacttcccctacctcatattgattggcaagaagaagtgtatcaaaagattaagtccatgaaagaaaattacttgccagagttgaatgaaatgtaccaaaaatctgctagtaaacttcagcgggtatgcttagtcagataa

SEQ ID NO: 1788 - DNA, 378 bp, Glycine max
  Peptide Sequence Number=SeqID_118566
atggaccacctcactagagaagacgatgcttttaatgcctcccttgtggaagagaattgctacgagatggagaaaatgatcgtggagttgaatgttgagctggtggagacatctggaggcactgtctctgattgcattaatgaatcccctcagacatcaactctccaaaccacttcttctccaccaaatctctcggatgcaaaatcagaactgaaaagtgaagcacattgcgatctaacacgtggaccagaatgtctcaaaagcagcttctatacacaattgcaattacttcaatgccagcaagatcgtgcgttccgatgttgccaattgacgaacaaaacggataatgacgcaattggcttcaaggattggaactag

SEQ ID NO: 1789 - DNA, 99 bp, Glycine max
  Peptide Sequence Number=SeqID_118567
aagccacatttcccagtccccggaggctccgcaattgatggtggaggacgcatgaacagcgctaggcaatcaatttatgagtctccggacaagatttga

SEQ ID NO: 1790 - DNA, 749 bp, Glycine max
  Peptide Sequence Number=SeqID_118568
atggcacgcagagacaaattatggtcattctgcacccttttgtcatccagaggcggcgggcccgatgacatgcggagacaaaatttggtcattccacacccctttgccattcagacacagtcgtgtccgatggcacgcagagacaaattatggtcattctgcacccttttgtcatccagaggcggcgggcccgatgacatgcggagacaaaatttggtcattccgcacccctttgccattcagacacagtcgtgtttgatggcacgcagagacaaattatggttattctgcacccttttgtcatccagaggcggcgggcccgatgacatgcggagacaaaatttggtcattccgcacccctttgccattcagacacagtcgtgtccgatggcacgcagagacaaattatggccattctgcacccttttgtcatccagaggcggcgggcccgatgacatgcggagacaaaatttggtcattccgcacccctttgttattcagacacagtcgtgtccgatagcacgcagagacaaattatggtcattctgcacccttttgtcatccagaggtggcgggcccgatgacatgcggagacaaaatttggtcattccgcacccctttgccattcagacacagtcgtgtccgatggcacgcagagacaaattatggtcattttgcacccttttgtcatccagaggcggcgggcccgatgacacgcggagatttacatcatcttccgtacttacaag

SEQ ID NO: 1791 - DNA, 576 bp, Glycine max
  Peptide Sequence Number=SeqID_118569
atgaataggtcctctaatgcaaatttttggcttgtgaatttcttcattttgagtgtgggagtaaggtcccaactgaccccggatttttacaaaacaacatgccctgatctttatagaatagttaggagagaggttcaaaaagctctaaaatatgagatgcgaatgggtgcttccttgcttcggcttcacttccatgattgctttgtaaatggttgtgatggttcaattctgctggatggagaccaagatagtgagaaatttgctactcctaacttgaattctgctagagggtttgaagttattgatacaatcaaaagttcagtggagagggcatgcagtggagctgtgtcctgtgctgatatattagccatagcggccagagattctgttctccttagtgggggtcccttttggtatgttcagctaggacggagagatggattaatctcaaacgggacactggcaaatcttgcaattccttctccatttgacacactagataccatcatttcaaagttcaatgacgttggcctcgatctcaaagacgttgttactttatcaggtacaatgaaatag

SEQ ID NO: 1792 - DNA, 582 bp, Glycine max
  Peptide Sequence Number=SeqID_118570
atgactgatgccaagccaataggcactccaatgtctaccacttgctcacttggcactaatgatgatatacctagctgtgactcctctttcttttgcagtctcattagatccttgcactacttatccatcaccagatcggatgtggcttttgctgtcaataagttatcacaatacatgcaagcacccttatccattcacatgcaagctctcaagcgcattctacgttatctcaagcacatcattttccatggtatccaccttgttgctacaagaaatcttgatctcattgcattttgcaatgcggattggggtggtgacaatgttgattggaagtctactagtgcctacattgtttatcttggccctaatgcctttcatggtcatgcaaaaaacagtccacaattgcgagatcttccactaaggccgaatatcgcacaatcggaaccaccacgtctgaactcttatggattcaacaacttctcatggagcttgggatccaaatacctaaacagacaaacatcttctcaaataacattggtgctacgtatctctgtgcaaacccagtgttccattcacaaatga

SEQ ID NO: 1793 - DNA, 624 bp, Glycine max
  Peptide Sequence Number=SeqID_118571
atgaagatgtttgttgacccgaagaatgcaaacacagctacattggctaaagttgcagagacattacagtatatggtgtcaccacaagggaggaacacatggacaattgatgattttgtgccttatggggcaaaaataatgattttatccgaagagcaagagagaatcactgagcctgtgtcacatggtccagcatcagagcgtcaatttccagcacaagagtttcacattcttcagtcaagtgttgaaactcaaggcataggcagacgaagggaggttgttgaagcggaagaatatttccaacaaatggtggccatggaatgtattacacgccaccaacattttctcagtatccttcacagatgtatcagtatcccttcgaagcaacacgatgccccaattgtaacacctaatgccccattaggtctacaatggaatgtacccggagcaatacctgatatgggtgacttattaggtgttgatttgcgtcaccaattttttgttgaggctgaccaagtagaagcggggagacatcggggcagaagaaatcctaatcgtcaagcgcaaagatgggatcgactatgtggcgcatcctcccgtcatcacagacatcataatgaatga

SEQ ID NO: 1794 - DNA, 108 bp, Glycine max
  Peptide Sequence Number=SeqID_118572
atgaaatgtagggagtggtgtatatataggcgagaggagcagtcaatggacttggagttttctcacaagggtggcgagaatattccaaatccgctattattcggataa

SEQ ID NO: 1795 - DNA, 210 bp, Glycine max
  Peptide Sequence Number=SeqID_118573
atgcaaaccgccagcctcattggcacgtttgctgtggctatgacacatggtgaagacgccactgccactggtgggttccttggtgtcgctagccccattggcgatttcaccatgcaggggggagtagccagtcaatctagcaagttacaggctagggtgcaggcttgtcagccttttcaggcttttcagttggcaggggctggggtatag

SEQ ID NO: 1796 - DNA, 396 bp, Glycine max
  Peptide Sequence Number=SeqID_118574
atggaggaagatgcgggagaaagaagtagcaacaccagcagctcgcgggagaaggaagaagacgcgaatgaaggtggaagaagaagaagaaaagcctcgcgggagagaagaaaagaagcgctaggtgagctcagctcacccaggctagctggttacttcacccctaagctatttggtagcccaggcgacctagaggctagcctgggcgagctagggtccagaaaaccccctgaaatgacccttttgcccctcccttttgaacatgcacaagggatgcctgaatatgcacgagctctagctattaagctagcagatcaggctgtgatagtcccttcgaacctgatcaaggtgatgcctgcgcagagagcctgcattttccatgcttctataggatga

SEQ ID NO: 1797 - DNA, 344 bp, Glycine max
  Peptide Sequence Number=SeqID_118575
tccatggtcatcgagtgttgcttggtgatgatggttgtgacctaattggcaaagtatgcaacgaaatcccaaagttagttctggagttggccacgcacaaggcaatagaagggcagaacttaattaagggattggtgaagacaaaatatgttccagccattgcggaatgtgctgataactataaaagtgttgctgacgcgtataggagagatttgagtttgttgaaacacgatcaacgattggctaactataatgttgctactgctagtgatggatctaattcatgtgagaaagtcttggctgctggtgttgcccttgctcctacgtatcctcaggtgagatga

SEQ ID NO: 1798 - DNA, 474 bp, Glycine max
  Peptide Sequence Number=SeqID_118576
atggtgttaggaaggaaaaaatcagaaattttaagggggcaaaaaggaagcttgatggcctcaagaaaaaacattgatgagttgctttgcaatgaagaaatttattgggcccaatgttcaacaaccaattggttggaggatggaaacaaaaataccaagtatttccaccaaaaagcttcccaaagaaacaaggtgaatacaattaagaagattagagatgatgaaggtttggattttatagacaaccatgtggggggtcgtattaatgatgagatgttaagattactgggaaaaagtttcattggtgaaaaggtagaggaagctttctttcagatgcaccccacaaaggctcttggcccagatgggacacctgcttatttttatcaacagttatgggatcttgttcgaccttatgtgaaacaaatagtgctggaggttctgaacaatggtagggatccttcttttctgagctag

SEQ ID NO: 1799 - DNA, 453 bp, Glycine max
  Peptide Sequence Number=SeqID_118577
atggtacatggaggtatgcacattcatgccaaaccatcttggggcaagttttcagtgtggcctggatggttttactacacttcaaagaattctggtactaaagcatctccttttgaagttacttttggtaagaaatctcctatcatttcatatattattaactctttcaatattgtgactgtggatgatctcttggtgaataaagacacaatgatcattgtattgaggaggaaactcacgaaggcccaagaaagaaagtcacaactgctattgcacccctataccaatcttgccaaacatttccatggtccctttcaaatattggataaaattggcaaagatactattcctgccattatgttacctaaaatcgtagttgagaaccaacctatgatcactccccttgctatcctcaatactgttggaattactctattgttgcaccacgtttga

SEQ ID NO: 1800 - DNA, 942 bp, Glycine max
  Peptide Sequence Number=SeqID_118578
atggaagcacaagagtttttccagaacaccttctgcccccaattcccctccggtaccaacatcacaccctccaacgccaatccctccgccgccaccgccgaccacttcctcgtcgaagacttcttcgacttctccaacgacgacaacgacgccaccgctgtcaccgacgccaccttcgactccctccccaccgacgtcgactcccccaacgttacccccctcgacagcaccaccaagaactccaatttgccctcctcctcctccgccgacgcccatttctccggtgacctctccgtcccgtatgatgatcttgcggaattggagtggctgtcgaaattcgcggaggaatcgttttcgagcgaggatttgcagaagctgcagctgatatcgggtgtgagagcgcaaaacgatgctgcatcgtctgaaacgcgtgacccgaacccaggagcaagcggacacgtgggcccccatgcaactggacactctcgcctcgttgtcctctctcccaacaccacgtcgtcgtcttctaactccgacgccggtaagaagccggcgacgccgcggaggagagaggctgccttcgccgaaggcggcagcgaggggcggaagtgcctgcattgcgccacggacaagaccccgcagtggcggactgggcccatgggcccaaaaacgctctgcaatgcgtgcggcgtgaggtacaagtcgggccggctcgtcccagagtacaggcccgcggcgagcccaacgtttgttctgacgaagcactcgaattcgcaccgcaaggtgctggaactgcggcggcaaaaggaaatggtgaaggtccagcagcatcagtttctccaactgcatcaacagaacatgatgttcgatgtgccatcatccaacggtgaggattacttgatccatcagcacgtgggccccgattacacgcacctcatctag

SEQ ID NO: 1801 - DNA, 1017 bp, Glycine max
  Peptide Sequence Number=SeqID_118579
atggagtgcgttgcggcgaggaacttggcggcaatggcgttctgcgtgagtcctttgtcgtcgaggttgaggctgcggaggaagaagctgtggagaagacgaaccgcgtcgtcgtcgtcgtcgtgcggcggccgcggcgtgcggtgtctgaaggtggaggcgaaggccgggagcgagagctgcgtggcgacgaaagaggacttcgccgacgaggaggattacgtgaaggccggtggctccgaactcgttttcgtccaaatgcaacagaacaaagccatggaaatgcaatccaagctcgcggataagttgccacctataggagatgatatactggatctagttgtgattggttgtggtccggctggtcttgctcttgctgctgaatcagccaagttaggactgaaagttgggcttattggtccggatctcccttttacaaacaattatggtgtgtgggaggacgaatttaaagatctcggacttgaaggttgcattgagcatgtttggaaggataccattgtctatctcgacaataaggaccccatttttattggtcgttcctatggacgtgtcagtcggcatctgcttcatgaggagttgttaagaaggtgtgtcgagtcaggtgtctcgtatcttagctcaagagtagaaagtgttattgagacgagtaatggtcatagtcatgttgtctgtgaatatgacgttgtagtgcccagcaggcttgttactgttgcatcaggagctgcttcagggaaactgttgcaatatgaggtcgggggtccaaaggtttctgtccaaacagcttatggtgtggaagttgaggtggaaaacaatccttatgatccaaatctgatggttttcatggattacagagactacatgaagcaaaatgttcaatgtccagaagcaaattatccaacatttctttatgcaatgcccatgtcccatacaaaagtgttctttgaggtttgctccatttttgttaacaacaacaacaacaacgccttatcccactag

SEQ ID NO: 1802 - DNA, 381 bp, Glycine max
  Peptide Sequence Number=SeqID_118580
atggagaaaaatatttataggcttgctaaatgtagggaaacagggacaagagatttgaataaagtgaaatgcataaaaaatggagaagttaacttcttggttacggaagaagatattaggaaaaatggaagagttaattccatgtgctatgagcatgtgaagaggacaaataatgacacagcagttaaacgggataatatacatagtgacatatggaaagacctacgagagaaaggcattagttggctcacaaagctgtttaacggtattatgaggtctaagagaatgtccgatgggtggagaagaagaactttaatccctatctataagaacacaagagatacacaaagttgtgcaaattataatggattaagctcatga

SEQ ID NO: 1803 - DNA, 453 bp, Glycine max
  Peptide Sequence Number=SeqID_118581
atgttcctatctactatctggatataccaagaaagatgtacggctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagactacgagtataataggagcatccgtcaacaaaaggatcaccctaagatgatcatctcgtggctattgagaacgaatcaaatcagatgggttctatttcttattcttaatgttttcgatctcggttccgtaggaacaagtcatagagattga

SEQ ID NO: 1804 - DNA, 1521 bp, Glycine max
  Peptide Sequence Number=SeqID_118582
atggagaatcaaaaggcgggggaatcggtgcatgtgagggaggaggaggatgacgtggcggtggaggaagaggaggaacaacaaggagatgttgatgttggttccagcatgaccttggagagggtcgctgcagctaagaaattcattgagaatcattacaggtctcagaggaagcacatccaagaacgcaaggagaggcggttaatgctagagaagaagttagcatcttctcaagtaccagaagatgaacagatcaatctattgaaggatttagagctcaaggaaaccgagtatatgcggttaaaaagacataaaatatgtgttgatgattttgaccttctaaccattattggcaggggagcctttggggaggtaaggctttgccgtgaaaagaaatcaggtaatatatatgccatgaaaaagttgaaaaagtctgaaatgctcagcaggggacaggttgagcatgttagagctgaaaggaatgtacttgcagaagttgcgtgtgacttcattgtgaaactctattactcttttcaagatgctgaacacttatatctcataatggaatatttgcctggtggtgatataatgactttgttgatgagggaagaaactttgactgaaactgtggctagattttacattgctgaaagcgttattgccatagagtctattcataaacataactacattcatcgagatataaaacctgacaaccttctattggaccaatatggtcacatgaagctgtctgattttggtctttgcaagccacttgactgctcaagtctatcatctattagtgaaaatgaaatcctggatgatgagaacttgaacgataccatggatgttgatggagccttgccaaatggcagaaatggtaggcgctggaaaagtccccttgaacaacttcaacattggcaaattaacaggaggaagttggtaatttccgtctgcccatgctcagaagttgtatttgatgatttcctggcattttccactgttggaactccagactatattgctcctgaagtactactgaaaaagggttatggtgtggagtgcgactggtggtctcttggtgctataatgtatgaaatgctagttggatatcctccgttttactctgatgatcctgtatcaacatgcagaaagattgtgcattggaaaaatcacttgaaatttccagaggaggtcagattgacacccgaagccaaggatctaatatgcaggttgctttccggtgtgccacataggcttggtactagaggagcagaagaaattaaagctcatccttggttcaaagatgtcatgtgggacaggctctatgaaatggaggcagcatttaaaccacaagtcaatggagagcttgacactcagaattttatgaaatttgatgagtgtgccatgtctataccagtggtatgttttgtatccatgacttctatgaatttgcttcatcctttcagcttgttcctaaccagagaagtaggtgccattgaagtggtggtgggcttataa

SEQ ID NO: 1805 - DNA, 627 bp, Glycine max
  Peptide Sequence Number=SeqID_118583
atggtgaaacgcttgacgccggaggaacccactttccgacgagagcatgggatgtgtttcacttgtgatgaacgataccttagagggcattacggcgcttctaaagcttcccttctggttgctgaagatgaagattccaatagccttaatacggacccagttgacccgaccttggacctgaaacccacacctaacccagacccaaaattcacacctgactcggacccaaaacccacatccaacccggacccgatccattcggcccaaattagtttgaccttcttctcgggtgatttagcaccgagaaatttgcgccccgccgaccttatctccggtaatcgagtggtcatccttgttgatgggagaagtacccacaccttctttcagcctcaactatcgatctctttgagcttacctaatcggactgctccaacaccattacgcgagatgttccttcctcacgagcactttgtggaactgcagggggtgatagggaagcatatagctgcagacaaagtgcaagaggtgcaagcagaagcagtgacagggaagcatatagcagcaggaaacaaagttcaggaggtgcaaacagaaacgaacaagaataaccaaattgctgaattctga

SEQ ID NO: 1806 - DNA, 396 bp, Glycine max
  Peptide Sequence Number=SeqID_118584
atggccactgcaacgcttagtcctactgatgttgataagttctcccacctcaaatctgtcgttgttgctttgagccaaattcagaaggaaaagggagacatgaattttaaattcgaaaaaggtttctcctctactggcgaagtcaatgttgccaccaccggcagcaccgctgacgatgtagtgatgaagggaggagtgatgagctttgcacgtcacatggaagcggctctgttaactaattggacgagtctgtatctgatagggaagcatatagcagcagacaaagtgcaggaggtgcaagcagaagcagtggcagggaagcatatagcagcaggaaacaaagtgcaggaggtgcaaatagaaacgaacaagaataaccaaatagctgaattctga

SEQ ID NO: 1807 - DNA, 540 bp, Glycine max
  Peptide Sequence Number=SeqID_118585
atggccttaaattcactggttcagagtttgggagtaggtggatatggtgatttgtgggtcgtgatggaggaaggtttgatgaggtattgtggatgtggaaatatgcattggctccctctttgcggaacaacctgcaaagttatggtggacgaggtttgcaccacacaatggcaaaacatgaagatcaacaacgaaggtaatatcctggacttgtattggagtagctttgcaaattgtgggtactccccacatccactaagatcaccactggttgcagtgcaatgtggcccacgagacggctccaatgaaggattgtcgtcttcaaaagactcaccgtcatcagcaatgagtagaaaggccttggaggcgcacttgtggcccgatgaaattttcatgcagttgaagaaaaggccacgttcgcgtctcaaggtcagctcctcgggcgatagccgcttaatgggtagcgaagcacgtggtttcggtagtgtcggtaacaatgacaaggaagaagttgtggcagaaggagaaggagacgattga

SEQ ID NO: 1808 - DNA, 1569 bp, Glycine max
  Peptide Sequence Number=SeqID_118586
atggaggaaataacttcgactgttgcagtgccattcacactagagaatttaatacaaaaagagccagcagtgacaacccacatggagataactggtctcaaactcagggcaaatacatcaccacctttgatattaaatccttcaattgaaattgaaaagcacacagatattggtccacaaccccaaattaaagcgtcttcagagggaacggagaatctggttggagctggccttgtctcagaaatggttagtcaaggagacaataatggtttgtattctgaaagtctaaagcaggcaagaaaagagaatgaatcattgcaagctaaggattttcagtgtggtggcaaaattggtccttgtagggaggaatcttctgttttgaggactaattgtgaaagaaattcacctattaccatcaaggttggtgataacataattgatggaaagtccggttcgaccaagccgccacgtgctagggaacatgagagtgataatggaagtggaccagatgagtctaataagaaaacatttgctgtgccttgtgcgatgccagagaagccaacatgcttggaattgagtggtggtactagtactaattgtactaccccactttggggttgttcatcggtttgtggaaggagagaggagatggaagatgctattgctgttaagcctcatctttttcaagtcacttcaaggatggtaagggatgatcatgtgagtgaaaacacaaaatactcaccaacccatttttttggtgtctatgatgggcatgggggcattcaggttgccaattactgccgggaacatcttcattcggtgttggttgatgagatagaagctgcagaatcaagtttcgatggaaagaatgggagggacggcaactgggaggaccaatggaagaaagcattctccaattgctttcacaaagtagatgatgaggttggaggagttggtgaaggtagtggtgcaagtgttgaacctcttgcttctgagactgttggctccactgctgtggttgccattttgactcaaacacacataatagttgcaaattgtggagattcaagagctgtcttgtgtcgcggaaaacaagcactgcctttgtctgatgaccacaaaccaaatagagacgatgaatgggaaaggatagaagctgcaggaggaagggttatacaatggaatgggtaccgagttctaggtgttttggcagtgtcaagatccataggtgataggtacttgaagccatgggtaattccagagccagaagtgaagtgtgtccaaagagacaaaagcgacgagtgcctcattctagccagtgatggtttatgggatgtcatgacaaacgaagaagcctgcgaaattgcacgaaagcggatccttctttggcataagaagaatggcaacaactcagtatcatcagaacaaggccaagaaggagttgatcctgcagctcagtatgctgcagagtatctttctagacttgccctccaaagaggaaccaaagataacatctctgtcattgttatagacttgaagcctcagagaaaaatcaagaaaaaagaataa

SEQ ID NO: 1809 - DNA, 237 bp, Glycine max
  Peptide Sequence Number=SeqID_118587
atgccacccccaatcaggccacaagatgaccagttaagtttggcagacattgatacaatcgaagtgattggaaaaggaaatggagttatagtgcaatgggtgcaacacaaatggactaatcagttttttgcattaaaggtttttgaccctataactttactagacattggttttgatggttgtctcttgaagggtacatgtgatgctatattgttggtaggagagaccctaacctaa

SEQ ID NO: 1810 - DNA, 504 bp, Glycine max
  Peptide Sequence Number=SeqID_118588
atgggggaagaagaagaagaagaagtgagcgtcaccgctttgcatcatccaaacagcggaaacgatgatcagagcctcgaattcgatatatatcctttgagcagttactattttggatccaaagatgctgttccctccaaagacctcaccttagttgatcgtgttctcaggatgaagtccaaaaattccatatataaacttcctggtggccgattaaggccaggtgaatcagatactgatgggttgaagcgtaagctggcaaggaagctctctgtgaatgaagatggggacgggtcagaatgggaggtgggtgaatgccttggaatgtggtggaggcctgattttgaaacattaatgtatcccttcattccacctaatgtaaaaaagccaaaggagtgtaccaaagtcttccttgtgaagctgccagagagtagaaagttcattgtgcctaaaaacatgagggtgcttgcagttccgttgtgccaagttcatgaaaatcacaag

SEQ ID NO: 1811 - DNA, 156 bp, Glycine max
  Peptide Sequence Number=SeqID_118589
atgaagttcttaagtgataggataccgaaaagggttgtggagaatgcggtggttgttgagtgtggtgccttagtatttggggtgataaaacgggttaaccagccccacctcatcattgaccaaccaaaaatgggttgtcccacttgtcctacataa

SEQ ID NO: 1812 - DNA, 189 bp, Glycine max
  Peptide Sequence Number=SeqID_118590
accgcgtcttttccggtttttccgacgttttcctcaaataaacgttggtggcgactccgcgcgtattcctttcgtggaacacgcatcccgcgagtcacgcgtcgccctcccgccgaagggtaggttgcgacacagccgttctacaagccttgagccaaaatcccaacttatcataaaccttgacccagg

SEQ ID NO: 1813 - DNA, 708 bp, Glycine max
  Peptide Sequence Number=SeqID_118591
atgaatttattgcctagtgctgttcatgcatcctccacccaagagtctggagccccgcgaatttattgcctagcgctgttcgccaattctccattctccacttttctccggagccccatgaatttattgcctagcgctgttcatgcatcctccacccacgagtctggagccccgcgaatttattgcctagcgctgttcgccaattctccattctcgtctttttttgcagccccacaaatttattgcctagcgctgttcgccaattctacattccccacttttatccggagccccatgaatttattgcctagcgctgttcatgaatcctccacccacgagcctggagcccagcgaatttattacctagcgctgtttgccaattctccattctccacttttatctggagccccatgaatatattgcctagcgctgttcatgcatcctccacccacgagtctggagccccgcgaatttattgcctagcgctgttcgccaattctccattctccacttttttcggagccccgcgaatttattgcctagcgctgtttgccaattctccattctccacttttatccggagccacgtgaatttattgcctagcgctgctcatgcatcctccacccacgagtctggagccccgcaaatttattgcctagcactgttcgccaattctccattctccactttgatccggagcccatga

SEQ ID NO: 1814 - DNA, 270 bp, Glycine max
  Peptide Sequence Number=SeqID_118592
atgaagaaagcatacatcacatgggatgacaatgatatggaatcttctgaagattcaaaaaatgaagaaataaacctctgtctaatggctaaaagttatgaaagtgatgaagaggtgtctttgaggaaggaatggtacatagatagcggatgttcaaaacatatgactggagatgcatcaaagtttacatatatctctcccaagaaaagcgggcatgtcttaagcacaacctacttagtgttagtcaattatgtgacaaaggctatctag

SEQ ID NO: 1815 - DNA, 174 bp, Glycine max
  Peptide Sequence Number=SeqID_118593
atgttagtaaaaaaatttatggacttaactggtggatccaccattcttgatcgtatagccacccctaagcgcctatgtggaatcactaacgtggcgacggtggagctgattgtcccgacttggtggtggcgtcacagaaaaacattgaaagcttttttggtgctccgacgatag

SEQ ID NO: 1816 - DNA, 384 bp, Glycine max
  Peptide Sequence Number=SeqID_118594
atggtgcaacccgaaccaagtgttggccttaaggggaaacctcaccaatatgttcccactttcatgtcttcttgtatttcaacaaacaaaggcttgggccccctagacctaagtcatgttttggcatttatcctaactttcacaagctgtccacatccaacaaatggtgaaaacaccattgaggcatttcaccgagcacttggtgggcgcacttttgggtaccaacaaaaagggaatggggacaatgtggcttgccccatcatttcagaacacaacctaggcctacgaccatcccctacaaccccccaattcaatgaatcaaagcataaattttccccaaattgtctcacggaattggtcaattatgtacaatttaaaggataa

SEQ ID NO: 1817 - DNA, 633 bp, Glycine max
  Peptide Sequence Number=SeqID_118595
atggagagacaacttgagacaaagcattcctacaagaagacctttcactatgatacttctagaggtaagggcaagtctaagaaggagggatcttcctcacctaagaaacaaggttcaaactctacaagtgggcgtgtatcacacttcaacaagatggatgatgattctaagcacaccataatagccaaggattcagtcattgctaaacaacaaaaatttagcaaaactaacctaaaagttgtgaaggttactttagaacaaagcccaaaagaggctcctcaggtggatctcgacaccatcaataagagaaagcagaagaggttggccaaagccattgctaatgaagatcaagcagttgctctggttgctcctacccccaaaaagagcaaagaaagtccaaccaaccccagaatcactgaattcatctctgttgaaactgttgaaagggaaaccatcagtgtccaagcttctacatggacaaagtatgactatgagcacacgccatctgaggcctttaaggctctaccaacagatgctatagttcatcttcctttcccacaatggactcatccaattcagccaaatgttatcaagatgcctccacattggcttgcacctggcactaagcaatga

SEQ ID NO: 1818 - DNA, 606 bp, Glycine max
  Peptide Sequence Number=SeqID_118596
atgtatgtaagagatcaagccactgcctaccctcctgatttgcacatctcaagggccaccgatatcaagacagttgttgacaaggtgtgtccacatttacctatatgggatgctgaccttctggaaccagatcttgagaaagccttcacttgtggttatgatggaagggataatgttgagcaccatgacatcattcaagtgctacatctagttaggaagtattacttcaatgatgcttgcatctgcttttcaaaggacgcctacaacaacacgttcattcaacgcctactccaacttcgtaccattcaatatcaggatgttgcctccgtccaagatgaagcgtcgactaaagttatggatgacaccattgtatgtagggtcatcattgatcttaccaacaccagtgtcatggatggaactcctaaggcatccaattcaaccatagctgatgaaggagaaccaaacatcctcatcatctactcaactagcataggacctgctccttttgaactatgcacaacctgctattgttaccagagatcaagtgcaagacatgatagggcaatcaatgaaatcatttgtcgaacgataaagtcaagaaaatga

SEQ ID NO: 1819 - DNA, 225 bp, Glycine max
  Peptide Sequence Number=SeqID_118597
atggaatacgattcgctttcaagatgccttggtggtgaaatggtagacacgcgagactcaaaatctcgtgctaaagagcgtggaggggatctttcaattgagaagatccatcgacctgagacgaagagaaagaaaggaagatctgtttgggaagtaagaagttcccttgacatctcttcatctgtaaagaattgtcgatgtgaaaacacagagacaaaaggctga

SEQ ID NO: 1820 - DNA, 264 bp, Glycine max
  Peptide Sequence Number=SeqID_118598
atgggttctagcagattatcattcattttagtacttgtgcttgtaaccttttcatccatgatcattgactcaagggttgcagaggcacgtaccctgccaaaatcagccttattgccttccaaagttgatatacctactgttgttcctcttccactggtggcaccactgccaaatttgcctgttactctccctccagtgcctgaactacctgcagtacctaaagtaccaattcctgaaggtggttctggttctgttggggtttaa

SEQ ID NO: 1821 - DNA, 726 bp, Glycine max
  Peptide Sequence Number=SeqID_118599
atggaagaagaggagatttcagagccattggcatttgaagaagccttaagtgatgagaattggagaaaagccatggatgatgaaattcatgcattagaaaagaatgatacatgggagctaacaaatttatctgcagataaaaggcctattggagtgaagtgtaagtacaagacaaagtacaatcccaacagagaaattaatcggttcaaaacaaggtttgttgcaaaaggatataagcaaaacccaagtattgattactttgaaatataccaaatggatgttaaatctgcatttctaaatgaaattctggaagaagaagcatatgttgagcagcttgtaggatatgtggtcagaggaaaagaagataaggtctatagattaaagaaaaatttgtatgggttgaagcaagtgctaagagtgtggagcacatgttatacatctaaatttgttgatcctggagatattctcattgtatgtctttatgttgatgatctaatctccactggcaacaatttaaggattattgcaaaattcaaggaggctatgataagttattttgagatgacaaatttaggattaatgtcttattttcttggcattgaggtcattcaacaggatgatgggatttatatctcccagaagaagtatgtagacaatattctaaagaaattcaaaaccaatttccacattagttcaagagaagttgatgctaacaaaggaaagtga

SEQ ID NO: 1822 - DNA, 720 bp, Glycine max
  Peptide Sequence Number=SeqID_118600
atggcagttcctgcaccattctctctttcttctgatccctttgcttccaaatctgccacatcaacgatccttggtcctgccgtgctgaaaatagggaactttgagcaaactcatttcggattgttcacggcattaaggagaaatcaaggtttcactttaaaggcctcaatggggcctgcgggatttacagagaaacttaacaacaacaggctaaagactttagctgacgctgaagatgggaaaaatattgaacagtttgaaaatcttgcaaaggttcaaacaccaaagttcatggttattgcttgtgcagattctagagtatgcccttctaatgttttgggatttcaaccaggagaagcattcatgattcgcaatgttgctaatttggttcctacctttgagagtggaccctcagaaacgaatgcagctctagaatttgctgtgaactcccttctggttgagaacatcttagtcattggccacagttgctgtggtggtatacgtgccctgatgggtatgcaagatgatgatgttgaaagaagttgggtcattgttgggaagaatgcaagaaaaaaagccaaggctgctgcttctaatttcagctttgatgagcagtgcaagcattgtgagaagggaaagggggtgggggtgggaagggtaggggctagtattttgacagaagtaatcttgaagacttatctgcagtttctcctaatgtga

SEQ ID NO: 1823 - DNA, 354 bp, Glycine max
  Peptide Sequence Number=SeqID_118601
atggtgaaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtatgggctttgggatcacaagtggtggaggcaactcaagtttggaaaatttggctcttctgacagtggagatgttgattgtagtaggattcctgcctctgcaaaccttgtctgacccatcattgttgaaaaagttagaaaaagttagaagcggaacacaccatctttcaaacttgtaa

SEQ ID NO: 1824 - DNA, 215 bp, Glycine max
  Peptide Sequence Number=SeqID_118602
ggttttatgatgatgctttgcgatatttgtgtgctgaaattgctgatggaaaactggtagacatgaaggggaaagtagaaaactgtgagattttgagggttagagaaactaaattcggggttagtgtaaattggggtctaaagacttgtgggaaagcttgggctgagcaaatgaggaaaatgagtgaccaaagtgaaagcaagagccatttctag

SEQ ID NO: 1825 - DNA, 600 bp, Glycine max
  Peptide Sequence Number=SeqID_118603
atggtgtcttggagtaccataagggatttgactcgccatggaggcatcaagaaaaagatcatacgggagggagaaggatgggctactcccagagaagctgatgaggtgctagtgaaatatgaagccagactagagaatgggatgcttgtctccaagtctgatcagggagtcgagtttaatgtaagtgatgacgggctcggtcaaaattcaaataaaatcactgagctagacggtgttcttccagcagattctaatttaacttgcatcaagcttgagttggtatcattgaaaattgttactgatgtcacgggagataagaagatacttaaaaaaattaagaaagcgggtgaggggtttgatcatcctaacgagggatcccaagtgaaagtgatatatttgtgtaaaggggaagatggtacggttattgaaagcaaaggatcagaggaagaaccttttgagttgacaactcaggaagaaccggtacccgagggtctagaaagagcaataatgacaacgaagaaaggagaacaagctcttgtgaccgtggatgctgaatatttgagcgactataataattcacggggaaacacaaaccaataa

SEQ ID NO: 1826 - DNA, 2100 bp, Glycine max
  Peptide Sequence Number=SeqID_118604
atgcccatttcagcacagcctttaaaggcactgtcccaagaaaaatctagagtgctgcattctgtgaatctggttttcagcatgtgggaatccgagagtgaatcggcttcagcacacaaatatgggggtggacttctcacttcaagtaaccatggtgtcaagacagaaggatttgtgcaaagaggccactcttggtatgtggctactgatattccaagtgacttccttgttcaaattggagaagctaacttccacttgcacaagtatcccttggtatctagaagtggaaagctgagtagagtcatatatgaatcccacgacccagatttgaataagatagttatcgatgatatccctggtggggcagaggcttttgagcttgcggccaagttctgctatggaattgctgttgatttaacagcaggcaacatctcaggcctaagatgtgctgcagagtaccttgaaatgactgaggacctagaagaagggaatcttatattcaaggcagaagcattccttagctatgttgttttgtcttcatggagagactctatagtagtgttgaaaagctgcgagaagctgtcaccgtgggcagaaaaccttcaaattgttcgcagatgcagcgagtccattgcttggaaagcttgtgccaatcccaaagggataaggtggtcctacactggaagaacagcaaaaatttctagcccaaaatggaatgatatgaaggactcaagcccaagtaggaaccagcaggttcctcctgattggtggtttgaagatgcctcaatccttaggattgatcactttgttcgagtcatcactgccattaaggtaaagggcatgagatttgaattggttggtgcttcaataatgcattatgcaactaagtggctaccgggattgattagtgacactgcaatccctggtgatgaagcaagcaactgcagcatgagtaacagtagtagtagtggtggcagtagctggaaaggtggacttcatatggttgtgactggaacaaaagatgacacttcaagtcttcaagctaaagagcaaaggatgatcattgagagccttgtcagcattattccacctcagaaggacagtgtctcatgcagcttccttcttaggctcctgagaatggcaatcatgttaaaggttgcacctgcactggtcactgagttagagaaaagggtgggaatgcaatttgagcaggctacactggctgatcttttaattccttcttataataaaggagagactatgtatgatgtggatcttgttcagaggctgttagagcattttattattcaggaacacactgaaagttcaagtccaagcagacagtccttttctgataaacagcatatgggaatgggatgcatcctaaatgccaaggcaagagtggcaaggcttgttgacagttatcttacagaggtgtccagagataggaacctttccctcaccaagtttcaggtacttgcagaggctttgcctgagtcagctaggacctgcgatgatggactatacagagcaattgattcctatcttaaggcacaccctacactttctgagcatgaaaggaagcgactatgccgtgtaatggattgtcagaaactgtccattgatgcctgcctgcatgctgctcaaaatgaaagacttccgttaagggttgttgtgcaagttctattcgcggaacaggtaaagataagcaatgcactagccagcagttctgtgaaagatgttgaatctgagagtcatgcaatggttacaaaccggaaaacacttctcgaagggacaccacaatcattccaagaaggatggacagctgctaaaaaggacatcaacacactaaagtttgagcttgagagtgtgaaagccaagtacatggagcttcaaaatgatatggctagcttgcagaaacaatttgataagatgctaaagcagaagcatacttctgcatggagcagtgggtggaagaaactcagcaaacttggaaggacaacacatctagtagaaaatcaggatgattctcctgagattcaagattcacttgaacaaaacagaaagactactagaaggtggagaaactcaatatcctga

SEQ ID NO: 1827 - DNA, 587 bp, Glycine max
  Peptide Sequence Number=SeqID_118605
atggaggtcgaaaggatgagacagttgatgctgatgtggtgtagaatacgaagcaaccgtgtcgctcttgtgggtggaaaccataccgctgccagcacgatgaagaataagcatttgcacgatggaagaacaattgctgctctcaaccccgaaagtttcctcgttatcaggattcccgatgcgcttgttttgcgcattctgtctcgctcattgttcgtggccatggttcttgctgccttgcctttcttgggaactgttctcaaaggattctatttctcttccagttttgttcccaatgtcgaaactgcagccgcatctgggtctctcgatgtgggactattgaattcgattctacatgatttcgctcatgagggtctcctcagagagaacgataaggcactcgttctgaactctccccttcctaatgtcttcagggaaaagattgatgttgtcatggattctgattgggaaagtaagagcttgtttgctgatgtgtcttatgattttgtgttcacctctggtgatattgatgctgagtttattgatcgcattctgaaaattgatggcattgtggctctcccgttggg

SEQ ID NO: 1828 - DNA, 1227 bp, Glycine max
  Peptide Sequence Number=SeqID_118606
atggtgtgccaagcagcaagccaaacaagattccgggctttgaaacatgagagtggcattaaaggtgaaccagcaattattgttagagtgatagcatgctttcaacctttgcacgattgtcagctgaagtttgtagttttctatttctgtcatttgttcccaagagaagcagcaagtcattcaagatcccatatcaaggcactggatcacaggtcttggccttacccacagcatgtggcttggccatcaccttacttaaattgctcctgcacctcggcagagcccagttcgcaggttcattcagcttatatgaaccccagcacatgcatctttcctgctgtcagcgtgtttccaggattcacagctcctgctctcccaaactggaagactgagcagaccaatgaagtgcatgggttccatcagtatcctcattcagaaccatatttgaaagaaacacatactggaggggctatgcaaaatgcaaatcatgcatctttccagaagaagttacttatttttgaccactctggtagtaagacaaggatgctttatagtcctgtcttctctcttgtccaaagtccaactgttactgctacaaaatttgctcaagtttatcatgtaaacatggaagcacaggcaactaatatgggccaaaagcatttacccatatacacttcacccgaagagactggtaaagatcatatagacaatgaagaaagtgaaatgcatgaagacacagaagaaatcaatgcattgctttattctgatgatgatgatgatgatgaggtaacaagtactggtcattctccattggttacaaaaagaacttatgtgatgcaagaacagtttgcaggcatgaagaaggaggttgctggctctgattggccaaacaaaaggcagaagttaattgatagtggatacaatacactaccaccactcatggacagtgctagttccgaaaggctaaatgaaatgtgcgagtatgccagtgatgctgaatcaaagtattctagtagtggcggggtgtatgctgcaaggcaaactaaagaagataatccaacacctgctgatattcaattgaaaaaggataaaatccgtgaattgttgagagttctcgagaactttattcctggagcaaaaggaaagcatcccctgttagtcattgatggtactattgagtacttgaaatctttggcgtcccaagctggtacactgaaatatcactaa

SEQ ID NO: 1829 - DNA, 336 bp, Glycine max
  Peptide Sequence Number=SeqID_118607
atggagaatcttgttgctgctataatcattggaattgggtcccccaacaatgcaaatgattggaagatcctcactgtaagtacccgcaatggcgttcagaatactaagaccaccaacgttgaaggttctcacgacatcaaagatgctgctagacaagggcaccataaaaaactccgtaccccattgcccagaggctcttcgctatgcgaaggtatgggggagggatgttgtacgcagtcttacccttgcatatgcaaagaggctgtttccggattcgaacccatgacgaacaagtcatcaagacacaactttaccgctgtaccaagggcaccataa

SEQ ID NO: 1830 - DNA, 216 bp, Glycine max
  Peptide Sequence Number=SeqID_118608
atgtttcctcaaaagatctgcatctcacctcattcagttgttcctctgcttctcgctttgacaaagattgttacaagatgcaatgaaatcagtcatgcggtggtgagtgcaacgacagtcactgctgaatggcggcgctgtgaagtgcgacagaggcttgggaaactcatccgagaatggtgtgacagtgatggagctcgttatatgacagcgtga

SEQ ID NO: 1831 - DNA, 618 bp, Glycine max
  Peptide Sequence Number=SeqID_118609
atggagatggtagatgcctcaggttatccctttgcaatgttggcttcagcaaaagggatggtggaagaacaccaccccaacttcatcggcacttactggggaccagcaagcactcccttttgtgcagaaattgtggaatcttctgatgcttacctttttgctggtccaatatccaatgatattatctctttagggaactcgctgcccctaaaaaaggagagctcaattgttgtgctgcctgatcgggtaatgattggaaatggacctaccattgggtatgagtgtcagatgcagtacggatcaataggttggtcagttggtgcaactcttggttatgcgcaggctgctccccataagagagtcattgcttccagaaatttaggcaggaaatgtggactttcaaacacatatcaaacgacagtacaggaagtgtcaacaatgttacggtgtgggcagaatggcattgtctttctaattaacaatggtggatacactacagaggtagaaatccatgatggactttacaatgtcataaaaaactgggactatgctggacttgtggaaagaatagataatggtgaaggcaaatgctggactgccaaggtcagacaatcttaa

SEQ ID NO: 1832 - DNA, 1605 bp, Glycine max
  Peptide Sequence Number=SeqID_118610
atggggcatcttctagaagagggcaaggtggttgatgtcttcatccctaaaagaagaagcaagagtgttcaacagtttggttttgtctgtttcatggaagtggaaaatgaagggaaactagagcatgagagaaggttgttattatgcccaagcaacaaaagccccaaaccaggtgtagaagagaaaaatggtcagagacaaggcagcggggttgagggaagggtagtaattaggattcgcagtacaaatgaagaatggttgaaaagacctgtgcgggataatttgaccctcatccctaagaatggagaggaggacgtgcatgcaattatggagaacaaggattggctagggtttttggcttttgtgagcactacagggacattcatcaatatggcagagaagattagctcattggagaaggtggattacgcaaggattgtggttaaggaagcacctacagtagagggaggtacatgctactacaacaaagataaggatggtgacaactccgcaccttctttcgatggcacggatgaggccaacaaaatctcgaacacgaaaaataagataggtgcagtcttcaagggtagcaaggaggaatttgttgaggagcttctaacatacaatgtgagagggttatggggtagggcgaagtggaaggagattagggaggttattgcaagagaagaactggacatgatttgcattcagagtcaaagatggaagttaatcttgataaagtatgtggtgctatatggggggattctggatattagtgtctatgttatggctacaaaaatggccaaatgttacccaacccttcaagatcttcaattattggatcaaggaatcgggttttgggagtttgagaaagcaaagtatgaggccattgatgttcatggttggggtgcttttgtgtttaagttgcacgagagaaaagagcttattgagaaattttggaggacaacaagaattcaagagtctattatgtgtcaaaagtctagaatcaagtggcttaaggaaggtgatgtcaatacaaaggtgagaagggtgtggtgtgatgatccttccattgttaagaaaaagatcaaggagttctttcatagcaaattcaaggaggataaggagatgcaagtgttgttggatgatagtaatgcctcttttctcactcttatccctaagaaggagaatccccaaggcttaggggagtatagacctatatccctcattgggtgcttgtataaaattcttgcaaagtcattggctaataggatcaagaaggtcttgggtggtattattgatgataaggcaaaggaatattttggatggggtgttgtgcttttgtggcaaatagatacaatggatgtggagttgcctacaaacatcctccatattcgtgcttgtgaacgggaggttgaggcaaaaaggatgctttccggtatggagattgggaatggcaacttaaagatctctctcttgcaattcatcgatgacaccatttttttctttaaagatgaggttagagacaccatcattgcgaaagcaatccttagatgctttgagatggcatttgggcataaggtaaacttctacaagagtagcttg

SEQ ID NO: 1833 - DNA, 348 bp, Glycine max
  Peptide Sequence Number=SeqID_118611
atggcgcatcgctcactcttcctctctctcagacgcttctcatcatgcagaaatagcggtttagcttgtgtcctgaacagaacaagattcgtgtcttcgggtgctgtgagcagtgatttggtggaagagagtgtggaaggtgatgatgacctaaggagcagaatcttcaggcttaggctccccaagcgaagcgccaccaacgttcttcagaaatgggtcctccaagggaatcctattacgctctctcagcttcgggatatatccaaagagcttcgaagatctcaacgttacaaacacgctttggaggtttcaccctttccattagagtataataacacaggattgtag

SEQ ID NO: 1834 - DNA, 333 bp, Glycine max
  Peptide Sequence Number=SeqID_118612
atgacgggagtcatggttttaaatagaggtcaacaacccaaattggggccacatcaatcgcatttttttgcagttgctcgcaatgtaaaggttttctggctgacagaaactgcaaccgcaattttaaaccatgacaggagtctttggggatttggaaattcagatgttttgaagaaagcctccctttggtggagagatttggcaaagaggggccaatgtcgattgggaagctgtgttgtgtgcccgcaagggatccggcaaaacttagagcttgggcatggattaatgcgaaagggaaaggaagaaaattctcttattatgaatgggagatga

SEQ ID NO: 1835 - DNA, 1506 bp, Glycine max
  Peptide Sequence Number=SeqID_118613
atggttgtgagcattgaccaacatcatggatttaagccatttagccgaacacagaggtgcaagctccaatcctatggtcaccttgatcctaacatcattgaacttagccaaactggtggtgctctttcttcttcttcaaactcctttggattagcatttcaagcggaaaacattcaccgcagtttctccactccatgcctccccctaactacaatgctaggaggggaagacttcacgtcttcttctcatccaagggttgagattgttggtggaagtgaagctcctccagtgcatgctctagttgttgaggttgccatagccatggcctcaggtgttcatcctatacccctcccaagtggcctaggtggtgcctatgttttccccaaccaaaacggtaacaacattgctgtagcaaagccagtggatgaagagcctttagccttgaacaacccaaagggcttagggggtcaaatgctgggccaacccggcctaaagaaatcgattcgaatcggtgaaaccggtatccgagagttagctgcttatcttcttgaccatggaggccttgctggtgtgcctcctactgctttagtcaaattctctcatgctgcgttctttggtgcaacggccactatttctcacatgcctaaaattgcgtcactccaacgcttcgttggtcatgattttgatgcaggagaattgggcccttctttcttccaagtttcttcagtccaccaaattgggatcctagacattaggattatgaaccttgatagaaatgctgggaatatgcttgtgatgaaacatgaccacaacaatagtggctatgttgatggagttgctgaccttgttcccattgaccatggtttttgcctacctgagtggctggatgatccatattttgagtggctgcactggccacaagcctctattcctttctctgactatgtacttgaatacatttccaaacttgatccctttagagatgcagagattttgagaaccaaccttccttcgctgagggagtcctcgattcgcgttcttatcgcttgcaccattttcttgaagcaagctgctgctgcaggcctttgtcttgctcaaataggccaaatgatgactagggaattttgtgatggtgaagagtcaccaagtgaattagaaaatatttgcttgaaggtcaagactactagcgtccctcggggttccgacgataacgtgaataaccgcaaagatgaaactgaagaatgtgatgaagttggtggcattatttccttggccgacctcaaccaaggtgaatgggaagcgtttttggagggttttagtgagcttttgcatggattttttgagggagatgttgtagacgaaggcgacattgttgttgtggagggtgttgaggtcaccgaagtagttattggaagaggggtcgacgatgtagtcgaaattgtgaaaggtgttgtactactcgtcgacgaggaagagttcgatggtggcgtagctatgggggcctag

SEQ ID NO: 1836 - DNA, 228 bp, Glycine max
  Peptide Sequence Number=SeqID_118614
atgagcttaggtggtttccaaaatatattgagtgaaaggtgggagatggtagctagggaggtgagcttttggaaagcaaagtggcttggtgaggagaatcttagtaccaagcataattgtgctttccttaattcggaacaaaagttcaactccatagcagagatgggtgcatggcgcggggaagagtggcattgggagctattatggaggatgccttggttccaatag

SEQ ID NO: 1837 - DNA, 1149 bp, Glycine max
  Peptide Sequence Number=SeqID_118615
atgcagcatgcagatgcagtccgcactggcaccctcgaaaccagcctatcttctccttcttcctctttgtttctggaggtgctgaccctcaaagttcagcaacaagccgctgcacgtaacacaggcaaaaaggcaaaaaggaaaaatgaaaaacttaagatttcactctcagtctttgcattgcatccattgtacctgagagtacaggcactttctaagaacatacccgaggagatcaagaaagagattgaaaaggcaaaacagcaattggatgggaaggatgttgattatgaggctacaatggctactaaactctcaattgctaagaaagttttcgctcaagagaaagatttgatacttaattcaagttcctttaaggagttcttttctgagaatgagggttggttgaaaccttatgctgctttctgtttcctgcgggacttctttgaaacatcagatcgcactcaatggggttgttttgctcattactcagaggataagctagagaaacttgtatccaaggacagcctgcattatgagataatttgcttccactactatgttcaataccatttacatttacaattatcagaagctgcagaatatgcaagaaagaagggagtgatactaaagggagatcttcctattggagttgacagaaacagtgtggatacctgggtttatccaaatttgtttcgaatgaacacttctactggggcacctccagattattttgataaaaatggccagaattggggtttccctacttataattgggaagaaatgtcaaaggacaactatggttggtggagagctcgattgacacagatggcaaaatattttacagcttacaggattgatcacattttgggattcttccgaatttgggaacttccggatcatgctgcgacaggtcttgttggaaaattccgaccatctattcctcttagtcaggaagaacttgaacgagaaggaatatgggactttaatcgcctaagttacccatatattaagcgggaactattacaggaaaaatttggtgatgcttggacttttgttgcaacaacttttctaaaggaaattgacaagaacttctatgagcatacatttagttttagtcataagggaagtagggagcaacttttctga

SEQ ID NO: 1838 - DNA, 723 bp, Glycine max
  Peptide Sequence Number=SeqID_118616
atggaggttggtgttgcggaagtagagccattttgcggcgtaaaagttgaggaagaaggagtggtcgagctcctcgcagcggctgaagtgctccttgcggactcgaggaatggagggaaacaaccacaatggaaactagacccatcaaggttgtgggccgcggcaaggttgtggactgcggctgtatgggtgcgaacggcggaggtggcggaggcggccaggctagcagaggtggcatggtcgtggatgagcatcaagtttggccaaggcggtcctcggtggcagacgaaaactcaaggtggtgtggtggttgttgtggggggtagtggagggtggtcttgcagttgtggagggcagccatggaagctccgtacgacgagtagtgtgggtggtggtaggcagccatggaagcttcatatggtgagtggtagccatggaaggcggccacgggaggtcaatgaaagcaccaaatgttacgtgcagcggcttgttgctgaacttcgagggtcagcacctccagaaacaaagaggaagaaggagaagataggctggtttcaagggtgccaatgcctcccgaggaaaagggagaaaggaaaactttgctatttcattcatatcctgcaagtgcccttacaacggatatatatagctactaatgggacaagaccccgacatccactaaccgtgctacgcaaaagcacacaaaagcaaaaatatcactaa

SEQ ID NO: 1839 - DNA, 618 bp, Glycine max
  Peptide Sequence Number=SeqID_118617
atgaaccagtacctgtcccaactcgctacaccctcacccacacatgcacctacacctacacctacacctacacctacacccaggaagggtgtgactccacccaaagttggttctcctgctgcctcaaaaagtgcacctgcaccaggaaaaagttctcaatctgagcctcctaattgtcattttagaaaaaggtctacacataattctgggaagcatgctcatcctccaatgcctgcagttgcccctattatcaatccacatcatcccgttcctgttgcatcaccaaaactacaggttgaacccccaacacatgtctctcattcagtacctgctttgagtcctttaccaaatgtagcttttgctcatgctgagccccctcctaagaatgaaccagcccctgaacgttctcaaacacattctcatgggccaccactgtcttcatgttttgcatgtaggttaaccagcaagcaggataattgtttagttcttagtgctgctggttgtcttagaactgttaaatgggcatctttaatgcttatagtactcgtgttacatgtcaaattccccaagtggcaggccttgatcacacacattgccgctgtttgtgatgtaagatga

SEQ ID NO: 1840 - DNA, 324 bp, Glycine max
  Peptide Sequence Number=SeqID_118618
atggccagcctacaactggtagcgcctccagaccccatcccgatggtagagcaatttaatgaatgggtagcctggccaaggactcagcctcctcttcacagggaagatgaagatcctgccactcaggtaccctatcagtcggaggatgagtcatcagagtcttccactcctaagccattgatcaagaagaggagggtagttgtaacccaggaagctacaactacctctgaaaattctcttgaagccactccagagcttccgacaccagtggcagataccacttctccacaacaaacaacagacaacagacccttccacgcctga

SEQ ID NO: 1841 - DNA, 252 bp, Glycine max
  Peptide Sequence Number=SeqID_118619
atgactaaagcacgtcaaaagggggtacggaaagagggctcaacgaaattcttcttcatttctccccctatttatagaaaaatgggggagatgcttgccacccagctcgcccaggcaagcaaggtgacttcctccagaaggatgcttctggaggaatcttcaggagggcccaactgggtctggttgctatttgcacccccatttctgctaaatacaccccctgccttttttttggtgattctttttccgtaa

SEQ ID NO: 1842 - DNA, 198 bp, Glycine max
  Peptide Sequence Number=SeqID_118620
atggaaaatggtactcctggaaaacaatatacaatcaaacatgacgcaaatggaaatactcaagtttctgatctcacagtagtggatgttcatagtgctaaagaggttgcatttcttttaaatcaacctgcaaatagcaggtgtaacaaactattgcatcttttagctatatatgaaggtgatgctatgctgtcctaa

SEQ ID NO: 1843 - DNA, 1689 bp, Glycine max
  Peptide Sequence Number=SeqID_118621
atggagagctttgcactttcagcctcaacctccttctctcgcttttcccaactccatcatcgtcctcgccctgtcatctccagatcccaatctctcagatcacccatcaccatctcccaacgtttctccttcccctccaaaccatcctccaccttcaacttcaacttcaaattcaaccgtttctcaaaaccccattacccaattcaagcttctccttcatcatcatcatcaccaccaccaccaccaccaccaccaccaccaccacctctccagggtgcaaagcccatccctttcattatctccatatccatcggcctcattgttcgcttcttcgttcccaaacccgtcgaagtcacccccgaggcctggcagctcctctccattttcctctccactatcgcgggccttgttttgagcccgttgcccgtgggggcgtgggcctttctgggcctcacggcctccgtggtcaccaaaactctcacctttacagcggccttcagcgccttcacgaatgaagtgatttggcttattgtgatttcgttcttctttgctcgcggattcgtgaagactgggttgggggatagaattgcgacgtacttcgtgaagtggatgggaaagagcactctggggctgtcttatgggctcacattcagtgaagtgcttattgcgccggcaatgcctagcaccaccgcaagggctggtggtgtgttcttgccgattattaagtcactctcactctctgctggcagtgaacccgcaagtcccacatctaagaaactcggggcttacctcattcagaaccaatttcagtctgctggtaactctagtgctcttttcctaactgctgcagctcaaaatctgctgtgtctcaaattagcagaggagcttggggtgatagttccaaacccatgggttacttggtttaaggcggctagtttacctgctgttgtttgtcttcttcttacgccattgattttatacaagctctatccccctgaaatcaaagacacaccagaggctcctgccctggctgccaagaaactggaaagtatgggccctgtcactaaaaatgaatggattatggttggcacaatgcttcttgcagtgtctttgtggatctttggagacactattggtatagcaagtgctgtagctgcaatgattggtttatcaatactcctcctattaggagtccttgactggaatgactgtttgaatgaaaaatcagcatgggataccttagcttggtttgccattctggtaggtatggcaagccagttgacaaaccttggtattgtgaactggatgtctgattatgtggcccacaaccttcggtcattctctttaagctggccggcctcactagctgttcttcaggcagcgtatttcttcatccactacctttttgcaagtcagactggacatgtgggagctttatactcagcatttcttgccatgcatagggcagctggggttcctggtgttctggcagcgcttgctttaggttataatacaaatctttttggtgcaataacacactatagtagcggccaggctgctgtatactatggagctggttatgtagaccttccggatatcttcaaaatggggttcatcatggcttttataaatgctatcatctggggaggtgttggctctgtctggtggaaatttttgggattgtattga

SEQ ID NO: 1844 - DNA, 336 bp, Glycine max
  Peptide Sequence Number=SeqID_118622
atggtgttcctctgtgtgctcctttgttgtacggtggtggggtgtacctaccaagacacttcgatgctcaagttagtggtgcagagggaaagatctaacagtctaaatggacacgttctctcatcgactagaagcttccagaagactataaaaaggcatctctttgtcttctacctttcgccgtctttttccaggatgttgtcacctgaagttcacattgatgaccctctcactatcatggtggctttgatgctgccaatgaccaagggtctaacattgcggttggtggcaccgccactattgctaacgtcgctaacaacgtccgtcccaacatag

SEQ ID NO: 1845 - DNA, 135 bp, Glycine max
  Peptide Sequence Number=SeqID_118623
atggagagcatgacaaccgagaagacatatattgatgttgatggtcaagatagaaatgcaaaagttctctttgatgaagaaaaggtgcagtttgtttctattttctatgaaatccagtgcttgctttattgctaa

SEQ ID NO: 1846 - DNA, 312 bp, Glycine max
  Peptide Sequence Number=SeqID_118624
atgctccaaccatatgggatcagcataggcttaaaggagcactcaaacccggtgacccccaaggcctacactccgaagagtccgtcagggcctctccctcctgattcagcttacaacacaaataatgtcacatcaagagttaatcacacacttattcacaaccaaaactcattcacaatttcacatctcataaagtcacaatccaccatcacatgtttcacgtatctcacaattcaacacatgttctactttacacttttactcaatctcaataacaatattataatctcaaggcatcatattattccataa

SEQ ID NO: 1847 - DNA, 531 bp, Glycine max
  Peptide Sequence Number=SeqID_118625
atggctccccttgccaaatggaggtgggatttgtttaatgagaacaaaggtagtttgcggtgtaggattctattgtttagttgggaaggtggagttggaggtggcatttttgttggagaagggagtggttcacccggaagtagatatgagactttcggctatcaacaacatcagatcctgaatgacatttggagcttgaaagtccctccaaaaattttgatgttcttgtggagagttatgaagaatgcactgcaaacaggggttgacttgaagaagagggtttggttggagtctactcagcaaatattctgtcagcgtgtcatggtgtcgggttctgcattagcaaatagaatatggcgaattttgtggtgttctatcacttgggtcatttggaattggagaaacaatgcggtgtttagaggggatcgtggatatagctggaaggttgtaggattcagtccttgtttatgtactcgagagcctcacttcatctgtagcatcttagtttatacaggaacgtgtataaggtaa

SEQ ID NO: 1848 - DNA, 726 bp, Glycine max
  Peptide Sequence Number=SeqID_118626
atggttaggtggatggctatggagaaccttatgctagaggacgctgggacattatgctctgataggatcgatgtgacattagggcataagatgtcttctttcgaccaggaggatatggcctacttcataagtttcccagggctcttcattgcaagaccgtggattgggatcgtaagaattatggccaagtttgattctaatttgtcaaaatggcataagccaagaaggctagagtcgagaaagaatcaactgagaaagctaaggctgacaaagggtaaggacttcaacccctatgctctctttcaatcctccatgctcagccaatttgaccatgatatgttgagcgaagctggtccttgcgccttcatgcattcaatcacctgcttccatgcaaggaattgggggattgctgatttttgggtcaatgagtttgaaaaggtcgatgtcaagtccaagaaggctcaaaccaaactcgccaaggctgagcaagctttggttgaggccactagggtgaatgtcaggctactgcaatcagtcaaggaatcccagaagtctcttgagagtacagggactaaattaaaaaaggtagagacacgagaagaggctttaaagtctaagctcgctacagtcgagtctttggctaaagcactccaaggagagattgagcatcttaacaaggagttttctctctttaaggtgaatgtggagaaggctgaagaatgttga

SEQ ID NO: 1849 - DNA, 297 bp, Glycine max
  Peptide Sequence Number=SeqID_118627
atggagcttacatcagtacttgtacccgaaattggcacaggtggagggcaaagaaggcctccttctgggggggaagagctattagtgagataccactctagaagagttagaattctaaccttgtgcgaggacctacgggctgagggacagtctcaagtagacaaaggccttccaaaaggtaacggacgcgtgcaaaggtttcctcgggccagacagagattgtcccttgagtgcaaaggcagaagggagcttgactgcaagacccacccgtcgagcagggaggaaagtcggccttag

SEQ ID NO: 1850 - DNA, 387 bp, Glycine max
  Peptide Sequence Number=SeqID_118628
atgtcatctttatatagaggggaatccaggaggtacaacaataaaccaagaggacgtcataatttgacaacgcagaagaagcaagagattaaggaagcctttgagttatttgatactgatggctcaggtactattgatgccaaggagctgaatgttgctatgagggcccttggatttgagatgacagaagagcaaatcaatcaaatgatagcagatgtggacaaggatggaagtggagcaattgattatgaagaatttgagtacatgatgacagccaaaataggagaaagggacactaaagaggagctcatgaaagctttccatattattgatcatgataaaaatgtaaagttcttcactgctatatacatcatttatacttcttga

SEQ ID NO: 1851 - DNA, 597 bp, Glycine max
  Peptide Sequence Number=SeqID_118629
atggaaaacgacgacgtcgacatgcacgctgccgacaccagcgaagaattggatgacatgaagaagcgcttgaaggagatggaagatgaagctgctgctttgcgagagatgcaggccaaggtcgagaaggaaatgggatctgcgcaaggttgcaaacgtagaaataaacagagcctagttgttccgtcaaagaaggtggactattcatgcactcctgaagaagtgcaacagcattttcagtcttgtggaacagtaaacagagtcaccattcgaactgataagtttggccaacccaagggttatgcctatgttgagttccttgaggtggaggctgttcaggaggcccttttgctgaatgaatctgaacttcatgggcgccaattaaaggtaacggctaaaaggaccaacataccagggatgaaacagtatcgtccccgtcggaccatcaatccttacatgggggggtttcgaggcagaaccccatatgcacctccctttatctactctccatatggatatgggttccaaggttcagaatggcaatgcgctacagcccctactattgaaagtccaattctggtaggatggactgaatga

SEQ ID NO: 1852 - DNA, 1104 bp, Glycine max
  Peptide Sequence Number=SeqID_118630
atggcggaaggtgctggaaggaagctcatggtggaggtttgcaacgcgaagaacctgatgccgaaggatggtcaaggaaccgcgagtgcttacgcgatcgttgacttcgatggccagcgacggcgaaccaagacgaaatcgagagatctcaatcctcaatgggaggagaaactcgagttcatcgtccacgacaaagactccatgccttccgaaacgctggaggtgaatatctacaacgacaaaaggacagggaaacgaagcacttttctcggcaaagtcaagatttccgaaagcacgtttgtgaaatccggttccgaagcgattgtctactatccgttagagaagaggagcgtgttctctcagatcaaaggagagctcggtctcaaggtttggtacgtcgaggacgatccaccggaaacagaaaacgccggtgaggagaaagcagagtcagcaccagcggcggaggagaagccgccggaaaaggaaaagaaagaagatgagaataaacctaaagaagaatcaaaagaagaaaaaccaaaggaggaggctacggcggaggcggcggcaccgccaccgccggaggtggagaatccacctattgcgcagacggagaagccaaagccgccgaaggaaaagcacggcgaagtgcagaagcgtgcggatctgaacgtgagcgatcacgaactgcgatctctgagaggcgatcggagctgcagtgcctacgacctcgttgatcgcatgccgtttttatacgttcgcgtggtgaaggcgaagagacctaaaccagaaaccggttcgaccgtttactcgaagcttgtgatcgggactcacagcgtgaagaccagaagcgagagtgaaggcaaagactgggatcaggttttcgccttcgataaagaaggcctcaattcgacgttgttcgaggtttccgtttggtcagaggaggtcaaagaaggggatgagaaaagcgagagttctctcggaacggtgtcgtttgatctgcaggaggttcctaaaagagttcctccggatagtcctttggctccgcagtggtacactctcgaatccgaaacctcgccgggaaatgacgtcatgctcgccgtttga

SEQ ID NO: 1853 - DNA, 1179 bp, Glycine max
  Peptide Sequence Number=SeqID_118631
atggcgaaggagtcatcggagtcacgcggctgctggagagtgttggagttttacagtggaatcggtggcatgaggtactcactgatgaaggcccaggtgaacgctcaagtggtgcaagcatttgaaattaatgacacagcaaatgatgtttaccaacataattttggtcatcgtccttatcagggaaatattcaatgtctgactgctgctgatctggacaagtatggtgccgatgcatggcttctttctcctccttgccaaccttatacacgacaaggtctccagaaggacactggtgatgctcgggcattttcttttcttcagattcttgagctcatgccatttttattgcggcctccgagtatgttatttgtggaaaatgttgttggatttgagacatctgatacgcatgcaaaactaattgaaatattggaaaaaacaaattttatcacacaggagttcattctgacccctttacagtttggaatcccatattccaggcctcgttatttttgtctggccaagagaaaactttcatcttttgttaatgagtgtctgaacagccagctgattcaatctccaccgccattatttgagcattttgacacagcggctgatgaagacgattcatcaaaagaggacaggcaaaacttgttgcagtcatgtcagcctattgagaattttcttgaattgaagaaccctagcagtgatatagctgttgaatctgtagctttaaggactgatttatctaatgacgctcctagaactttggggaaaaataatggtcatgatgaatatgaatctttggaccagtatttcgttcacccaagcttgatagaacggtggggaagtgctatgggtatccttgccttaagcttagatgttgtctaccctgattcaaagcgctgctgctgttttacaaaaagttattacagatatgtgaagggaactggttcccttttggcaactgtccagccagtgaagagggacaaaacatcactgaaggagcaatgccttagatattttaccccaagagaggttgcaaacctacattcttttcctgaaggatttgtgtttccagagcacattagtctcaggcaacggtatgcgttactagggaacagtttaagcatagcagttgttgctcccttacttcagtatcttttcactcaaccttaa

SEQ ID NO: 1854 - DNA, 480 bp, Glycine max
  Peptide Sequence Number=SeqID_118632
atggcagtctctgcctcctctatagtagcagtagcaataggctcaccccctcagctgaagagagccaatctccaggccaagccacctactggagaaattcctctggggctagttgaggtgttggtggtacctcctgtgtggctcgccctcgagtcttcttggtcctcgggaatgccacaaaagtatctgttgggttccaacaattctttcggccatgatgagaactgggaagttgagcctggacgtgttgggctgggctatctaggtgacctgagaggatatcatgttgcccaagttcatgtccatcttcataataatgccataaatgaggtgggcctgatccatgttgagataagaggtgtgggaggcaagagcaaggcagagcttagcctctatgacctggtggttaggataggtgtgaagaaactgggagtatttagggtagctctctccctcaagaaggactacaggtgtctctag

SEQ ID NO: 1855 - DNA, 144 bp, Glycine max
  Peptide Sequence Number=SeqID_118633
atgggaaatacttggagctacgggatagattttaactccatggagggattgattttgcactgctttggtgatgaggaaagaaagagcctctgcacacaatatgaaaagcccgtaagtggaccgggtaggctggtttacctctag

SEQ ID NO: 1856 - DNA, 249 bp, Glycine max
  Peptide Sequence Number=SeqID_118634
atgcaacttgggtctttgggacagtggcattgccacttctttggaaaaaagaaggtgcaaccaaaatgtttggacgacaactacctaaatcagttcaatgtgttgctttcttcatttgtcccctattcaaagttgcacaaagttgtttggatggtagcagtagaaggaggccaaaacagcttgcaagatggggggaaaacaaaaagtggtcttcattattttgaagacttgttctccgttaattactag

SEQ ID NO: 1857 - DNA, 192 bp, Glycine max
  Peptide Sequence Number=SeqID_118635
atgcatattgatcatgtcatcaaatccgaacattttcaagggttgattgatccttccttccgtcgaattccaacagaactgcaactgcaagcttgtgtgaacccaaatcttgacacggaagatggaactaaaacctcaagcacaaccacgccaatacggggaagactgaagagcctttacaaggacaactag

SEQ ID NO: 1858 - DNA, 606 bp, Glycine max
  Peptide Sequence Number=SeqID_118636
atgttcttctcctctctcctcttcacatccctagcactgcttttgtctacttttcttctcttcatgtggaagcacaaggctgaaggaattggtttcagttttgaggagaagaagacaccacaccatggaagggaaagtgttgttgctattgcaccaacccctatgcacaagaatgttgaaactattgtgacacaagcaaagggaagtgaagaagaagaacaagaagtattgtgtttgtccacttccgaggactatgaagaagtagatcacacactttctgatgagtgctcagatgggacaatttctgatgaggacagcctcatagagattgcacttccaagtggacactttgtgggtcataatcgtcatcatcatcataatcagaacaaagaagagtcaaattccaagtacaataacaaccacaactgctgcagcttacaacagaagaagagggagttatcaagtgctcatgaggcccttttcaaccaacaaagcctgatggaattcttggcagagtttaatgaaatgaatgaggaagataacttgatagagattgacatagccatgggttctatcaagtgctcaaggtttgaaatagaagcataa

SEQ ID NO: 1859 - DNA, 366 bp, Glycine max
  Peptide Sequence Number=SeqID_118637
atggttgtatttctgaacaatcctgtcgcggtggtggtggtggaggtgaaggtggaagcagaggtggaggctttgtcgaatgagtctctgctattctggtgtggagaagctctcaatatcaaagagatcgaagcttacgttgctcgcggtgttgtcgtccatgatgacgcgtgccttctggagagtgaatccatcaggggaacggccatagaggagataacgacgcggggggtctcgatcgaggtagagggggagaaggaagaactgaagcaacgaggtagaggggtgagaaggaagaatcgaagcaatggggtagagggggagtcagagagtgagagggagagtgagagggagaacgagaaatga

SEQ ID NO: 1860 - DNA, 546 bp, Glycine max
  Peptide Sequence Number=SeqID_118638
atggccgacgcactgattaggttgttttcagtagtcttgctttgcattacagcagcacaagggaaagaacagcttcactcaaacagtgaatggccaaaatctttttcagttattcgtgatactgatggtatctgcaaagtggcagagacacaaggttacacatgtgaagaacataaggctacaacagaggatggctacatcctgagtttgcagaggttgcccgcgggacagtctggtaagaaagcccacaagccaccggtgctattacaacatggtctcttttgtgatgccatagtatgggtggtcaatcctccagatgaatcattgggatttatcttggcagacaatggatatgatgtgtggcttgccaatgttcgtggcacaaaatatagccgcgggcacatatcacttcatcctaatgacatggcttattgggattggtcatgggatgaattagctaggtatgatcttcctgcttttgttcagtatgtgtacaatcaaaccggccagcgaatgcactatgcaggtcattccttggttttgtaa

SEQ ID NO: 1861 - DNA, 704 bp, Glycine max
  Peptide Sequence Number=SeqID_118639
atgggaaaatcaaagggaggacgcaccaacctgcccactttgcatttcgttgcgatgagaaggtcgtattatgttagaaccaaagcattgcgtcaagctttaggcggagttttaggaagagctttaggaagacaggatcttgagaatgtgaataatgttgcttacgagcctcatgaggagccttatgctcaaattacggaggatgtaggtggtgattcacagggtttttcagcagttgcactagtccatatgtatgacaatctgaatgttgtgtccaagcataccacaaaacatcttgtaggatatatcactcttttgcggatctatgagcatttccctacaattgcaaatattatttctaatgaggattgccatgagagaaaaccacatgcttgtcattggaagtctaggaaggcattaccaatgacctcctatcgtaagcgcttgaataggctaacgtcagatgctgttagctggatacctgatggtgatcatcgtgcattcaaagaatttgaactctccattcatccactccctactgctctatctctatccatagaggagattgacaatagatggcttcagttttctcaataccttgcatcagttggagagttttgtagttttcctagtcagtgtgcaacaagttacatggagtggttttataggatatctcagccattcatgagtctgccacagcttgg

SEQ ID NO: 1862 - DNA, 624 bp, Glycine max
  Peptide Sequence Number=SeqID_118640
atggagtatgaagatgaagattggctttgtgtcactatggatgagttttctcttgctactgaaaatggttttagcaggcaaatgatgagtaggaagaggaactatgatgatgacacaagagaatacaaatcaaagaaccttgagactgaaaggaggaggagggagaagctcagtagcaggcttttgatgctgcggtctatgatgaataaagcaacaattgttgaagatgctatcacctacattgagaagctgcaagacaaagtccagaatctcagccaagagctacaccaaatggaagcaacttcagtggaaacggcagagacaaaaatagttgaaattgatgctgtggaagatatgaagaattgggggatacaggaagaggtcagagtggcgcaaataaacgagaataaactctgggttaagatcattattgagaagaagaggggaagattcaacagattgatgcaggccctcaataattttggcattgagcttattgacaccaatctcacaaccaccaaaggatcatttctgattacaagctgcataaagtgcaagaatggtgaaagatttgaaattcatcaagcgaagaatttgttgcaagatgttatcaaccacatatag

SEQ ID NO: 1863 - DNA, 284 bp, Glycine max
  Peptide Sequence Number=SeqID_118641
tcacttcttttagataccgtaaggatcggaatggtcaatggctgaagaaagatgcccttcctccacaagttgagcatactccttctcctcctcctcagcgagatgattcagcccttatgactgaagttctttccgagttacggggtcttcgtacttatgttggtgaacgttttgactctttggataatctctttgccggaatggatatccgtctcacacagattgaagatgtgggttatattcgtcagagcttcgatcttccaccaccacctccaccttcttag

SEQ ID NO: 1864 - DNA, 294 bp, Glycine max
  Peptide Sequence Number=SeqID_118642
atgaaccaattaaagcgcctaagcatcacctcagaaatgcttagattctctaaccacgctagttacccacgtctggaccatccgacaaggtcagtgcactctacccccatggcatacacttcatacgatgtatgttcgtggccaaaagctagtactaaagaccctggaaggtcaatgcacagtgccccccacaaacatacgcaacatccaacgtatgaacgcggccaaaagctagtgtcaaagaccctggaagaaaaatcagcatgcaacagggacaggcagatatcctcatag

SEQ ID NO: 1865 - DNA, 317 bp, Glycine max
  Peptide Sequence Number=SeqID_118643
atgcccttcaccttcgtcaaatttccattccacatcctcctcttcctcgtcctctcgctgccctccccggtaatttcgcaggaccagcaaacaaccctcctcggcatcaaacgacaattcggcgaccctcccgccctccgctcatggaaatcctcgtcgccgccgtgcgcatggccggaaatccgatgctccggcggcttcgtcacggagctccacctcgccgggaaaaacatctccgccgtccagctcccggcggcgatctgcgacctcgcgcacctcgctcacctcaacctctccgacaacaacatcgccggcca

SEQ ID NO: 1866 - DNA, 372 bp, Glycine max
  Peptide Sequence Number=SeqID_118644
atggtgtggcgtctccaatcatctttcttccttctccattccgctaccattgaacttcaagaagcaaaggactccattgatgaagaagatccaaggcctacaaactccacatgggctacatcagcaatgccttttttcaatgagatgtttacccttttgggggccattgggttctggcaaataattaccatgtattttccaatggaaatgtacattgcaataaagaagatcacaaaaggagcaatgagatggcatggacttaaaacattgaacttagttttcatgttactatcagtggttatagcaattgttgtcattcatgggatgaatcaagctcttcgcaagtacaagccctgcaagtataaagggtag

SEQ ID NO: 1867 - DNA, 684 bp, Glycine max
  Peptide Sequence Number=SeqID_118645
atgccctcgccttcaaggactacacgtcctcggcttcagaggactacacgtcctcccatcagagggctacatgtcctcaccttcatagggctactcgccctcaccttcagagggctacacgtcctccccttcagaggactacacgtcctcgccatcagagggctgcatgtcctaaccttcatagggctacacgcccccacctcaagagggctacacatcctcgccattagagagctgaacgccttcaccttcagaggactacacattttcacctcaagaggactacacatcctcaccatcaaagggttgcacaccctcaccttcagaggactacacgttctcacctttagagggttgcacgcccttgcctttagaggactacagtcctcacctcaagagggctacacatcctcgccatcagagggctacgggcccttaccttcagaggactacacatcctcacctatagagggctgcacgccctcgcctttagaggactacacgtcctcaccttcagaaggcttcatgccttcgcctttagaggactacacgtcctcaccttcagagggctgcacgccctcgccttcagagggcttcacgccctcgcctttagaggactacacgccctcaccttcagagggctgcatgccctcaccttcggagggctccagatctgcgccttaa

SEQ ID NO: 1868 - DNA, 2513 bp, Glycine max
  Peptide Sequence Number=SeqID_118646
gcttggcttataacagcttcgttaaccagacgccgtttgagttcgggaacttgaagaacctgaagaccttgtggatgcctatgtgtaacttaatcggggcgataccagagagtttcgcgaatctcagtagccttgagttactcgacttgtcgtttaattttttaacggggaatattcccaacggtttgttcgcgttacggaacttgcagtttctgtatttgtaccataacggtttatcgggtgaaattccggttttaccccgttcggttcgaggttttagtttgaatgagattgatttggccatgaacaatttgaccggttcgattccggagttttttggaatgttggagaatttgacgattttgcatctattctcgaatcagttaaccggtgaaattccgaaaagtttggggctaaacccaactcttacggactttaaggtttttgggaacaagttgaatgggactttgccgccagaatttggcttacattcgaagattgtgtcttttgaagtagcgaacaatcaactaagtggtggtttgccgcagcatttgtgtgatggtggtgttttgaaaggtgtgattgcgttttctaacaatttgagtggcgagttgccacaatggatggggaattgtggctctttgagaactgttcagctttacaataacagtttttcaggtgagttgccttggggtttgtgggatttggaaaatttaactaccttgatgttgagtaataactcgttttctggtgagtttcctagtgagctagcttggaatttgtcgagactagaaattagaaacaacttgttttcgggtaagattttttcttctgcagtgaatttggtggtttttgatgcgagaaacaacatgctttccggtgaaattccaagggctttgacaggtctttctaggctcaacactctcatgcttgatgaaaaccagctctatggcaaacttccatcggagataatctcgtggggatcactcaatactctgagtctttcaaggaacaaactctttggtaacattcctgaaactttgtgtgatcttcgtgaccttgtttacttggacttggctgaaaacaacatatcgggtgaaatcccacctaaacttggtaccttgaggcttgtttttctcaacctatcatccaataagctttcaggaagtgtccctgatgagttcaacaaccttgcatatgaaagcagtttcttgaacaaccctgatctttgtgcttataacccaagtctcaacctgtctagctgcttgaccgaaaagtccgccaccccacaaaccaaaaactctaattcttccaaataccttgtcctaattcttgttcttatcattattgtgttgctagccagtgcctttcttgtcttttataaggttagaaaaaactgtggggaaaagcactgtgggggtgacctttcaacttggaagctcacctcattccagaggctgaacttcactgaattcaatctcttctctagtttgacagaggaaaacctcatagggagtggagggtttgggaaagtgtaccgcgtggcctcgggtaggccaggtgagtatgttgctgtgaagaagatatggaatagtatgaaccttgatgagaggctggagagggagttcatggctgaggttgaaattctcggtagaattcggcactccaatgtggtgaagcttttgtgctgcttttcaagtgagaattcaaagcttcttgtgtatgagtacatggagaaccagagcttggacaagtggcttcatggaaggaacagagtttcagcaaatgggttgagttcacctagcaaaaattgtttgctcctgaagtggccaactaggttgcggattgcggttggagctgcacaagggttgtgttacatgcaccatgactgttctcctcctattatccatagagatgtgaaatctagcaatatattgatggactcggagttcagggccagcattgcagattttggactagctaggatgttggtaaagccaggggagccacgtacaatgtccaacattgcagggtctcttggctacattccaccagaatatgcctatacaacaaagattgatgaaaaagctgatgtatatagttttggggtagtactcctagagcttgtaactggaaaagagccatatagtggaggacagcatgcaaccaacctagtagattgggcgtggcagcactatagggaagggaagtgcctcacggatgcatcggacgaagaaatcatagaaacaagttatgtggaagagatgatcacagtcttcaaattaggccttggttgcacaagcaggttaccctcaaataggccttccatgaaagagattttgcaagttcttcgcgagtgttgttatccttcagctagtaatggacgtagaagagtgggaattggatttgatattgctctccttcatggggataccacttacgtttctagttataaggatagtaataataaggctataagcgaaaatgaagaaagctgcttatatagtgtgtaa

SEQ ID NO: 1869 - DNA, 352 bp, Glycine max
  Peptide Sequence Number=SeqID_118647
gctgatgaaggtaaagctgagaagaaggtggaggaacataaacaacagctggcagctgagccggcactagaaccagtttctgattttgttgaacttgaggaagttgtggaagatgaagatgaccaacaggagagagagacaccaataaaagatagtcaagaaggaataaagatgaaggaagagcaaggaaaagaaaaagaaaaaagagagattacttcagctgaaggcaaggaagtaccatatccattggtaccttccaagaaggataaagagcgaaacttagccagatttcttgacgtcttcaagaaactggatgagcacgaagtctgccataaagaatttggaagtccaa

SEQ ID NO: 1870 - DNA, 1152 bp, Glycine max
  Peptide Sequence Number=SeqID_118648
atgaatggtaaacataaaactggatcacggagaaagaatgttcctttccccgcaaacactagtacaactcgttgccttttttcttctaagatgaatagttcaaagcgtgctggggaagcaaaatttacctgcagtggttgcgaacgcaagtttctattacctacaatcacaaatgcataccgttgctataaatgtgatagtgtcgccaattcaactttaggttctgagcaatcaaggaaagacagtggagtctgcaaacatgatcaactgaataatgcttacccaaatggagctttgctgccaccttcagctagttgttccttgtcattatccatgacgatgggtaacaagcgtgcagttatatgtggagttacatacgggaaaaggaaattcaagctagaaggaaccattaatgatgttaataacatgaaaaatctacttcttgataactttaaattcccaattgggtgcatacgtgtccttacagaagaacagaaggatcccaatttaattccaacaaagaagaacatactggattccttaaattggctcgtgaaggactgccagtcagaggactcattagtcttctacttctcaggacatggtttgcaacaaccagaagatcgcaaaggagatgaaattgacgggcttgatgaaactatttgtcctgttgattttttgagagaaggaatgatcactgacaatgaaataaattctatcattgttcaaccactcaagcaaggtgtcacacttcatgctattattgatgcttgtcatagtggaacaacacttgatcttctgtatctttgcaaaaaagaaaaaggcagttggaaatggaaggataacaaaccacctcatagtaaagaaactatgacaacacaaacaaatggtggacttgctatttgcctcagtgcttgtgaagatggtcagatggctgctgatactgcagcttttgatggaaacaggtttaacggtcttgtgacctatcttttctcacaaataattagagataatcctgaaataacatatggtggtttactagaaaagctacatcaggaaattggaaatatccatcaaagcaaattctccaacagcatcttgaaacgtatttttcaccgaaaaattgatcaggtaggcttccgtcttctttag

SEQ ID NO: 1871 - DNA, 386 bp, Glycine max
  Peptide Sequence Number=SeqID_118649
tggtggaggatgaggtcaactgtaaatttgacgtcgttatggttgatttagattcgagcgacgtgaggaacggtgtaagatctccgccgttggaattcattagaaaggatgttcttcttgctgctaaattagttctttgtgagtttgggattcttgccattaatgtcattcctcctagcaggtccttctacgacaacttggtgagtcattttcaggaagtttttcatgagctgtacaagatagatgtagggaatggtgaaaattttgttcttattgccacagcttcacctctggtgttttcagttgaggattgtggtaattcttttcttatgcgactgaaatcagttattccggaagcattcataaattccataacaaagatataa

SEQ ID NO: 1872 - DNA, 765 bp, Glycine max
  Peptide Sequence Number=SeqID_118650
atggatgccctcattgaaattgctcagaactctattatggaggatactgtcactgaaccccatagttcagctaaactgaataggattcctggttcagatgctgttggttacttagatcaagatggaaactctgagtctccagtcagtgaacagcaaatggaagatagcatgactggaaaaaatgtggatcatgatttggatgaaaaagtagaggaaattgacgatgataaccatgcgattgatgtaaaagatgatgtgccattgactattgaggaactggatcagtctgggatggatttggatgacaattctcaaaactgtttacttcctttatctaaacatcacataataccagaatctgaaaagagtgaaaattctgtatgtgctaatactaagggtcaatttatacttgatgaaggcatcagtaacaagagtgagttggaatttagtttaaatggcttgaaggatgtacctgttactgttagcactaatgtccaagagatgggaggaaaacagttttgcagtgttgatcatgaacatgataatgtcaaggggttccaggaattgagatttgatgaaatagatattgttgaaaatcagcttacaactgtgtgtgtatggtgtggaatagagtttgaccatgatgctgttaattctgaaatacaaccagattctgttggattcatgtgtccagcttctaaggcaaaaatctctggtcaagtcaatgtgttggactgtggatccccgaatgctggctgtctatag

SEQ ID NO: 1873 - DNA, 1281 bp, Glycine max
  Peptide Sequence Number=SeqID_118651
atggataaatctagaacaacgagaaagtacgtttatattccaaaaactacacctcaaggctttgtttccccaaatattaatagttcagagcatgctggggaagcaacacctacctgctttgtttccccaaagattgatgctttgaactactacaactcgagaaaggatgttcctttcccgacaaacactagtacggctcgttgccttgtttcttcaaagattagtagttcaaagcttgctggggaagcaaaacttacctgcagtggttgccaacgcaagtttctattacctaaaatcacaaatgcataccgttgctataaatgtaatagtgtcaccaattcaactataggttctgagcaatcaaggaaagacagtggagtcttcaaacatgatcaactgaataatgcttacccaaatggagctttgctgccaccttcagctagttgttccttgtcattatccatgacgatgggtaacaagcgtgcagttatatgtggagttacatacgggaaaaggaaattcaagctagaaggaaccattaatgatgttaataacatgaaaaatctacttcttgataaatttaaattcccaattgggtgcatacgtgtcctcacagaagaagagaaggacgccaatttaattccaacaaagaggaacatactggaatccttaaagtggcttgtgaaggactgcaagtcggaggactcattagtgttctacttctctggacatggtctgcaacaacctgaatattgcaaaggagatgaaattgacgggcttgatgaaactatttgtcctgttgattttgtgagagaaggaatgatcactgacaatgatataaattctaccattgttcaaccactcaagaaaggtgtcacacttcatgctgtcattgatgcttgtcatagtggaacaacacttgatcttatgtatctttgcaaaaaagaaaaaggcagttggaattggaaggatagcaaaccaccccatagtaaaaaacctatgacaaaaacaaatggtggactttctatttgcctcagtgcttgtaaagatagtctgatggctgctgataccgcggcttttgatggaaacaggtttaacggtatattgacatatcttttctcaaaaataatcagagaacattctgatgaaataacatatgttggtttactagaaaagatacatgaggaaattggaaagattcaccaaagcaatttctgtaacagcttcttgaaacgtatttttcaaagtaaaattgaccaggtaggcttccatcttctttag

SEQ ID NO: 1874 - DNA, 294 bp, Glycine max
  Peptide Sequence Number=SeqID_118652
atgacgatgggtaacaagcgcgcagttatatgtggagttacattcgggaaaaggaaattcaagctcaaaggagccattaatgatgttaataacataaaaaatctacttcttgatatctttaaattcccaattgggtgcatacgtgtcctcagaagaacagaaggatcccaatttaattccaacaaaaaagaacatactggaatcattaaattggcttgtgaaggactgccggtcagaggactcattagtcttctactttgccggacatggtctgcaacaaacagaatatcatga

SEQ ID NO: 1875 - DNA, 969 bp, Glycine max
  Peptide Sequence Number=SeqID_118653
atgttgcccaaactctcaaaatgcatcagcttcaccgcttcgcgggactggttgtaccgtcatttgttcgcctccgcggggctccggtcggtggccaccgacctcggcgaaggaaccaccatgcattgctgggtacccaaaatgcacaagccatgcaagccaagtctcgtacttgttcacggttttggcgccaatgcgatgtggcaatacggggaacacattcggcacttcatggggcacttcaacgtgtacgtgccagaccttgtgttcttcggcgagtccttcacgtctcgacctgagaggagcgagtcctttcaggcggagtgcgtggtgaagatgatggaggctcatggggtgcacaaaatgagcttggtggggatcagctatggtgggtttgtggggtaccgtgtggctgctcacttccctgaggtggtggagaagattgttctttgttgtgctggggtttgcttggaggaggttgacatggaaaatggtttgttcagggtttccaatttggatgaggcttccagcattttgttgccacaaacaccggacaagctcagggaattgatgaagttgtcctttgtcaggcctgccaggggtgtgcctacttggttccttcaagatttcattcaagtgatgtgtacagactacattgaacagaagagagaattgcttgaggcaatactgaaaggtcggcatctttctgatcttcctaagatccaacagcctactctaattttgtggggagagcaagatcagatattccctctggagttaggacacagattaaaaaggcatatagggggaaatgctcaaatggcagtcatcaagaatgcagggcatgcagtgaacctagaaaaggccaaagagtttggtatgcacttgaaagcattccttatagattctaatactacaaagtcatgtcccacctcaccgttttctgctggggggaatattcatttttaa

SEQ ID NO: 1876 - DNA, 1391 bp, Glycine max
  Peptide Sequence Number=SeqID_118654
gtactgatactacgggatgtgtgagaattccagcagcattctgtggtattcttggctttcgaccatctcatggggttatatccaccattggagttcttccaaatgcacaaagcttggacactgttggatggtttgctcgggatccttctgtcctacatcgagtaggacttgttttacttccattgaattctgtggagctcaaaagaacaaggcgtattatttttgctgatgatctttttcaattatgtaaagctccttcacagaagacagtatatattattgggaaagctattgagaatttgtctggttatcagtttccgcagcatatgaatctttgccagtatattgcttctaatgtgcccagtctaaaggagtttagggagaaattcacacaccaacaaaatggagtttctatattgaaagctctcacttcggttatgttttatttacaaggccctgtaattgcaatttcgcatctgctcttcagatatgaattcaaaaccaatcatgaagaatgggttaaatctgtcaaacccaggttagggcgtggtatgtctgagcgtgttaatgcagccatgaatgctacacatgataatataaaaaccttgtataaagatgatggaatactagttattcccactgttgcagattatccattaaagcttaatacagagaaagggttttcttctgagtttggtgacagagcttttgcattatctagcattgctagtatttctggatgttgtcaggttgcaattccattaggatgtcacaatgattgttgtgcctctgtttcactcatctcagcacatggagctgataaatttcttcttaatacggttttggatatgtattcaactcttcaggagcaagttagtgttgcttatgctttgccactgccggatacaaatggtagtatgggaacttctgagcttttgaaggagaaggcatctcttcagggaaatgcggcctttaaaggaaggctgtggaataaggctgttgattactacactgaggctattaacttgaatgggacaaatgcgacttactacagcaaccgggcagctgcttacctagagttaggatgctttcaggaagccgaagaggactgcaatatggccatattacatgataagaagaatgtgaaggcatatctgagacgtggaactgctagagaattactacttcgttataaggaggctctaaaagaatgctggaggagaattgttgacaaggacatgtatcatagaacagccattacaaggaaatttggacgttttagttgtactcaaatcttgcactggagtgatttccagcatgctctcgttcttgaaccacagaacaagactgctagtcttgcagaaaaaagactcagaaaatcaacgagttga

SEQ ID NO: 1877 - DNA, 342 bp, Glycine max
  Peptide Sequence Number=SeqID_118655
atggtgataattaataattgtgaagacaatgctattacaagcgaaggcgccacaagtgacaacgttgatggtatggtctctcaaagagttagttcacgtttgagaaatcagcctaagaactactggggaaatgatgacaataagagaataaagagtggtacagatgaggaccataatattggagagagaaccaaactcaagaatacatgctctcattcaatcaattcgagcgacaattcacttgtgtttgataagcaagattttgaaggtattttaaagattaaaaagttgctgagagacacaaatatctatagacttcaatccgacgaggcgtataattga

SEQ ID NO: 1878 - DNA, 507 bp, Glycine max
  Peptide Sequence Number=SeqID_118656
atggggtctctgagatctaaactgacgatgttaatctgtctggttcaagcaccaggcgaggacggagttattcacgctcaccagtcaggtcacgttcacctcatcgcggcagaagccgtgatcgcagttacagccgagatcgcagctacagttttgggtgcctttggccttgctagtcgatcacgatcccctgtcagaagagaagaaagccctgttcgggaagataggtcacaaagccctgatcacaaaaatagtcctcagccctccaagacaaggaagcatagtccatcacctgaccgtagcccacagaaaagaggtgacacatctcccgacaatgataggttgagtagaagccctgcaagggaccctgaagataggggctatgacagccctaaagttaatggtcgtagtggcagccctagctgtagccccagggatgatgacaggagccccattgacgatgacaacaaccaccgccactcgccaagaggcagcgagtcaccttaa

SEQ ID NO: 1879 - DNA, 906 bp, Glycine max
  Peptide Sequence Number=SeqID_118657
atggaggactatcatgtagcaaaaatcgtcaagcttgtagggcaagagttaggactttttgctatatatgatggacacttgggagacagtgtgcctgcctatttacaaaagcatctcttttctaatatcttgaaggaggaggacttctggactgatccagccagttccatcattaaagcctatgagacaacagatcagaccattctttctcatagttctgatttggggcaaggaggatcgactgcagtgactgcaattcttattaataatcagaagttatgggtagcaaatgttggagattcacgagcagttttgtcaaggagaggggtggctgaacagatgactattgatcatgagcccaataccgagaggggcatcattgagaacaaaggtggctttgtctcaaacatgccaggcacatgcttcaatggagatttactttcctctgttgatcaaactttctggaagtatttgttcaaattctttgtttctatctctttctggtttgcaagacatcaactgttcatatctgttagctacatgcctacatcacccataataacagatacaaatgcaatttcaagtgttaataactatgtggtggatcaaggagacgttgcaagagtaaatgggcagcttgcagtttctcgagcatttggagacaaaaatctaaaatcacacttacgatctgatcctgatatacgatatgttgatattgacctagatgctgagcttttgatacttgccagtgatggtctttggaaggtaatggcaaaccaagaggcagttgatattgcacgaaggataaaagatccacaaaaggcagctaaacaactagttgtcgagtcattgaacagagagagtaaggatgatatttcgtgcattgtagttcatttcaagggatga

SEQ ID NO: 1880 - DNA, 1014 bp, Glycine max
  Peptide Sequence Number=SeqID_118658
attaatgttgagaaaagcatgtctgaattgaagggatgtgataatcttataaagaagcttcgacgagtagcaataaatgtaaataagctcgttgctgaaggacaaatatccagagcaccttctattcatcctttggacctcagctatggtctagaagccatacccattccagttacaaatgagatcgatgattctcctatcacacctatcgactttacatatatcacatctatccaagttgcaaaaaacgtgaaagttccatctagtgatgattatggctgtcaatgcaaaggaaatagttgtagaattaacaagacttgttgttttagactaaacaacatgtatccatatgttcgtcgtgggaactgtagcagattggtcggagctagagatattgtgtttgaatgtggtccaagatgtggatgtggacctgattgtggcagtagagtatctcagaagggtttgcagtaccagcttgaggtttatcgtacgtctaacaaaggatgggctgttagaactagaaatttcattcctattggagctttagtttgtgaagttgttggagtactaaagagaactgaagacttggagaatgcttcacacaatgactacattattgaaattgactgctgggaaactataaaagagataggtggacgaaagaaacgattgcctgacgaaccattgcctgcaaaaattttccttggacaaaaggatgatgagacaaccaaaaatgagccagagttctgtatagattgtagttcttttggtaatgtggctaggttcatcaaccatagttgtgatcctaacctatttgttcaatgtgttctgaactctcattatggggtcaaacaagctcgactcgtactatttgcaggaagaaacattcgtcctaaacaggaacttacttatgactatggttaccgacttgatagtgttgttgatgccgatggaaaaatcaagcaattgccatgttactgcggtgaagctacttgtcgcaagcgtttatactag

SEQ ID NO: 1881 - DNA, 2751 bp, Glycine max
  Peptide Sequence Number=SeqID_118659
atgatatgcccaaagagtcatgaggtatatattgagtttgtgggttggattcaagccggtggcctgtgtccaatgactaaaacaggaaagtgcttgtgcttgatgcagttttatgagtcaagactcaagagttgcacatctgccaacatcttaagcttttggcatgttgataaaagcactcttggtgatgaagtcccaacagattcccaaaaggtaacttctccatcgtctagccttcccacacatcatagctgtgtttcttcactgagtacagattccgtgagcccaacaaccagtttgatgtctttacatgaagatgctgattctgaggatatccaccatgcaagttctgggttgcacccattacatgagtcacaacatagtgggaatagtccattgacggaaaagattggtgctggttcgaacagttcatatcttatgcatcccttttcaggtgataatgaacagtcatcaatttctggaacggattatatccctgttgttcatggggataaatttagaggaaatgatactgcttatactgatggtcagaaaccgcatggcatggcaccatggggcactgtcttgcaaagcactgccaaattgcacaatgatccttctcttgcatcatttccttccatcctacctagttcaatgggagacgtccttgaacaagaacataccatttttggtgaccttttaatgagcaaaagtggtctcactgaggaagcagagagttctcagtctctccaatcaaattggcagattccttttgaagacaattcaggaggcatgccaatgttaacccaaacccaatcatttggtctgcaatttagatctgattatggcaccggtttactagggaacgaaactcgtaatgcaagttctgaaattgctccgatcctgtacagttttcatggtgaaccaaaagagcagcctatgcagcaaaactatccacaagagcttgaagatggacaatctcaacatgcactaaaatccaattctgcaaataaagttcctgatgaagaaactatcaactatggcttaacagtgaagagcacattattggacagagacgagagcctgaagaaggttgatagcttctctcggtggattactaaggaacttggagaggtggctgatttgaatatgcagtcctcacctggtatttcatggagtacagatgaatgccagcatgtgatagatgatacctcattgagcccatctctctctcaagaccaactgtttagtataaatgatttttcacctaaatgggcttatgctgagtctgaaattgaggtgttgattattggatcatttttgaagagtcaaccagaggtgacaacctgtaactggtcctgtatgtttggggaagttgaggttcctgctgaggtcttagctgatggaattttgtgctgtcaagctccttgtcataaggttggacgggtccctttctatgtaacatgttccaataggttagcttgtagtgaagtgcgggaattcgatttcagagagggctttgctagaaatgtagattttgcagatttttatatcagttcaactgaaatgctgcgtcatttgagactggaggattttctttctttaaagccagtggacccttcaaatcattcttttgagggtgatatggagaaaagaaacttaatttttaagctcatttcactgagagaggaggaggactattcaattaaggatgaagttactagagaattggatatatcccaacacatggtgaaggagcatctgtttcacaggcagtttaaagagaagctgtactcatggcttcttcacaaagtaactgagaatggtaaagggccaaatgtattagatgaggatgggcaaggtgttctacatttagcagcttttcttggttatgattgggccataaatccaattatatctgctggagttaatatcaacttccgagatgtgaatggatggacagctcttcattgggctgcatcctgtggcagagagcggacagttgctgtccttgtctccatgggtgcagattgtggagcactgacagatccatctcccgcatttccatctggtagaacagctgcagatcttgcctctagctatgggcacaaaggaatttctggttttcttgctgagtcttcattaactcaccacctcgaaaccctcacaatggatgatcaaaaaggtggtcagcaagaaatttcaggaatgaaggtggtgcagacagtttcagaacgatctgcaacacctgtgcactattgtgatatcccagatgccatctgcctcaaggattcacttactgctgtgcgtaatgcaacacaagctgctgatcgtatacatcaagtatacagaatgcagtcatttcagaggaagcagttaactcagtatgaaggtgatgatgagcttggattgtcagatcagcaagctctttctctgctagcttccagggcatgcaaatctggacaaggggatggtttagccaatgctgctgcagtacagatacagaaaaagtttcgtggttggaagaagagaaaagaattcttgatgattcgtcaaagagttgttaaaatccagaaaaccatccagaatgtgaggaaagaatgcagtaaagtgttctttatattgggttcttccttccatcattccatgcatttacttggtgatttggtgttgtgtcaacattcatcaaatcatgaacttgagcacttagtgggccgtaaaagcagtcgtatgtcatggcagatccaatga

SEQ ID NO: 1882 - DNA, 1791 bp, Glycine max
  Peptide Sequence Number=SeqID_118660
atgggtatatctgttgtagccatgaagttgcgccatgttgcaattagaaggctatcagttgttggcatgttcgttgcagtgatagttgttttccaatgttgttggacaacttattattctgtgttggatgctggtgggagctcagtggctttgccaattgaagtttccatttctggaacttcagaaaagaagggtgtgtttagatccacatcagcaaccaatgttatgcttaatgctacttttgtctctcattcaaaggaatatgattctgagaaagaagctgatttggaccatgaattggaatctgatgggggcagaaattcaagagagggacacattcccaataataagggttttaaagtgggaaatcataaggatgcaatttacagtttcactcagaaaagacccaagtatgctgttttgagcgcatctgatatgttgcttgctgtaaaaaaaccttcaaatgagagtagaatacaaagtgtggaaatggaatctcaaaatgagaaaccacaagtgttgaaatctcctttgtccatgtcgaaaagtaaacctaagatgggtacttcatcaacgaggagtaagttggtgtggccaacttcaataacacagatgaactctttgatgcttcagagctttaatagttctgcttctatgaggccaaggtggtcttctcgacgggacagggaactcttatctgcaaaactagagattgaaaatgcccatgccatatcaaattcttctggactttacgctcctattttccgggatgtttccaagttttcaaggagttatgaactgatggagcgcaagctcaaagtttttatctatagagaaggagcaaaaccaatattccatcaaccaaagatgagaggaatttatgcctcagaggggtggtttatgaaattgatggaaggaaataaaaggttcattgtgaaggatccccgaaaagctcatttgttttacctaccattcagttcacaaatgctaagggttactctttctaacccaaagcaaatggagcaacaccttgagaaatatgtggagctaattgcaggaagatatcgtttctggaacagaactgatggagcagatcattttcttgttgcttgtcatgattgggcctcccgaatcacaaggcaaccaatgaaaggttgtattaggtctctttgcaattctaatgttgctaaaggcttccaaatagggaaggacactactctacctgtcacatatatacactctgtgatggatccactcaaagaatgtgcagggaaacctccctcagaaaggtctgctctggccttttttgcaggaagcatgcatggttatctccgtcctatcctgctaaaacactgggcgaataaagaacctgacatgaaaatatttggtccaatgccacgtgatttggaaggtaaaaagatgtatatggaatatatgaatagcagcaagtattgcatatgtgctagaggctatgaggttcacaccccaagaataattgaggccattttttctgggtgtgtgccagttatcatatcagataattatgtgcctcctttatttgaggtattgaagtgggaggcattttccctgtttgttcgtgaaagggatgtcccaagtctcagagacatacttctctcaatcccagaagagaagtacctggcactgcatttgggagtaaagaaggttcagcagcacttcctgtggcacaaagttcctgttaagtatgacttgtttcatatgattcttcacgcaatatggaagaataggctttctcagattagacccaggtga

SEQ ID NO: 1883 - DNA, 153 bp, Glycine max
  Peptide Sequence Number=SeqID_118661
atggcccgacccggtgatgtagatgcagtaacagttaactatgatacttacaacacagttacacgagatttcgcgatcacaatatatgtagtagcctatgcctcaaaacaaaagaaagagaatgtcctttcattggtttccaataaggtctaa

SEQ ID NO: 1884 - DNA, 258 bp, Glycine max
  Peptide Sequence Number=SeqID_118662
atgtcacagttcttcgacccaaacgttcttggctctcactgtctctcttgctctggcagaagctactccacgaccacccccaacaacgtcgcctttgttagtgtcgcccaaacccttcgcctcacttcttatcctctcagtgtgaagtccgcagtgcgaaccctagctgcgaagtcttgctcgcttgcacctgcgccctcccttcctctctttgaccactcttcctcactgattctgccttcgaaagacacaaggtaa

SEQ ID NO: 1885 - DNA, 447 bp, Glycine max
  Peptide Sequence Number=SeqID_118663
atgcactatatcattgttagaattttgatgctccgttcttctaatctcgctcaagcctttgaggaggacatgattctgatgtgggctttcttgaccaattgtccaatcgactgggcccatttgattcgttaccgcatgcataaggcattgcggtctagtgcacctctaccttactctcaacttgtgactttgtttcttcgactttttgaaattcctttggattctgagccttttgtgcaagttaaacgttcctttgctattggtgtcgatgcggtaacttcctttggctactgccttcacacctatgttggtgaacgctttgattccttggatggttgcatagatgccattgatgcttgctttgaaggaatggatacccgcatcactcagcttgaagaggatgtgagttatcttcgtcggtgcttcgaccttccaccaccttcctag

SEQ ID NO: 1886 - DNA, 615 bp, Glycine max
  Peptide Sequence Number=SeqID_118664
atggatagatttctctttaaaaatgagaagccctctcaaagagtcaatctcatgctttctcataaggttgagccctttggactcaatgtcctttgctttaggggactcaaagtcctcgcctttagagggctcaaagtcctcgccttcagagggctcaacgtcctcgccttcagaggactcaaagtcctcgccttcagagggctcaaggtcctctccttcagagggctcaaggtcctcgccttcagagggctcaaggtcctcgccttcagagggcttaacgtcctcgccttcagagggctcaacgtcctcgccttcagagggctcaacgtcctcgccttcagagggctcaaagtcctcgccttcagagggctcaaagtcctcacctttagagggctcaaagtcctcgccttcagagggctcaaagtcctctccttaaggggactcaacgtcctcgcctttagagggctcaacgtcctcaccttcagagggatcaaggtcctcgccttcagaggactcaaggtcctctccttcagaggactcaaggtcctcaccttcagaagactcaaagtccttgcctttataggactcaaagtcctcgcctttgtagggctcaaa

SEQ ID NO: 1887 - DNA, 684 bp, Glycine max
  Peptide Sequence Number=SeqID_118665
atgaaagcacatttcaaaattgttactcaattagaaaataggttttcagagcttgacaagttgtattactcaatgtatggtcatgtggaaacactagctagggaaatattgcgcggggctaattctgtagagggtgttgaggccaaactgtggcagatacctgagacactgccacctgaggagcttgttaggctgcgagcaccaccaaagagtgatgtaccaatcattaacccttttaaactgcccgtggcagatggttttgtctttggttttccaacaagattgggaatgatggctgctcagttcaaggctttcctggattcaactcaatatctatggaaagcgcaaatgcttgcgtgcaagcctgctggaatcttctatagcaccagttgccaaggtgttggacaagagactgcaccgtttactgctatcactcagctggttcatcatggaatgatatttgttccaataggatacacattcggtcctggcatgttcgagatgaaggagccgaaaggtggaagtccttatggtgcaggaacttacactggtgatggctctaggcagccaactgagcttgagttgcagcaagcattccaccaagggaatcatatcgccaccatcataaagaagttcaaggaagatgctcacccaatttttactctacacaatagaggatattga

SEQ ID NO: 1888 - DNA, 1989 bp, Glycine max
  Peptide Sequence Number=SeqID_118666
atggccgagcacagaactaggaagacgaccacctatcatctcgaagatgccatcgcacgtcttacgaatagccaggcctccatcaatgaacgttacgccgacctatctagcaaggtcgattccatcctggagcacctccgcctccatgactccggccaagccgccaccactgctacagctaaccagcaccatcagcgtaacgccgttaagcttgatatacctcgctttgatggtcgtgatccgctcgggtggatctttaagatcactcaactcttccaatatcaaaacactccggaagaagatagaatcaccgtggcttctctgtatctcgacgacgccgccttaagctggtaccaatggatgtacagcaatggtctcatcacatcatggaacgccttcctcgaagctctagaatcccgatttgcacctacgtgttatgatgatccaaaaggtgcactgttcaagttaatgcaaagaggcactgtaaatgaatatttgaccgaattcgaacggttagcgaatcgcgtgataggcctccctcctccattcctcctgagctgtttcatctcaggtttaaaccctgatattcgacgagaagtccttgctctacaacctatttctctcttacaggccacgactctagctaaactacaagaagagaagctccaccacaccgtaactataccccgccattatcatccacaaatcaaagcaccgaactcaccagcaagccaaaacctccctacgtgcgtcggcctatgttataattgtgacgaaaaatggaacgcaaatcatcgttgcaaaggccgaataatgctgctcatagttgatgaacaaccatcgccggcagctgttgagctcggactcgaggaagaaccagtcactgttattcctgatccaccggaactcttgccggatcccagttgttctcatattagtttacacgcgctctccgggttaccatcctcagaaacctttcgtatctttggcgtgatcaagcacgcacgactgacctttctcatcgatagtgggagcacccacaatttcctccaaccccgaatcgcgcacttccttcgacttcaagttcaggccactcatcctcttcacgtcctagtcggaaacggctcaaccttggcatgtgaccagacctgtcctgccgttccgataaccatccagggacactccttcaccgtcaacttccatctccttcagatcagtggtgccgacgccgttctgggcattgattggttaaagaagcttgggccggtgactactaattacaccaccttcattatgaactttaatcacttgggccacgatatttcgcttaaggcagacgttactcttgggctagaaccaacttctgcggcccaactcagacgccttatcctcacgggttcagcttcagcgttttttcacttaagtctggtacccgataacatacccgacccacccacggcccgatactccatcccttccattgcatccctgctcctccgatataaccatctcttccaacctccgtcacaactaccgccaccacgtaccgtggttcatcgtattcctttaaacccttcctccgtgccggtaaatgtccgaccctaccgctatcctcatttccagaagagtgagatagagaagcaggtttcagacctcctttcagctggtttaattcgccccagtaccagtccctattcttctccggtactccttgtgaagaagaaggatgggacatggcgtctctgcgtcgactttcgcgcccttaactcagtcacgattcgtgaccgttttcccatcccaaccattgaagagctgttagatgagctgggccatgcctcctggttctccaagttggatctccggcaggggttccatcaaattctgatgcatgaagaggacgtccagaaaactgcgtttcagacccatcatggtcactttgaatatctagtgatgcccttcgggctatgtaatgcgccctccacgttctaa

SEQ ID NO: 1889 - DNA, 636 bp, Glycine max
  Peptide Sequence Number=SeqID_118667
atggttgttttaagtggtaacaattttgctacacttcccaacctcaagaagctttccaaactggtctgtttaaagttacaacattgcaagcagttgaaatctttgcctgagctcccttcacggattgacttgcaaactggtgcactaggagcaggattatacatgtgtaactgcccagaattaattgatagggaacgctgcattgacatggctttttcatggatgatgcaattgtttcaggtgttatacacatatcctttctaccatgttagtggaggtgttagtcctggaagtgaaataccaaggtggttcaataatgagcatgagggaaattgtgtaagcttagacgcatctcctgttatgcatcaccataattggattggcgttgcgttttgtacaatattcgttgtacctcaagaaacaatctcagcgatgggggtttcaggtccagatcggagatatcctgattctggtgatattccagtggatttttatggagatgtagatctagaacttgttttagacaaatcagatcacatgtgcctattctttcttgatcgagaaacgttcattgaaaaattccatctcaagcacaaatatcttggaagatttcttttgaaatatgatagaggatga

SEQ ID NO: 1890 - DNA, 342 bp, Glycine max
  Peptide Sequence Number=SeqID_118668
atgtcggccttcattcgctcatgcacctcctctatttctcccactctagcatgggtttgtactgcggggttgaaccaattaaaacaatgtggttcgtcacctattgtccaagttgtcgcaacctacccttcggtgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaaggttcgggagttgtatttacgcatggggaaggtattagcaccccacacgtccgtcacaagggacggcagcctttaa

SEQ ID NO: 1891 - DNA, 533 bp, Glycine max
  Peptide Sequence Number=SeqID_118669
atggccataatgatggaggacatgatgagcatgaagaagatcaatgcggctgcagttgctgctaccagcgctattgctaaggtggacccgactcccccatctggcctcaaccaaataaatcatccaacctcggatatggtaagcaaagagttaggaagtacgggcggtccccattttgtgcaagttcagaataagcatgccttctcaccatatggcttgcctctcaactatacaccgcccaacgtggtgcacactcctgatgagaatgtcaataactccattcccatactcattgagagccaacaacaccaagctgatcatgcacgtgtctctcaacctgtgggggagacacataaagtaccctaccacaatctagccaacttcgagcctcgcctcggatacgccactgaggggcaggaagttggtggtgtacccctaccaaacactttggagggtcctcagttttgcccacaaccacaacccttgcattttacggcgagaagagtccctcctgctatggcggaaaagaagaa

SEQ ID NO: 1892 - DNA, 1749 bp, Glycine max
  Peptide Sequence Number=SeqID_118670
atggaatttctacccattttgtcttccatttcccttttgttgtgtttggttttgtggcaaggaagtggtgaacctgttgaagataaggaggctttgcttgactttgtgaacaagttccctccttcaaggcctttgaattggaatgagagttcccccttgtgtgattcttggactggagtgacttgcaatgtagacaagtccaaagtaatagcaattaggttgccaggggttggatttcatggcagtattccacctgatactattagccgcctctcggcactgcaaactttgagcctcagatccaatgtaataactggccattttccttctgattttttcaatctcaagaacttgtcttttctctatcttcagttcaacaatatttctggtcctttgcctgacttctcagcctggaagaacctcactgttgtcaatttgtccgataaccatttcaatggcaccatcccttcctcccttagcaaattgactcagcttgctggtttgaaccttgcaaacaacaccctttctggagaaattcctgacctcaacctgtcaagactgcaggtgctgaatttgtccaacaacaacttgcagggcagtgttcctaaatccctgctaaggttttctgagtctgcattctctgggaataacatttcctttggaagttttcccacggtttctccggcgcctcaaccagcttatgagccgtctttcaagtccaggaagcatggaaggctcagcgaagcggcgctgctgggagttattgttgctgctggtgttttagtcctcgtgtgttttgtttctttgatgtttgtgtgctgctcaagaagaggtgatgaggatgaggaaacattcagtggaaagttgcacaagggagaaatgtctcctgagaaagcagtttcaaggaaccaggatgcaaataataaactggttttctttgagggatgtaattatgcctttgatttggaggatttattgagggcttctgctgaggttctgggaaagggaacgtttggaactgcctacaaggcaatacttgaggatgcaaccacggttgttgtgaagaggctgaaggaggtagccgttggaaagaaggattttgaacagcacatggagattgtaggaagtcttaagcatgagaatgtggttgagctcaaggcatattattattccaaagatgaaaaactcatggtatatgattaccacagtcaggggagcatctcttccatgttgcatggcaaaagaggagaggatagggtgcctttagattgggatactcggctgaaaatagccttaggtgctgcaagaggcattgctcgtatccatgttgagaatggtggcaagcttgtgcatggcaacataaaatgctcgaacatcttcctcaattccaaacagtatggctgtgtgtctgaccttggcctggcaaccatatcaagctcacttgccttaccaatatcacgagcagccggttaccgtgcacccgaagttacagacaccagaaaggcagcacagccctcagatgtttacagctttggtgtagtgttgctagagcttctgactgggaaatcccctatccacacaactggtggtgatgagattatccaccttgtgaggtgggttcattcggttgtgcgcgaggagtggacagctgaagtgtttgacttggagctgatgagatatcctaacatagaagaagagatggtggaaatgttgcagatagccatgtcatgtgtggttaaggatgcctga

SEQ ID NO: 1893 - DNA, 1164 bp, Glycine max
  Peptide Sequence Number=SeqID_118671
atggcaggcatgtggacctgcttgcagtacccttcatgtcattatggattgcacgaagtgcatggcctatgggctgcacatgcttttgagctcatagtaccactttgctacgatagaagtatggagatgactccatccaacgtggccatgctatgttctgctgttcatttcctggagatggaatgtgatgatgatggtcctggaacacccaacttgaaaccccacattgaaaagtttcttgaaggggttcgtttctggacttggtctgagctccttgaagcattgaaacagtgtcaaggcttgttttctttcaaagattatttggcaattctggacagaattgtggatcacttgatagagaggctagcttcaccaggcatcacaagtccaaatacatgttcctccaacaggtcaagctttcaattttcttgtgatactagcagcaataacagctggagaaataactcctctggggctacatggtggtttgaacatcttctgttcttaaagattgatttgttggataaggtcataaggacaatgatatgttatgattttgatcatggtgtggtctctaggtttctgttctactatcacaactcaagttgtcttggtgctgcacaagctgagaagattgagtctactgaggttgtaatcgatcttcttttgctgctagatttgagatcaatttcttgcaaggatttattcaatcttaatagaaccgctgttagtttgaaaatgagcagaagtttcataagcaagatagaaagtcttataggtcctctgctggatcaaacaacaattgattatctacttcttccatctccacatgggaagggtcaagcatatgatgttgattttgtcctaaggctcgtacacatatttttctttggaggcagttttgagttaacctcgaatcgacttatgagagtggcgaaaatgatggatttgttccttgtggaagttgctccagatccccatctcaaaccttttgagtttgaagcattgattacagtgctcccagatgtagccagggaatctcatgatcaattgtacctagccatggacatgtatctaaaggtaagctaccaatttgcattgttctatgattctactagtgtgcaacatagcaatccttgtgttgtatgcaagttttcactttag

SEQ ID NO: 1894 - DNA, 384 bp, Glycine max
  Peptide Sequence Number=SeqID_118672
atgcagaatgcttatgccaaatatgtcaaagagtactacattggaacttttggtgttgatgtaaagacttatgatcagaagtacttgataagaaatgctatgagtgaggacaattctgctcgattatggtggtttcaagtttgcactgaagttgcatactttcagtggctccctcaaatgatagtattcgctcctcaaaagttgacacaaagcaagttcttatccaaacaaacttcatctcctcatataccttcctacattgtcaaatgttacaattgtggcaactgttccgaggatgtcttcaatctcctttctccattgaaggtaatgcgaaaaactgcacctctcctgatgcagttcacaaagtatggcaaaagattttag

SEQ ID NO: 1895 - DNA, 1055 bp, Glycine max
  Peptide Sequence Number=SeqID_118673
atggcggcagagtcatctcgcagtagcgctaaacgcccctttatggaagaagacgacaatgaattctccaaaaagccaccggttaggtttccaaagggaaagaaagtgaagccaggagatgaagtggtggtggacaaagcaaatgttgaggagggtgaagttgacttggtgaatgctaaaactgccaccaatgctgcaaaagagcgggaaaaactcagaaggtttctaaagggaaagaaagtgaagccaggagatgaagtggtggtggacaaagcaaatgttgaggagggtgaagaagttgacttgatgaatcctaaaattgctgctgccaaagaacgggcaaaactcagaaatcaaattacttctgaactccttagtgagggcgctggaggtatcacaaacgatttatcggctgctgaagtgacatatgaggataacgagaattttgttgatgatgggattcaaattgagcctttcaacctagagaaagaaagggaagaaggttattttgatgctgcaggaaattttgttgaatatgtaagagagaatgagattaaggatgcatggcttgataatgttgaagttgatccaaaatatgctgcattaagctctgtagcaacaaatgatgaagatgagggccccccagacctttcttctaaagatattggaatcatgaagaggcgcattgcaaatgttcttgaacctggggaaacggtcttgcaagccttaagaaggttaaaaggtaacagtgatagaaaggcaaaaatgtctgctgagactaagattgtatttgaccagctaactgaggatgctatgaagctgatggagaatgatgtttatcatgaaaagcaagaggtttttgatcgtgaagcagaaggatatgagaagttagcccaggcaaattatgatatgtttgctgatgatgacgagcatgataccagtaagccatctacagatgaaaataatgcagtcagtcaatcttcttcagttgccataaattctggtcctgagggtggagcatcacaaaacgattatgtgtatgatgaatcttctgg

SEQ ID NO: 1896 - DNA, 654 bp, Glycine max
  Peptide Sequence Number=SeqID_118674
atgactgcatctgggttgagtggttgtcccacaagatgtccacagctaccttttcatcccatgggatcacgccatgcccgggttatggccttctctgtggctgggagaaataaacaagggatagcatttcgtcaagtggaaagacaacttcagttggtcaaaagtgccatggatgcttcatatggtgatatgtcaaatgattctgctgctgtttttccaagaattaatgtgagggacccatataaacgacttggaataagcaaggaagcttctgaagatgaaattcaaggagcaaggaacttcctgattcaaaaatatgcaggacacaagccaagtgtggatgctattgagtcagcacatgacaaaataatcatgcaaaagttctatgaacggaaaaacccaaaaattgacattaagaaaaaaatgagggaagtcaatcaatccaaatttgtgcaggctgtcagaggcagatttcaaactccatctacaaaattcattataaaaacttcaatagcattcttggtacttggagttttgactgtcctctttccaactgaagaagggccaactcttcagggttggagcatttggtatttcgtggctgttgggaaccttcttgatggtgtcagtaattcctcctattaccatacttaa

SEQ ID NO: 1897 - DNA, 417 bp, Glycine max
  Peptide Sequence Number=SeqID_118675
atgaggcttaatctaacattcagatatagattaaggtcagcaatggactccataaatgcaaagcttaatagaacaaaaattgaaaacccctggttcatttttagtgatttgtattctggagcacccagtgcatggttccgtcttaagtttccccatttaacatgtggaagtctggctagttctgcagttgttcttgctgtttataactacacagaatttgatcagcagattggtgagtcggcaggtcctgaatgtaaagaagcgctgcaagaaattactcaactcattgaacacaaacttgcaaccagtggaaaggaactaaaggcctcttttgatgcagctaattttcaatatggaaatccagataaagtatgcaagcctcttgttgaagcaaagaaggctggagaggacttggtg

SEQ ID NO: 1898 - DNA, 1587 bp, Glycine max
  Peptide Sequence Number=SeqID_118676
atgtctatccttctcatgctcgtgctactgtgcgcgcgctgcttatcatgcgcccaatgcggttccgttacagagatccaagccttaacttcgttgaagctcaacctccacgaccctcttggcgctctcaacggctgggatccttcaactccgttagctccgtgcgactggcgtggagtttcatgcaaaaacgaccgagtcactgagttacgcttgcctcgccttcaactcagtggccaactcggtgaccgcatttcggacctacgcatgcttcgaaggctaagccttcgctcaaactccttcaacggcaccattcctcactcgctcgccaaatgtacgctcctacgcgccttgtttctacagtacaactcactctctggccaacttcctccggcgatcgcaaacctcgccggcctccagattctcaatgttgccggcaacaacctctccggcgaaattcccgccgaacttcctctccgtctgaaattcatcgacatctccgcgaatgctttctccggcgatattcctagcactgtcgctgctctttccgaacttcatcttataaacctctcctacaacaagttctctggtcagattcctgcccgtataggagagcttcagaatctgcaatacctttggctcgatcataatgttcttggaggaaccttaccttcgtctctcgcaaattgttcctcgctcgtgcatttaagcgttgaagggaacgcgatcgccggtgtgttgccggcggcaattgcggctctccctaaccttcaggtgttgtccctcgcgcagaacaatttcaccggcgcagttcccgcttccgttttttgcaacgtctcgctcaaaacgccgtcgctccgcatcgttcatttaggctttaacggtttcacggactttgcgtggcctcaacccgccacaacgtgtttcagcgttctccaagttttcatcattcagcgcaatcgcgtgcgtggcaagtttcccctgtggttaaccaatgtcaccacgctgtctgtcctcgatgtttccggcaacgcgctctccggcgagattccgccggaaattggacgcctcgagaatttggaggagttgaagatagccaacaactcattttccggcgtgattcctccggagatcgtgaagtgctggtccctgcgtgttgttgattttgaaggcaacaagttttccggcgaggttccttcgtttttcggtaatcttacagagcttaaggttctgtctcttggtgtgaaccatttctctggttctgttcctgtgtgttttggtgagcttgcgtctcttgagacgttgagtctaaggggtaatagattgaatggtacaatgccagaggaggtgctgggtttgaagaatttgacaatattagacctcagtggaaacaaattctcaggtcatgtttctggtaaagttgggaatctgagtaaattaatggttctgaatctgagtggcaatggcttccacggtgaagttccttctacattggggaatcttttccgtctcactacacttgacttgagcaaacagaatctctctggtgaattgccctttgaaatttcagggcttcccagtttgcaa

SEQ ID NO: 1899 - DNA, 3144 bp, Glycine max
  Peptide Sequence Number=SeqID_118677
atgggttccattgcagaggaggaggcaatgtcaaacctagcaggcagtgaagagaggattcttgtttctgttcgtgtgagacctctgaatgaaaaggaactcacaagaaatgatctgtctgaatgggaatgcattaatgacacaaccatcatgtacaggaacaatctttcagctacagaaaggtccctgtatccaacagcatacacatttgatcgagtatttaggaatgacagccccacaaagcaggtgtatgaagaagcagctaaggaagttgctctttcagttctcagtggcatcaactcaagcatttttgcgtatggacaaacaagcagcggaaaaacatacaccatgagtggcataacagatttcgccatagcagatattttcaactacatagaaaagcgcacagaaagggaatttgttttgaagttttcagcattggagatctataatgaatctgtcagggacctccttagtgttgacagtacacctctcagacttcttgatgatccagagaaagggacagttgttgagagactcacagaggaaactttaagggactggaaccattttcaagaacttatttcattctgcgaagctcaaaggcagataggggagactgctctgaatgaagtgagctccagatctcatcagattctcagactgacaattgaaagttctgcacgtgaatttctgggaaatgacaaaatgagctccctttctgcttctgtgaatttcgttgatcttgctgggagtgagcgcgcatcccaaactaattcagctgcctccaccacaccggttcactgcgacgatgacccaccgcaagacgtcgacaatccaccgcccgtctcaccttcactgcacgacgtcggcggtgtccgccgcattgtcgcccaagatctgctaaatgggttgtggtttgcggttttttccggatctgaaaaaaggtgtatccgtcgttgccatggaagggaaaatcgttgcactttgatgttgtcgtcgttgtcttcatttaatgtcgctagtggttgcagtggtgtcactgtcgttagctcatgtggcggtggtgcgtgttgcgctggttcctccacgcgggatgctagtgtcctagaaagagaaagggaaaaggatagagaaggtaccaaagaaagaagggggagaaatggacatgttcctttcagagattcaaagctaacccgcatactgcagtcttcattagcaggcaatgctaaaactgcaatcatctgcaccatgagccctgcaaggagccatgttgaacaaaccagaaacacccttttatttgcaagttgtgctaaagaagtgacaactaatgcaaaagtcaatgtagtggtgtctgataagttgttggtcaagcaattacaaaaagagttggctagactggaaagtgagttgaaaaattcagggccaacccgccttaaatttgattctgcagcattgctgaaggaaaaagacctccaaattgagatgttaaagaaagaggtaatggatgtttcgatgcagcgggaccttgctcaatctcaaattaaggacatgctacaagtgcttggagacgatgggtcctcaaccgagctagacagttcaggtcatcagtatcccaaattacgtgtgcgaggttcatttgactttgaaaatcaaacagccgaacgacaaaatttatcaagttttgactgcgttgagagtgtcagatcttttgatgcatctcaatattcagatggacatagtcttagttctgatgagaactatttccaactccctgatttggaaaagaatcttccagtcaggatttcttcccctgcgctttctattgtaagtcatgatgctgcaaagaatgatttggatcagaaaagcgttgaagataatttaggggaccgttgtagggaaattaggtgcatcgagtcagatgatctaaattcaaacacacatacattctctactgcatcatctccagccgtctcaggattaactgatgttgataatacagacaaagaaaatctagatttgtgctcatctgtgttaaagaacaacaaagaagtagcggatctagttcttccttctttgttcttgcaagaacactttgttcttccctcttcagagaaaatatctccaggtctgacacaaagtagtgcatctagttccaaaaccacgaaattaaccagaagcagaagttgtaaagcaagtctcatgagatatccatcttcagattggtttgaccaggaagaaatgattcagaacgcacccccaataggaagcgaaaaagatttcacaagaagacccgagggccttcaaaggaagacttgtacacatcattctaatgccaatgctaagaggttatcatgggctggctacgcgaattctctgggaagagcttctgatgtacagaatatgaaatcctccatcgataatggaagttataaagacaattctttaccccagggaagaaacggaaagaatgatcttgaaagttcaaatctgcaagggaaccctgaggttcaagagacaggaatggagtccaaaattaatacaaagaagttcaaagatgttggtttggacccattgcaatctgaggaagaaaaacagttggaatggccttcagaattcaagcggctgcagaaagagattattgaactctggaatgcttgtaatgtttcattggttcacaggacttactttttccttctgttcaaaggagacccttcagattctatctatatggaagtagagcgaagaaggctgttctatctcaagcaaaattttgaccatgggaatcagactgtggaagatggacttacccctgaatcaagtaagaggcatcttagaggagagagacagatgttgagtaggcaaatgcagaagaagctgtcaagatctgaaagagagagcctatacattaaatggggaattcgtttgagttcaaagaatagaaggttgcacttggcccattgcttgtggtcagaaacagaagacttagagcacattagagagagtgctaccattgttgcaaagttggttggttcagtagagccagatcaggcttttaaggagatgtttgtactcaactttgccccaaggcgcacgagaaagaaatcgtttggttggacagccagtatgaagaatattttgtga

SEQ ID NO: 1900 - DNA, 1191 bp, Glycine max
  Peptide Sequence Number=SeqID_118678
atgaatatttcaattattctcaatgtggttcttctgcttgcaattatattgttattgctgctttactacaacacaaccagaaagctcaataaaatagtgaagctagggcagattcccacagtcaaagaaaaagagagtgatgatgtggaaatcagtgttgacaagaagatagaaataggagaggggacaaagatggtgacagtggaagagagaaaggaactcgtgttctttgatgataaggcaagatttcaaatgggtgaacttcttagagcttctgctgaggcactgggtcacgggatcttgggaaatagttataaggctatgctgaatgatggatctaccattgttgtaaagaggctaagggacttaaaaccactctctaaggaggaatttgcaaagatattaaatgcgattgctgagatgaagcaccccaatttgttgcctttgcttgcttactaccattccagagatgagaagcttatgctctacacatactcagagaggggaaatcttttctcccggcttcatgatggtagaggtggaaaccgagtcccattcagttggaactcaagattgtcagttgcaagaggagtggctcgagcattggtgtacctgcacctcaacagcaagttccacaacgttgtcccacacggcaacttgcggtcttcaaacgtattattcgatgaaaacgatgcagttcttgtctctgacttcggtcttgcatccttgatagcacaaccaattgcagctcagcacatggttgtctacaaatcacctgaatacgggtatgcaagaagggtgacagtgcaatccgatgtttggagctatggatcacttctgatagagcttctaactgggaaagtgtctgtgtgctcagctccaccagggaccaatggggtggatctatgcagttgggttcacagagctgtaagggaggaatggactgctgagatatttgacaaagaaatttgtggccaaaagagtgcacttcctgggatgctgaggttgctgcagattgcaatgcgttgcattgagaggttccctgaaaagcgtcctgagatgaaggaggtgatgagggaagtggagaaaatacagcaggcacccgaagatgatgatgatggatctgtggataggtccctaactgatgattccctttcaaccagcacttctatcattggagatgaaagatag

SEQ ID NO: 1901 - DNA, 595 bp, Glycine max
  Peptide Sequence Number=SeqID_118679
atggagggtggtttgtggaacaaagagttgcttctaaagtttgttgtgcttgctgtggctgttgtgaacacactgcaacggaatggcgaaaggcacgtgtgtagggttctattcgagcacatgtccacgtgctgtgtccattggtcagaccctactttagctggtccaatacttaggatgcacttccatttttgtgacgcgtctgttctcatagccggtgatggtggcactgagagaacagcagggccaaaccttaatttgagaggatacgaggttattgatgatgctaaggctaagctcgaggctgtgtgccctggtgttgtctcttgtgctgatatccttacctttgctgctcctgattctgtagttctgataatttttctcactctgcccactggacgcagagatggaatggtttcaataggaacagaagccttaagcttgcctggtcgtaatgataacgtcgcaacccagaaggataagtttttaaaaaagggtcttaacaccgaagacctcgtcattcttgctgatactctccaattcggaaagtctatgatcaagatgagcaacattggtgtcaagaccggttctctgg

SEQ ID NO: 1902 - DNA, 2020 bp, Glycine max
  Peptide Sequence Number=SeqID_118680
gattcctgaacacaagggatgggttgtccctgtgtggttcagactttgtaatggattttacaaagatagtggaaatctcaaattagataacgtgtgggatggatttggtgaaaatgatgatcatagagtgccccatgctagtgacaaacataataatcagtttgtaatacaaggagatagctgtaagaaaacacgtcttgaattacatggtatcagaaatagtgattatgtgaatagctacggtactcagggtaaagaggaattgtacttagaaaatatgattcaaaaagaaagaatgctggaaaaggattcatggtctcacacacctgaaggtgtgttttcttcatgtggtagtgactcaagcaaagaagccaaaaggctaacatcagatgacacgggcatgcccgatcattgcttcaagagcagtaatttagattctggtggttgtgagctctgtgaagatgatattatcttgggagacaagtgtgtggtggaaaatgatagtgtctgtcaatatccaaccagtcacatatcccaagttgacaatgaactcagttttcttgataatgatgggtggctggatataggagactttgaagatgttgacaggatgttaagttgtgatttaacatttggagcgggaagtctcaataacgaagaggagttttgctggctctcatcttctcatggtgctgaaggttctgatgatgcattgaagtctgacttcaagttttcatatgcagaaatgagtccattgaaaaatatatcagattataatatggattccaaggaaagtattgtaggtcttccgatcaatgatcccaaccaaagatcatctgctcttgatgaaaaaatcaggtctcaaatggatgttattgacaatggtgtccctgctccattatcaatgttcagtgagagtgattcagacatgaaatctgttaatatagatgacttgctgcccaaagaaaagggtgatttgttagatttacttggtttccaatgtaggtttaatagcaagaggaagttgccaaagccatcagcgggaaggcgaaaaaatggttacctacaaaatggtggttctgtgcatccttatgctgatccagagcaatgtgcagatacaaagcaatcctttggagcctcttccagtggggttacttctcttgatagcatccagaaacataagttgaacatagattctgattctttaggctgtatacagacacaaattcctatgacacgccctgactatagtcatgctccaaatcacacttccctctttccgactttgtctggatcaagatctgagcatgatggacatctgtctccttctcttaaagaatcatcttatgcatcaaacatggagagttcccatggtcattctttggaggctgcggccttgaaaacaaaagagaatagagaaaatccgggttcagctcagcaagtaggtcatcattttgaaaatgaaaatgaaggtcatagtgaattccgaggagttggcctaggcttttcaccagaaatagattcatcaacagtgcaggaaagctcatccatgggctctgctctggaccaagcttcacttgaagcaactagcttttgccacctgcaacagatcatggatcagttggatattaaaaccaaaatgtgcataagggacagtctataccgcttggctaagagtgctgagcatagacacaataattcaaatgcaaatggttgcattggagacgatgaaacatgcaaagcaatgatggcgcaggatgcaaacaggtgtgccggattaatggatatggaaactgacacaaaccccattgatcggtctgtagcacacttactgtttcacaggccctcagatccatcagtgttgcttcctaacgaaactttacctttcaaatccagtgccacgatgcatcatggatcagtgatcaatccaccagtgaagactgagaaacaggtctgtcaggaagattctactggagtggaaaaaaaggttttacgggcatttttgcataggatgccataa

SEQ ID NO: 1903 - DNA, 969 bp, Glycine max
  Peptide Sequence Number=SeqID_118681
atggagggacagagtttgtactcactagtgtttcttgtgcttgctctggccattgtgaacacagtgcatgggcaagggacgcgtgtagggttctattcgagtacatgcccacgggctgagttcattgttaggtccacagttcaatcccacgttaggtctgatcctaccttggctgctgggttgcttcggatgcacttccatgattgctttgtgcaaggttgcgatgcttctgttctcattgccggtgatggaactgagagaacagcatttgcaaaccttggtttacgaggatttgaggttattgataatgcaaagacacagctcgaggctgcgtgccccggtgttgtgtcttgtgctgatatccttgctcttgcagctcgtgattccgtttctctgagtggtggaccgaattggcaagtgcctactggacgcagagatggacgcatatcacaggcttccgatgtgagtaacttgcctgctccttttgactctgttgatgttcagaaacaaaagttcgcagcaaagggtctcaacactcaagacctcgtcacccttgtcggtgggcatagcattggtactacagcatgccaattcttcagtaatagattatacaacttcactgcaaatggtcctgactcttccatcaaccctttatttctttctcaacttagagcactctgcccacaaaatagtggcggttcaaaccgagtggctcttgatacgggtagtcaaaccagatttgacacatcttactttgctaatttgaggattggccgtggaattctgcagtctgatcaagcactttggaatgatccttccacgaagtcatttgtacagaggtacctgggcggcttcaaaggcttgcttttcaacgtggaatttgcaaagtctatggtgaagatgagcaacattgagttgaagaccggtactgatggtgaaattcgcaagatatgttctgccattaactag

SEQ ID NO: 1904 - DNA, 804 bp, Glycine max
  Peptide Sequence Number=SeqID_118682
atggcagggttttggaaggcgacaggaagagacaaatcggtgtatgaaagcatcaaacttattggcatgagaaagaccctcgttttctacaaaggaagagcccctaatggacaaaaaactgattggatcatgcacgagtataggcttgaaaccgttgagaatggacctccacaggaggaaggatgggtggtatgcagagcattcaagaaaagaacaacaaacggccaaacaaagactattgaacgatgggatcgaaactacttatacgatgaacaagcatgtggtagtgtcagcagcactgtggtggaccataatattgaccttatggtaaggcaacaacaacctcagaggttttcagcagctcaaaatttcctgtacaagcaagaagagatcatagaagaagaacaacatttggtgcagcttcctcagctagaaagtccttctttgccactagcaaagaagcaaagctcagtaatgtccctaatatcagagaatattattaataacgaagatattgataatatttctcaaaagggtttatcccacaacactgcaaagaaagtgactactgattggagagctcttgacaagtttgtggcttctcagttgagtcaagaagagaggcatgaattcataggtgtgtcaagctttgcaactcatcacactactactagctcggacatggcattgttgctactgcagaataatagtagggaaaatgaaaggaattacaagttcaacccgtttttgaatacaagctcaacatcagactgtgacattgggatatgcgtatttgaaaaatga

SEQ ID NO: 1905 - DNA, 593 bp, Glycine max
  Peptide Sequence Number=SeqID_118683
gaagggggtttgggcggggaagacagcccttcaacaacagggggaatttcaacaggagcaggagtttctatcgtggtgggcacagccaaattggaagaatgggttttcaggatgaccatgattttagtatgcatccagatttccgtcaaaggcaatttggtccacaaggagctgtgaggggtggacattatgcaggtagccgaggtgctgcatttgctggaccatctagaccttatcatgatagagcatggtatggtattcccgatggaggccctattgagcctattcctccaaggaggccctactccccaggtggacagtttgacatgccttctatgggaaggcattttgatgatccatatctgtatgatgacaatatgcatggaatgaaacgtccattttatatgactgaccctgagcctgattacatggggcctaatagattacgtcctcgattggattatgcagatccacctatatttcatggaactcatcaccatgattcttttggggctggcagcagacagtaccctcctgactattacggttctgacgaggatctggaattgtgggatagacatcttcaaatataa

SEQ ID NO: 1906 - DNA, 342 bp, Glycine max
  Peptide Sequence Number=SeqID_118684
atgaggatgcggctgacaactttcatttggctttgccacatagatcgaataattagactggaactcaagatagaggaaggggacaccgccacaacattttcaacgaaggttttcaacagagtgaaatctggattgaagggaggaaagaagaggtttacgatcgtgatgcattggaactccgacaccgaccggtggtgcatgatgatgatgatgatgtgtctggacacaaccaaaaaaagacagcttgtggcgttgttgccagggcattatgacctctctcttccgtacgattgttatactgttataccgccaacatcgacaagttcaacactccagagctag

SEQ ID NO: 1907 - DNA, 528 bp, Glycine max
  Peptide Sequence Number=SeqID_118685
atgcagcatggttgccctctggcttcggaaagaggcaaatggcaaatggctgcgctcgatattgtttcatcacttcccttgtttgtccattcattctctcatgtggtggaggagccacttcgtgaggcagagataggggggtgtgagatttggagaaatgggagtggacaagggttggtgggtacaagaggggaatggtggtggtacgtggtgaaggggctgtcagaggaggtagaggagccttcaaagatggagggtaaagtttttatgtggagggcaatggcacaagttggtggtttggtcatgttgcaacctgaagtgggaggttctcgtgaaaacttcttctttgctggaatagacaaagtgcggtttcgtaagcctgtgatagctggggacaccttagttatgagaatgacacttactaagctgcaaaagcgatttggaatagcaaagatggaagggaaggcatatgttggaggtgaagttgtgtgtgagggtgaatttttgatggcaatggggagtgaataa

SEQ ID NO: 1908 - DNA, 1965 bp, Glycine max
  Peptide Sequence Number=SeqID_118686
atgagaactcgaaacgccgattccgcctccaaatccgcaacccctaagaagacgccgccgaagaaatcccctgcggccaagcgcaccaccgccaccaaaaccagagccaccaagaagaacgagctctcgcccgcacccgattccaaccccgatcaatctcctctggaacagaaatcgttaggcagtgctagcagcgcaaaatctgtgaaaaagaagactccggggagatcgagaagtaaagcaatcaatactccgaattcggaagaacaatgtgaggcagtagctgatgaaactccaattgaagatgataccgaggtagcagagaaagtggaagatgttggagtggttgatgcagataatgttgagggtgagaaggaggggggaaaaggtgttggttctgttggattgtctgatgagacggatcgtaagtcgatggaagtggatgaacttgttcaaaaggtttgtgaatctgtgggaaaggaaaatgatgtaatggaagttgaagtagctgcttgctgggatgcttctgtttcttttaggcgaccagggcgacctattgtggatctcaatatatctgcggataatgaagattgtactggtgaaaaggagggagagaaatggaaggaagagttgaaagatcaagagggggacaaagggaaggaagagttgaaaaaacaggaaggagacaacgggaaggaagagttgaaagaactggaaggagagaaaggagaggaagagttgaaagaactggaaggagaaaaaggtgaggaagagttgacagaactggaaggagagaaaggaaatgttgaattgaaagaacagaaaggagacaaaggaaaggaaaagttgaaagagcaggagccagagaaagcaaagggagaggaaacaaacctttttggacatgaagagaactctgagtcttttggtgtagaaggtgaagcccagatgcaaaaagaagatgctaatcctattaaagatggcggtgaaggaccaaagattggtgaaaattcagatcttggagaacaagggaaggtggagcttgttgaagatccagaagaaaaccctgaagaagatccagaggaacctccagaagaaacttcggcattggaggaggagcatagggaattggaggctattgcaaatcagagaaagattaaaaaagaacacgagatttttgttggtggattggatcgtgatgctacagaggaagatctgagaaaggtttttcagaggatcggggagatagttgaagtcagattgcataagaattcttcaacaaataaaaacaagggctatgcttttgtgaagttttctgataaggagcatgcaaagaaagctttgtctgaaatgaagaaccctgttatacatggcaaacggtgtggcactgcacctagtgaggataatgacacattattcttgggaaatatttgcaatacttggaccaaagaagctattaaacagaagctgaaggattatggtattgaaggggttgaaaacattatgcttgtcccagatgttcagcatgagggcttgagctggggctttgcattcctagagttctcttgtcatgcagatgccatgcttgcatataagaggcttcaaaagcccgatgttatgtttggccatgctgagcgaacagctaaggtagcctttgctgaacccatacgtgaaccagacccagagataatggcacaggtgaagtctgtgtttattaatggtctccctccacattgggacgaagatcatgtgagggagctgtttaaatcttatggtgaagttgtaagaattgtgctagcacggaatatgtcttcagctaagaggaaggattatggatttgttgatttttctacacatgaagctgctgtagcttgtgttgatggcgtaaataaatcagaattgggtgatggggcatcaaagaattattctttccattgcttacccttctgctggttttcagcaatgtag

SEQ ID NO: 1909 - DNA, 1966 bp, Glycine max
  Peptide Sequence Number=SeqID_118687
atggctatttccggctcatctagtgaggacgatcttactccaccaccaccaccaccttccttgtctcacatcacaatggcccaataccaacaattgatgaatcttctcagcaaatcctctggacctggtgacccaatttcatatacgctacctacaccaccccaatttaccccatccacacctatcacaacaaacactgaaccaacaattcctcaacccaatggctcaccatcacctttcccaaatccttcaactcctcctacaatcgacacaccaaatcccaacatcattgatcaacacatccaagaaccaccatctaaccatgctttaccacgtcgctccaaccgcgacactcatcctccttcttacctttctgattatcaatttcaaattccttccctcaagtctgctcaatcatcatcaacatgcacatatccaattcagagtttcctctcatacactcatgtctctccttctcatcgcgatttccttatgactctgtcatctgagcacgaacccaccagttttcatgaagctgtgaaacatcaatgttggcgtgatgccatgaaatgtgagatcaaggctctacagttaaatcaaacctgggacattgttcaaaccccttctcatgtacgaccaattgggtgcaagtggggcatagattactttgaaaccttctcccctgttgttaagatggccactgttagagttgttcttgctctagcatcgattaatcgatggcaccttcatcaattagatgttagcaacgctttcttacacggggacctcaaggaggatgtttacatggagatccttcctagcttgcttggttacacatcaagtcagagttgcaaattgaagaaatcactttatggattaaagcaatccagcagacaatggtatgaaaaattatctaatctattgctgatttgtggttattcaaatgcccatgctgatcatagtctattcatcaaggctcataattctgaatttactgctttaattgtatatgttgatgacattgtgctgaccggtaattcccttgctgagattgaacacattaagcatattcttcacactaattttcacattaaggatttggggaaacagaaatattttttggggattgaagttgcacattctgataaaggaatttcattatgccaacgtaagtattgtttggatttactgaaagattcaggtatgcttgggtgtaagccatcctccactcctatggatagttctcttcgactccataatgattcctctggttttcttgatgatccactatcttatagacgcctagttggaagactagtctatttgacaagcacacgccctgatattgcctttgctacacagcaactaagtcaatttatgtccaaaccaacaaaagcccatcatgctgcagctatccgcgttcttcgatatctcaaagggtgtccaggcaaaggcttattttttccaaggacttgctctcctcatctacttgggtttagtgatgttgattgggcaacatgtattgactctaggcgctctattactggttattgcttctttataggcaattcgcttgtttcatggaaaaccaagaagcaaactacagtatcacgttcctcttctgaggctgaatatcgagcacttgcttctgcaacttgtgaattactatggctttcttaccttctaagagatctacgaattcccctttccaagagtcacgtactttactgtgataataatagtgctcttcacattgctgtcaatccagtctttcatgaacgcaccaaacacttggacattgattgtcatctagtctgtgaaaagtcccaagctggactcatgttactgctcccagtcccttcttcaaatcaacttgcggatatattcacaaaggctgtccctcctcaatccttcaacacctatctttccaagctgcagttacaaaacatttttgcacctccagctt

SEQ ID NO: 1910 - DNA, 2490 bp, Glycine max
  Peptide Sequence Number=SeqID_118688
atggccattcccctatctctcatgctagtcatagccatgctttttctcttctcatccaaaatttcctccgaatctgacaccctcactcagttgcagccacttcacgatggagccaccttggtttccaaagaaggaacctttgagttgggtttcttcagcccaggtagctccacaaaccgctacctaggaatctggttcaaaaacattccactaaaaaccgtcatttgggttgccaaccgcaactacccaataatcaacaagaacacctccacctacaccaacaccaacaccaagttaaccataaccaaagatggaaacctcacccttctcaccgcaaacaacacccatcactggtcaacaaatgcaacaacgaaatcagtgaatgcagtagcacagctcttggattcaggcaacttgatcctaagagaagaaaaagacaacaccaattctcaaaactacttgtggcaaagctttgactatccttcagatacacttttaccagggatgaagcttggatgggaagtaacaacagaggctcttaatcttaataggtatctcactgcatggaacaattgggaagacccatcttctggtcaattcgcttatggcgtggcaagaagcagcatccccgaaatgcaactatggaatggctcatcagtgttctacagaagtggcccttggaacggctttcgattcagcgctacacccattccaaaacaccgttcattggtgaatcttaattttgtggacaccaccaaagagagttattatcagattttcccgaggaataggtcattgcttataagaacggttgttaaccaaaccgtttccactcttcagcgcttcttttgggatgaagaaagccaaaactggaagctggagttagttattccgagggatgatttttgcagctataaccactgtggctctttcgggtactgcgccgtgaaggataactcctcagtgtgcgagtgtttacctgggtttgaaccaaaatcgccttggactcaagggtgtgtacatagcagaaaaacttggatgtgtaaggagaaaaataatgacggtttcattaagattagtaacatgaaggtccccgacacaaaaacatcatgcatgaatagaagtatgacaattgaggaatgcaaggcaaagtgctgggaaaattgttcttgtacggcttatgctaattcagacatcactgaaagtggaagtagttatagcggctgcatcatctggttcggtgatttattagacttgagacagattccagatgcagggcaagatctatatgttagaatcgatatcttcaaagtagataaatatggatcaaagaaagtgatggttgttgtcgcaagcattgtttcatctattattgccatgcttgtagtattgaagtttgtttactggagaaataagaccaaatttagaagcgaagtgatcatcaagacaaaaggaaaaacaaatgagagtgaagatgaagatctagaactacctttgtttgactttgactttgatacaatagtatgtgctactagtgatttctcaagtgacaacatgcttggccagggtggttttggtcctgtatacagaggcacattaccagacgggcaggatattgcagtcaaaaggctttcggatacatctgtacaaggactaaacgaatttaagaatgaggttatattatgttctaaacttcaacatcgaaatcttgtcaaagtccttggctattgcattgaagagcaagaaaaattactcatctatgaatacatgtctaacaaaagcctaaacttctttctctttgatacttctcaaagcaaacttctagattggccaaggcgattagacataataggcagtatagctcgaggacttctttatcttcaccaagactctagattgaggatcatacacagagatttaaaatcaagtaatattttgttagatgatgatatgaatccaaaaatttctgattttggattagctcgaatgtgtagaggtgatcagattgaagggactacaagaagagttgttggtacatatggttacatgtcacctgaatatgcaattggtggagtgttctccatcaaatctgatgtctttagcttcggtgttatattactagaggttttaagtggaaagagaaacaaagagttttcctactcaagtcagaactataatcttattggacatgcatggaggtgttggaaagagtgcatcccaatggaatttatcgatgcttgtttgggggactcctacattcaatctgaagccttacgatgcattcatattggtcttttatgtgtgcaacatcaacctacagatagacccgataccacatctgtagttacaatgttaagtagtgaaagtgttttaccacaaccaaaaaagccggttttcttaatggaaagagttttagttgaggaagattttaggcaaaacatgaattctccaaccaatgaagtaactatctcagagttggaaccgagataa

SEQ ID NO: 1911 - DNA, 2493 bp, Glycine max
  Peptide Sequence Number=SeqID_118689
atggccattcaactacctttaatgcttctcatagccatcctacttcttctcttctcatccaaaatttcctctgaaacggacacactcacccagtttcagccactttctgatggaacaaccttggtttccaaagaaggaacctttgagttgggtttcttcagcccaggtagctccaccaaccgctacctaggaatctggttcaaaaacatcccagtaaaaaccatcgtttgggttgccaaccgcgacaacccaatcaaaagcaacaccaacaacaccaacaccaagttaaccataaccaaagatggaaacctcgtccttctcaccgtgaacgacaccgtccactggacaacaaatgcaacagaaaaatcgttcaacgccgtagcgcagcttttggacacaggcaacttggtcctaatagatgagaaagacaacaactcccaaaactatttgtggcagagctttgactatcctacggatacacttttaccaggaatgaagataggatgggaagtagcaacgggtctcaacaggtacctcacttcttggaacaattgggaagacccatcttctggtcacttcgcttatggcgtggcgagaagcaacatccccgaaatgcaaatatggaatggctcatcggtgttctaccgaagtggcccttggagcggctttcgattcagcgccacaccgacattgaaacgccgttcgttggtgaatatcaattttgtggacaccaccgaggagagttattaccaacttttcccgcggaatcgctcgctggttataagaacggttgttaaccaaaccgttttcgctctacaacgcttcatttgggatgaagtaactcaaaactggaagcttgatttgctcattccgagagatgatttttgcggctacaaccaatgtggctctttcgggttctgcacggagaaggataactcctcagtgtgcgggtgtttgcgggggtttgagccaaaatcgccacaaaaccggggtgcaaagaatagcactcatcaagggtgtgtgcaaagtagtaaaagttggatgtgtagggagaaaaatattgacggttttgttaaaatgagtaacatgaaggtggcagacacaaacacatcatggatgaatagaagtatgacaattgaggaatgcaaggaaaagtgctgggaaaattgttcttgtacagcttatgctaattcagacatcactgagagcggaagtggatttagcggttgcatcctttggttcagtgatttactggatttgaggcagtttccagatggagggcaagatctatatgttagagtggatatttcccaaatagataaagatgctaaagatggatcaaagatagcggtggttgtggtcgcaagcattgttccgtcaattattgctatacttgtattcacgttcttttaccggagaagtaagaccaaattccgaagcaaagtgatcatcaagacaaagggaaaaataaatgagagcgaagaagaagatctagagctacctttgtttgattttgagacaatagcatttgctactagtgacttctcaagtgacaacatgcttgggcaaggtggttttggccctgtatacaaaggcacgttaccagacggacataatattgcagtcaaaaggctttcagatacatcggcacaaggattagatgaatttaagaacgaggttatattttgttcaaaacttcaacatcgaaatcttgtcaaagtccttggctattgcattgaagagcaagaaaaattactcatctatgaatacatgcacaacaaaagcctaaacttctttctttttgatacttctcaaagcaaacttctagattggtctaagcggttaaacattataagtggaattgctcgaggacttctttatcttcaccaagactctagattgaggatcatacatagagatttaaaatcaagtaatattttgttagatgatgatatgaatccaaaaatttctgattttggaatagctcgagtgtgtagaggagatataattgaagggaatacaagcagagttgttggtacatatggttatatggcacctgaatatgcaattggtggactattctccatcaaatctgatgtctatagttttggtgttatattgcttgaggttttaagcggaaagaaaaataaaggattttccttttcaagtcagaactataatcttattgcacatgcatggtggtgttggaaagagtgcagcccgatggaatttatcgatacttgtttaagggactcatacattcagtcagaggccttacgatacattcatattggacttttatgtgtgcaacatcaacctaatgatagaccgaatatgacagctgtagttacaatgttaactagtgaaagtgctttaccacatccaaaaaagcctattttctttttagaaagggttttagttgaagaagattttgggcaaaatatgtataatcaaaccaatgaagtaactatgtcagagatgcaacccagataa

SEQ ID NO: 1912 - DNA, 366 bp, Glycine max
  Peptide Sequence Number=SeqID_118690
atggattggacaaaaggatgcacgcgtattgaaccgtggagttgtggtgtcagaaacaaagatggttttcgtagatatgctgggatgaaagtgccggatacgacacattcttggataaatgcaagcatgacacttgaagattgcaaggccaaatgcttggaaaattgttcttgcacagcttatgcaaacttagacacaaatggaaagggaagtggttgtgctccatttgtatatgcagatgctaaacataataagcatccaaaaaaggtagttttggtcgttgtagtcatagtttcggtagtccttctgatgctattggcatgctattacattgacattaacagaacaaagtataaagtacagtaa

SEQ ID NO: 1913 - DNA, 291 bp, Glycine max
  Peptide Sequence Number=SeqID_118691
atgaagagggtccttagtaagtgtattgtggaggagcaagcaacattcatagaagagatacccataatggataatgtgttggtgttgactaagcttatcaacaaggtagtggctcatgtacaagtgcatggagtcaagatctgtaaggaagctccaataatctcacatcagccttttgcaaacgattgcttcttattcttttatgcaaattcacaagaaattgagatgatgaacgatatcttaaagtcctatgatgaggctatagaagcaaagcttccaagattattttga

SEQ ID NO: 1914 - DNA, 501 bp, Glycine max
  Peptide Sequence Number=SeqID_118692
atggtatatcaacagaggaggaagatgaaggtgaacaagaaaatttggagcttcctttcttttgatcttgctacaataattaatgccactaataacttcttaaatgacaacaagctcggtgaaggtggtttttggccagtatacaagggtactttgctagacgggcaagagattgcagtcaaaggctttcaaggagctcgatctggacaaggattgaccgaatttaagaatgaggttatattgtttgccaaacttcagcatctaaatcttggttgttgcatcgaaggagaggagaaaatcggttacatggcgcctgaatatgccattgacggattattctccataaagtcagatgtatttagctttggtgtattattgttagaaatggggagtagcataaacaaaaatatagaaattaatgttcctatgaccaaactgaacgtagtaattgcattgaataggcatagagattgtggaaagatggcactccagagcaattga

SEQ ID NO: 1915 - DNA, 450 bp, Glycine max
  Peptide Sequence Number=SeqID_118693
atggatttcacagcggagaagaaggaatcagagagcaaaaccgaaaatgctcatccaacaacgttagattcttcttctcaattggcatcggcacttgattccaacaacaaagaaatcgaagaacgacaagctcgtgaactcaaagccggtcttcaccccctcaagggtggctctggagcaaatgggactataactgggaaggcttgccccaaagggttgtacggtaccttttgtgagtttcacgactctaaggaggttttcctctcctgtcacttcaatcttcagagcgccgacacaattgaagccagatgtacgctccacagcttcaagagctacacgaagctcgatgctgtcgaaaatgacgatatctcttccaccggcgccttcaatcctgatagagttgttgaagatagtggaaagcaggaatctctggaggcattgacctcacag

SEQ ID NO: 1916 - DNA, 150 bp, Glycine max
  Peptide Sequence Number=SeqID_118694
atgtggcgtcttaacaagcataatggtcgacaatctattgagatggtgttgatgaaccatatgggtgtgatggaagaaattggagacctagcagctagaatgttaacttctaaagcaactacacatattacaatatcgagagataactga

SEQ ID NO: 1917 - DNA, 246 bp, Glycine max
  Peptide Sequence Number=SeqID_118695
atggcgggtgctgctcccaaacaattgttcggattcggagttgtggcgatgctcgccactctcattcttgctctctttatgcccgccgctgttcaggctcaatccgcatcccctgcacctgcacctactagcgacgggacctcccttgatcaagggatagcatatgtgttgatgctgctggctctggaacaaatgaggcgtgtcatcgtttcctatgcagatgcagggttgtgttcacggctatga

SEQ ID NO: 1918 - DNA, 261 bp, Glycine max
  Peptide Sequence Number=SeqID_118696
atgattggttgggatatcgaaaggaaagaagagtaccttggcgaggacgcagtggcgcaaggaatgcaaaaggggaaggcatttgtcttcttcatatggagagtgagtgacgcaattgagaagagcgagggcttcttctgcacacaccggtttcgctttactttcttccatcctcgctttttagtgagggtaattcctaaggcggcaattagttttttgctaaaccacgggccacgaccatttattactcctcttctgtag

SEQ ID NO: 1919 - DNA, 1353 bp, Glycine max
  Peptide Sequence Number=SeqID_118697
atggaaattgagcactacaggagggagatcctacaatctgaagtgattaatggaatccatgaggtgtactgtgaggaattatcatcaagtctcaatcaagatgatgcagaatcagaattgctattgcatttcctcatctcactaaaagagcagaagcacatggatgccaacaaattggcagaagaaatcagatgcttagaatcagatgtgaaagaggtggagaggagacatgacttgagaaaatccttgcttccctcaagcttgcagaatgactcctctcttcaaatagagaatgtatctcttaaagaatccataatttctaatgcaaatgaactgagattgatgaaaattataccccgacttgaaagtgcttacttttccatgagatccaaaattaagcttcctgaaacagatactgcaactcacccagataaagatatactgataaatcatgacaattggtgtggagctcaaaaagacatggaacaacataaagcgacagatgctttaggagctttctttgacagtttgtgcaagtatgcacgttatagcaagtttgaagtgcggggcatactaagaaatactgattttaataatcctgcaaatgtaatatgctctctgagttttgatagggatgaagattactttgctgctgctgggatatcaaagaaaattaaaatatttgagttcaatgcacttttcaatgattccattgacatccattatcctgtagttgagatgtcaaacagatcaaggctcagttgtgtttgctggaataactacatccagaactatcttgcctccacagactatgatggtgctgttaagctatgggatgctaatacaggccaagggttttctcgattcaccgaacatgaaaagagggcttggtctgttgatttctctttgttatgccctactaaatttgccagtgggagtgatgattgttctgtgaaactgtggaatatcaatgagaaaaacagtttagccacaatcaggaatgttgctaatgtctgctgtgttcagttctctactcattcctctcatttgctggcctttggatctgctgattactcagcatattgctatgatcttcgcaatcttagaaacccttggtgtgtgttggctggccatcgtaaagctgtaagctatgtcaaattcttggactctgaaacacttgtttctgcatcaaccgataacatgttgaagatctgggatctcaataaaacctctcctgtgggtccatcaactagtgcttgcagcttaaccctgtctggacatactaatgagaagaattttgtgggtttatcagttgccgatggatatatagcatgtggttcagaaacaaatgag

SEQ ID NO: 1920 - DNA, 566 bp, Glycine max
  Peptide Sequence Number=SeqID_118698
atggcggaagcacttataatttcatccaagagacactcatttctcaccttgggctatcttcatgagaaacacgaccattacgagtcatggttaggaatggttagcatttggaatgcatgcgctagttctctcggtccggtcctcattgattacaacaccttgtgcatgaaattcttgtatgatggtcatctggtggaacttaaggccctattccaatcaccgtctagtctaccatcggcgcgagagactgatcatcatattcatttgcttccacatgtgactccggtcgacgtgtggccatatcgctacccccattaccagaagtgcgagattgaacttcaagttgaagccatgttacagaaagggctcattcaacccagcaccaaccctttttcctccccggttttattggtcaggaagcatgatggatcgtggcaattttgtgtggattatcacgccttaaattccatcatgatgtgcgaccgattccccattcctactatagatgaactcctagatgaactgggacaagctcgttggttcttgaagttggacctattacaaag

SEQ ID NO: 1921 - DNA, 384 bp, Glycine max
  Peptide Sequence Number=SeqID_118699
atggttcttttcgagaagcttcttatgaaaggtgagagaagagacacgggaggcaatggccatggagattatcttttgggaagctgctggcatgggtctattggtatcatcaatagaatctccacagggaggtcgagatccaccattgaatcattgtcctccgccatcaaactaatccatggtctagagagagagatggttggagcattgacatcggttgatgttagctgtggcttcaactacaatcctcttcgactctttgtgaagagtgatagaagaacaccaaacacaggggcaattacaagggaggatgcaagggtgcaaatagaaagagaagggaaaagaaaaatcacaaaacctgcttacctgtgggattatgtgtga

SEQ ID NO: 1922 - DNA, 1407 bp, Glycine max
  Peptide Sequence Number=SeqID_118700
atggacgaagaattggaggttggtgagggtgtgcaacatcaaaccaaagatgatggattttcactaaaccctgaattccccaaaatattaaaaccccaagaaatatacacttcctattcccacatctcacaagataagaatgtggttgaagcaagggagcatctgcacccaagtctattttctgatggtgctggtgccatggttgaagaactaacagtgaaaagttacaatggttctagactacatattggtactttgaacaatccagggcctttgcataatagccggagtcaatggcggcatatttatcaaccggttggtgattcaggcatgggaagtgattgcataatagccagaaagagtgttgaggctacatctagtgcttgggaggatattgggtccacgtcttttcgagacatgttagatagaaaaccagtcaatgatgaacagggccatgtcatgcagcacctgtccactgacgtgcataccgctgaacataaagaggatgaaggtcatgctcacgaaggaatacaaacaaaagttatacacaaatcaggatttgcagagtattctggtagaagtacattgaagggaaagggtgttgtatgtaaaggtccatcttctaatggcttatatattgagtctagagatcagaacccgataaagtctggtattgacactcagatggattctaatgcattgccgagctcaggtttaaagactgcaaagtctcctcataatgctacagggccaggatctggtgggtctgacactgatggtgtgactttgagagaatggttgaaatctaggcaccacaaacggagcaaaacagatcatttaagtatatttagaaaaattgtggatttggttgatggttctcacttcgagggagttgcaatgcgcaatctgtacccttcttatattaaattgttgccatcaaaccaggttatgtaccttgggttgcctgctcagaaacagacattagatagtgttgcaaattctgaagttcttcagctagataattcttttattagaaaaaggctgtcagagacggtaatatctccctctcttaatttgcaattgaagaaacagaaattcaatgaaaatgctagagttgctggtgattggagtcaatgccctcctaggactgacttgtatcttcaaattgccaatgatattaaagtcaatgcagtgggatcacaagattattacaatgaatacaaggaagatatccaattttctaaacataatattgggagaatgtctcgcatccctcacatatctagtgcaggtcaattgcaattgacttctttaaatgaaggattggaagataaatggtatgcaagtcctgagggtggttgcacaacatcatcaaatatctactgtcttggagtccttctttttgag

SEQ ID NO: 1923 - DNA, 213 bp, Glycine max
  Peptide Sequence Number=SeqID_118701
atggaggaagagaaagagacgatactacaagtaccagtggaagaagtggtggaggataatgaagcatggttggctggaaggattctaactcaagaatctttcaataaaggtgaagaaggggatcaagattcgggaggtggggaaaatcctattcatttttccttttttgtcgatatggtggataggggggaggttttgagcagaagcccatga

SEQ ID NO: 1924 - DNA, 508 bp, Glycine max
  Peptide Sequence Number=SeqID_118702
atggcccttgcagaagcaccttgtcctcaagttgataatcttgacataggtgggaccaatcttcctacgaagtttcatcaggagaaagtccttgccactaccccaacacttcccagcgtggttgtccgggtgataacgggttgcaccttgacaaacttctctgggaattgcacagtgtctgctgacggtggagggcctttaaatggtttcaacaaggaacagtggaagaatgggccagtaatgaagtccaacgacaagtcttcccaaggacggtggggtaccaatagtggacataacaggaaattcacatctcctggcgcagtcataggtactctggatgaaccgccaattgttggtgtagttctgcgaggaaggtcagacaaagtactgaaagaatcatgcacatgggggtattttgctcaagaagtctggagagagcatcaactgcttgattggtggcaccagagcaatattggatttgataatcaaatcccattaggcatgcaag

SEQ ID NO: 1925 - DNA, 2364 bp, Glycine max
  Peptide Sequence Number=SeqID_118703
atggctctatttcttgctatgttagttttttcaaacccactagtgttcttctctcaaatttcctatgcaactgataccattactcagtcccagccacttcttgatggcagcaccttggtctccaaggaaggaacctttgagttgggtttctttactcccggtaattccccaaaccactatgtcggaatatggttcaaaaacatccccatgagaacagttgtttgggttgccaaccgcgacaaccctgcaaaagataaatccaacatgttgtctctaagcaaagatggaaacctcatactcctcggcaagaatcggtctcttatttggtcgacaaatgcaacaatagcagtttcgaatccggttgtgcaacttttagacaacggaaatttggtaataagagaggaaaaggacgacaacatggacaatgaagagaattttgtgtggcagagctttgactatccttgtgatacacaattacaaggaatgaagttggggtggaaccttaaaaccggcctcaatcggtatcttacagcttggaaaaattgggaagatccatcttcgggagattttacttcagggttgaagcttggaaccaatcctgaattggttatatcgaaaggctcgaatgaatactataggagtggcccttggaatggaattttttctagtggagtgtttggatttagtcctaacccacttttcgaatataaatatgtccaaaatgaagatgaagtgtacgtgaggtacaccctcaagaatagttctgtgatttcgataattgttttgaaccaaactctttttcttcgccaacgcattacatggattcctcacactagaacttggagtgtgtaccaatctctaccacaagacagttgtgatgtttataatgtttgtggagcgtatgggaattgcatgattaatgcctcccctgtgtgccaatgcttggagggatttaagccaaaatcaccccaagattggaatcaaatggattggacaaaagggtgtgtgcgtagtgaaccatggagttgtggagtaaaaaacaaagatggttttcgtctaattgctgggatgaaaatgccagatactacacattcttggatcaatagaagtatgacacttgaagattgcaaggccaaatgcttgaaaaattgttcctgcacggcttttgcaaacatggacaccggtggtggaggtagtggttgctccatttggtttggtgatcttgttgatttgagaatttctgaaagtgggcaagatctatatgttcgaatggccatttcaggcacggtgaatgcagatgctaaacataagcatctaaaaaaggtagtcttggtggtcgcaatcacagtttctttagtccttctgatgttattggcattttcctacatttacatgaccaaaacaaagtataaagaaaatggaacatggacagaggagaaagatgatggtgggcaagaaaatctggagcttcctttctttgatcttgctacaataattaatgccaccaataacttctcaattgataacaagcttggtgaaggtggctttgggccggtatataagggtacaatgttagacggacacgagattgcagtcaaaaggctttctaagagttctgggcaaggattgaaagaatttaagaatgaagttatattgtgtgccaaacttcagcatcgaaatcttgttaaggttcttggttgctgcgtcgaaggagaggaaaaaatgttactctatgaatacatgcccaacagaagtctcgattcatttatttttgatccagctcaaagtaaacttttagattggcctacgcgctttaacatcttgtgtgcaattgctcggggacttctgtatcttcatcaagattctagattaagaatcatacacagagatttgaaggcaaattttggcttggctaaaatgtgtggaggtgatcaagttgaagggaatacaaacagaattgtcggaacatacggttatatggcacctgaatatgctattgatggattattctctataaaatcagatgtatttagctttggcgtattgttgttagaaattataagtggaaagaaaaacagaacagtaacatatgaagagcacagtgacaatcttattggacatgcatggagattgtggaaagagggcattccagaacaattgattgatgctagtcttgtggactcatgtaatatatctgaacttgtacgttgcattcaagttggtcttttatgtctgcaacaccatcctgaagataggccaaacatgacaactgtggttgtaatgttgagcagtgaaaatagtttatctcaacctaaggcgagcaaccttgtggtagacaagagtcttgttcaaccaatgaagtaa

SEQ ID NO: 1926 - DNA, 171 bp, Glycine max
  Peptide Sequence Number=SeqID_118704
atgattttgaaagttagtggcgccattaccgcatccatcaacggtggcaccatttttgttagcagcgacaacaccattttcggtccattcaacgtcgttgactcgctcggccaacacaagactgactccaagaatattgagccagagataaaggaggtcctagggttctga

SEQ ID NO: 1927 - DNA, 459 bp, Glycine max
  Peptide Sequence Number=SeqID_118705
atgacaaatcaccacacaagggaatcaatcaagtttctagagagtctaattcatcctaaaaatgttgaagacctccaaagaaccaaaacagatattgaaaataacgtctctaaaattcttgagcttatcaagaacaaaagccattccacaaaggggacagaacttgtggggctagtagaggatttataccagaagcaacaatcacttaatgccctatatgatcgagtcactgaagagtttgaaaaagaagtttctcgcagaagaatcaagaagtctgcaatgtctttctctgactcggactctgaatacttttctccagaggaagtagatggtattaagagaaagtcagaaaaagaacgtcacattgtatctgatcttgacacccttaagcaggaatccgattataagatcaaagcaacaacaaaatttgaggaacaattaacttcactaacgaaagag

SEQ ID NO: 1928 - DNA, 1314 bp, Glycine max
  Peptide Sequence Number=SeqID_118706
atggtggaagagaaagaggggtttcttaagaagctaaaggaactagaactaaatttggaaagtcaaaacaaccagaaaaatgaattggaagagaagttaagagacacaagttatgaggttaaacaactggcaaatgaaaacaaggcccttcaagacagaaaccatgaactgaggacaacaatgacacagaaaggggaagagatctctatttttatgaaagaacaagaaaaccacaagaatggagcctccatggaggttatgtctttaaaagcaaaacttaacggtatgagacttgagctagacactatgcatgagcaaaaaaacaagctagagcaacaaaatgaacgaagtcaaaaggaatatgccgaaagcttagcaaaggtggagaatttgaacactaacttggaaacccagatagatgatcaagcgaaaatgattgaaagacttaacgaagagaataaacaagcaaaaatcgtgtatagtaaattgaagttaattcaggtaacagcggaaaggaaaatgaatgaattggcagaagagtttcgaaggaaaatggaagacaacatcaggttgttgcaccaaaggatccacgtggcggaacaactgaacaacgagaacaaaaatagttgcaaagtgacaaagcagaggtacgaggacgagaacaagaatctgggactgaagattgcgagttacagagaggaaacaacaacgcgtgttccaattaggtttgaattggttgcacaaaacagtttggatttggtggttgaaaaagttgaggagcacacgagtcgcgtgactagaatgaggtgtaaggttgagtttgtgaaggattggatgaaggaaaggaatggtgaggtgaaagaattgagagagaaggtggattgccttagggagttgttgaacaaaaaggaagagcaagaattagtgttaagggagaatatgtggaaattagaggagaatgtgagcaaggaaggaggggagaagttgaacctaaagaaacaagtgagccaacttgagaagaaagtggggaaattagagaaaattttgaaagagaaggatgaggagttgagagaaaaatcgtttacagaaaaatacattacacaggaatcaaaaggaacaaaaagaggaatcgaggaacatgcaaagagaatccaccgaacggcaggaggaaacgggcacagagaacatgaaaactgcaagtacgtggcgcaaatggagtctggagccagatcatcatcatcatcatcagtatcagctttgtcttttttattttatgagaggcaaggaacattctcagcttacaataatatgtaa

SEQ ID NO: 1929 - DNA, 286 bp, Glycine max
  Peptide Sequence Number=SeqID_118707
atgaggatggattattggaagcaaaagtttcctttcaaccacagaaacctcttcctcaagttgctcctcacaatcttcttcctaggcctcgctttccgcattctctttttccactccctgtcccctcagatttcttctgttttggaatccccgtttcctgagaaagtgacattacccgaagaacctcagacttcacctgttccggaagaagaacctgttcccgaacccccacttgttatagaacatgttccccaaactgaagatcaactgtctcccactgactcag

SEQ ID NO: 1930 - DNA, 1446 bp, Glycine max
  Peptide Sequence Number=SeqID_118708
atgttacattctagtattaacgaacctaatgatttgccccccgggtttgaaagcagtcatttcctaaaccaacccaaggttgaattatccaacattcccctgataaaatgggaatgccctcctctggttgttgtcagatctcaatggcgtgttgcagcaggtgaagaaagtagggagaaagagaatcagaaactgagagaaatgagggtgcttgaagcactttatccccgtctttctgccattcctcctagcccttctgtctctttggatgtagaagaggaagattatgatgatggcattactcctctcatccctatcattcccattgaagaggaagaatctatggatattctgcctgaattggcagtagcactgaagccttcccccaatgtgcagtcgcagaactctccacaatatatatctgcaaaaacctccattagttcagcctctaatgcctctcctgctgtttcccatgatccttgtgtaaggccattggctgaagctgatttagcagcagcctcttcagttgttgcaaccattataaggagtaatgagcagggaaccctgattgatatggatttactgggtaaaatatttactgatccaaaaatacttgagcagttgattaatgaacacagaactgcagctaccaccacaagtgcgtcctcaaagactgtggatatacccacttctgggcagaagcctgctattccatcagttctgttgtctacatctacacctgatgtgacagcttctgggactacacccacaagtgcagtgagttcattaccttctgggttttggttgaagccttcaaatccatcagtttcattattgaatcctacaccttgtaagacacccactctgtcagtgcccgcaattccatcattttcactattgtcttctacacatgatcagcctgtgactgcatcagttccattgtccaggcccgtatctggtaagccagtaactccctcagtttcattgcttacacatactcctgcgcttgatatgcacaggcctgtcagcaaaaattttcacgtgtcaagtggaatgccccctgctttaaatagccagtctcagcaagagacagctctggcatctgggccaaagcgagccgcatcattggcgtccataccttatagccaattaagctctggtccattgccttctgcagccgggaacttgcgcgcaactataaatcaggcgcagtctgctgcaaccacaatgccttataaactaagtacgtgttcatcagcttttgcagtaaaggatgccaactactataaaaacctaatcaggcaacatggtgcagacaagcaagatatccaggactcacacataggtatccgtcatagtaacttccaagatatgaaaccggttggagaggttggtgcggtccttgtcaagtggtggccatcattggcggatggtaaccagccataa

SEQ ID NO: 1931 - DNA, 423 bp, Glycine max
  Peptide Sequence Number=SeqID_118709
atgggtactagtacctatcgccttctgagggctacacgcccttgccttcagagggctgcacgccctcaccttcagagggctccaaatccgcgccttcagagaactcaagttcctagaccaccccctgatcttggagggggggccaactgtgcgagcacggccagaggaggaggcagcaacattctgcccagtgaccattactccgatctccccctgccaaagtgtcagttggctttcatcgagaagtactgcgccctcaggcaggtgcggggcgaggcaccacagcagcctgaggacggccagcagcgggcaacggacacaccgccaccaccccagagtccacctcagctcttctacaaggctgtagcattgcctacgacacgtggccgaccagcaggcgatcgaatccaaagccaaaggtaa

SEQ ID NO: 1932 - DNA, 494 bp, Glycine max
  Peptide Sequence Number=SeqID_118710
atgggtgaagcagaggaggtgcaagagaagatgaaggccgaagtggaggccatgaaagagcgaatggccacaatggtagaagccatgatgagcataaaggagatggtggaggttagtgcggcttaccaaacccgtgctagagctaaaataatgggtgaagtagagaaggtgcaagagcagatgaaggccgacatggaggccatgaaagagcaaatggcacatgaaattccccaccacattctagccgactttgagccttgcctcggatatgccactgaagggcaagcagttggtgcccctcctgctatggctgaaaagggaaaggtggatcatctaaaggaaaggctcagggccattgaaggaggtgaagattatgcctttgctaacctagaagagttgttcctagtacccaatatcatcacccctcacacgttcaaggtactggactttgacaagtacaaggggactacttgctccaagaaccatctaaggat

SEQ ID NO: 1933 - DNA, 186 bp, Glycine max
  Peptide Sequence Number=SeqID_118711
atgaatgagatacgaaggtttggaggtttgggaatggaggaacgtcgtaagagaaaagggggctgcgcagggatttctggaaaatgtgatatttatagagcaggacgcctggccatctgttctagtgtaatcgattacagtattcatgtaatcgattaccagaacaaaaaaatagccttttcctaa

SEQ ID NO: 1934 - DNA, 216 bp, Glycine max
  Peptide Sequence Number=SeqID_118712
atggttaaggaggagtgtaaaggggtaagtgtctcctccaagagtgatcaaggggttcccacgggccctaagagaataaaagtcattcctgattggcccactccccccagtgttgagggaaggagcccagagtatgaagaacctcgggatttgaggtcaaatcctttccaaggtggacgggatgatgcaatcctaccccctaagggtattggatag

SEQ ID NO: 1935 - DNA, 471 bp, Glycine max
  Peptide Sequence Number=SeqID_118713
atgcctaggccattcatgtgcaagacccccatgcttcctctcaaagaagaatctccacactgcaatggaaatgtgaagcatcacacacccttaggcaaagaaactctaaaagtctatgtccttaacaaaagcaaccatcaagagaaggaatcctattgtgaacaacaacaagccagagaaggaatcagaggtgtcaatcagaagctgatcatggggtgttgtcccttgaagcatgcttgcggtcttggatctgtggccaagcacagagatctctttggagtagaatatcatcaaagctccacaagtaagagctattgtggaatgaagaacacacataagggcatatatagaagaaaccatttatccgaattcacttcaaaggcctttaattgctttcttacttttaactcaatggagcctctgccctctaaaccaacaatggtagttgaaattccaatcacttctttctag

SEQ ID NO: 1936 - DNA, 1086 bp, Glycine max
  Peptide Sequence Number=SeqID_118714
atgaagacaaaagtaaaaataaatgatagcaatgaagaagaattggaactacctttgtttgactttgatacaatagcatttgctactaatgatttttcagtgacaacaagcttggccaaggtggttttggtcctgtatataaacttatcctttccatttaactatgtgaatgtgattttttcgaagggcacattaccagatggacaagatattgcagtcaaaaggctttcacaaacatctacacaaggattaacagaatttaagaatgaagttatattttgttctaaacttcaacatcgaaatcttgttaaagttcttggttgttgcatcaatgagcaggagaaattactcatctatgagtacatgccgaacaaaagcctagacttctttctttttgattcttctcaaagcaaacttttagattggtccaagcgattgaacataataaatggaattgctcgaggacttctttatcttcaccaagattctagattgaggatcatacacagagatttaaaagcaagtaatattttgctagataatgacatgaatcctaaaatttctgattttgggttagcacgaatgtgcagaggtgatcaaaatgaaggcaatacaagtagagttgttggtacatatggttatatggcacctgaatatgcaattgatggagtattctccatcaaatctgatgtctatagctttggcattttactactagaggctttaagcggaaagaaaaataaagggatttcctactcaaatagcagctacaatcttattggacatgcatggaggttatggaaagagtgcaccccaaaggaattcattgatacttgtttgggggattcatacgttatatctgaagccttgcgatgcattcatattggtcttttatgtgtgcaacatctacctgatgacagaccaaatatgacatctgtggttgtaatgttgtctagtgaaagtgttttaccacaaccaaaagagcctgttttcttaacagaaaaagtttcagttgaggaacattttgggcaaaagatgtactattcaaccaatgaagtaactatctcaaagttggaaccaagataa

SEQ ID NO: 1937 - DNA, 363 bp, Glycine max
  Peptide Sequence Number=SeqID_118715
atgaaggttccagacaccaacacatcttggattagtagatatagtaatatgacacttgagaaatgcaaggaaaagtgttgggagaattgttcgtgtacggcttatggtagctctgacatcactggaaagggaagtggttgtatcctgtggttcggtgatctattggacttgagactgcttcctaatgcagggcaagatatttacgttagagtggatatctcccaaataggtgcaaaaggtggttctacttctaggaaagtgcttgttgtggtcacaggcattgtttcatctattattgctattcttgtgatattcgtgctcgtttactgcaacaagtttagaagcaaaggtaaccttccttaa

SEQ ID NO: 1938 - DNA, 912 bp, Glycine max
  Peptide Sequence Number=SeqID_118716
atgactagaaagatgagagcaacactaaagggtatagcaagacattttcccacagcaattgtgaccggaaggtgcagagacaaggtatataactttgtaaaattgacagaacttggcatggacatcactggtccaacaaaaagtccaaaagcaagtgtacaagatcttgttagaaaaaacgaagactgtcctaggggccctaaggttgagaacaataagttttgtttgtccttgcactttcattgtgttgacgaaaagagttgggcagtgttggcggagaaagttagattggtgctcaatgagtatccacaactcaggctaacccaagggagaaaagtgctagagatccgtccaaccatcaaatgggacaagggcaaggctcttgaatttttgttagaatcattagggtacaagaatttgaatgatatatttccaatctatattggtgatgatcgaactgatgaggatgcttttagggttttgcgcagtaggggtcaaggaattgggattcttgtttctagagttgcaaaagaaacaaatgcttcctattccttgcaatgtaggttgcaagttggaggagtgcaacttttgatctgtaataaagtgggcaagtgggctactggaagtcttatgtttgctacaggatcatctgagttgtcattctgggaatcaaagcctatcatggataaagaatttcattggctcatcttcacgctcgtgtctcgacccttctcttcatcttcatgctcgactcaaccaccgtcacactacaacttgtcgttgccaccatcacactgcgagaaaacttgttgtgctaacctcagcgctggtaatgcagacgaagacgtcgaagaccttggaggggtcaaacttcaatttcattgtgaagcggtgatgattgaagagaaatag

SEQ ID NO: 1939 - DNA, 781 bp, Glycine max
  Peptide Sequence Number=SeqID_118717
atgaccattccactacctttcatgcttgtcatgatcatagccaacctgcttttcatctcatccaaaatttcttcagaaaccaacaccatctcccagctccagccactccccgatggaactaccttggtttccgaagatggaacctttgagctgggtttattcagcccaggtagttccacaaaccgctacctaggaatctggttcaaaaccatcaaaccaaaaaccgtagtttgggttgccaaccgcgacaacccaatcaacaacaccaattccaccactaagttaaccataacaaaagaaggaaacctcgtacttctcaaccaaaacaacaacattatttggtcaacaaacacaacaacaaaagccaccaacgttgtggcacagctcttggacacaggcaacttggtcctaagagacgaggaagacaacaatcctccaaaattcttgtggcagagcttcgaccatccttcggatacgcttttaccaggaatgaaactaggttgggaaaaagtaacaacaaagggtagtcttaatcttaacaggtacctcactgcatggaacaattgggaagacccatcttctggtcacttcacttacggcttcagcagaagcaccattcccgaaaagcaaatgtggaacgggtcgtcgttgttcttccgaaacggcccttggaacggaattcgcttcagcggcacaccctcgttgaaacaccgtccgttattcggtctcactttcgtgtacaacgcggacgagtgctatttccagttctaccccaagaaca

SEQ ID NO: 1940 - DNA, 216 bp, Glycine max
  Peptide Sequence Number=SeqID_118718
atgttgcatagcgactcgacgggtcgatgggggaatgagggaaaaacgaaccacaaccaggccaagcgcaagcttccacgaaaggaagcttcaatggcaatgctagacagcttcgacagagacatgagtaagagaggatgcaaagagactctgacaaagagtaagaaagatgaagatgagagatataacagtaacctaatggttggagaagagtga

SEQ ID NO: 1941 - DNA, 201 bp, Glycine max
  Peptide Sequence Number=SeqID_118719
atgatgggctcgtcattccctgaatcggagaaggaggaaaacactcaagcaagcccatttgacttattaaagtggaaggcgggtctaaaattgcggcagaaccatggaggttgtgtgttatgtgtctggatgcttttgagggaaatcacacacacggccccagaatatcaaacaattgcaaggaaaggagcacccaattga

SEQ ID NO: 1942 - DNA, 663 bp, Glycine max
  Peptide Sequence Number=SeqID_118720
atggagaaatcgagagaagaaaagcttagccaagtttgggattgtggcagcaccctttatgattcctacgagctcaactccttcaaacgccaattaaacacggcaatagcgaattccccgagcaatagaagaaccctttccatgtctcatttacccgaacgttgtctctcatcactacaatcacagccacagccacccatgtccaacaacaacaagtctttcaagatctctcgaaccttccagaaactccttcgatttgttttcaagtccagcaacaaattaaggatttctagcacccgtaatactactagtaacaatattagtactttccaagtggcagagaaatatgccaatgaccgtttatacgttgtttatgataaatctgaaccggttctctccacaattcccgaacttccagagtttgaggtgggtgtgctttcgccggatatcacttccttcgtcagaaagtcgtcgtcggagcggtttatggccaccactgctatcggtgcattatgggacttctttgtccaacgtggtggggctgagtcactcctcactctcactaacttgttcattgtcttgggtctcagagaggctctcagaaaagctcaaaattcacaagatcaaaatgcttccactcctaactcagtcttggacgagtag

SEQ ID NO: 1943 - DNA, 2426 bp, Glycine max
  Peptide Sequence Number=SeqID_118721
tctaccatgacgaggaatacaagtgcaaaagatggaactttccctcatacaacttcagtgtgtcagtaatatggtcaccattccttgtggaagctgctatttttgaagacataaatggtgtttcgagttctgaagtggatctacatcttgacagactggatagcaaatgggcagatcagtacctcgactttgattacattattgtttcaactgggaaatggtttctcaagtctgcaatctactatgagaatgaaactatattgggttgccactcctgtcctaagaggaacctgacagagctgggttttaactttgcttatcggaaagccttgaaattagtgatgaacttcatagtgacttccaatcacaaagggttgattttttttaggacattcacaccggatcattttgagaacggggaatggtttagtgggggaacctgcaacagaacagcaccaattaaagaaggtgaaatggaaatgaaatatttgaacaagatgcttcgtgaaattgagttagaggagtttggaaaggcagcttctgaagcttcaaaaaatggggtaaattttaagcttgtggattttgcttcactttcacagttgagacctgatgggcatcctggtccatataggcaatttcatccatttgaaaaggatcaaaatgctaatgttcagaatgattgtttgcattggtgcttacctgggccaatagactcttggaatgatataataatggagatggttgtcaatggagaggggaaggggcagcaggagaaaaccccatcaacgaacgagggcaacatcttagcctcatctgataagggacaaggaatgcttcagcagatgcggcgtcttgagaaggagaagactgaagtgctcttgaaggccgaagacgatgttctcaagcaaaaggatgaagagctcaaaaaccgtgggcgtgagcaagagaatcttcagactgagctgaaaaaattgcaaaatttgcaggagtttaaacctaccatgggcaattgggggcctatgaaccttgctgactatgctacgctccgttcgcatcacaatttgcctgtgttaaaagagaatgaacaaaacaaggataagaagaaaaaagggtgctctaccttacattttgtggatgaaagaccaatggaattagttttggaatccccatttcctgagaaagtgacattaccagaacctcaaaacccacctcagacttcaactgttctagaacatgttcccgaactactacctgttccacaacacccaactattctggaacatgctcccgaactactacctgttccagaaaccccaactattctggaacatgctcccgaaactgaagatcaactatctcccacagactcaaagaaatgtgattactttagtggggattgggtcccgaacccttcgggtccggcttacactaatgaaagctgtgacctcattgtatctcatcaaaattgcttgaagaatgggaggcctgatacagagtttctgtattggaggtgggctccaagagattgtgatttgcctcagtttgatccagaaaggtttctcaacatgatgtggaacagagcctgggcacttgttggtgattccatttcactcaaccatgtgcaatcgctgctctgcattcttgccaaggtggaacaacctgtcttattctactataacaaggaaaacaggtgcaaaagctggcgttttccctcatacaacttcagtatgtcacttatttggtcaccattccttgtggaagctgctatttttgaagacgaaaatggtgtttcaagttctaatgttgagctacatctcgacaaactggatagtaaatggactgatcagtaccttgactttgattacattattttttcaactgggaaatggtttctcaaatctgcaatctactatgagaatgacaccatattgggctgccacttctgtcctaagaggaacctgacagagctggggtttaacctggcttatcggaaagccttgaaattagtgatgaacttcatagtgtcttcaaatcacaaaggggtgatttttttccggacattcacacctgatcattttgaaaatatggagtggtttaatgggggaacttgcaatagaacggcaccaattaaagaaggtgagatggaaatgaaatatttgagcaagatgctccgtgacgttgagttagatgaggttggaaaggcagcttctgaagcttcaaaaaatggggtgaatttgaagcttgtggatattgctccactttcactattgagacctgatgggcatcctggtccatacaggcaatttcatccatttgaagaggaccaaaatgcttctaaagtacagaatgattgtttgcattggtgcttacctgggcctattgactcttggaatgatataataatggatatgattgtcaatgagtaa

SEQ ID NO: 1944 - DNA, 303 bp, Glycine max
  Peptide Sequence Number=SeqID_118722
atggctacaccacttaactcccctcctcctcctcgtgagtcagcaacacctttttcaccatctacgtcgaagaagacaagaaaagcaagaagggcgaggatgataaagcatgatgttcgaaacaaggagcatgccattcagaaacaaaacattgtcctttacgtgttgtctcgtggggattccctggaagagcaggcctcacaggaaaactttgttgtccatggacgtcaggatgtactaactactgcccttaggcgactagaacaccttcaaggggctcccgcacctcttcaaggaaactaa

SEQ ID NO: 1945 - DNA, 951 bp, Glycine max
  Peptide Sequence Number=SeqID_118723
atgggtgaaacagacgaggttcaagagtggataaaggctaacttggaggccatgaaagagcaaatggccacaatgatggaggccatgatgagcatgaagaagataatggaggtcaatgcggccacaattgccgctactagtgccgttgctaaggtggacccgactcccccatctagcctcaaccaaataaatcatccaacctcagatatggtcatggaggcaaagaattgggaaagcaagcatgccttcctaccatacggcttgccccccaactatgcaccacccagtgtggtgtgccctcccgatgagaatgtcaataactccacttccatactcattgagagccaacaacctcgatttgatcatgcatatgtccctcaactcataggggagacacatgaaataccccaccacaatctagccgacttcgagcctcacctcggatatgccgctgaagggcaagcagttggtggtgtgcccctgccaaaaagtttggagggccctcagttcctcccacaactacaaccattgcattttatggtgggaagaatccctcttgctatggtggagaagggaaagttggatcatatagaggaaaggcttaaagccgttgaaggaggtggaagttatgctttcgctaacacgacaaaattgtgcttggtgcctgacatcgccatccctctgaagttcaaggtgctcgacttcaataagtacaaggggactacttgccccaagaaccacctaaggatgtactgcaggaaaatgggggcatacacaaaagatgaaaagctattgatgcatttcttccatgaaagtcttactggggcagctgtcacctggtacactaatctagaaccttcgagagtccattcttggaaagacctaatggtttccttcattaggcagtatcagtatatttctgatatggctccggataggacgcaactatag

SEQ ID NO: 1946 - DNA, 219 bp, Glycine max
  Peptide Sequence Number=SeqID_118724
atggagagagaaaatgtagaaggagtatgtgatcaaaaccaattcccaccgatttttatagggatttacatacgatcttcaatgaggccgcacgttgcttgcattctcaagctgccttccacattcccaagttgtcttacactgacttcaattgggagcttacagaaattagagatcgtcaaaagtcaaaatttcaagttgcgcttggcaactatatga

SEQ ID NO: 1947 - DNA, 708 bp, Glycine max
  Peptide Sequence Number=SeqID_118725
atggaaaaagactgctggcaaaccaatgcagtgatgagtccgtcggatatcatctctagaactggcttactttatgtgattggccgtcagcattttccttatgatcttctgatgttaagtcaacggaacagactttttctcttcaattttagtagtttaaccgcaaatgttgcagacttgctggttttggctggtaatctgcttgtgtttgacaagaatctttggaggaaggtcaatgtcatggatgatggtcctgcaaaattaaaattcatccctgatcattttcaagttccaacatcaagtatagaatctcctgagagcagaacatcatctattacagaacctggaactgatcaatctccaaggtattgtttcctggttgagctaacagctgcagagttagagtcacttcgattggagcttgctgatatagaggagagggaagctcacttgaaagctcagttggaacatattgatgaagttttgcggtctgctcgtctatctggatatttatacattcgaactgtactgattgcccgccctacaccaagatgggcaacactaccaggagaacctccacctttagatgatactgaagtagatgattggcttcctcgttttgtcattctccatggagcatgcaaatctagagcagtaaatctctgctctttgtttcacattcttcttcgacacctctctattctttga

SEQ ID NO: 1948 - DNA, 543 bp, Glycine max
  Peptide Sequence Number=SeqID_118726
atgggttttaagatgaatcaggaagttgtcaaggtgatcttagactgtaagaaaaatatatggaagaacccagaattgtttgagctactcatgtttgagaagttgcgagtacgacaaagcaaacttgataagaaagtaaaacgaatctattcatggaggaaggtctcaagtatgatatttgtggctacagttgctgctgtgttgatctgctcagtcgtggctgcagcaattgctactccagatgttgcagctgctctagctgctgttactgcaaccccaattggttcaatgggaaagtggattgactccttgttgaacaactatgaaaatgccatgaaagaaccaaaggaagtaaccttctctatgcaagttggcacctatgttgctataaaggacatggaaaacatttgggttctcgttgatcggctggaagttgagattgagtctctattgcacaatgtggaatttgccattgaggaagctgtgaaggttgcaatagaggagatccagaagaagttggggagtttttatgaagaatgttga

SEQ ID NO: 1949 - DNA, 186 bp, Glycine max
  Peptide Sequence Number=SeqID_118727
atggattgcgctatgagtgctcaagcaattctaaaatacagtttacctccatcattcttctttcaggtggactcttggttatcggctttacaaagtgactgcaaattggaatctgatacattttgtaaagctgactgcaaactggaatctgatacatcagttcccaatggttcgattgagatgtaa

SEQ ID NO: 1950 - DNA, 732 bp, Glycine max
  Peptide Sequence Number=SeqID_118728
atggcctcacaggtttgcaaatctgcttccagagccgcgaggtcccttctatcctctcgttttcactctcaaggacgtgcgcttggggctgctgcggctgtttcattgagcagcaaagtgcctcttttttacggaaagaacggttctggaaatggatccgcttcttcatcatcatcatcatcatggatttcaggagctcttgctcttcctgccgcaggagccttgtccattgctgtctctgtctggggatcagcttacatgttccaagatcaggaggtgcaggcagctgagctggagcgcactttcattgccattaagcctgatggagtgcagagaggcctgatttctgagattatatctcgttttgagcggaaagggtacaagcttgtgggaattaaagtagtgattcctaaaaaggaatttgcccaaaggcactatcacgacctgaaagaaagacccttcttcgatgggctgtgtgattttctaagctctggccctgttattgcaatgggagttatttcctatggccgaaagctaattggagccacagatccacagaaatcagaacctggaaccattaggggtgatcttgctgttgttgttggaagaaacatcatccatgggagtgatggtccagaaactgccaaggatgagattaagttgtggtttaagccagaggagttggttagtttcactagcaatgcagagaagtggatttatggtgccaactga

SEQ ID NO: 1951 - DNA, 360 bp, Glycine max
  Peptide Sequence Number=SeqID_118729
atggttcgtaataatcgtgaatgggtggcccaagagatattggcgccacttcttcactgtagaggtgatggcaaacagttctcgcacatacgtggatgccgtcagaagtttcttagtaaatggtttgctaaagactgctcccataccattgccggaagcatcagtctccacggtgaagggtacttgaaagtcaggttcaatggtggtgactcaaaccaagggatcaacaatcatggcgtagcctttgatatatcggcggtggcgcaagtgatcttcaaaggtgccacagtaaatgaggatgtcatggaacaagacgatgacaaagcggtggagaaatggccgaaaaatcaaattcattaa

SEQ ID NO: 1952 - DNA, 1227 bp, Glycine max
  Peptide Sequence Number=SeqID_118730
atggggggtcatattggagtcacaaagacaataacatggttgtcggagaatttaacttggccaggtctccgagctgatgtcgccaactttgtagctaattgtattgaatgtcaattcacgaaatatgaaacgaaacatattgtgggcttgttgtgccctcttccagttccattcagaccatgggaggacctctcccttgatttcgtcattggtcttcctttttttcagggcaagattgtactccttgtggttgttgaccgcttttcaaaggggattcacttcggcattatacctcaggctcatacagctcacatgagtgatggtcaggtagaggtaatgaacagggtaattgaacaatatttgcgtgcctttgtgcatcgttggccagaaacatggggcaagttattgccgtgggttgagttatcccataacacttcgtggaatagtagcacaggctccacaccttacgagataatatttggacacaagccattctcctttccagattaccttgcgggctcctcaaagcttgacgtcgtggacgaccttctaatgactcgcgatgaagtgtttgctagcattcgtcggaagttgctcaaagctcaagcttacatgaagaaaaccgcagatactaaacgtcgagaagttacttatgatcttggtagttgggtcctattgaagctccaaccttaccgccaacgatcggtaaaggaagcacaggctgggtctggaaagcttgctaaacgtttctatggaccttttcaagtcattgatcgtgtcggcaaagttgcatatcatctgaagctacctgatactacccgtattcatccagtgttccactattctctcttaaaacctttccatggtgacccaacttccaacacagctgctccactttcgaaacattttctcaatgatcagccactcattatcccgttagcaattttggattatctccgccacgtggagaaggactcatgggaagtgctagttcaatggaagggattatctcctgatgagacttcctgggaagattgggcacaactccaacaggaccatcaccttgaggacaaggtgattctccaagggtcgaaggaagttgatagcagtgtagcaacaacagcagcatcagaagggcaaacaagggaaatagacaatgcaggagtacaaatagcaaaagtaaagaggagagttaccagacctgcatacctcagggattacgcctga

SEQ ID NO: 1953 - DNA, 255 bp, Glycine max
  Peptide Sequence Number=SeqID_118731
atggcctacaaattctacatgatcaatagagcagctacgcaagcaaatcaaatatttgtaccagatctccgcaaggcagccagtggcacaggcgtaaccaatggctactcagtaacaaaagaacacattcatagctggttcttcgcaagaaccatctcagctaaatacacaggccaatatgctgagtccgaaatcaaaacaatgtatagtttctgctatgaacctaaggagggggaagccatgtgtttgagataa

SEQ ID NO: 1954 - DNA, 1179 bp, Glycine max
  Peptide Sequence Number=SeqID_118732
atggctccctcagccatattagtatgtggtttttgcatcttccttttccatctccaaagcacaagagggaacaaacaggttaactgcaacaggttgcgttgcggcgatatagatattgagttccctttcggtttgagaggatccaaccaagaccgtcgctgcaggtattacccaattcaaagcttccaactttcgtgtctggaccaaacacaaaccattctcaccctcccaggcttcggtaacttaaccgtgaaaagcatcgattacgaaacccaaagcatccgagtcaacgacccagcagggtgtctcccgaaacggttcttacacaagtggaacctttcggatgattcaccttttgctttaaacccattgatttatggaacaattccgtttaacctcactttcctacgatgcccctccaacgtgacggactcgtctcaattcccgtcagtgccaatttcgtgcctgagcgataaaagcaactactcgaccatagtttcgtggtcacaacctattatatcatcacccttgttgtctcaacagtgcgaggtcatgtttcgggctcttgtccctctgccggtgttggacacgcccatgttgccattttggcctgatctcaacaccgaccttgatttggtgtggacccaacccaattgtagggactgttcacttagtggccaactttgtggcttctccaaggacaaaactaaaacccctcaagttcggtgtttcgctagggactccaccaaaggtctttcaagaagtgggaaatatgggttagcaataggagtgggaataccaggagtcttgtgtctaattgggatttgttgctgtatcggcggcaagctgaggatgctaaggcatggtggacgcagcacagatgttccggtgagaagcgtccctttggaaatggggcttgacggagccacaattgaaaagtatcccaaaactcttattggggagagtggacgcttattgaagcccaatgacagcacctgcgcaatatgcctctgtgaatatgaggccaaagaaaccttgaggagcataccccaatgtaaccattattatcacgcacattgcatagaccactggctcaaattgaatgccacctgtcccttgtgcaggaattcgcccacagcttctcttttttccttctctcccacttcctcattggcctag

SEQ ID NO: 1955 - DNA, 462 bp, Glycine max
  Peptide Sequence Number=SeqID_118733
atgcacacaaaagggaagcaaaagttccctggtctctcattggctaacaaaatttccaagatgattcggaccatatttgcttgcctcaatggaaaagcatcacataaaaaatctaaagtagagccactggaagtcacaaaacctgtttatagagatgagttaaccaaaaaacaaaggccaaggaaggcagggaagaaaactgtccggtttgcagaatcagaacctaccattttgggagaagatggtgagaaggagtttgagaaaacaagaagtgttagtggtaatgaagtgggagaaaaagaagggataagagtgaggattaaattgacaaaagaagaagctgcacggttcctatcaaaatgcaacagaggagttcttgaattcgaggatgttgctcgtgagcttgtgttgatcccagttaatcgagttagcattgtgtccgatggcacaatcaatttgtag

SEQ ID NO: 1956 - DNA, 1140 bp, Glycine max
  Peptide Sequence Number=SeqID_118734
atgactctaaacctctgcactccatgcttctctcgcatgcttcaccaccctttttcttcttcttcttctctccccaacactcacactcctttgccttctctattatttttctccccttcctcactccccaaccctaaccaatccaccttcataagcaccaaagcttccgtgagcgagagccacaatgaaacctccgacgacaccgctgccaacttatttgaccaacaactcatcctccgactcgccgcaaccgccaaagacgccgacgaggccttactaatgatcgccgacaactcctcccgaaacgacggcgtcgtttccacctccgattgctgttccattatctccgcagcacttaaccgcaacaatccccaactcgctctctccattttctacgccatgcgcgccacttttcatcaagttggcgagagtggtcctttggctgagagatggaagtggtcgaggccaaatgcaaatgtttatacattgttgattcaaggtttagcggcggtgttaagggtttctgacgctctcagggttattagatatatttgtgaaatcggcgtttctcctggtgaggaggttccgtttgggaagatagtcaaatgccctagctgtcggatagctgttggtgttgcacaaccacaacaaggtattcagatagtgtcttgtgcaaagtgtcgctaccaatacgaacttgtttcaggagacatagtcagtattgaatcagaagaaatcagcatggacattaccgcatgggaaagggggttaagatacgtgaaactgatgaagcaaagcattcctgctgctgttcactctattgtggtgcagaccccttctggtctggctcgcactcatagatttgcaactgaaacagttgatctgccagctcaagaaggtgaaagggtaactgttgctgtggcagctccatctaatgtgtatcgaaaggtgggcccctttaaattcagtccaagagcccctgatttctatcctggtgaggctatgtgcataacaaaccacaaggatgggcgggagtcactactgttaagagccccaagaaaagaagtaaattcgtcattactcaaaccctccctcatctttccacttcttgctttgttgccaccggtgatgtgcctctga

SEQ ID NO: 1957 - DNA, 243 bp, Glycine max
  Peptide Sequence Number=SeqID_118735
atggatgaggaagccacttgtaggccgcgacaacaaaagggcacgagccattcacggtggttcgaaactcagaaccacgccacgtggagctcaggggtgtgcgacaacctagggaatgagccattcacgatggttcatttgcacgtactagggttcctctacggaagtcaccatggtgcacgggtaaacccgtctttgtatgacacgatatctatgatggtgtttacatatacactgtcttag

SEQ ID NO: 1958 - DNA, 414 bp, Glycine max
  Peptide Sequence Number=SeqID_118736
atggtttctgatgtttatgttggtggagacacaagtttaagagtcaatagcaagatgtacaccaaattggattcttgtttggtgataccacctaccccaaatcgtgccaagcctcgagctatagtcaaattcctgggtggtgccttcattggtgctgttcctgaagtgggggcaaccctgacatctgggttgcctcaagccaatttgtcacctgctcagcttgaagaccttcctcttttctctattggtcatagcaatggggcacttcttcaagtactcgcaggaagcttatttcctaagaaaatacctaagcaattcaaggagtgtgacgaaaagtgttgccctgcagttgggtcctgcagtcagccaaatgatgctagttgtggtggcaactcctttttactcaatagctag

SEQ ID NO: 1959 - DNA, 2034 bp, Glycine max
  Peptide Sequence Number=SeqID_118737
atgacgattttcactctcatacttgctattgccaacctacttttgttcctctcaaaagcttcctcaattgacacactcactctgtcacaatctctccctgatggtaccaccttagtttccaaagatgaaacttttgaactgggtttcttttccctaagaaactccacaaaccgttacctcggaatctggttcaaaaacatcccagtaaaaacagttgtgtgggtggctaaccgtgactaccctctcaaagacaattccaccaagttgatcataaccaacgacggaaacctcgtccttctcacaaagaataacaaagttcagtggtcaacaaacacaacaacaaaggcctcaaggcccattttgcaactcttaaacacgggaaatttagtacttcgcaacgataatgaagacaacaagaacaataataaaagcagcaacaacaacaacgaagataggttcttatggcaaagctttgactaccctagtgacaccttgttaccaggaatgaagcttggatggtacagaaaaaccggtctcaatcgacgtgtaatcgcttggaagaactgggatgatccttctcctgggaacttctcttggggcatcacatttgacagcaaccctgaaatggttctttggaaaggatcattcaagtaccataggagtggaccttggaatggtattcggtttagtggtgcatttggtggctcaaataggttaagcactcaccctctttttgtttacaaattaataaacaacgatgatgaagtttattactcatacagcctcaccaacaagtccgtgatttcaatagttgtcatgaaccaaacccttctccgtcgccaacgcaacatttggatccccgaaaatggaacatggaggttgttccaaaccgcaccgagagacatttgtgacacttataatccgtgtggctcttacgcgaattgtatggttgattcatcgccggtgtgtcagtgtttagaaggattcaaaccgaaatctttggatacaatggaacaagggtgtgtgagaagtgaaccgtggagctgcaaggtggaagggagagatggatttagaaaatttgttgggttgaagtttccggatactacacattcttggattaataaaagtatgacactcgaggaatgcaaggttaaatgttgggaaaattgttcgtgcacagcttatgcaaacttggacataagaggagcaggaagtgggtgttccatttggtttggtgatcttattgatttgaaagttgtttcacaaagtggacaatatctttatattcgaatggcagattcacagacagatgctaaagatgcccataagaagaaggaactgttgttgataggtacgatcgtgcctcctattgttctcgtgatactattggcaatcttctactcttacaagagaaaacggaagtatgaagaagaaaacgtgtcggtagtaaagaaagatgaagctggtggacaagaacatagcatggaactaccattgtttgatcttgctacattagttaatgccaccaacaacttctcaactgacaacaaactaggccaaggtgggttcgggcctgtatacaagggtgtattagcaggaggacaagaaattgctgtcaaaaggttatcgaggagttctggacaaggattaacagaatttaagaatgaagttatattgtgtgcaaaacttcagcaccgaaatcttgttaaagttcttggttgttgcattgaagaagaggagaaaatgcttctttatgaatacatgcccaacaaaagcctagattcctttctttttgattcaactaaaagcaagattttggattggtctaagcgcttccacatcttatgtgcgactgctcgtggacttctttatcttcatcaagattctagattaaggataatacaccgagatttaaaagcaagtaatattttattagataacaacttgaacccgaaaatttcagattttggcctggcaagaatgtgtgggggtgatcaaattgaaggaaacacaaacagggtcgttggaacatag

SEQ ID NO: 1960 - DNA, 759 bp, Glycine max
  Peptide Sequence Number=SeqID_118738
atgaccccaccagcccgagcggttccccggcatactgcatcaccaactcttccagcagcgcagcagcctcagcgggaaaagtcggcagctgcggcaccagcacctcaatgtgcggatgctgcgcctgacaccactgctataaatcagcgccgccatggtttagtagccctcggaatccagatccggacggaacagatcgctttgcagacgattcacttcggtgtgcagcgtgccatccgcctgcatcgtcagccagcgccagccgggcgccacggtatcaatggtgaagttggtgcagtgcgtcgagatccagctcctgatgaatgtggccgcacaccaggtggcgcgccagcgggaaattttgcagcaccgcatccagctgatgcggattgcgcaggctgtgctggtcaagccaggtacagccagaggccagcggatgatggtgcagcagcaccagcgtgtagcgatcggggaactgacgcagcgtgcggtccagccactccagctgatagtcgctcagcatgccgtgcggcacgccaaaaacctggctgtccagcagcaccagctgccagtgctcgccgagcagcacatgcttgtccgcagcgatgccggcctgcgccagcgtatccaccatcgccggctgaaaatcgtgattgcccggcagccagacgcacggcttcggcagacgtgcaatgcccgcaacaaaatgctgataagcttcgacggtgtgatcctgggcgagatcgccagtggcgataa

SEQ ID NO: 1961 - DNA, 642 bp, Glycine max
  Peptide Sequence Number=SeqID_118739
atgccctgcccggccagcgccagctggcgcagggtttcgccgctcgacgcgcacagcgtgggtttgatgcgcaaaaactcgccttcacgctgccataccggccagacattgtgcgcgtccagctggctgaatcccagcagctggtgcataggccggactggccagcaggcgaatcgcgctgctgcccagcacgcgggcgcgcagcgtggagtcgcgcagttcgccaatgcgaatagcgatatcggtttgctgctcaagcaggtcgatgacaatgtcatcggtgttcagctccagctgaatttgcggatagcgcgcgcaaaattcggcaaccagcggcacgataacatgcagggtaaatggcgtattggcgttgacgcgcaaccgtccggaaggaatgtcgcgccgctgcgcgatatgctcttcggcctgctccaccgacgcgaggatttgccgcgcgtgatcgagaaaaatcagcccctcttcggtcagcgccaggcgacgcgtggtgcggtgcagcaacgtggtttgcagtttgctttcgaggcggctcagcgcccggctgatgccggagctggtttgatccagctgttccgctgcggcggtaatcgaaccggtgtccaccaccgcgacccaggcgcgtaa

SEQ ID NO: 1962 - DNA, 1248 bp, Glycine max
  Peptide Sequence Number=SeqID_118740
atggctaatattacagcagcagataacgcgaccgttatctcgaccaaagatcagttttataaatggattgataagagcgtagcaggtgccaacggcggcaagctggagattacaatcgatggtgaagtgcacatggttgatatcagcgaggacggtaaatggtcattcgacccgaaaaccagctggttagacggcacccatgtcattcagctggtatcgattgataaagcgactaacccgagcccaccgcgtatcttcattcttgatatggatacgacgcctccggcaaaaccggaaatctggcgcgtgattgatgacgctgcggcggaagatcactacctgacgccgggtgaagccaccagcgataaaacgccggcgctggctggtgtggcagagcctggcaccattgttaccctgtacgataacggtaaagagatcggctcagtggtagcagacaaaatgggcgcatggagcatcacgccggagctggcagacggcgagcaccaactgaccgtgatggcgaaggatacggttggtcatgaaagcccgatctctgatgctttcaacctgacgattgctgacggtgtggtcactcaggcggttaacgaagcggtatctgtaacgccagcagaatcaaccactatggacgcggttccgtttccgggtaaacccattaaaaccatcaataaaaacattatctcgttgagtgctgataatgctgaacccaatgcgttagtacagatcgttattgatcaaacagtttacactacccgtgctgatgccagcggcaaatggcagtttgactcgccggaaatgaaagaaggtttgcacgttgcgggcattcgttatctggaccgcgccggtaactggggaccatcaactcagcttatccgcaatatcgacacctctgcaccagaagcgccgcagattatgcgcgtgatcgataacgaaggcagcgcagatacctatctgacgccgggcaactacaccaatgacaaaaccccaaccctgtacggtgttgctcagccagacagcgtagtcaaaatctacgatattcgctccaacgtgattggcagcgttaaagccggtgccgatggccgctggagctttacgccggaactgaccaccgacggcacccacgtgtttagcgccagctacactgaccgcttcggcgccgagagcccgcgttctgacaacttcgcgctgacgctggatacctctgtgccgggacccccatcatggagtgag

SEQ ID NO: 1963 - DNA, 879 bp, Glycine max
  Peptide Sequence Number=SeqID_118741
atgaaaattgcaaaaaaattactcttagcttcactggtgtgtgcgccagtattcacgactttttcaacccaggcgcaaaattcatttgatggcgcatggcgtagtttatcgccggtatcggcagagcaggcgcgggtggtttattatcgtccggcttcattaaccggggaaaaaccggcgaatatttatgtcgacggtgaattccatacgtcgttactggccggtggctatacggtgttttgtgttgcgccgggaacgcattcgctgggcagttatgtcaacgacgcgccagattatcagggtaaacgcgcgcaatcgtggactgataaactggctgccggtaaaacctactacattcgcgctaacctcgatgacagcggtcgtccgctggtggtcagccagcagcaggcgcagcaggaattgctgagcaccaaacgtcaggctcatctgctgtcacgcgcatcgtcggtacagcgctgtcaggaaggaacaactgaagcttatgataactatgcgttttcatctgacctgctgttccgtttcggcagcgccaacagcaacgacatctccgcacaggggcgcgaagcactcagcagttttgccagcatgctgaaaaaggaaaatgctgctcaacgccacatcatcgtcaccggctttaccgatccgattggcagcgacagcagcaatatggcgctgggccagcgtcgcgctgaggcggtgaaagcactgctgattgctcagggaatgaatgcggccaatatcaccgcgcagagcatgggtgagtctcaggttgatactaactgttcaggcagcctgcaggagcagaaagcatgctatgccagcgagcgccgggttattatcagcgttgaaaacaagtaa

SEQ ID NO: 1964 - DNA, 1002 bp, Glycine max
  Peptide Sequence Number=SeqID_118742
atgtcggtaatgctgagcgtgatcgtcccgatgcacaatgcgggggaattattggagcctttcctggcctcgctgctggcccagcgtgagcagcggttggaggtgatcatcgtcaacgatggttccaccgacggttcgggggagatcgcacaccgttacgcggcggcgcatccgcatattcgtgtgatcgatcaagccaatgccggtgtttctaacgcgcgcaatgccgggctcgccgttgcccgaggcaaatatgtggcgtttcccgatgccgacgatgtgctggcgccggacatgtattccacgctgctggaacaggcggaacaacaccaattagacgtgatgcaatgcaatggcgaacgctatttcaccagccaggatgaattgcagccgatttttcccgaggcgcgtttgcgcaccaccgacgttatcaccggcgtacagtggtttgaacgtgcgctgaaatcgcgaaagtttattcacgttgtatggctggcaatatatcgtctcgactttattcgccagcatcgcctttatttcgagccgggattgcatcaccaggatattccctggacaacggaagtcatgtttaatgccaaacgggtcaaatatttaagcacgccgctgtaccgtcaacgggtgcacgacaaatcgatcagcaaccgccgtcgcaccggtcaggcgaacgtggattatcaacgccactatatgaaaatcgtcgagatgctggagcggctcaaccggcgctatgccggcactgtcgccattcgtccggctttccattggcaaatcacccgcgaagcgctgggcatttgccacagcattcgtcgtgagccggatccggctgcccagagtcagatcaccgaagagttctatcagcgcggcatcgacagagcgatgttcgccaatgcgcgcggcctgaaacaagggtggcatgtcatgctgtggcggcatcggctgaaacagtggcgcacgataacggctgctcgcaaccgggcctga

SEQ ID NO: 1965 - DNA, 243 bp, Glycine max
  Peptide Sequence Number=SeqID_118743
atggctaggattttttgggagaggcaaggacacaagatgtcttggaagaaaaaagtggtgcaagaagattcatatccgggagttgctacgtgcacccagcattattgctggggcacccagcaaacagtgaagtggcgaaactgcccttcagcaattattcttccggaagaaggttcttccggaaaagttccggaaataatttttccggaaagtttccggaagaatcttcttccggaagaataa

SEQ ID NO: 1966 - DNA, 298 bp, Glycine max
  Peptide Sequence Number=SeqID_118744
gctcgatcgtgtccaacaacacgcagaggcaaattatggtcattatgcgccttgtgtcaaccaagaggaacgaattcgacagtatcaggatgatgtgtcggaccatccgtggttgggatgtgaccctcgtttgactacttcgaggtacttggcacccatcgttaggcaattcgtgaagttccgtgacatgccggaagggggtgcaaatagcatccagacccacttgggccttccaggatgttttccagaaggcggtgccttctggaggaagcaacctagctcgcctgggcgagccagg

SEQ ID NO: 1967 - DNA, 409 bp, Glycine max
  Peptide Sequence Number=SeqID_118745
atggctgttttggccaatgcctacgacacatttaaccggagatgcgagaagagcggcgcaaggattgtctgttgcacacccactctttatgtatggatggtctctcacctctttcatcatgaaagtagacctgtctatcccctacaaggtcaccacatttgccccgagaaagggaaggcgaattgggagcacctcttggccaatatggtagaggcatccgttaattggttcccccgatggaaggaaggaagagtcggggttttgtcctcatgtgaggggttctcaaacatccccttgatgggaatgaggggttgtatcaattacaatctcatccttgccataagacaacttggttatcccatgagaagagcatcgtcagaagaaagtatcacacctttcatcgcacggg

SEQ ID NO: 1968 - DNA, 324 bp, Glycine max
  Peptide Sequence Number=SeqID_118746
atgggtagtttagcctctcatgacacaagaggtaaaaagtatggaggaaaaggaatgaagatgaaaatggaggttactgattgggcccttctttggtttaatgtagggtacatcatctgtggtattagcgggattgcttgcatcactcaaattagttgggggggggggggagaggacctttggctatatgttcttattcttcggtgttggagagttacgagtctaagggagactggttccttcacatacctaagtaagcacaggatagggaaagtgtttggtacatttccacttgcattaaaatcaaaaggtggccaatcatga

SEQ ID NO: 1969 - DNA, 507 bp, Glycine max
  Peptide Sequence Number=SeqID_118747
atgaaaatcataaccctaaggagcactatgttattaaggtcaagtagttgtggcagcaaggagaaagaatacgagcaagacagaaggttgtgcttacttgtataccgcagacaacgtacgacggcgttacacgaaggagtgacggagtgcacgagagacggcgaacacaggcacggagagccagatccaagctgcattgtacccaacctagtcaaaattcaaatcctaaacccaccaacaccggaaagttattcctatacatcttgttcaaggaagtcaagcacgagaaggctacatgattgccatggtgtggtagaggcgacgcaacgacaactcaagggtgagggctttgcagttatgcagaatgtgagagggcgtaagcgagaaagaagcactggtaggattcaagaagtgagattgtgtgagaatgaaaagggaaaacacatccctttcaggacagtttttaaaactgacattgaagtcttgcttttaacattggttctttaa

SEQ ID NO: 1970 - DNA, 312 bp, Glycine max
  Peptide Sequence Number=SeqID_118748
atggtgagatcgggaggaaggggccaggagaaggaattgtggttggaagcacatttgcgagaggaatgtttggtggtgtcgaggaggagagaggccattttgagggtgcgatcgatgagatcaaagtcgttgctggagggaactgattggagaagcctctcaaaggagagatcaagggagagagaagccacgtccgagagggagagaaacagtcgacgctccacctcacccatattctccgctctagggttttgtgaaggacacagacgtttcaccgtttcaccattgacgacaacaacatcattgagctga

SEQ ID NO: 1971 - DNA, 369 bp, Glycine max
  Peptide Sequence Number=SeqID_118749
atgaccactgctaactacacagaggtttccctgttaggctcatggacatttcaggtatcagcttcagaacagacaatggaccatttaagggggccagaacatgttaagtgccctgtagttgaaggactttcagatcagattcggcaactcagggaatcgattgaacaacctttaacgaatcttgagctttttctcagagttggaattggaatgaaactccccaagggtgttcttcattatggagctcctagaactaggaagacattattagcaaaaccaatttcctgcaaagtagatgctatattcttgaaggttcaactcttgtctttgtgctgtgcgaaaaaagtgcttgatgatgggtttgtctaa

SEQ ID NO: 1972 - DNA, 402 bp, Glycine max
  Peptide Sequence Number=SeqID_118750
atggtaggcaaagatttgggaagtagggacggcccccatgatgtgcaaattcaaaataactacaccttcccgccatatggctcgcctcccaaggaggatgccaataactccgctcccatactcattgaaagccgacaacctcaatctgatcatgcacatgtctctcaacccatgggggagacacatggaatgccccaccataatctagccgacttcgtgccttgcctcggatatgccaccgaagggcaaacagttggtggtatacccatgccaaacactttggagggccctcagtttcgcccacaaccacaacccttgcattccacagtgggtaaaaaccctcatgctatggcggaaatgggaaagttggatcatctaaaggaaaatgctcagggccattaa

SEQ ID NO: 1973 - DNA, 867 bp, Glycine max
  Peptide Sequence Number=SeqID_118751
atgggaagctgcagtgtggatagggtgttcgaagttggaccatgcaaagctggttacgaaatgggtctcttaattggacaaggattctccgaaatgatgagtagagtggtcacagacctcattctacaaaaccagcttcgaccatttccccacactcctcaaaccactttttttttaacaaccaaaccaaatttccaaggtattgagaagcgattttgcttatcaacttcaggaagtagattctggcgtttattccaaaagaaggagcaaaaagtgacaatgttgatacctcggatgattgctctgatgttcttgttatcagtgaatctatggctattgcggcgcacaacgaagatgcaaatgttgcccttgttggccacacctactttaatcaaaggaatcttgccggatggactcttctttgtagactgtgcatttggcttcaatagccagggactggcattcactctggattctgatcccccagctgaagatgagattgtggctggtggcattgggcgcaacttcatttctcgagaccttcttgaagctacaagcatggatgatgcaatgaataggatcaaatcgtcagaagtttctgtggggcattcttataacctgtttgaaacaagcacgcgcaggattgttaatgttgaaaccgcatctaggaagcggatttcagtttatgaggtacaagatgagaattcaatcagcagacagaaaagggcagctgtcttgacaaaagaatcaaaaggggatttcctgtcacttctagaagatatggacgacaaaaaataccctatctacacgactgaggcccaagatatgcccatcaatacaccgcatagctgcaaccttatcacatag

SEQ ID NO: 1974 - DNA, 846 bp, Glycine max
  Peptide Sequence Number=SeqID_118752
atgagtttcgcagcgtacaagatgatgcagtgccccaccggcattgacaattgcgccgtcgggttcctcacccactcccgctctgactttgtccctctccagcccgacgacatcgacgttgagtggccctcccgcccctgccaccacgtcggctccctccccaacctcatcgtcactgtcgccaacgtccttgaagtctacgccgtccgcctccaggaggaccagtcgcccaaggccgccatcgactcccgcagcgacaccctcctcgacggcatcgtcggggcctcccttgaactccacagagataaggctgcgtttattgcttgcatcgctaagctcgtagtcgaggttccttgcaagaggaagcaatatcatacaccatgcaaacacttggtcctcttcttccacgatatcatatacaacggaaacaatgcagccaatgcaacgtccgcaatagtaggagccccagaaggtgccaatttaaccatattggcaaatcagttccactttggaaacatagtggtttttgatgaccccatcacattggataacaaccttcactccaaacccgttggaagggcacaaggcttttatatctataacaccaagaatacctacacttcctggcttggatttacgttcgttctcaataacacagaccatgacggaaccatcactttcgctggagctgaccccatcatgcaaaagactagagatatctccgtcactggtggcactggagatttctttatgcatagaggaattgccacaattatgaccgatgcatttgaaggtgaagtttatttccggcttcgtgttgatattaagttctacgagtgttggtga

SEQ ID NO: 1975 - DNA, 207 bp, Glycine max
  Peptide Sequence Number=SeqID_118753
atggagggcatgcgaggaaaagagaaagaaatgtactttgggcattgcatgagggcaagaaatggaattttgcagttatctttcttctacctattattcaaacaactcgtttaccatgcatctccctcctccttgtcggttgttgaagatgaagaaggaagcactagtagcagatcgacaatggcaatcaacatactgattctctag

SEQ ID NO: 1976 - DNA, 474 bp, Glycine max
  Peptide Sequence Number=SeqID_118754
atggccaccagaatccgaccaagcttcgacgacgacacaattctgcactgtatcagtatagatcctctcatcaatcagtcgttgcagcctgcatcagctatctcctccagtctgccgtcagagagaatggtgatggaaccggcgacggcgtcgccgtggcggtaccgtagagggagtagtagtttctggagcaagaggccttcaccgtttggatcgttggggaagccaaggcttgtcgcggcagagcaagtcgatagcgagtctgatgtttttgtagtggtcgggggtgacgtcggcggcgatgttcttggcgagccggttgagggtgacggggaagaaggagttcatggtgaggatggagggggtgatggaagggaggaaggagaagctgaccagcagggtggcgcgttcgacggtgctggcgcgatgatggtggtctccattttagaaggaaaagaagggaaaaagacgatg

SEQ ID NO: 1977 - DNA, 819 bp, Glycine max
  Peptide Sequence Number=SeqID_118755
atgaacgacgcagatgtctcgaagcaaatccagcagatggtgcgtttcatccgccaggaagctgaggagaaagccaacgagatctctgtatctgccgaagaggaattcaatatcgagaagctgcagttggttgaagccgaaaagaagaagatcaggcaagaatacgaacgcaaagagcgccaagtcgaaattcgcaagaagatgtcatctcgtccgttgacatcgattaaaattaaattctggagtgtgagtcctactcgtataggtcttgatttgatccctgcgtttcataataccgcaacctctactgactgtgattattgtgagtactcaatgcagctgaatgcttctcggattaaagttcttcaagctcaagatgacgtgatcagttccatgaaagaagctgcatccaaggaacttttgaatgtcagtcatcaccatgatgatcatgtgtatagaaaccttctgaaagatctcattgttcagtgtttgctaagactgaaagagccttctgtcttattgagatgtcggaaagatgacctgcacttggtagagaatgtgctggattcagctgctcaggagtatgctgagaaagcaaatgttgatcccccagagatcattgttgacaaccaagtctatcttccacctggactcactcatcaaaattctcatgatctctactgctctggtggggtggtgttggcttctcgtgatggaaagattgtgtgtgaaaatacacttgatgcacgtcttgatgtagttttccgtaaaaagcttccagagatccgaaagcagctctttggacaaattgttgcttga

SEQ ID NO: 1978 - DNA, 1074 bp, Glycine max
  Peptide Sequence Number=SeqID_118756
atgaactgggatttcatctgggtgttgcttctcaccttgtgttgttgctgctgctccttcgggcacagcttggacaacactgctgctgcaagtgaatcattgaattccttggttcaagattttgctttcaggtcactggtcaaacacaggcctcaaactggtgctctgtatgatgctcttcttccaaggaatctgtctggtatggatgtttcagtagtccgtctcagaagcagaaggctctggaacaaaggtgccaactttagctactttcggatcccaccaagaaccatgtccattccccatgtcaggaggttggccattgtctaccaaaacttgggcaactggtcttcccactactacaatttgccaggttactcattcatttcttctgttgttggcttcatggtttttgatgcctcaaatgtaacagacacaagtgagagaaacctcactctcaacacaatggggcagcccatatctattcaatttcccaacattacatttatggctaggggtagcaatagcatcaacacaagggtgagatgtgtagctttcaatgacaatggaacatttcagcttactgagatgagttcccctggagtgtgtaactccagagaccagggtcacttttcagttgtactcccattggagaagaggcggggaacatggtatctttgggtgattggctttgttgttggattttttgggttgatcatagtgggatatgtggttttttcttctagaagacttctcaagaccaagaggattcaagtcatggaaaaacaagccagtgaagatcaggttctagaaagtagatgggttggcaatagtaaaatgccctccgcaacagtgacaagaactcaaccagttcttgagaacgatgtttcaagaatgaagattattactagtcttttaactcgtgcaagcttctccaatgaaggagatttgacggtaaaaataaaaacttggccatcaaggtaccaacaggaagcacaaaatcttacaagtgcacatgcatgtaaagttgcaaagggaggaaaaagagaaaatccttcaccagatacaccaggatga

SEQ ID NO: 1979 - DNA, 348 bp, Glycine max
  Peptide Sequence Number=SeqID_118757
atgtccaaattgacgctgcaaaagtctctctccttcaactcttcactctgcagaagatacaaaatacacttccagaaaggatactttggattgcaattgttgtttccgaaacaggttttctataagcacaataatgattttcagaaccccctttctgaaatatacaaaacacttttcgggatcgccttttcgggtgtggaaaatgaggagctaccgtgggagggaggggtgtcattgccatggtgtactgaggaagggattgttgtagtggtggtgtgttattgtgagggggtgttagggttgagagaagagacaaagaaggttttagggttaagagataggagttaa

SEQ ID NO: 1980 - DNA, 624 bp, Glycine max
  Peptide Sequence Number=SeqID_118758
atgaccgggattaagggagccccttacagagcatgtattgatgccctgacagtgaccgacgtctgttggatgccatatgatgagcatcggggagttcggggctatgacttgatatcctcgtacacggggcaagtaagatggggtccgatcatcgtctacattcgaccagagtgggtggttcgacagatggggtacattcagaccgttcctccgtcaccggttcgtgattcgttaacaggtactgatatagatgaccggtgggtacactttttagatcatgtggcgcctacaggggagctctgtgtagttcctgggcaggtggccccagactacatggagtggtttttccagatttcgcacccttttgtgacgccgaaggaggacactactgagccgagacctacgcctccccctcccactcatgatgatgacttcgtcagatccccctacgcattttgtgttgattgcacaacatgtgtcaggatgggaaggattgctgagcatttggagcgtgtcatcaacctcaggatggtgactgcagagactgacttatatgatatcatggatctttttctgaggatagctagagatgacaacccagatgatagtcttaggccgcgatag

SEQ ID NO: 1981 - DNA, 504 bp, Glycine max
  Peptide Sequence Number=SeqID_118759
atggaggttggcataggtcccatactagacctcactcctaaagaagagaaaaggatagaaggtctgaagagtgaagagagaaaagttccattggctacccttagcttccaagggtatgccctctattggtggacttcccttgttacagaaagaaggattcatggggatcctctagtagagtattggaatgatcttaagagtgatcttaggaaaaggcacattccctcttactatgaaagaaatcttatggtcaatctgcaaaggcttagacaagggagtatgagtgtcgaagaatgtagacaacaaatggaactactccttttaagagttggacttagggaggaggaaagaacaagcataactaggttccttagtgggcttaatatggaagtgaggaacaaggagactacttcttgcccttcctctagtggaagtgaagatgaagtaaggggtgaagagtctagtgaggaagtctacccccatgaagaagatgacctcttaatg

SEQ ID NO: 1982 - DNA, 189 bp, Glycine max
  Peptide Sequence Number=SeqID_118760
atgggaacatttcctcttctcagcctaagaagatgtgaaagcgcctctctctataagaatggatgcgatcttgctcgtgaaggtaatgaaattatccgtgaggctagcaaatggagtcctgaattagctgctgcttgtgaagtatggaaggagattaaatttgaattcgaagcaatggatactttgtaa

SEQ ID NO: 1983 - DNA, 258 bp, Glycine max
  Peptide Sequence Number=SeqID_118761
gggaaaagagggaggtggttcccgcccagctcgcccaggcgagctgggttgcttccaccagaaggcaccgccttttgttgaacaacctggaagatccaagtacttgacacccatcgttaggcaatccgtgaagttttgcgacatgtcgggagttgaaaggaaaggggtacaaatagcaatcaggcccacttgggccttccaagatcttccaacagaaggcagtgccttctggtggaagcaacttagctcgcctgggcg

SEQ ID NO: 1984 - DNA, 841 bp, Glycine max
  Peptide Sequence Number=SeqID_118762
aatcaaactctatgatgctgatccaaatgttctatctgcattctccaattcagatgtggaattcatcataggactagggaacgagtatctgcagagcatgagagacccttctaaggctcagagctgggttcaacagcatgttcagccttacatttcactaaaccagaatcacttgcatcactccaattcttttcctccttcatctggggcattcaggcaagatctgatacaatacattcaacccctccttagctttcatgctcaaatcaaatcacccttcctcattaatgcatatcccttttttgcatacaaggacaatccaaaccaaatctccttgaactatgtgctatttcagccaaatcaaggggccactgatccaaacaccaatttgcattatgataacatgttgtatgctcagattgatgctgtctacgccgccatcaaagcgctgggacataccgatgttgaagtcaggatttcagaaactggttggccttctaagggtgaccctgatgaggttggagccacaccccagaatgcagaaatatataatagtaatttattgaagaggatagagcagaagcaaggcactcctgctaatccatctgttccaattgatatttttgtctttgcacttttcaatgagaatttgaagcctggtcctgtttctgagagaaactatggcctttattatcctgatggtaccccagtttataacattggattagaaggttatctcccagaaatggttatagagtccaaatctaacgctttgtccaccaattttctcatctacatatttacatgtttgttgttcatttgggagctttcaagaccgtga

SEQ ID NO: 1985 - DNA, 405 bp, Glycine max
  Peptide Sequence Number=SeqID_118763
atgaaagttattggtagaaagaaattctgtggtttacgcctacagagattatttttaaatgttgtctcagaggtgggcgtagctcttgatattgttgaaaaaatgtgtgaagctggatttaccttgtcaactgaggtgttacagtgtttggtacactttttcgtgaggatgaaagactttgaaggtgcattcaggatgattgctgacttagaggatatgaatttcaagcctacaacaaacatgtacaatgctataatggcaggatattttcgagagaagaacatcagtggagtgttgagggtccttaagaaaatgcgaggtgccaatgtaaaacctgattctcagactttctcctatttgattcggaattgtgaaaaggaagaggatataatgaaggtagcttaa

SEQ ID NO: 1986 - DNA, 228 bp, Glycine max
  Peptide Sequence Number=SeqID_118764
atggacaaggcaatggctgtgatcctgaaatatttcctatcagtcaggataaatgtcagtaatagaaaaggaagcagcagaaaggtcacttatggcgggggaaaacatgatggtttaaaacgtcatggcagtagaaggattaaagcagttcctgctcaaaataaggccactagtaatccacgaagctttgagaaacttaaaatggaatatgcatcacaaaccacttaa

SEQ ID NO: 1987 - DNA, 375 bp, Glycine max
  Peptide Sequence Number=SeqID_118765
atgaatcttatcagtgttagtcaattctgcaaagattctaaacatgttcttcataaaggtcttgtgggaagtgatgaactctatcaattcctagctttgcttacttccatgtctcagctcaagggttcttccaatgtctttaattctgttccttcaaataaaactgctgttgtcaatacagcttcttgtaatactgctgttgataatgcagcttcttgtaaatctgtttcttgtactacagttccttgtaattttgtttcttgtgctagtcctgttgttaatacagcatcttgtaaggctgtttcttttagcacttggcattctagactaggacaccctagtgttaatgccatgaaagttgtattccaactttga

SEQ ID NO: 1988 - DNA, 361 bp, Glycine max
  Peptide Sequence Number=SeqID_118766
atggtccagtctgctatagaagcttctcttaatgaatacgaggataacatcattgagacaaaccctagtgttgcacctattagacccaaaccaatatttgaatatgatgaaagggtgagatcagtagcaagccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 1989 - DNA, 1152 bp, Glycine max
  Peptide Sequence Number=SeqID_118767
atggcttacacatattttcatgtgctcacagcctgcactagcatgtttcttgtcacatggaacatgacaaaaagtgacacagcaagtgtttgtgaaatttcagggttgttgccaaatgggaacttcgagcagggcccaaagccatcacaattgaaggggtccgtagtgacaggccacgatgccataccgaattggacaatttcggggttcgttgaatacataaaatcaggacaaaaacagggtgacatgttactggttgtgcccgagggtgactatgcagttagacttggcaacgaagcttccattaagcagaagctgaagctgattaaggggtccttctactccatcacgttcagtgcagctcgaacctgtgcacaagaggagaagctcaacgtgtcagtggttccaaccaccgagaagagggactggggcatcatccccattcagactatgtatggtagcaatggctgggagtctttcacttgtggcttccgagcagatttcccagaagctgaaattgtcatccataaccctggcaaagaagaggatccagcttgtggtcccctcattgattccgttgccctcaaggtcttgtacccacccaaaagaacaagagctaatttgttgaaaaatggaaacttggaagaagggccatatatatttcccaactcgtcttggggggctttgatcccaccgcatatagaggattctcacggtcctttaccagggtggattgttgagtctcttaaggccgtgaagtacattgattctgaccactttgctgtgcccgagggaaaaagagctattgaacttgttgcagggaaagagagtgcacttgcacaggtagtgattactacaatcggcaagacttatgacctcactttcgccgtgggtgatgccaacaatgaatgcgaagcttccatgatggtagaagcatttgctggcgcaaacactgtccaagttccatatcaatctaagggtaaaggaggttttgtcagaggcaagcttcggttcaaggccgtctcaacacgtactcgtcttaggttcctaagcacattttacaccatgaagagtgataactctggttcgctttgtggacccgtcatagatgatgtaaaattgcttggtgttcgttatcccacacaggcttga

SEQ ID NO: 1990 - DNA, 608 bp, Glycine max
  Peptide Sequence Number=SeqID_118768
atgatggaggccatgatgaacatgaagaagataatggaagtcaatatggttgccggtaccagtgttgttgctaaggtgaacccgatgccctcatctggcctcaaccaaatgaatcatccaacctcaaatatggtaggcaaagatttgggaagtatgggcggcccctattatgtgcaaattcaaaacaagcacgccttcccgccatatggcttgcctcccaactatacaccacccaatgtggcgtacactcccagtgagaatgtcaataactccactcccatactcattgagagccgacaaccccaaactgatcatgcacatgtctctcaaaccatgggggagacacatgaaattccccaccacaatctagccgacttcgagccttgtctcggatatgccactgaagggacaacagttggtggtatacccctgcaaaacactttggagggccctcagtatcacccacaaccacaccccttgcattccacagcaggtaaaaaccctcatgctatggcagaaatgggaaagttggatcatctagaggaaaggcttagggccattgaagcaggcgaagattatgcctttgctaaggtgccagactttgacaa

SEQ ID NO: 1991 - DNA, 204 bp, Glycine max
  Peptide Sequence Number=SeqID_118769
atgactgccgacaaaggaaaacccatttttgaagtagttcttcctttggggttgccattcaaagtcactctcgattggcgatatcccgccccacataatcaaagaggaaaaagaccgacacacccagcttcctctccaaaaaacactaccctcgagaaaatcctattgatccgtgatcgtgcgtgtgatcttttggttcgatag

SEQ ID NO: 1992 - DNA, 426 bp, Glycine max
  Peptide Sequence Number=SeqID_118770
atgagggcgcacactgcctactcacgtctaaccacaagtaatgctaataacaaaaagtgcggtgaccttggtcacgtggctccgctccctcccaagaaactgagcaggctcctcccctgcctgggcatcgggccagtctccaggccatgcgacctcagccccaaactactccggggtagggcatacaaaaggggtggaaccctgcccctgctgactgaggctgaaccgatagagacattcatcgaaccaaatgctatagataacgctccacgccaagtggcccagctagatcgacctgccgaggtggtggcggtgcgcctgcctaggcgtgtagtacttctcgatgaaggctcaggtgatcgacgatcgtattaccttactgggggtgacaggaactccgtaggactggcagaggcccgtgattag

SEQ ID NO: 1993 - DNA, 147 bp, Glycine max
  Peptide Sequence Number=SeqID_118771
atgacgtttaggaattctatcggagcagtcggaggaaaagctggagaaatcaatagagatgctattatcgctgttagaagacacgtgatcccgcttagagtattgttattgtgtgattccaaaaattattcaagtgttggagtttga

SEQ ID NO: 1994 - DNA, 462 bp, Glycine max
  Peptide Sequence Number=SeqID_118772
atggtgggttacacaccttcaagttttacagatttggtcttcgccagcaaaaagatcgaagtggatccgaaaagaggcaaatttgatcatcctactaggacgactgagaaaactggggcaaatgaagagggtgagaaagagggagaaacccatgctgtgactgccattcctatacggccaagtttcccaccaacccaacaatgtcattactcagccaataacaaacctcctccttacccaccacccagttatccacaaaggccatccctaaatcaaccacaaaccataaccctagccaaggttcatcaacctccatttctccgagaatacgactcaaacgcaacgtgtgcttgtcacggagaagccccggggcgttccattgagcatggtagggctctgaagcgtaaggtgcaaggtctaattgatgcgggctggctgaaatttgaggagaattgcgtgtaa

SEQ ID NO: 1995 - DNA, 969 bp, Glycine max
  Peptide Sequence Number=SeqID_118773
cgcccgtcagcgattcaacagcgagccggtgaagaactctctgcgcaccggcagctcgccgcgcgggctgttaatggcgctgaacagcagctccgcggcgatctcccccagtttctgcgtatcgtgatacacccccggaatgtgcaggccgtaagcgccggcgcgcggcggctcgtctatcgagaagaacttcacctgctgatagagccccatctcgtggcagatggcgatggcgcccagcgtgatgatgccgttcaggccgatgatgtaatccgggcggttctccggctgcgccagataggcgcggacctcgctctcttgcgaggtaatttccgaatccgccgggccgccgataatcaaaagcttctgctccggctgctccgccagatagcgcccggccagcacgccgatctcgcggttatcgaggaacacgccgctcagctgctgatcgtagagatcgcggtcgatcaggatcagcggcacgccgtacacctcggccagctcgagataggcggggcggtagcgcttgtcgtcgcgcaccgccgacagcaggatgccgcgcgccttgtaaccgaacagcgcctgaatggcgcgcatttccgcctcttcgctgccgtcggtgtcgaacagcatgatctggtagccctgctgacgcgcaatgcgcgatacggtcttgatcaggccggaatagaacgggttgtacatgctgctggtgacgatgccgataatctggctgctgctgcttttcagctcctgcgcgaacgcgttgggcacatagttcagctctttggcgatggcgtgaatgcgctcgcgggtttccggcttgaccagctcgggcttattgaaggcgcgggaaacggtgatattggtcaccctggcgcggcgggcgatatccacgatagtggcattgggattggctttcgacaccgtctttccttgcgttatgcctcaacagatcccttattgtag

SEQ ID NO: 1996 - DNA, 669 bp, Glycine max
  Peptide Sequence Number=SeqID_118774
atgttcagtcaggttgatatcaatagtttcggtagttttgcggacctcagttggagaaagagccttaaggatgcaggtaacaacgtccagaatttcaagaggctcaacatcctctacggacggaactactctggtaagacaacactctcgcggattttccgcgctttggaaacggggcgcattccacacaactacgtggacccaaatttcactattcgtggtgacaaaggtgatgtgacacaggtaggccttgccggtcatggctacgatgttcgagtctacaaccgagattttgtgagcgataacctaagcttcttggtcaatcaaaccgacggcgagatcaagacgtttgctattgttggtgaaaagaataaagaaatcgaagataccattaccgcaatccaaactaagctaggcagtgttgaatcgaaggcgggcctccggcatgaacttgaagctaaaaagaaagagcgagatcgaacgaaagacaatcataaaactgcgtctgatgctctagagggcaaacttcgttctcatgccaacaataagattaaacagaatcgcatctacggcccagctgtctacaacatagaaagcatcaaaaaagacattggctcagtcaaaaaaactagcttcatagctctgacaaccgaagaacaagcagccaag

SEQ ID NO: 1997 - DNA, 404 bp, Glycine max
  Peptide Sequence Number=SeqID_118775
ttttgccttgtcatggatcttttcatggcaatacagatacggaaagactgaaaacagcaagcaatatccaccgttacagagacacgcctttgtaaaatggtggtcacaattcgatacttcaaaggctgctccagaccaagtcaagaactggttccagagcaatcctgagttccttaaacctgctgatccggagacatctttgtttctaaatcagaagtcgcaactggcagcattcttagcaagctcaaaatctaaagagagtcttgctcagaatctcaaagaagttctccaactacttcaacaggaagtggaagaagaaccttccaagaaggaagctgaatcatctgagactaatgatgaccaagaagatgatccattctaccagaatgaagaatactgttttg

SEQ ID NO: 1998 - DNA, 372 bp, Glycine max
  Peptide Sequence Number=SeqID_118776
atggctgaaaacctgagtgataaattttcccgtggtgaattgctcaatgtgaactgcccgtcacgtgaagtgttaaaacggattaccagccgctggagtgtgctggtgttactggcgctgcgcgctgaaacgctgcgcttcagcgaactgcgccgccggattggtggcatcagtgaacgcatgctggcgcagacgctgcgctacatggaagaagatggcttcattgagcgtatcgcctatgaagtggtgccgccgcacgtggagtaccggctgacggcgctgggccatgaggtggaagggcaggtcatcggcctcgccgactggctggaaagcaatgtccaccgcatcattaaagcgccgcagacggcgtga

SEQ ID NO: 1999 - DNA, 1260 bp, Glycine max
  Peptide Sequence Number=SeqID_118777
atgtttggattagatgccttccacctggccaggattcagttcgcctttactgtttccttccatattattttcccggccatcaccatcggtctcgccagtttcctggcggtgctcgaaggcatgtggctgaaaacccgtaacgagacctatcgcgatctctaccatttctggtccaaagtctttgccgttaacttcggcatgggcgtggtgtccggactggtgatggcgtaccagtttggtaccaactggagcggcttctcgcagtttgccggcagtattaccggtccgctgctgacgtatgaagtgctcaccgccttcttccttgaagcgggcttcctcggcgtgatgctgtttggctggaaccgcgttgggccgggcctgcacttctttgccacctgcatggttgcgctcggtaccatcatctcgaccttctggatcctcgcgtccaacagctggatgcataccccgcagggctacatcattgagaatggcatcgtggtgccgcaggactggtttaagattgtcttcaacccgtcgttcccgtaccgcctgttccatatgtcggtggcggccttcctcgccagtgccttctttgttggcgcgtctggcgcgtggcatctgctgcgcggtaacgataacccggcaatccgcaaaatgttttctatggcactgtggatggcactgatcgttgcgccgattcaggcgatgatcggcgatgcgcacggcctgaatacccttgagcatcagccagcgaaaattgcggcaattgaaggccactgggaaaacccgccgggagaagcgacgccgctgatcctgtttggtattccggatatggatgaagagcgcaccaagtatgcgctggaagtgccgtaccttggcagcctgattttgacccacagcctggacaaacaggtcccggcgctaaagagcttcccgaaagaggaccgtccgaattcgctggtgatcttctggtcgttccgcgtgatggtggcgatgggcctgctgatgatcaccctcggcgtgctgagcctgtggctgcgttacaaaaagcggctgtataactcccggccgttcctgtggttcgccctgctgatgggcccgtccggcctgatcgccattcttgccggctggtttaccacggaaattggtcgtcagccatgggtggtgtacggcgtgcagcgcaccattgatgcggtgtcggcgcatggtgatttgcatatgaacatcagcctgctggccttcatcctcgtctattcgacg

SEQ ID NO: 2000 - DNA, 891 bp, Glycine max
  Peptide Sequence Number=SeqID_118778
atgacccgtcttaccgcccaggattttccccaggaactgcttgagctttatgactactatgcacacggtcgcatcagcaagcgcgagtttctctcgctggccgcgaagttcaccatcgccggcatgaccggagccaccctgctcagcgccatgagccccaattatgcgctggcagagcaggtgtcgtttaccgaccctgatatcaacgccgaatacattcactacccgtcgccccagggacatggcgaggtacgcgcttatcgggtgcgcccgactcacgccagcggcaagctgggtgccgtggtggtggtacacgagaatcgcggcctgaatccttacattgaagacgtggcgagacgggtcgccaaagcgggctatgtcgcgctggcgccggatggcttaagttcgctgggcggctatccgggcaatgatgaagagggccgcgcgatgcaggccaaagtcgacccggccaaactgatgaacgatttcttcgcggcggtcgatttcctgatgcagcatcccgaggggaacggcaaagtcggcatcactggcttctgttatggcggcggcgtggcaaatgcggcggcagtggcgtttcctgagctggcctgcgccgtgccgttctacggccgccagccaaaagcggaagatgtggcgcgcattcaggcgccgctgctgctgcactatgccgcgctggataaaggcatcaacgaaggctggccagcctatgaagccgccctgcaagccagccacaaaacctatgaagcgtatatttatcccggcgtgaatcacggctttcacaacgactcaacgccacgctatgacaaagctgccgccgacctggcatggggtcgcacactcggctggtttgagaaatatttgcacgcctga

SEQ ID NO: 2001 - DNA, 507 bp, Glycine max
  Peptide Sequence Number=SeqID_118779
atggaaaaacctaaagcagagattttgacaacttgtgcaaagatttttgctaagccctgccgtcaaaaatccttgtacaagttggccgattttttccgctatctcctgacgggcgagcttcgtatcgtgctctcatcgcacactgacaggaacagcctgatgaaccagccaaatccacaaacagcgcgcagcggcgcgttttccccttttgcctacgggcttttcgccgtgatctggaccgcttcggtgctcggcaataccggtagctttatccgtgacgtcgccagcgcctggctgattaccggactgtcggataacccaaccgccgtcgcgctgatgcaaaccgccgccacgctgccggtatttctgctggcgctgccggccggcgtgctgtcagatattgttgaccgccgccgcctgctgattgtggtgcagctgctgatggccagcgtcagcggcacgctactgctgctgtcgcacaaccactggctcaccgtgaatggctga

SEQ ID NO: 2002 - DNA, 822 bp, Glycine max
  Peptide Sequence Number=SeqID_118780
atgagcacattcaagactaaagacggcgtaaacctgtacttcaaagactggggcaagggccagccggtgctgttcagccacggctggccgctggatgccgatatgtgggacagccagctcaacttcctcgccgagcgcggctatcgcgtcatcgcgtttgaccgccgcggctttggtcgctccgatcagccgtgggaaggctacgattacgacacttttgccgacgatattcacggcctgatcgagcacctgcagctggatgaggtgacgctggtgggcttctcgatgggcggcggggatgtgtcacgctacattggtcgttatggtaccgcgaaagtgaaaggactggtgctgctgggcgccgtcaccccgatctttggtaaaaccgacgatcacccggaaggggtggaatcagcggtgtttgacgggatcaaagcgggtttgctgaaggatcgtgcgcagtttatcaaagagttcgccacgccgttttacggcaccaacgcgggccagacggtttccgatggggtgctgacgcagacgctgaacattgcgctgctggcgtcgctgaaaggtacactggattgcgtgaccgcgttctctgagacggatttccgtgcggatattgcgaaggtggatgtgccgacgctggtgatccacggcagtcatgaccaggtggtgccgtttgaagccaccggtaagctggtgcacgagatgattgcgggttcgcagctgaaagtgtatgagaatggcccgcacggttttgccgtgacgcatcaggaccagctgaatgcggatctgctggcgtttttgcaggggaattaa

SEQ ID NO: 2003 - DNA, 1569 bp, Glycine max
  Peptide Sequence Number=SeqID_118781
atgacgaccgcatccctgatttttaccaacggtaagtttcacaccgtcgaccgcgcaaacccgctggccaccgccgtagccatcaaagacggcaagttcctcgccgtaggtagcgaagcggacgtcatgcgctttgccggcagcgacacgcaaatcatcgacgccaaaggacacaccggcattcccggcctgaacgattcccacctgcatctgattcgcggtggcctgaactacaaccttgagctgcgctgggaaggcgtgccgtcgctggccgatgcgctgcgtatgctgcgcgaacaggccctgcgtacgccgtcaccgcagtgggtgcgcgtggtcgggggctggagcgagttccagtttgctgagcgccgcatgccgacgctggacgaaatcaacgccgccgcgcccgatacgccggtcttcattctgcatctgtatgaccgcgcgctgctcaatcgcgccgcgctgaaagtggtgggctacaccaaagagacccccaacccgccgggcggcgaaatccagcgcgacagcaatggcaatccgaccggcatgctgatcgcccgtcctaacgccatgctgctgtacgccacgctggcgaaagggccaaagctgccgctggaacagcaggttaactcgacgcgtcagtttatgcgcgagctgaaccgcctcggtctgaccagcgccattgacgccggcggcggcttccagaattacccggacgattacgacgtgatcgccgaactgcacgcgaaaaagcagctgacggtacgcatcgcctataacctgttcacccagcggcccggccacgagctggaagactttgagaagtggaccgatatgctgaagccgggccagggcaccaatttcctgcgccacaacggtgccggtgaaatgctggtgttctcggcggcggacttcgaagatttcctcgaaccgcgcccggatctggcacccggcatggaagatgagctggagcgcgtggtgcgccacctggtggagcatcgctggccattccgcctgcacgccacctataacgaatcgatcagccgcatgctggatgtgtttgagaaggtgaaccgcgacattccgttcaatggcctgcactggttctttgaccatgcggaaaccatcactgaagccaatattgagcgggtaaaagcgctcggcggcggcctggcggtgcagcatcgcatggctttccagggagaatactttgtcgatcgctacggtaaagaggccgcgaagcagacgccgccggtggcgcgcatgctggaggccggcgtgccggtgggcctcggtaccgatgccacccgcgttgccagctataacccgtggaccgcactgtactggctggtttcaggccgtaccgtcggtgggatgcagctgtacgatgacaatgcacgcatcgaccgtgaaaccgcgctgatgctgtggaccaaaggcagtgcctggttctccagcgagcagagcgccaaaggtgagatcaaagtcggccagctggcggatctggtgctgctgtcgaaagatttcttcagcgtgtccggaagaggagatcaaaggcattga

SEQ ID NO: 2004 - DNA, 1284 bp, Glycine max
  Peptide Sequence Number=SeqID_118782
atggccgcttacggtgccgatgtcgccagttattttttcgtcatcgccgcgctgctgtggtggaaacgtccggcgaaagccgctaccgcgctgaatgagcacttctttggcgcttttcgcgccgggctgcgctatgtgaaggccagccgcgaactgcaccgcgtgctgttacgcgctgcgctgtattttgccttcgccagtgccatctgggcgctgctgccgctggtggcgcgcaccatgctgcacggcagcgcaggcttttacggcttgctgctcggcgccgtcggggccggtgccattgccggcgcgctgctgctgccacgtctgcgtgcccggctgagccatgacggactgatgctgctctccgccgtgctcagcgcgctggtcatggtggcgctggcgctcagtccgccgcagtggctggcgctgctgctgatgctggtactgggcaccggctggatcatcgcgctgacgaccctcaacggcgtggcgcaggcggtgctgcccgactgggtgcgcggtcgcgggctggcggtctatctgatggtgttcaacggcacgctggcgggtggcagtctggcctgggggctgatcgcccagcacatgggcctggcgccaacgctgatgctggccggcgcggcgctgctcatcacggcgctgctggcaaaacggctggcgctgccggcgggcgaagcggatctgcagccagcgcagcactgggctgaaccggtggtgagcgatgcggtggatatccgccgtggcgccgtactgatccagattcgctaccgtgttccccaggccgatcgcgccgctttccagcacgccatgcacaaactggcgcaggcacgacgtcgtgacggtgcctatgcgtggggattaatggagcagaccgacgatgccggagcgctgctggagtggtttatggtggagtcatggcaggagcatttgcgtcagcaccagcgcgtctcgcgcgccgatgctgagttacagcaggcggtactgcagttccaccagggtgatgaacccccgcaggccgggcagcgtcggcaggcgctcgcgccaccagatagccgcgttgccgcaggcgctctcattccacgccagataggcgatatcgcgccggcactcgctgtccagctggcgcgccaccagcgcaccgctcgccaggtgcgggcgcgccagataaagcggcagataaccacagccgagcccggcgagatgcgcctgcagtttggccgggaaatcatgcacgctcagcgtcttctgctcatccagcacgcgtaa

SEQ ID NO: 2005 - DNA, 846 bp, Glycine max
  Peptide Sequence Number=SeqID_118783
atgtccgaagaagcgctgcgccagcagattcagaacctgaaaaagcacaatgcgcgccttaagcgcctggcgcacgacgcgcgtaataagctgaacgcggcgctggacggcaccggcttgtgcctgtggcagctggatattcccagcggcaagctggtgatttttaaccggcgctggggcgcgatgctcggctttcaggcgaaagagaccaaagcgcgctttgatgcctggcgcgagtgcctgcatccggaagatgccgatgaggtgctgcgcgccttttacgatcatattgaaggacgcgcgccctattacgaggcgctgcaccgtatgatcggcaagaacggcaaaatcacctgggtgctggatcgcggccgcgtcagcgagtgggacgagcagggtaatccgctcaaagtgaccggcacccatatcgacatgaccaaagagaagaattacgaagcccagctctccctgctggcgcatcacgacccgttaaccgcgttgcccaaccgccacgcgctgcaggcgcattttagtcagctgcaacgcgccgggccgctgtgcgtggcgtttatcgacctcgacaacttcaagcacgtcaatgacacgctcggccatcgcagcggtgacgaggtgctgattcagctcagccagcgcatccgcgatttgctgccgtcagaggccatcgtcgggcggcttggcggcgatgagttcgtgctgctgctgccgtttttgattgattaccccaaggtgcgcattctggcgcatgcggggctggatgcagcgctgactccgtttgatatccacaatggtcatgcgcggattggtgcttcaatcgggatcgccccg

SEQ ID NO: 2006 - DNA, 650 bp, Glycine max
  Peptide Sequence Number=SeqID_118784
atgcctgacgcgcaacgtgccgtcagagaagaagcgcagtcatggtggcggcgcgcgcaaccggtccagcgagtgaaaccatccgtgagtaaacgcatcctcagcctccttctgttactgggcttttgcctgtctgcctggggtgcaaccacgttaaatttctcgccgcgctatggtctggtagcaccggaagtcacgctgtcgccgcagagccagcagtggctgaaacagcactctgtactgcgcgtcggcgtgtggaacaatccgctgccgccctattccgtgtcgtttgaagccaatacctacgaaggactctcggccgattatctggccattgtggcgaaggcgttaaatctgccggtgaaaatcaaggtgtataaaacccggctggagctggtggatgcgctcaacgacggtgaagtcgatctgattccttactacacgctggccgccaatcaggatacgcatctggcgctaagcctgccgtattcactggcgcgcagcgtattaatcagcaaacgtaacgcgaccttcgacagtgagctgaaaaatagccgctatcgtctgctctattacggtgatgcagaactcaaagcgctgctgcacaagcgctatccgcgcgccacgctggccccggccgcgccgccgct

SEQ ID NO: 2007 - DNA, 493 bp, Glycine max
  Peptide Sequence Number=SeqID_118785
atggcacacagagacaaattatggtcattctgcgtccttttgtcatctagaggcggtgggctcgatgacacgcggagacaagttatggtcatccgcacgcttttgctatctgtaagactcgacgagataaacgcgcagagacaaattatggtcattctgcgcccgttgtcattcaggaacaacaagttgagtgataaacacgcagagaaaaattatggagcagcaagtcgagtgataaacgcgcaaagacaaattatggtcattctgcgccctttgtcattcaggagcagtgagtcgagtggtgggcggagacaaattatggtcattccgcacaccttttcgccatccagaggcgatcgtgtccagtggcacgcaaagaccaattatggtcattctgcgccttgccacccaggctcgattgtgtccgaggacacgcagagaaaaattatggtcattctgctccttgtgtcacccaagaggaacgaattcgaca

SEQ ID NO: 2008 - DNA, 246 bp, Glycine max
  Peptide Sequence Number=SeqID_118786
atgaccataatttgtctctgcgtgccatcgaaaacgactgtgtctggatggcaaaaggtgagcggaatgaccataatttgtctttgcatgtcatcgggctcaccgcctctggatgacaaaagggcgcagaatgaccataatttgtctctgcgtgccatcgaaaatgactgtgtctggatggcaaaaggtgagcggaatgaccataatttgtctctgcatgtcatcgggctcgccgcctctggatga

SEQ ID NO: 2009 - DNA, 643 bp, Glycine max
  Peptide Sequence Number=SeqID_118787
atgacggaaccatcaaaaaagcggaaaggaacttcaagtcggagtcagtggcattcagggtcacaggaagccccaattcctccctccattccctttggatcattattctcatcagaggaacaatgtatacggtacacaaacctcttttcctctcgtttcattgtagacccaaaattcatagatatggagttcttctcaaatgagaattttgaatgcttccaagcatttgaaaactccaatcttattccattcatgtctctaaaattacctgtctattctgaattagtcaaagctttctattctaatttagaaatccatgaaggtaccctaatgtctgaagtttatgggattaagatggtcattgaccaatccctattttatgatttaacaaaattgcctagtgaaggtgtgccttttgagggtgcactgattgatgaatggaaattcgatttctctgtgcatgatgcacgccggttggtttgcaccaaccaagcggatatgaccggaagactacttgccggttcattggcttttgagagccgcatcctccattaccttattgtttgcatcctactccctagatcttcaaaccttgctcaagtttctgaagaagatctcattgtcatgtgggcctttcataaag

SEQ ID NO: 2010 - DNA, 564 bp, Glycine max
  Peptide Sequence Number=SeqID_118788
atgtacgaccagttagatgaggcttgtaggaccaccacccgacagcttgcggggtacttgacgctacttcagtgctggatctatgagcacttccctagtgtgcatcagtgcgtgactgacgatacataccaggagacgtccccacgtgcttcccggtggttgacgtcgaaagcgcacatgaagggcatcacaggagcaccctacagggcacgttgtgatggtttgaccgtcacatatgtgtcctggttgccgtacacggagcatcggggtgttagggcgtttcaggagatttcatcgttccagggtcagctcagatggggtcctatgatcgtcacagttcgaccggagagggtggtacgccagttcggttacatccagagcatccctccgccgcctgtatctgcggattacattgagtggtttttccgcatatctcaccctttcatgacaccgacccaggcagctgaccaacagagggatgcaccagctgcagaccctgaggactacatacagccgcccagcccccaggttccagtggcattgacccccctccatatgtggtaa

SEQ ID NO: 2011 - DNA, 351 bp, Glycine max
  Peptide Sequence Number=SeqID_118789
gtgttgttgcctgattcacgattcactcgaccggatatgggttttcacccgacgaaactcaatgtcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 2012 - DNA, 522 bp, Glycine max
  misc_feature (338)..(338): n is a, c, g, or t
  Peptide Sequence Number=SeqID_118790
atgtccaaatcttgtggatttgggatgaccggccctctcgatgagtcgatctcttgctttctcataagggtggacccttgggtacttgtacctatcaccatcagaggactacacgtcctcgccttgagaggcctacacgccctcaccttgggactacacgtcctcgccttgagaggactacacatcagagggctgcacgccctcacctccagaggactacatgtccttgccttgagagggctacacgccttcaccttgggtactagttaccctcaccgtcagaggactacacgtcctcgccttgagaggactacacgtcctcagcatcagagggccgnacaccctcgccttcagaggacttcacgtcctcgccttcatagggctacatgccctcaccttctgagggcttcacgccctcgccatcagagaactgcacgtcctcgccatcagagggctgcacaccctcacctccagaggactacacatcctcgccttgagagggctgcacgccctcacctttag

SEQ ID NO: 2013 - DNA, 180 bp, Glycine max
  Peptide Sequence Number=SeqID_118791
atgttgctaagtagcagtgtcatacatatctgtgtaagagtggtcatgttggtgcgcacgatccgcacttgtctctttgcagcggcacggatgtggagccctctgaaagcgaggacgcgtagccctctaaaggcaagggagtatgcagccctccgaaggcaaggacgtgtcaccttctaa

SEQ ID NO: 2014 - DNA, 414 bp, Glycine max
  Peptide Sequence Number=SeqID_118792
atggaatcaagaaaaagagctagaacagaagacatcccttcatcatccactccagctcctcccctgcaagagttggctcacaataggccaatcatatccatggagcattttcttgagcaagtagcctggcctgaagctcaacttccattgatgagacccaacgaggttaattcagagccaactgacccacaatctccagtggtgaatccaccttcttcacctgagcttgaagcagttccgccatctcctcctctgattgtcatttctgacgcatcatcagatgaagcggctacccctcctgattcaccagttgtagaaatagctgacccccttgtttccccaattggaggagttgcaaatctttctaattcatcatctggagaagttgttgctctcaccaattccccagtttaa

SEQ ID NO: 2015 - DNA, 324 bp, Glycine max
  Peptide Sequence Number=SeqID_118793
atgaatgcatgtcccaaaaatatgtgcaaaccaaattgccccatggcttgtttccctacaaaaaatcacgcgctaatgccattgagacatttcaccgaacacttggtgggcgcgcgtttaggcatcaatagcaagagaacggagacaatgtgcacaaaaaggagatcaaaatacaccaatgaaaagctagaaagcttagggatggaatacttacttgttggtgatgaacaaaagcgcaaaacggaatcaaaaaatgcgaaaaaggatgaccctagggctgcaaattcatcaatcccgtggaggtggctcgcccaggcgagctaa

SEQ ID NO: 2016 - DNA, 507 bp, Glycine max
  Peptide Sequence Number=SeqID_118794
atggctaagttcgatcctgagatagtcagggatttttatgctattgcctggcctacagaagaaggagttagagacatgcgctcttgggtgaggggccaatggattcccttcgacggggatgccatcaaccagtttctggggcatccactgatcttggaggaaggccagtacaacattctccccaatgaccataactcagacctccccctgccgaagtgtcagttagtctatgccatcctaacacaggtgagtgtacatgttgctcagctgatctctaatgctatctaccagtttgcagggattactcctccaagacacccagtggacccgaaaaagtccaacagggccctgggatttcctgctctaattataggtgatgtaagctccattggagcttgtaggcctaggatcttcttcatcaatggattcctttgcttcttggaagatgaatggcagtggaatggagaaggaagagagagaggagacgccacatcaaggagaagatga

SEQ ID NO: 2017 - DNA, 201 bp, Glycine max
  Peptide Sequence Number=SeqID_118795
atggagcatgaaatattccttgcaacttggttgacagagattgatttctctcccaatggcttgagattctcaaatttgcaaccacagcctaggttgatcaaccatgaaaaacctatgctatgtaggtggcacaagcttaatcccttgaaaattgagggtaggagatttgccctggattcagctagggactactttccttag

SEQ ID NO: 2018 - DNA, 775 bp, Glycine max
  Peptide Sequence Number=SeqID_118796
ctttcggcgtcaggctgttgcgagtctttataggcgtccagttgctccggcataaggtctttggtttccagaaacaggttgataatctcggtgctcaggctcatttcctggcgtcttgcaccgtccagcaggttctccagcaggtgggtggtttcctgcagcaccgaaaagccaaaggtcgccgcgccgcccttgatcgagtgcgccgcgcggaagatggcgttcaacggctcgatatcgggggccagcggatccagctccagcagatgttgctccatgtcggccagcaactcgtccgcctcatcaaagaaggtctgataaaaatcgctaatgtccatgctcacggggtcacctctggctgtgagtcgcggttagtcggtgcgggtgcggccgccgggctgccgccgagggctccggcgtttggctggccggcgcagtcgccgacggcgccagctcaccagcacggtgatgcgacggttaatcgcgtcatcggcgccgtgctgtttcaggctcatggtggccgccatgcccaccacccgcagcaccttgccttccgccagaccgccggcgatcagctcgcgccgggaggcgttggcgcgatcggccgacagttcccagttgctgtagccacgctcgccgctggcgtaagggatatcatcggtgtggccggacaggctgatcttattcggcaaatcgttgaggatcggcgctatcgcccgcagaatatcgcgcatgtagctctcgacctgcgcgctgccggttttgacatcggccg

SEQ ID NO: 2019 - DNA, 129 bp, Glycine max
  Peptide Sequence Number=SeqID_118797
atgcccgaaaaaccatctcttcttattcacgatgcattgggtatcatgggactaccagcaataacgtatcatcaaaagatgaaaactctaaatgaggcttcactgttatcaagcgagttggagacctag

SEQ ID NO: 2020 - DNA, 327 bp, Glycine max
  Peptide Sequence Number=SeqID_118798
atgtacatcaagtatggcccaaaatacatcatgaagcctagccaacaaaacaagttatccaatgaaacaaaaaccccccacacttattcccaaaacaattccaaagctccaaaattccttaaggatatggtgatatcatggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaagcaatcaatggggcaaaacacaccaaatga

SEQ ID NO: 2021 - DNA, 288 bp, Glycine max
  Peptide Sequence Number=SeqID_118799
atgactaaagcacgtcaaaagggagtacggaaaagttcgatttcgggaacttaccggttgaagaccgaagaacgacgaagaacaaacgaagaacgtcgaagaacggttgaaaatcttcgtgaaatcacccacggaaacgtcacggaagcgttacggaagcgccttgggaaaaggaaggagaagcttgccacccagctcgcccaggcaagctcagctcgcccaggcgagctaggttgcttcctccagaaggcacctggagaacttcctggaaggcccaaatgggtctga

SEQ ID NO: 2022 - DNA, 234 bp, Glycine max
  Peptide Sequence Number=SeqID_118800
atggtcattccgcccaccttttcgccatccagaggcgatcgtgtccggtggaacgcagaggcaagttatggtcattctgtgtctcgccgcccagcctcaatcgtgtccaacaaaacgcggagacaaattatggttccgctggcagggaggttcactggccgaatgctgtcataccctaattttgtccggggaccatccgttgttgggatgcgaccctcgtttgaccacttcgag

SEQ ID NO: 2023 - DNA, 216 bp, Glycine max
  Peptide Sequence Number=SeqID_118801
atggcaaagggcgcaaaattcttctgtgcgcgtttaccactcgactcgctgctcttgaatgataaagggcgcatcatctgtctttgcgcgtttaccacccaacttggcgcaaaatctgtgatgcaatcctatcccgcaagggcattgggtagaagactccaagtagattgggctagagttcaaagggaaggccctagggttctcatgagccttagg

SEQ ID NO: 2024 - DNA, 578 bp, Glycine max
  Peptide Sequence Number=SeqID_118802
ttggggcagagagatccctaatacatgtggatcctgagatcgagaaagtcgacggtccccacagaaagaagttaagaacatatttgaggatcgtcgctcgtgataaagtggatgttacatacgagaattggaagcaagtccctgctgctcagaaggatttgatatgggaggatattcatgctgaatttgatatccctgaagcatcttatctgaggaaaaaaaaaagaaaatacttcagactgtgggggagtgtcgacaaggacagtgtcgatgacactgtatgcgaaaagtacgacattagcaaggagaagtgggcccaattttgtcagagttgcagagacccttcgtgggaggccatctggaaacaaaacagtgcccctcacatgttgtcttgtgggggttatgaatttctagaaaacaagttgttagaggagaagaaaaagaaacaacttgcaaaggctgctaaatctggaagcactcacactgtcattgatcctctatctcccatcagacgacacgtgaagtggaagatgaaccgcaccaagaaagctgggcaaatgacttctgagacaatttaa

SEQ ID NO: 2025 - DNA, 386 bp, Glycine max
  Peptide Sequence Number=SeqID_118803
gtatgccacccactaggcaccctctagacccggataagtctaacagggccctggggtttctggcattgatcacgggcctctgccagtcattcggggttcccatcacccctagtaaggtgatccgaccgccgatcacccgggccttcatcaagaagtattgcacgcctaggcaggtgcagggtgatgcacttgaggccgcagacgcaccgccaccacctcatcaggccaatcccgctggatcactaggcatggagcgttatctacaacacttggttcgccagcaggcggccaaccaccgggggcaggtgcagatacatgagttctaccagtttagcctcagtcagcaggggcagggtttcgctccttttgcgtgccttactccatag

SEQ ID NO: 2026 - DNA, 738 bp, Glycine max
  Peptide Sequence Number=SeqID_118804
atgatcctggtcgggcatgtgaccaaagagggttccctggccgggccgcgtgtgctggagcacattgttgatagcgtgctctactttgaaggtgaccagaattcaagtttccgtttgatccgtgcgttcaaaaaccgctttggtgctgtcaatgaacttggtgtgtttgcgatgacggaaaaggggttgcgcgaagtcagcaatccttctgccttgtttttatcacaccacgaatcgcctgtgcctggttccagtattactgtcacccaagagggtacgcgacccttgctggtggaaatacaggctctggtggatactgcacatgcaccgaatcctaaacgtctctgtgtggggctggagcaaaaccgtcttgccatgttgttggcggtgttgcacagacatgccggcgtagcctgttatgaccaggacgtcttcatcaacgccgtaggcggcgtcaagatcagtgaacctgccgtggatttggcggtattactggcgattgtgtcttcactcaaaaacaaacctttgcctagcaagctgattgtgtttggtgaggtgggcctggcaggcgaggtacgcccggtacagcgtggacaggagcgcctcaaggaagcggccaagctaggctttacccatgccattattcccaaagccaatgcgcctaaaggcggtgtcgctggtttgcatgttgaggcggtcgaccgactggaacaagcgatagacgtgctacgcgcataa

SEQ ID NO: 2027 - DNA, 182 bp, Glycine max
  Peptide Sequence Number=SeqID_118805
tacacccggtttaccggactctgctttacgtaaagttgccagagtacgcttaacctctggatttgaaattactgcttatatacccggggggagggttaaagatttacccggtgtgagatatcacattgttcgaggaaccctagatgctgtcggagtaaaggatcgtcaacaagggcgttcta

SEQ ID NO: 2028 - DNA, 277 bp, Glycine max
  Peptide Sequence Number=SeqID_118806
cgctattcgtgcatcctccaccatcaaatcttattcggagccccatgaattgattgccattcatgcatcctccaccatcgagcccggagccccacgaattgattgcctagcgttattcgtgcatcatccaccatcttattcggagccccatgaattgattgtcattcatgcatcctccgttatcaagtacggagcctccaagaaagaagaaggagagacgggagtcacttatttcagatcgttttgggttgggactattgtgattgagatcaattaa

SEQ ID NO: 2029 - DNA, 276 bp, Glycine max
  Peptide Sequence Number=SeqID_118807
gttttactctcgtcgttcggaaacattcaagcccggcgatgcgcgaggttcttctctgctgggcagggacgatcgagtgcaatggcgaagggaagtgtcgggaagctgtcataccctaatttcgtccggggaccattgtttggtggcatgcaaccttcgcttgaccgctttgaggggtgtgcaaatagcaaccaagcccacttgggccttctagggggttccaacagaaggcggtgccttctggtggaagcaacccagctcgcttgggcgagctag

SEQ ID NO: 2030 - DNA, 252 bp, Glycine max
  Peptide Sequence Number=SeqID_118808
atgggctacgtgggagtacgtgagctcagttggaggtgggcaacaggggatggtgggtttatgcgcgcattgtggatgtggaaaacttgttgtgcaccatcgcccgaccgcaacctagtaccacatgtgatggagtggtacctggagatatgtcgcgggggtcaggagaccttggggacgtcaggtagggtgctattgcccaaaaccaagcttgaccaatcccgacccaacccgggcatagtcggtcagtga

SEQ ID NO: 2031 - DNA, 202 bp, Glycine max
  Peptide Sequence Number=SeqID_118809
ggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 2032 - DNA, 444 bp, Glycine max
  Peptide Sequence Number=SeqID_118810
atgatgtgtgccgcaggaacaaggattgcatcatcgtcatccatgatcaagcaaaaggaggagagttgtagcaacaaggaccacatcgctgtcatctgtgactaccactccaagatcgagttgcgtcttaaactccaagatgcgtgcctatcactagcaaggaaagagttgggtggaaaaaagaaggatgaaggtgaacctgagcattacattgcaagggctggggttcccatggaagtgatgggtttgatgcttggagaattcatggacgagtacaccatttgtgtggttgatgtctttgcaatgccgcagagtggcatggtgtttgtgttgaagttgttgatcatgttttttagactaacatgcttgacatgcttaaataaaccaaaagaccagagatggttattggctggtaccattcgcatcatcgatttggctctttga

SEQ ID NO: 2033 - DNA, 468 bp, Glycine max
  Peptide Sequence Number=SeqID_118811
atgactgtgtcatacaaggattggcacgagatgctcccttttgcattgcatggttatcgaacctcagtatgcacattgattggggcaacccctttctctttggtctaccggatggaggttgtgcttttgtttgaagtagaggtcccttctttgagaattcttgtcgaatcagggttggaggaatcagagtgggcccaaactcactttgatcagttgaatcttatggaaggaaataggttggccgccatgagccatgtgtgctcgcgtaagttcaacgagagggatctcgtcttgaagaaagtatcccaagcacaaaagtaccacagcgggaagtgggctccaaattatgagggaccttttgtcgtggaaaaggagttttcaggagggacattgttgcttgccagcatggatgatgaggagttgccttcgcccatgaattccgatatcgtcaaacaatattatgcatag

SEQ ID NO: 2034 - DNA, 111 bp, Glycine max
  Peptide Sequence Number=SeqID_118812
atggccctggcattaccatcgggaaatctaggaggacagctcgccgagcctatggtggacgtcggttgggttgtcgacgattacgaccattcaaaggcatttttccattag

SEQ ID NO: 2035 - DNA, 278 bp, Glycine max
  Peptide Sequence Number=SeqID_118813
gggttgtggttgtgggtgaaattgagggccctccaaagtgtttggcaggggtacgccgcaaaatgcttgtccctcagtggcacatccgaagtgaggctccaagtcgactagattatggccttggggtgcttcatgtgtctcccccatgggttgaggtgatgcaatcctaccccgcaagggcatgggatagaagactccaagtagattgggccagagatgcaagagaaggccctagggttctcatgagccttggggtagattttgggtccatgggctaa

SEQ ID NO: 2036 - DNA, 1464 bp, Glycine max
  Peptide Sequence Number=SeqID_118814
atgggacctatccaaaggcaagccttccgcaaagtgtacgggaagattctagatttggccatagcagaggtatttacggaagctgtcgtatccctcgcccaatactatgaccagccgttgaggtgtttcacgtttggggacttccaaatggtaccaactattgaagagtttaaggaaatattaggatgtcctcttggggggagaaaaccgtatcttttttccggctttcttccttccttgagcaagattgcagctgtgattggagattcaacaaaagagttggatcgcatgaaacaaactcgcaatggagtagtgggcctgccacggaaatacttggaaggcaaggcaagggatatggcgagccaagagaagtggggcccgtttgtggatattttagctttgctgatttttggggttgtcctcttttcgaacgttgacggtttggtagacttagccgccattgatgctttcctcgcatatcaccatagcaaggaaagttcagtggtggctatcttggcagatttgtttgacacctttgatcggaggtgtgagaaaaacagtgcacggatcgtctattgtttacccgctctctgtgtatggttgatttcacacctattccgacaagacacgagacacccgtgtccgcttcaaagctatcgctcgtgcgccgaaaaaggaagagtcgtttgggaccaacatttggctgggatagggggcagcacgatcaattggtttcctcgttggaaggaaggcaaggaaggagttcttttctcgtgtggggactatcctaatgttccactgatagggactaggggttgtattaattataatcccgcactcgccataagacagctagggtatcccatgaggggagcgccaaccgaagaaagtctctcgcctttccttgtgagggatctaggcgcgcaaggtctcaaggttatacaaagaatccacaaggcgtggaggagtccgttgaggaaagacaaggagcttaggggcatccgaaacggcgtcattgaaggttatcatgggtggctaagaattcacacgctgggcttaggttggctctccaaattgaaagttgtcgatgaggagaaattcgaagctccggaggaagatgaagaagtccgagctctaaagttagagctagggaaggcgagactcgccaaggagaagttcaaatcagctgccacacacatccagaaggagtgcaccgagttacaagaggaaaacgcggccactgcaagagctcttgaacaagaaaccaaaagggcccgcaaggaggaacatggccgagaaaaattccgaggagcattgtggggtagcaacaatgagctcaagctccgaagagaggagagagatcggtcacaggtgcatggcatgatcttaaaagaagagttagttgcttgcgcgaggtccaaaagagtttggctcacacttggaagcacggagcaagcatgctag

SEQ ID NO: 2037 - DNA, 397 bp, Glycine max
  Peptide Sequence Number=SeqID_118815
atggcgggcatggcgatgattcttttatggcagctcggtggtgttaccgcagctggcgcagcaggatctcggttataccgccacctggtccgggctggtgctgtcgcccggcgcgctcctgatcgtgctcaccatcccgctggtgctgaagctgatgccgattgtgcagacgcgctacatcatcgcctttggctttacctgtctggcgctgccttcttctattccagcaccctgacgcccaacgtggatttcaccacgctggtgctgatgcgcagcgcgcagtcgattggcctcggcttcctgtttgtgccgctcaccaccattgcctttatcaccgtgccgcagcgcctgaatgcggatgcctccgcgctgttcaccatgttccgtaacgtggccg

SEQ ID NO: 2038 - DNA, 360 bp, Glycine max
  Peptide Sequence Number=SeqID_118816
atgctcaaagagttatgttgcaagttgtccaatctgaacttcaagatttgtaatttaaagtatcttccatctttgacattctatcctgtagaagcaaagcttcatgatgaatcaagattgattcaaagatgttttgatgataacaaaggtgatgacaaaaaactcaaaggtcaatcaaagtatgagttcaagatgttcaagatagaatcaagaacacttcaagattcaagaggaaagttgatttcaagaatcaagaatcaagattcaaggatcaagattccaagaatcaagatcaagattcaagaatcaagagaagacttaatcaagataagtaaaaaaggcttttcaaaaactgagtag

SEQ ID NO: 2039 - DNA, 371 bp, Glycine max
  Peptide Sequence Number=SeqID_118817
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggtcagacccattcccatccaggccctctttgttggggacgctggagggatttcaaaagtccccacactgaacgtgggtggtctagtgcccccacattgttccttaaaatcggttgtctcggatgacgcttgccctggcgcttgctttgttcaacgcgaagctactactcttagttag

SEQ ID NO: 2040 - DNA, 1134 bp, Glycine max
  Peptide Sequence Number=SeqID_118818
atggagaaagtaatgtttaaactgaaacaattaacggcttgcgtggctttggcattgactgccggtgccgcctgggccgagggtgtgagcgtattgcacgtcggtgaccaggaaagctggctgctgtctgcgcaagaccgtttggctactgtcattaaaaatgcggagactcaagcgattgctgaaggccgtaccgtattgaagctgaatgccggggatgcttttttgcctggcccgcgtttcactgctagcctgaataacttggccaatagctaccctgatggcggccaggatttttatgatgcgattgctttgcgccagattggttttgatgccatggtgtttggcaaccacgagtttgacctcggtccgcaaatggctgcgcgttttgccaaagtatccggcagcacttacctttccagcaacctcaatttcaatgctacggccgaatttagcgccttaaaagccagcggtaaggttgcgccttctaaagtgatcacgaccactgccggtcataaaatcggcctggtgggcgcgacgacacctttgttgccaaatatttcctccccgggtgcggtgaacgtgatcggctttgatgcaaacaatactgaagcacaaaacctgcaggcgttgattccactgattcaggccgaagtgaaccgtttgcgcagcgaacagggcgtgaccaccgtcatcctgatgagccatctgcaaaatgcagccaatgaaatcagcgtggttattccagcgctgaccggtgtcgatttggtcttgtctggtggcggccatgagttgatggtcgacccggatgacgcgttgatcaatggtggtgtggccgcaacgtacacttcacacccagtgaatgcggtggatgcacatggccgtaccgtgccggtactcaccagccattttggtaaccgttatgtcggccaggtaaatttcacgattgatgatgctaacggcacttttgtcggtattgagtccagcaaaatgatgcgtgtgagtggcgcaacggcggatgccgaccgtgtgactggtgatgcaatgatccaggcgcaagtggtgacacctgtgctgaactatatctctgccttgaacgcacaaatcatcggcactactgccgtgaaattgatg

SEQ ID NO: 2041 - DNA, 1024 bp, Glycine max
  Peptide Sequence Number=SeqID_118819
atgcatacctacaccgccaccacattcagcagcaacattaccgggttggtggcagataccaacaatttctatagcgctaatgccactgctggcagttatcaggccacccaggatggcgccaatatccgcgtcttgccatatattattgtcaaaagcacgaccggtgtgtcgcctactgctatgagtgtcactgctgaccagaaccttcgcagttttggcagtctgatggcgggccagggcggtacactggctttgctttctaatggtaacctgaccatgaatgggagcctgagtgatggattcagtacagctactagcgcgggggtattgcaggccaacgcacaaaccttcagttatcagctggtggctggtgcagattacaacgcagccaacctgatgcagactgtagctggcaccggtaacttgagcttggcaaccagcaagatcatacgtaccgggactggggatatttccatggcggctggtggtgatatcacactagccagcaatgcgacggtttataccattggtcaggcagccagtaccctggctgggtttaccttgccttcttcagtcagcaccacgcaaaaccccaacgtcatcaatgcggcgagttatgtgaacaatggtggagacatcagtattcaggcgcagggcaatattacgggctcggccaccacgcaaagtgtgaaccagtggttgctcagacaagggggcaatggcactgataccagctggtggatcagaaatgacctcttcaaccaaggtgtggcagcgctgggtgggggtaatgtggttgtgagtgcaggcggcaatgtgaccaatctctcggcggcttcagccactaatgcccagtatgacaatactggcgaccaagctagcggggcctatgttgtcaatggcggcggcgatgtcaccgtgaccagcaatggtaacattaccaatggtgtgtattacgtcggtagaggtcagctggatattcatgttggcggcagtattctgaaatcttcgttgtctgccatgg

SEQ ID NO: 2042 - DNA, 871 bp, Glycine max
  Peptide Sequence Number=SeqID_118820
atggctataacacaaggtttaggtcgtgtcataggtagacttgtaggcagagatagacatgatgaccatgatgcagctgatgttcccgagaggcgtaggcctattgcctcagcccgtaggcaacggattcatcagatgactgcggatgcacgtgatatggctgaggacgttgctgacatgactgacgatgtccctgatctggctgcggaggcacctgagatgcgtgcggacgtacagggtggtgatggtgctgaggggtcagatgctgatgatgctgctgagggattccctggtgggccacgtgacccttcagtgctggcatcatttgcggaccatgttgcacatgctatttggagtggacagaggtggcacggtgagaccagcaccttccaccttccggtaggagagttgacaatcacattggatgatgtgtcgtcactccttcatttgcccatcactggcgcattgcacagttttcatgctctttctatggaagaggccagatttttgctgacaggtttgtttgaggtgtctgccgaggaggctagagccgaggaggctagagccgaggaggctagagccgagacagcactaacacgtagggcatatgtacgactaggatgggttcgagacatttatgagacgagatgtcaggtccggcaatggattgtagcagctcatgcttatctgctgcaactggtcggttgcactctttttgctaataagagtgcaacatacgtgcatctggttcaccttgacgcttttcgggacctcgctcagagtggtggttatgcttggggagttgcggcgctggttcatatgtatgaccagttagatgaggcttctaggaccaccacacgacagcttgtgg

SEQ ID NO: 2043 - DNA, 410 bp, Glycine max
  Peptide Sequence Number=SeqID_118821
gtgttcttaacgcaatgcctgaaaagaaaaaggctgatgctgacttaaagactttcttagatactaagcaagctgagatcaaaaagaaagcagatgctggacaagctaaattaaagcaatattctgaggaagctcctaagaaaactgccgatgaaaacaaagcaagagaagctgaattagctaaaatgcaagaagaaattcaacaaatgaacgataaagctcagaaagattttgtggctaaacaagatgctgcttacgagcctattgagaagaaactaaacgaggctgtatctaaagtagctaaagctgcaggatatgatttcattatggatgcaaactcttctgcatttgtatacaaaggaggtccggatgcgactccagctgtaaaaaaagaattaggtgttcaataa

SEQ ID NO: 2044 - DNA, 699 bp, Glycine max
  Peptide Sequence Number=SeqID_118822
atggaaaaagaagtatcaacaacggtaaaagtcagattcagtgattgtgatcctatcgggcatctcaataatgtaaagtatttggattatatgtttaatgcgagagaagatcacgttgaaacattttatggctttacttatgaagagtacaccaaaaaaactggctgtacctggattgctatacagaatgaaatagcatacctgaaagaagtaagatacaatacccaggttgtaatcagcagcaaaacaatcgacatacaggacagaactgcaaaagttgaaattcttatgaagagtcttgatgaaagtacaattcatgctgttttatgggttaccacccttgatattacagatgaagatcaggtagacaccttcttttacgataataagccggacttctgtatcaatgcatcagcgtatacagcggtagatctggctgaaaaagagaaagaaaaagcatttgcagtaaatgctgatggggtagcacatcttgcccaggcatgttctgaacataaaacagttttaatacatgtttctacggattatgtttttgatggagaaacaaatttatgctattctgaagatgactttacaaatccgattgggggatatggagcatctaaattaagaggagaagaacttgcattggaaattaaccctcaaacaattatcctaaggaccctcctggctgtattctga

SEQ ID NO: 2045 - DNA, 285 bp, Glycine max
  Peptide Sequence Number=SeqID_118823
atggaacctaagagaataaaggtcattcctgagtggcctactccaccaacaccactcattgagttggtgaggaatcatgttccttcatgggaaaatgcccaggaaatgggttttcagaccttaccttacttcaacataccaaacaccactaatacatatgtttttgttctttttacgggtgttgaggaaaaaatcccagagtttcatgaacctcgggatttgaggtcaaatccttttcaagggggagggaatgatgcaatcctaccccacaagggcattggatag

SEQ ID NO: 2046 - DNA, 639 bp, Glycine max
  Peptide Sequence Number=SeqID_118824
ggcgcgtcccattcgccattcaggctgcgcaactgttgggaagggcgatcggtgcgggcctcttcgctattacgccagctggcgaaagggggatgtgctgcaaggcgattaagttgggaattcgatattcccgtgcattagaagcaggtccctgttctaagaacatgattcatactgttgaaagcactatgttgcatggtgatgaagctgcaataaaaccatatgatccatcaccatcaaagaaatcgtcaacatgttggccgggtgctgtggtgcaggatgcttacataacaccacaaagtcagagaaacagatatggacttcataacttcccccgtactccttattccagaactcttttaacaaagtccaagtccaagttgattcatatgaaaggagatagcagccagatttcatcaactcccgtccgtcaatcacatactactatgtatccggagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 2047 - DNA, 615 bp, Glycine max
  Peptide Sequence Number=SeqID_118825
atggtgaaattctcgaaggagctcgaagctcaattaataccagaatggaaggaggcctttgttaactacaggcagctcaagaaacacataaagaggatcaaactcacaagagtctccaagcaatcacaagccccagaagagtcctttggtcgctccgttttcgattcgtttcgcttcataagaaacaagttccgctactcagacaacaataatttacaagacataattcagtttgttatttttcagctcattcttttggtggttccggtgaggagaaaaacaacggaggagagtgaagaggtgtatgaaacggagctggcgcagttgttttcagcagaggatgaagtgcaggtgttttttgcaaagctggatggagagcttaacaaggtgaaccaattctacaagaaacaggagactgagtttgttgagagaggagaaatgctgaagaagcagcttaacatcttgctagacctcaagcaaattcttagtgaccgacgcaagaaaaatccgtcgctaaagccttctaatactggagtttttcctcgttctcctggccaagattccaattactccggtcagttctttattaatttgttcttttcttgttttgtataa

SEQ ID NO: 2048 - DNA, 171 bp, Glycine max
  misc_feature (5)..(5): n is a, c, g, or t
  Peptide Sequence Number=SeqID_118826
atggnccgtgacggcgatgggcagcagcggtgccggtggaagatgatccctttctcttctttgatggctctgccatttgatgaagtttttctggattttgatcggtggaagtttgaagttctaggtatggaggaaaacgtggaggaagctttggctgcgcagcagctctga

SEQ ID NO: 2049 - DNA, 429 bp, Glycine max
  Peptide Sequence Number=SeqID_118827
atgggttctcttgcttttggcatagcgggccccgcgggaggcccgcacgacgggctattagctcagtggcacattagcatggcgtacttctcctgtttgaaccgggggtttgaaaccaaacttatcctcaggaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 2050 - DNA, 303 bp, Glycine max
  Peptide Sequence Number=SeqID_118828
atgattgatcctccatctcccatcagacgacacgtgatatggaagatggcttgcaccaagaaaactaggcaaatgacgtctgatgtagcaaaggaaattgctgacaagattgcctcacaggattcctttgtcgcccatggacgtcaggatgtactgattgctgccattgggcgactagaacaccctggtcgtgtgcgtgctgctggagccggtgtcacaatcaagcaatactttcgaccaactccaaggacctcctgcacgtctttctccatggcccccgaagacttggagcagctgacgtaa

SEQ ID NO: 2051 - DNA, 411 bp, Glycine max
  Peptide Sequence Number=SeqID_118829
atgcagttccagtttcaatcgcatatgcaatcacaaggactcgcactgcctcttgagcctgaggttggtccttcagttgctcgtgccagcacaaaggagagttgtgttgatcccttagggaacgatccaaacacaggtgactcagagaaatgcgggttgtacatcgaagaaaattctccctggctggttgccctagaaagactttatgagggatcaacaaccgttcacaacatctctttgtgccatgatcaagtcaagggagctttaggatcaatgaaatctgcagataggccaaatcatgatgtcgatgatcccctatatctgatgacattgaccatctcacaactttttcttaagtcgttgcaagttatgtgcgatgttgtgggatgctaccgtgtttggggtgattaa

SEQ ID NO: 2052 - DNA, 555 bp, Glycine max
  Peptide Sequence Number=SeqID_118830
atgtcatttcctgctttcaggtacttggggatgggcacgagtggaggcgaggcccatgatcaacagatcgtcgtcccacgtccagacaaacgagaagcgctactgggaggcagcctagtgatggttggatgcctaatttaccctagcggcttcgaggttagctcgcctgggcgagcaccccctgcacgaaatggtttaaaaggaaagggggagtgcagttttcacccaaggaacttctcccccttacttaagaacgcaagcactcatgggattctagctttttctgaccctaggccaccattgtgtgctttttgcttccattttagagtccttgccactccatacaagaaatggctccaaagaaactctccacgaagaggtctagaagagatgccacaggagaaggatccagtgctacctcaaagtttgatagtcatcacttccggagtgccgagcaccaacaacgcttcgaggccatcaggggatggtcattccacagggagaggcgtgtccagctcagggaggataagtatacggacttcccagaggagatag

SEQ ID NO: 2053 - DNA, 228 bp, Glycine max
  Peptide Sequence Number=SeqID_118831
atggaggtgcttgcagctggtgtctcgctaagcgaggcttgtgcgcttagcaagaatcatgcactaagcgaggcactcagcctgcttagcgagttgggagaatctggaggagaatctaagaagcatttgcatgctcagcacgtcatcagctcgctcagcgaggtgtttgtctcttcccgttctaagtgcgcccagctcgctcagcagatgttcactgactcgcactaa

SEQ ID NO: 2054 - DNA, 418 bp, Glycine max
  Peptide Sequence Number=SeqID_118832
agggtacatctacttgggtttgactgagaacaagagagggtacatctcttgtggatcagttctagtggaaggtacatccactaggttgttcaaagagaacaagggagggtacatcccttgtggatctttgcttgtaaaaggatttttacaaggttggaaaagaaatctcaaggactacaggtcgcttggggactggatgcttgcagctggtgtctcgctaagcgaggcttgtgcacttagcgagaatcatgcactaagcaaggcactcagcccgcttagcgagttgggagaatctggaggagaatctgagaagcatctgcacactcagcgcgtcatcagctcgcttaacgaggcgtttgtctcttccagtgctaagcgcgcccagctcgctcagaagatgttcactaactcgcactaa

SEQ ID NO: 2055 - DNA, 2378 bp, Glycine max
  Peptide Sequence Number=SeqID_118833
aaagcaatgagcaggataaaataattttaggggtggttggtgtgtacagtctgatcgacacacaagttttagaaggcattcttagcagcacaaaaggagtaaggaagtttcattttgacaaggtttcaggtgaattggatgttctgtttgatcctgaagttctcagttctagatccgtagttgatgcaatccaggagggaagcaatggaaagtttaaattacatgttagaagcccttatacaagaatggcttctaaagacgttgaggagatctcaaccatatttcggctcttcatctccagtctgtttcttagtattcctctcttcttcatgagggtagtttgtcctcatattccaccattctattccttgttactttggcgatgtgggcctttcctcatgggtgatttgttgaaatgggcattggtgagtgtcatccaatttgtgattggcaagcgcttctacattgcagccggcagagctcttcgaaatggttctacaaacatggatgtcctggttgctgtgggaactactgcttcctacatttattctgtttgtgctcttctatatggtgctcttactggattttggtctccaacttactttgaaacaagtgctatgctcataacatttgtattgttgggcaagtatttggaatgccttgccaagggaaagacatctgatgctatcaagaaattagtagaacttgctcctgcaacagctttactagttgtcaaagataaaggcggtaaatctattgaagaaagggaaattgattctttgcttgttcaacctggggacacattgaaagttcttcctggtgcaaaggttcctgctgatggtattgttacttggggatcaagttatgtaaatgagagcatggtaactggtgaatctgtacctattatgaaggaggtgaatgcttccgttattggaggcacaataaatttgcatggcgtccttcacgtagaagctaccaaagtaggatctgatacagttttgagtcagattattagtttggttgagatggcccagatgtccaaagctcccatccagaagtttgctgattatgtagcaagcatatttgttcctacggttgtttctttagcattattgacactattgggttggtatgttgctgggtctattggagcttacccagaagaatggctgccagaaaatggaaatcactttgttcttgccctaatgttcgcaatatctgtagtagtgattgcatgtccctgtgcacttggcttggcaacaccaacagctgtcatggtggcaacaggggttggggctaacaatggagtgttaattaaaggaggagatgccttggaaagggctcagagggtgaagtatgtgatatttgataaaacaggcactctaactcagggaaaagccactgttactgctgccaagacattcacaggaatggaacgtggagaatttcttaaattggtggcttctgctgaggctagcagtgaacacccactagcaaaagcaattttagcatatgcacgccattttcatttctttgatgactcttctgctactactggtaccgagaatgatgccaaaactgatgcaaagtctgggtggctttttgatgtctcagacttctttgcccttcctggaagaggtgttcaatgttttatagatgggaagcatattttggttggtaacaggaagttgatggaggaaaatggcatagatatttcaacagaagtcgaaaattttgtggtagagctggaagaaagtgcaaagacagggatactggtagcatataatgatatattaactggagccttggggattgcagacccactaaagagagaggctgctgtagttatagagggcctccagaaaatgggtgtcaaacctgttatggttacaggagataactggagaacagctcgcgctgttgccaaggaggttggcatccaagatgttagggcagaggttatgccagcaggaaaagctgatgttgtacgttcattccaaaaagatgggagcatagttgcaatggtgggtgatggtatcaatgattctcctgcattagctgctgctgatgttggtatggcgattggggcaggaactgacattgcaatagaagctgctgagtatgtcctcatgagaaatagcttggaagatgtaatcacagccatcgatctttcacggaagacctttactcgtattcgattgaattacgtgtttgccatggcttacaatgttgtggctataccagttgctgctggtgtgttttatccttcactggggctcaagctgccaccatgggttgctggtgcatgcatggctctctcttctacattgagagtctcatacaaaacaacgcatatcattattgaggtgaaagattag

SEQ ID NO: 2056 - DNA, 201 bp, Glycine max
  Peptide Sequence Number=SeqID_118834
atgctcttcgatctaggtttgcttcagcagtgggcaactggtagtcatgctactgtgtataaagctaaagaacaaatagctgcaaatttcaagaatcaagaatcacgatataagaaagtgtggaagataattgatactcattgggatttgcaattacatagcaatcttcatgctgcttcattctatcttaatcccaagtaa

SEQ ID NO: 2057 - DNA, 573 bp, Glycine max
  Peptide Sequence Number=SeqID_118835
atgcctacaaagaaggctaatgctaatggaattgtggaggaaccagaaaagtatagtaagctaagaactttcattggaaagaaatcagctgaagtttctaacagtggactccctggaaacttggtcaaagttactctaagtaatacaaaactggcagatgcaagtgttcaatgggcttcactcccatcatctatttcgaagattggaagggaagtaatgaaacacagagatgtggcacagatagcaacaattgaggctatgcaagagcctgctgctgctgagagtttattgcaatgcctaagcaaagtcctaaacttcaacaaaatagtttacctcactcaaaatgacaccttgcgagcacgagtgagcaccccgaacggaatgcaaagtcagcaccccaaacagcccacgacaatgaccataaacctaatccttcgagcaagatcgagcacgactcccacaaaccaactccttgcaacacacacaaacaaaaatccttgcagtgagcacaagttccccaaacaaacaaacaaagaagaagaacaagaacaagaagaagacaacaaagactaa

SEQ ID NO: 2058 - DNA, 159 bp, Glycine max
  Peptide Sequence Number=SeqID_118836
atggagcacaaggtggatttcaaggataacaggtcagtagacccagagaaatacactttcagcctaacaggaaggaagcctattagtttggaagagaaaaggaagcttggtgaagggtatattccactgctgcaaacctctataccagagaaaatgtag

SEQ ID NO: 2059 - DNA, 1707 bp, Glycine max
  Peptide Sequence Number=SeqID_118837
atggggagattgatggggatgtcacgcagattgaagctagtggatgaagtggccaaatgcttctgtgttatcaacggttcggcagatggcggagtatggcaaaaggccaaaagtccaccatataaacagaccattgcagcctatgtgctgctagagtgggcttcccttcacaaatttcctatggtggttggcaaaaaatctgccatgccattccaccatggcgttgccatttaccactgtttggaaggaagtagcacctactatggaggagatgatgaaatattgtttaaactccaaatagaagctctaatggctggagaggtaaaatgccacaagtatagtcgacgacgcccttccgatggatggacttttacagtagagaaattgggatccagtggaaaacgtgggggtggtggtggctggaaatttgcaagcatgccagatggatcaagccgaccactgaatgagatggagaaaatgaactccgaacaacgcagcgacacgacacgccgaatgggtggccacggtgaagttacaatcttcgccgacacaaacttgggcactcgcattgctttcaatgcccctcctgacattacagctgcatctctcaaaagagactttgagaaagcacacttcagttgtttacccgatataggagagatacaagttaaagggttaatggtgaagcgaaaatcatgcttctactacctgcctgattcgttccctatacagtatgctttccctgcaatcagaggaacatggtttcttcatgtggaagtgaagcatttaaagcgtttgtgcattccgtgtccacctggtgatgcagctgttctttcaaaacataaggacttaaagacctgcaatggtgaggataaggcaaaatgcaacagtgaggaaaataaaatggaagggttccaaccccgttcatgttttgcagaagagcatgaaactactaatcatgtttcaaagaagctgaacaaaaagagaatttctaatgaaaaccacacgcagaatgaagccactggaatgccagaaagatatccctgcagatttggagacaaatctactggcatggccaataagagttcagatgtaatactggagaataaagttgaaaatctggttgagttgcatgctaactcaatgcgatgcagtctcagtaaggtgtcaacacaagtgatatctgtcacaggtataatccataaatatttttcaagtttcaatggaattgacaattatagcagctcttcaaactcagatgttacatctaaagcttttcatggtgagattgaagttctttcaaacaccagacaacacagttgctcgaagagacaaagcgattccttgccacagttcactcccaaaacacccccacatgtcttgcatgcttcattgcacgttgacttggttcccaaaaaatcaggttgcaaaagtagaaaatcaaaagttgggaaacatcttaaatcagatggcaaaaatagaaaatcaaaagttgggaaacatcttcaatcagggggggaaaatagaaaatcgaaaattgggaatcgtcttcttgcagcttcacggagtcttggggtttctatcactaagcatgatcctacactttctttccgtagatttaaggatagaaaactacggcaggacaaatctcaaatgaagggttcaatattttctatcagtggcagtgacgatgacggattggtgtag

SEQ ID NO: 2060 - DNA, 1320 bp, Glycine max
  Peptide Sequence Number=SeqID_118838
atgaaatggagaaaagcatcgggggtgttatgtgatgcaaaggtaccgatcaagctaaagggaaagttttatcggactgcggtaagaccggcgattttgtacggaacagaatgttgggcggtcaagagccaacatgagactaaagtaggtgtagcggagatgaggatgttgcggtggatgtgtggtaagactcgacaggataaaattagaaacggagctattagagagagggttggagtagcgcctattgtagagaagatggtggaaaatagacttaggtggttttggcatgtagagagaagaccggtagactctgtagtgaggagagtagaccagatggagagaagacaaacaattcgaggcagaggaagacccaaaaagactataagagaggttatcaagaaggatctcgaacttaatgatttggatagaagtatgtttccagatcatgatctaaaagtggaggcagtttatcctggacattttgttgatacgactagtaattactgggacgtaccattttcagtggcagttgatcttgcttctgtgactaccagtgactcttccactgcttatcatttgtctgcgcactacacttcggggtcacccaagcagtttgaaaatattcaaaatcaaaatgatagagtgccaccacctactctacttcctggcttggccttcaaaagtgtgttttcttacaggaagaaagttgatatttggagaagtgaagctaaaaagttgaaattggtgcaaccatatgacatatttctttcgaatcctcacgtgtcagcctcggggattattggtgctgctgcaaccactgcttttggggataattcggcaagagcacaagtagaagatggtagtccaggattttttctccaggcttctggaataaagtcttcctttctagcagatatatttgcgtccgtttcatttacagcccaacatggaaacttccaaaggctttttctagatcttactcgatttcaggcccggctagattttccttctggtttcaaatttctttcagctgcaactggtcgaacacatcttctcaattctcaaaatcccgctattcagacgattttacccaatgctacactatcacttcagcagcagattgtcggtcccgtcagttttagagttgattcaggaattacagttgatctgaagaaccctgataggcctattcatgcaccggaacccgtatttgctttggaatatgcattgaaagtacttggttcagcaaaagcagtggcatggtatttccccaaacgccaagagtttgtggcagaacttcgtttctttgaaacataa

SEQ ID NO: 2061 - DNA, 261 bp, Glycine max
  Peptide Sequence Number=SeqID_118839
atggacgtcagagatatgagtgattttcaatcagggtcttttggtgctgttattgacaaagggactcttgactctatcttggtgagtgtagcgatggtaatgctcattgaaatgctcttgatgacacactatagggtcctcaaggataaaggagtttatgtcctggtgacatatggagctccactatatcgcctgcgcttgctacaggaatcatgctcttggacaataaaacttcatgtgataggttggcttaaatcttaa

SEQ ID NO: 2062 - DNA, 318 bp, Glycine max
  Peptide Sequence Number=SeqID_118840
atgaggacgcgtagccctctaaaggcgagggcgtgcagccctctgcaggcgaggatgtgcaatcctctgatggcgaggacatatggtcctctaaaggtgatagccagcccatatcaattagaccttgcaccttacgcttcagagccctacaatgctcaacggaatgccccggggcttctccgtgacaagcacacgttgcgttcgagtcgtattctcggagaaatggaggttgatgaaccttggctagggttatggctaccattgaattatcaagtggtgtttgtcattggaagtgcggtaggtaggctttgtggttga

SEQ ID NO: 2063 - DNA, 810 bp, Glycine max
  Peptide Sequence Number=SeqID_118841
atgtttatctctaacattatctgtaagctctcagctattatctatatgccggaaattatctacaaggctacaatagcccctacaaacaaggaccagtacccttgctcaactaatgtatatacaggtcccccctcctgtcaaaggtgcttctctaagcttacgtgtgaagttcggaccccactcagccacgtccaccctgacgtgacatggtttcagattttggtaagaacatttggtgcccaccgtggggccacagtaaaacatatcctgcgacctcttttcaatcctctaacattcatccatggtttgcactcgatctggcctcagacgcgagaccctcctcaccgactctcatccgcatctgatagttataacaaacacagacactctacaacaactccaaactgcatcgcggagatagagcgacgccatgaggaagagttgacaaagctaaaagttgaccatgaccagctagaggctcgggtcaggcatccccagggcaacaagcaatccactcacactttgtctgaatgcacccaaggggaatcacccccccaatgcacaggcaacactgcagactacctaggaagcagcattaaccatttgactgggtacggtggactcccacccaagtccatagacaactttgacaccctcgtcaaacgatttagcacgcagtacaccactagcaggtctcaccgcatgacctcgatcaccttggccagtctgcaacaagcagatgatgagtccctcaaaaagttcatggacaaatttgggcgcacgatcgtgttacaagatccaaaatcttga

SEQ ID NO: 2064 - DNA, 210 bp, Glycine max
  Peptide Sequence Number=SeqID_118842
atgtcggccgaaaaaaacccgttcttggtatatttgacgaccgatgtcgcctatggttgttttcctcaatccctgaataatcaatcggttaggaactattcggttaacgccagcatgctaaaggcccaagtggagaaggacgaaggcccaagtggagaaggacaaagcccccaagtggagaaggatgaaggctcaagtggagtaggatga

SEQ ID NO: 2065 - DNA, 534 bp, Glycine max
  Peptide Sequence Number=SeqID_118843
atggcgaacaaatttacccaacacaccgggattgtggccccgctggatgccgcaaacgtcgacaccgatgccatcatcccgaagcagtttttgcagaaagtgacgcgcaccggctttggcgcgcacctgttccacgactggcgttttgatgatgatgccggcacccagccgaccgccagcttcgtgctgaataagccggagttcaaaggcaccagcatcctgctggcgcgtgagaacttcggctgcggctcctcgcgcgaacacgcgccctttaataaccaactgctgccggtgacgctcagcgatgagcaggtggacgagctgttcaagctggtacaggcgaacccgggcatcagctttgaagtagaccttgaagcgcaggtggttaaagccggggataaaacctacagctttaaaatcgacgacttccgccgccactgtatgctcaacggcctggatagcatcggcctgacgctgcagcatgaagaggcgatttccgcctacgaacgccaacagcccgcctttatgaactaa

SEQ ID NO: 2066 - DNA, 141 bp, Glycine max
  Peptide Sequence Number=SeqID_118844
atgtgtgtaccaaaccgtgagttggagggtcgtgagtttgagtctaagagacgtcatggaaggagcgattggtgtgagggacttttctttaagttttggcttgcttggactctaaggagagaggtcttttctagttcttaa

SEQ ID NO: 2067 - DNA, 213 bp, Glycine max
  Peptide Sequence Number=SeqID_118845
atgaggatgggctaccaagaaagtagggttaaagttacaaattcagcattgtccgtcctggatcaaagtgaagtctgcgagagtgacgtctcctttgcaaacaaggaaaccagggtgaagtctatcaaagtagtggctcttgttgacgggacacttgaattgggcttgattttgaaggctgtagatgttggtccactggaagttgttatgtag

SEQ ID NO: 2068 - DNA, 312 bp, Glycine max
  Peptide Sequence Number=SeqID_118846
atggaaagagagatgatcataatgataatggacacattactagtgttatactatgagaagatggtgggttacatgccttcgagctttgaagatctggtatttgcgggtaaaaggatcgaagtaggcctaagaaggggaaaatttgattacgccgcttcaacaagtgttggcaataggaggaatggaataggtggggcaaagaaaaatgagggagatgctcatgtcgtaaccataacacccacatgggcaaattcccaacaaacccctcacaaccccatgtaccaatatcccccgcaccaatacaattattga

SEQ ID NO: 2069 - DNA, 411 bp, Glycine max
  Peptide Sequence Number=SeqID_118847
atggtggaatctgaaagacttagctatatcagaaacaaccaaaagaagcttagagttgataagtattctagcttacaaacttcattggatactggaacagctaaaggcttaaccaagggaaaaagagtcatcttaccctcaatgtttgttgggagcccacgttatatggatcaactttactttgacggtatggcaatatgcagtcatgttggttttccaaatctttttattactctaacctgtaatccaaattggcctgaaattcgtagattactttcacctttgaatctcaaactgatagacaggctagatattgtatcacgaattttcagattaaaatatgaacacatgctgtcagacttaacaaagggtcaattactgggaaaagtggttgcatatattaatggctaa

SEQ ID NO: 2070 - DNA, 393 bp, Glycine max
  Peptide Sequence Number=SeqID_118848
atgccaacaactcagaatattgctgctgggaagtacaccttacaaggcaatcatatgccctctgggacagtcttacttgtaaggaaactgatctctatggacatgaaaataatgcactaccagagcaagatagttatagttatagagcttcgaaggctgagaaaactaagtcatgaaaatgtaatgaaacccattggatatgttatttgtagtggtgtagctcttctcattcatcagtatctacccaatgaacattggctcaacttctttatgaatctacaatgctacctggaattcagcctgactggtgtgctagactatcacaatgatgaatcaaaagttcaatcacaaataggttttgagagcagcatgtgcatacacacttgtgcatga

SEQ ID NO: 2071 - DNA, 1113 bp, Glycine max
  Peptide Sequence Number=SeqID_118849
atggctagtgttggtacccatttaaggttgggtatgtgttcttgcactttcagttgcggcccaagctttggttcttcttcttccacgaagaagaggaagctttccaacaaagccaatattggttcaagaaataagaagttcaagaatgatgatgattatgaggtttggaagatcaagaaagtgttggaaaagagcaatattgggaccatgcgcaggttgatactgaggagagagatggaagaggagtttgtgttgtctgtgttgggggatgatgctgatcagattgatagtggagtttctgttcagatttgggatgtggacaccaagtccatactctcttgttttcaagagatgggtttcttcaagaagttatgtattccttggtgtgacatcctgtttcattctgagcgttttgatatatatattgcctactttcgaaaatgggccccgacgggtgcagagaaacgcgaggaactggaaccagagaagcggcacgcaaaccgagacagggttttagcattcaaaaagtcaaatttttctctccttgtggctgggtatgaagtcacatcaaggggaagaggtggaccccttttcgctccactcaaaatgggacaagtggcaactccaaactttgctcatcatttctactccaaattgcaaaaggaagccattttcggagtcgtgaagtgcacctctatgttgtgggacttcgaatttcaggaatttgctgaaagcatgctaaacttgacatgtttgataacactggtagagatgatggggagagttaacctagggttaaatgtgagaatggtagtgattaaaattttcaagtcgatccaacggttaacgaattggaacgaagagaatgttactgggttcatgatagttggaattgaattgcttggatattttggaagcttggaggggttgatggggacccggtgggcaactggggatggtgggttcatgtttgatttgtggaaagtggtacctggagatatgtcgcgggagtcaggagaccttggggacatcaggcgagctcttggcagtcaaccaataaaagaacaaagaccacgaagcaatgaagcttgtgtggcggctggccagctatga

SEQ ID NO: 2072 - DNA, 657 bp, Glycine max
  Peptide Sequence Number=SeqID_118850
atggcagaaaaggaaaatttggatcatgtagaggaaaggtttagggccattgaagggggcggagttcatgctgttgctgacatggtagagttgtacctagtacccgacgtggtcattccttcgaagttcaaggtgccagacttcgataggtacaaggggactacttgccgcaagaatcacctaaagatgtactgcaagaaaatgggggcaaacacaaaagatgaaaagttgttgatgcatttcttccaagaaagtcttactagggcagcctatcagtataattctgatatggctccggataggacgcaactacagaacttgtgcaagaaggggcatgaatctttcaaagaatatgcccaaaggtggagggatctagcagcccaagtggcgcccccaatgatggaaagggagatgataacaatgatagtagacacattaccggtgttctactatgagaatatagtgggttacacaccttcaagctttgtggatttagtttttgccggagaaaggatcgaagtaattctgaaaagaggcaaatttgatcatcccactttgacaaataaaaagcctagggcaaatagagaggaccagaaggaggaaggaacccatgctataactgctattcctacatggccgaatttcccaccaacttaa

SEQ ID NO: 2073 - DNA, 264 bp, Glycine max
  Peptide Sequence Number=SeqID_118851
atggaacctacacctcgcacacacattgagatattaggccccacacccaggaaagaatacgctttacggcacccttaccgaacgcgtgctagagctagagtaatgggtggaacagacgaggtgcaagagcggataaaggccgacttggaggccatgaaagagaaaatggccacaatgatggaggccatgatgagcatgaagaagataatggaggtcaatgcggctgcagttgccgctaccagtgccgttgctcagtggacctga

SEQ ID NO: 2074 - DNA, 477 bp, Glycine max
  Peptide Sequence Number=SeqID_118852
atgggtgaagtagaggaggtgcacaaacagataaaggctgatatgtcgaccctgaaagatcaaatggcttccatgacggaagccatgctaagcatgagaagattaatagaaagtaacatagctgcggcagccgccaccaacaccgccactaaggcagatcccatccttccgtttgcaacgaatccagcacaccaactcgccccagacatagtgggaccaggtgaagaagtattagggagtaccggtggcccgcatttggggtataacaaaaatgcttacccctacggcttaccccccaatttcacaccacccaccatgcacgagaacatggatcatgtcgttctcgttaccttcgaaggtcaacttcctcatcctatagggggcgcccgcgaagagcctcgggagcatgcccaagttgacgttgacttataccccccgttcatcgccgagggaccggcgttcaatgccatgccttag

SEQ ID NO: 2075 - DNA, 417 bp, Glycine max
  Peptide Sequence Number=SeqID_118853
gaggccgagcaaatgctcatagaggtgcatgagggatcctttggaacacatgccaatgggtatgccatggcccgtaagattctgaggacggggtattactatctcactatggaaaatgattgttgcatccatggaatagatgtgatcggagccattgaacccaaggtgtcaaacgaacatcacttcatcttggtcgccattgactacttcaccaaatgggttgaagcagcctcgtatgccagcatgacgaggagcgtggtggttagattcattaagaaggaaataatctaccggtatgggttgcccaggaaaattatcatggataatggcaccaacctgaacaataagatgatgaaggaaatgtgtaaggattttaagatccaacaccacaattccacgccttatagcccaagatga

SEQ ID NO: 2076 - DNA, 204 bp, Glycine max
  Peptide Sequence Number=SeqID_118854
atggtagttcttaatgtctggtctgctcttgagatggaacctgcgctccttcccgcatctcgtgcaacgcaggaactcatccttgtgaaagttttgtttcctcattgcaaagtctttccgaggtgtcttccagagtggaactctgtcttcgtcttcccaatgatcccagatgtttctcttccaccttccactccctccccttaa

SEQ ID NO: 2077 - DNA, 183 bp, Glycine max
  Peptide Sequence Number=SeqID_118855
atgaagaaggggcaggaatgcgagaactcacatggcggacgagaaggcagcgggggtggaaatgaagacagtgggggagtggtggagaattttatgattatgtacaatactgttttcatagcaaccctagaacccaggattagttatataggtctattatggtataagcatgcagggaagtaa

SEQ ID NO: 2078 - DNA, 2880 bp, Glycine max
  Peptide Sequence Number=SeqID_118856
atggtcttctcaactgtctttctccatgaagatgacacctttttttctagaaaaaggccaagagtgtcagatcttggacatcaagatatagatttacatgcagatgcaggaagttccagtgatatttccttgttctcgcatcaagatatagaaaggggtactggtgatgttccctcttccagcaatactgatgataaagttgatccagattctggagtggagatgagctgcccgtcaaatgttaagagtggctatgtccctgtgtgttctaccacagggcatatttcacacatggaccagagtttctgtggctatgtgcaacaacctgcttttgtgagtggatggatgtatgtgaatgaaaatgggcaaatgtgtggtccctatattaaggaacagttatatgagggcctaactactggtttcttgccatctgagcttcctgtgtatccagtgattaatggcacactaatgagccctgtaccactgaattacttcaagcagttccctgatcatgtttccactgggtttgcatatctgagtatgggtttctcaggcacaagggtgccaacaatggcagcatatgagcaagataggtcttttgagcatgctgctcctctggctgttaatcctgattcacagccagtttcacagtcacatgtcaattactgcattaaggaatccaatcacttaggtgtagaatgctgttggctttatgaggatgagaagggtatgaaacatgggcctcattctattaacgaattgatttcctggaaccgtcatggatatctgaaagattcaacagtgatctctcattctgacaataagtacgacacctttgtgctattgtctgctgtaaatgcattaaaaggagatatctctggaaccatttgtagatcaggttccccaagtaacgaggttggtgatatggtaaacttaattggtgaaatatctgaggacatttcttcccaattgcacatgggtatcatgaaagctgctcgcagagttgtgctagatggaattattggtgatatcattgcagaatttgttacggaaaagaaacgtacgaggcataagcttgaatcagctgattgtactcctggaaacaatatgtctaagttttctgccgagattagtagaggttctgctatttccagtgatcctgcatcttcccacactttggacgatcagacttgtcatgaaagttccagactgccccctgccatcattaaatcagttggaagcattgaaaatttttggtggtcatatgctgttgttcgcaaggtacttcttgattattccatgcaagtcatgtggaatgcagtgttttttgacacactagcagaatacttatcttcctggaggaaaaagaagctttggtctcatcgtaagcctcaaccttctgctaatgaatgtgaagatcatactgaaaagattgaatcagaagctttggttatcaatccagatacttctgaaagcaatgttgatggctataatcagtttggagtactggcaacagaaaaaaattgtccccggttattttcatcttccagtagcctcaaaggtggaaacttactagaaggtcaaaaagtttcatgcctttatgataactctagagatttgacttgtattcttgaaagtgtggagaatgagcttcacttctcttcaaaggtgtctttagctgattacattcaaagttttattgaaaaggaagtgaacaaattaattcctttcccagaagaaaacaaatttaatgaggttgctgttggagacactcgtttttcagagaaacttgcagataaaacgtctgtgaaggaaattctaaatgacaagtctgtggatcctgcaaaggctggaaattcttttggcgagtctgcgtctggaaaccatatgtctgacgtattttcgaaagcatttaaggagttgtgtggatatgtagatgatgtggttgaagaggagattgatgacctaccacctgggcttgagaaatctcaaacagttgcccttcactacaattccaaatttcgaccttcaaggtcggctgaatgtaatcttaagataacagaatatgttgctacagcactgtgccgacagaaactgcatgatgaagttctggaaaagtggaggtcgttgtttcttgattctgtgcccaagcaagtttttatatcatcaagcaccataaagaaacatttcaagtctgatggtcataagaaaagaaaaacggtcaatgcaagcaaggaacatttgaatagtgctacttctggactgggaagagtgaaggaaggagcaaagagttcttctgaagttcctccggtgattggaaagtatacctattgccgcaagaaactgtcaaggaaggagttaatttcctcaaaatctgtagcagaaaatgattctaggccaggtaagcagcctgtggccaagttgaggaaacatttttctggagatgttggtgaggctgcagaggttaaaatagcttctgttatacatggaaagacaaagatgattaaagggaagaaggatacaacttctaagggcaaatcttctgtcagtgtcaatagtagctcacacaatgatcaattatctttaaagaataaagctggtcaaaaagtgttgaagttttcggatgatgttaaagattttgtaaaatccaatgtaaagaagctttcagcatcaactgataatagcgttgtcatgaagaagattgtcaaaagtgatggcactgttaaagagaaggagtcgcaacaccctgttgctcctccaagggccatcgcacctggctggagtggtgcttttcgatgccaaaatcgaaggccggagcgggctaatcacatcgcactgcaactgttccacacttccgctcatggctgcgcttttgtctag

SEQ ID NO: 2079 - DNA, 210 bp, Glycine max
  Peptide Sequence Number=SeqID_118857
atgggcttcatggttgcagagcttggtgacatattcggatccaagccccacactggaagtatgggattcttgtgtggggtttataaggtcttaggctctccaacaacaacaacaatgcttttgtcatgtggttctcccaagggccttagagttcttaaggaggagaacctatcatgggtttggatgccattgagaggagtcagtagttga

SEQ ID NO: 2080 - DNA, 552 bp, Glycine max
  Peptide Sequence Number=SeqID_118858
atgggtcgaaaggagaaggagaatatgagcaagggtcgcccaaggagaaggagaaggagaaggagaaggaaatggaaaatggaagtttgggggtcagagagagtgagagacggcaaagacggaggagaggtcgcaaacgcaaaaatggtgaagtttctgaaaccaaacaaggccgtcattgtccttcagggacgctacgccggcaagaaagccgtgatcgttcgaaccttcgacgaaggaactcgcgagcgcccctacggccactgtttggtggcggggataaagaagtaccctgcgaaggtgatcaagaaggactcggcgaagaagacggcgaagaagtcgcgcgtgaaggcgttcgtgaagctcgtcaactaccagcacctcatgcccacgcgctacacgcttgacgtggacttgaaggacgcggttaaccccgacgttctcaacgcgaaggataagaaggtcactgctctcaaggagaccaagaagcgcctcgaggagaggttcaaaaccgggaagaaccggtggttcttcaccaagctcaggttctga

SEQ ID NO: 2081 - DNA, 406 bp, Glycine max
  Peptide Sequence Number=SeqID_118859
atggcgccgggaatcagaggcctgcagctgacttccctcgccggcgactccgatgagctcgaggacgtgcggctcttggactcctacgacgaaatcgacggcggagcgaggcggattcaggtgtcggtcaccggaatgacctgcgccgcttgctccaattccgtcgaatcagctctcaaatcactcgacggagtcatcagcgcctctgtcgcgttgcttcagaacaaagccgacgtcgttttcaattcggctctgctcaaggatgaagacataaaaaatgcaattgaagatgctgggtttgaagcagacatattacctgaatccagtacagttgcacatgaaaccctggtgggacagttcacaattggaggtatgacatgtgcagcatgtgtaaattctgttgaag

SEQ ID NO: 2082 - DNA, 288 bp, Glycine max
  Peptide Sequence Number=SeqID_118860
atggtggaaagagagatgatcacaatgatagtagacacgctgccagtgttctactacgaaacgttggtgggctacatgccctctagcttcgcgaatctagtatttgcgggcgagaggattgaagtaggcctgaaaagagggaagttcgactatgtcgcccctgctggtacaagcaacagaagattcagagcaactgtggcaaagaagaaggaaggggatgtgcaaaaaggagctattttgaataagtgccaaaggagtcattacgctaagcgagctcaatgcgcttag

SEQ ID NO: 2083 - DNA, 564 bp, Glycine max
  Peptide Sequence Number=SeqID_118861
tctcacacctcttttttcatgaaagtagacccgtttttcccctacaaggtcactgcttgtgcgccaagaaaaggaaggcaaactggattctcaaacgtccccttgatgggaacgaggggttgtatcaattataatcccatccttgccataagacaacttgtctaccccatgagaggagcgtcgtcggaagaaagtatcatgcctttcatcacacagggtttcagtgaccccaatgcgaggatacttcgaggaatccgcaaagcgtggagcgcggtgcaaaagaaagacaaggagcttagagaaagccgcaatgggatcatcgacggctatcataagtggctaaaggctcggacgctagagttggattggctcccaaagctaaaggtttcaagcgaggtagaggctgaaacccccgaggacagtgaggaggtgcaagccttaaaggtggaacttgaaagagcacaagcggtcaaggaaaagttcaagacgacggccatcaaggtccgaaaagaatgcaatgagctgagggacatcaatgtggccactgccgaagctttggagtag

SEQ ID NO: 2084 - DNA, 405 bp, Glycine max
  Peptide Sequence Number=SeqID_118862
atggaaaccatatcgaaacgctttgagcaactcgatgtttgtggcaaagtacatttgaagacaaagctgcaagaaattgcttatcctgatatgaactccatgtgtcctccttcagaaaaggttatcatggacaagtggatgaatattacagatacgggatatgtcattgcttcacaatacaatgtgatcgttgtttctctttcacgacaacaaaacatgacattttttcctcttcgaaggtttttttatgagaccattgtcctttatcaccattggcgttgttgtggaatacacattgtcattctcaggcaaagcaatggtccaccctcgtacataggtagaatgcagcgttacacaaatttgtctaggctgaaaaccgaatttattgatttaggtgaacaatga

SEQ ID NO: 2085 - DNA, 414 bp, Glycine max
  Peptide Sequence Number=SeqID_118863
atggcgagtctgcttcgcaacgctaacatttccctcctcaaacgttctctcttccactctgaccttctaacgcgcttttgctttaaaccaggagtattgggcacgtctcaagttttgagcttttcaactcgtaaaaggaggtctaaatcagatggaagtgactcaggtgaagagaacttgtctaagaaagatttggcattacaacaagctattgatcagatcacctctgcatatggaaagggatctatcatgtggcttggtcgttccgtggcaccaaaaaatgtacctgtggtgtctactggttcttttgctctggatatagcacttggggttggaggtcttccaaaggttgtttgggtttcaatagtttactttgcaaagtatgtttctggttatgagatgtggtttcaatag

SEQ ID NO: 2086 - DNA, 573 bp, Glycine max
  Peptide Sequence Number=SeqID_118864
atggtagagaaggcttcaatagaggatgtaatgaaagtgctgttggcatcaagaaagcaagacatgcagcaactatgggcaacatgttcccacttggtggcaaaatcaggtcttcctccagaggttctagcaaagcacttaccaatagacattgtggcgaaaatcgaagagctccgtctcaaatcctccctggcacgccgctcattggtgccttctcaccaccaccatcaccaccaccaccaccaccacgcggcggcggcactcgacctcgaggaccagaaaatccggcgaatgaggcgcgccctggactcctccgacgttgaactggtgaagctaatgctaatgggagaaggcctaaacctcgacgaggctttggccttaccctacgcagtggagaattgcagcagagaagtggtgaaggccttactggagcttggtgcagccgacgttaactacccgtcgggtcccgccgggaagacgccgctccacattgcggcggagatggtgtcccccgatatggtggcggtgcttcttgaccaccacgcggaccccaacgtcagaactgtcgatggg

SEQ ID NO: 2087 - DNA, 1380 bp, Glycine max
  Peptide Sequence Number=SeqID_118865
atgaagtcttggtcactggacgagtggaggaactacttcgggtctgcgaattcggatatattcgagataattgagcacgccataattgtggcggcttcggattgtcctaaggagtttagagtgaggagggattggattgcagagaggttgttttcttgcaggttgactcggtgtgtggggtgtgaccgtgttgagttggctgtgggtgcagatagtaaaaaagagaaacatgatggtgatgatggtgataatgataagagtgggtttgagagagatggggttgagtttgaaggtgcaggggcaagcaaagagagcaaggtcaatggggatgcgaatcttggtgacagcaattatagctttggggaggctgaagcattaagtgatgagatggaagaggagtctcagtatgttgcggagattttgaggatcaaggatgttctgcttaaccctgaagatgaggatgggtttttgaggtataaagaaatgtggtttttgttggattctgaggctgtgatatttgagtcattgaggaggcttcagttgatggaactcaccgtggactgtttaaaggcaacggagattggcaaggcggtcaatcctctccggaaacatggatcgaaggacattcgtcaacttgccaggactctcatcaatggctggaaagaaatggtggatgagtgggttaaggccactactaccacagctatcacaggttcagaagaaggtacaccagattcagtgaatccatccgttgtagatgatgatgaagaagaaggacttccatcacctcccttggatgaaggggctttctttgtcactcaggctggttcaatggagctgtcacagttctttgatggcatggacgacgatggaaatcctcgaccaactggaccattcagcaagaaccatgagaatggcagaaagccagcttttgacagccatgttttagagatgaggaagttgcagccttcccatgacacagtcgtcattaacagagatgttaagagtcagcaacaagcaaaggaaaacaaggctgctgtcatgcctgtgaggccaaataaacctgtaacagctgattccgggcctggcagacccccaaaatcaaatgtgcagcgaaaaagtaatatggagccaaagatgcagcaaaaaatggagaacaattcaatcactaggaggcctccaactgctcagttagataaatccaagcgttcagatgacgatgcagtccaagtaaagctagaagccaccaagagaaaacttcaggagagctatcaacaagctgaaaaagaggcagagaacaatacaagttatggaaataaacgatcttcccaagcaaggtttgcaccgaaatacacatttcaaacctggatatcacagtag

SEQ ID NO: 2088 - DNA, 204 bp, Glycine max
  Peptide Sequence Number=SeqID_118866
atggaaagtaagggagtgggagagaatataagatgggatgaggaagatgaatgtggctacacctatcccgccagcatgcacggtgagatggttgaggtggagacacatggcgaaaaccgccaggaggaatggcgagacagcatgcatggggtatacgatgaattcggttataacaatcttgtatttcaatggaagggtatttga

SEQ ID NO: 2089 - DNA, 150 bp, Glycine max
  Peptide Sequence Number=SeqID_118867
atgtttggggttcgctcacgagctctagcaccttccctatctaaatctcacggttgttgtagtgcttcaagcaatgtttcagcatttctgacgtcaaaccattgcacgtggggaggcggggggcacgcacggagctgttgttcagatatg

SEQ ID NO: 2090 - DNA, 276 bp, Glycine max
  Peptide Sequence Number=SeqID_118868
atgcctttttgcgggcgcgcgaggcgaggttctcgggtgcgttttccaaaggaggaaaatgcacggagtcgccaccaacgtttatttgtggaaaacgccggaaaaaccgaaggaaaccggtcgacaaacgcggggctcttgctcctacgtactctccatcgaagaggaaatcagacctacgtagttctttttaagggtgaatcaagtgattctttttacttggaaggtgatcattttaaggcgttggaccttaaaaatgatccatttacttggtaa

SEQ ID NO: 2091 - DNA, 273 bp, Glycine max
  Peptide Sequence Number=SeqID_118869
atgttgcggaactttgcggattacctaacgatggatgttaagtacctcgaagtggtcaagcaaaggttgcatgccaccaaacaatggttcccgaacaaaattaggggatatccaacaaggtcactgcaccccccatgtacatacacaacatacaacatcacaatgacattttcaacatcatcaacatctcacctcaatatcattatctacatcaacattgcctcatctcatttcaatgacattatcaacaacaacaacatcatatcatattaa

SEQ ID NO: 2092 - DNA, 411 bp, Glycine max
  Peptide Sequence Number=SeqID_118870
gtcgacgtgacatacgagagctggaaggaagtccctactgctcagaaggatttgatatgggaggatattcaggcggaatttcaaatccctgaagcttctgacagtaggacaaagaagaaaattcttcagactgtcggcgagcggtggaggcaatttaaatcggacttgactaggaaatgggcacttacagccgacaaggatggtgtggacgacattgatgtgcagaaaaaggcacaggccatccagaagcaaaacactgcccctcacgtgttgtctcatgggggttatcaatatttagaacaaaagctcatggctgagaagacaaagaaaagaaaagactggaagaagctacccagtccggaagcactgagggcatcattgaccctccatctcccattagacgccatgtga

SEQ ID NO: 2093 - DNA, 267 bp, Glycine max
  Peptide Sequence Number=SeqID_118871
atgaagaaaggagaagattcctccttagccccaaaatgcaatgaatgcgatcaacctgagcacttgagattcgattgtcttgtccctaaaagaagaattgaaaaatccgacaagagaaacttcaaagaaaaggaagaaaagaaagcatacatcacttgggaagataatggcttggattcttcaagtgattcagaaaatgaaatcataaatctggatctcatggcgaaagactatgaaagcggagaagaggtaatgtcttctaactaa

SEQ ID NO: 2094 - DNA, 1260 bp, Glycine max
  Peptide Sequence Number=SeqID_118872
aggactacacgtcctcaccttcagagggctgcatggcctcaccttcagaggactacacgtcctcgcctttagagggctgcacgccctcgccttccaaggactacacgtcctcaccttcagagggttgcacgccctcaccttcagaggaatacacgtcttcaccttcagagggctacacgtcctcaccttcagagggctacacaccctcgccttcagagggctacacgtcctcaccttaagagggctacacaccctcgccttcagaggactacacgtccttgccttcagtggattacacgtcctcgccttcactgggctacatgccttcaccttaagagggctgcatgccctcgccttcagaggactacacatcctcgccttccgagggctacacatcctcacctttagaaggttagacgccctcgccttcagagggcttcacgccctcaccttcagagggctgcacatcctcaccttcagagggttgcatgccctcgcctttagagggctacacgcccttgccttcaaagggcgacacgtccgtgacttcagagggttgcacgccctcgcatttagagggctatgcgtcctcactttcattcctgggccaccccctgatctcgaaggagggccaattgtgcgagcacaaccagagggaggctattgtgcagccactatgcatactggggcaagatttcacccagccattgcaaagagacgacatcattctgctcaacgaccacaatgtcgatctccccctgcggaagtatcagttggtctgtgccgtcatgacatagggatcacgcccacaagacacccagtggacctggaggagtccaacagtgccctagtgtttccagctttggttacgggcctctgtcaatcctacaagatgcccgtccccccaccaaggtcatgccatcgtgacatagggatcgcgcccgcaagacacctagtggacccagagaagtccaacagggtcttgtggtttccagctctaattacgggcctctgtcacttctacagagtacccgtcgcccccaacaaagtcatcaggccccctactaaccaagctttcatcaagaagtactgcgcccctaggcaggtgcagggcaagacaccacaacaacctaggcatggccgacagcgagcaacagatgcaccgccgccacctccaaagcccctcatctcatctacaaaagctagagcgttgcctacgacccgtggtcaaccagcaggcgaccaagtccaaagccaaag

SEQ ID NO: 2095 - DNA, 324 bp, Glycine max
  Peptide Sequence Number=SeqID_118873
atggcgacgttttatggatacaagctaagcatgtttcagaacatatttggaatggggaagaagacagaaaattacacatcagacgagatgtccccatgtatcaagatcaagaagaaataccagaacaaattattcctctacttcggtctctgtgtggatgaatcatcattaattggtccaacaagtcttgattggattgatttatgtgaagaattgttaggagtcagaccacaagaaggtaaacttcaaggtagtgtggttaaattaagttggttcgctcaccatttttcacaattaaataacaatgacggtaacgtgcaataa

SEQ ID NO: 2096 - DNA, 120 bp, Glycine max
  Peptide Sequence Number=SeqID_118874
atggcattgctactactttttgctaagactttgagatacgtagagagtggcgggttaaatttagatggcgtaactcaagatgggtcatatgatgccataaagattatttttgaatactag

SEQ ID NO: 2097 - DNA, 171 bp, Glycine max
  Peptide Sequence Number=SeqID_118875
atggctcaagaggagggtacctgcacagatcagataccagaaccatcctctgcacctgctcctgaggagacccagccatctacaccagtcatggagccaaattatttaaaatttcagcattttgagttgtttgcttgtaccaaaagcgtgtttgaattgcgaattgattga

SEQ ID NO: 2098 - DNA, 123 bp, Glycine max
  Peptide Sequence Number=SeqID_118876
atggcctccatcattgtggccattttctctttcaaggcctccatgtcggccttcatctgctcttgcacctcctctacttcacccattactctagctctagcacaggttcggacatggggttga

SEQ ID NO: 2099 - DNA, 378 bp, Glycine max
  Peptide Sequence Number=SeqID_118877
atggatcaactttactttgacggtatggcaataggcaatcatgttggttttccaaatcttgttattactctaacctgtaatccaaattggcctgaaattcgtagattactttcacctttgaatctcaaaccgacagacaggctagatattgtatcacgaattttcagattaaaatatgaacacatgctgtcagacttaacaaagggtcaattacttggaaaagtggttgcatatatgcatactatagagtttcaaaagcgaggactccctcacgtgcatttactactatttctacatccagacaataaatatccatcttcaactgacattgataagataatatcaactgaaataccttcccatgaagatgacccataa

SEQ ID NO: 2100 - DNA, 786 bp, Glycine max
  Peptide Sequence Number=SeqID_118878
atggccgattcgaccagtgaactgatgatgtttgccgagatgagcggacatcgcccggccgcccccgctgcggcaccggtacgtagcgcgccggtacagcgcgtgcccgttgcgccagtccagcgctttgcaaccgcgccggcaccgcaaccgatgtttacgcaatctcaggccgcgccggttgcgccaccgatcgccgcgccacgcgctcagccggcacctacaccgacaccttcaccggcaccagcgccagcagcgccgattgccccgccgccggtacagccggtacagggcggcggttttctgacggaggagcagcgccagccggaaccaaagcagactaatccgctgctgaaatcggtacgcactttcaactcgcagcagcctgcgccggtgccggtgaatgaagcagaagtaaaagcacagagcgagttcagctatgtcagcccgccggtagcggaaaccagaatcaccgccgccgatgccgccgtggcgcgttcaccggtcagcctgagcggcgcggtggatgaaaccgtggctgaatccgagctgcggcagaaattcctatcggccgcgcgcatcacctggcgcatcagtccggcactgaaatcgtccgtggcgcagaccgatgccgccgccgccagtgtggatgaggcgaaagggcagcgctggccacagctggatgtcagcgccagttcggcgaccaaagagtttggtggcggggtaaaaagcgacggtgtcagagcaacgtgccggcgctcggcgtgtcgatggcgaccaacctga

SEQ ID NO: 2101 - DNA, 267 bp, Glycine max
  Peptide Sequence Number=SeqID_118879
atgtcatcacgcactcagcgcgtcatcagcttgctcagtgagaagatagtctcttttgcgcttagcatgagaatgacgctaagccaaatttcacttactcgcgctaagcgcgaaaatgacgctaagcgagccttcacggacaaaaagccctttttaagcctgaattgcagagaaagagaagcaggtctgaatagactacgtgagcctagtgtagaacaaagaacagaggaaaaactgagcaaggaagaaaaaggctttaacttttag

SEQ ID NO: 2102 - DNA, 300 bp, Glycine max
  Peptide Sequence Number=SeqID_118880
atgacactttctgacttcaatgtcatgcttgggttcaaaattaaggagttagtccagacattggagtatcaactggctttcatgaagaagccagactgtcacttccagtcccctctctttcagcctgacgcattcaaagacagcctcttccatgacccaaccctatgcctagctcacaaatggttcataaggagcttgcatgggaagaaggagagcattggctcggtcacctccaaggatcttttccctatttggtgcatttgttgcgatgtaaatgctagctcagagcatggttgttaa

SEQ ID NO: 2103 - DNA, 357 bp, Glycine max
  Peptide Sequence Number=SeqID_118881
atggtgcgtgagtgcaatgtgcttggacataaagtgtcatctactagcattgaggtagaccccgccaagatggaggtacctccacctaattgtgttaaggtggtaaggagttttctaggccatgctggcttttacaggagtgcattcaatttgttgaaggagcgcttgattagtgttcttgtaggtttttcccttgggtgctcattgtcatttgagctaatgtgtgatgctagtgatatgactatgggggaagttctaggccaaatgagaggcaaggtgttccacaccatctactatgccagtaggatgctagatgagcctaggaaaattataccaccactaagaaagaattgttag

SEQ ID NO: 2104 - DNA, 585 bp, Glycine max
  Peptide Sequence Number=SeqID_118882
atgtgctatgcaggaggctccaactggtcctctgtgtcatcattggcctctaagatagcatttgcaccgcaaaaaatgcaccaaataaagaagaggtccttggaggctggctttacaaacgctaggctaaaacagaggggacccagtgagtttcttgaagaataccgcttattggaagcgacactttggctgcttcatgaaagccagtggatacttcaatgtctagactacctccttagtttcgaactcaagcatgacattaaagtcaagggtcatggtgctgtctcacacctggaaagtggagatgaactccatagatatgtcatggaaggattgctcttagatgaaagctatgtgctgccacccaatggtagtctagtagtaggagattctctcatagaggccaagttctcagagaatccaatcctcgggggctctggttccctcttatggggaggtggtgatggtcaaggatgtgactatagaacactggataacgagatccacgaccatggtggaagtgataatggtagtgttgcaagacaaaggtgccaatgtgagatggataacggtcatgatgcttga

SEQ ID NO: 2105 - DNA, 889 bp, Glycine max
  Peptide Sequence Number=SeqID_118883
ccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatgtgtgacacccagcaggcgtgccctcggcctaatggcttcgggcgcaacttgcgttcaaagactcgatggttcacgggcactctgcaaattcacaccaagtatcgcatttcgctacgttcttcatcgatgcaagagccgagatatccgttgccgagagtcattcgccggggtttgtgtttgtcgcgaggacgaggaggccgggcgcacggggcgccgtggtcatcccctccctcccgacggcatcgacaatgatccttccgcaggttcacctacggaaaccttgttacgacttctccttcctctaaatgataaggttcagtggacttctcacaacgtcgcgggcagcgaaccgctcacgtcgccgcaatccgaacacttcaccggaccattcaatcggtag

SEQ ID NO: 2106 - DNA, 225 bp, Glycine max
  Peptide Sequence Number=SeqID_118884
atgggtatcagaaaggcattattttcagcaaatgaagtatcttcaaaagccgttcatgcgccaaagggctatcttgcagtatatgtcggagagaaaatgaagcggtttgtgatccccgtgttgtacttgaaccatccttccttccaagacatgttgagtcaagctgaggaagagtttggatatgatcatcccatgggtggcctcacaattccttgcagcgaagat

SEQ ID NO: 2107 - DNA, 875 bp, Glycine max
  Peptide Sequence Number=SeqID_118885
atgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggtcaattattcaatcaaatgatattgagcatgtttcccatctcttcttgagaaacaagcgggctatttctttgcaaaattgtgctcaatttcatatgtggcaattccgtcaagatctcttcgttagttgggggaagagtccgcacgaatcggattttttgaggaacaacatgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaat

SEQ ID NO: 2108 - DNA, 945 bp, Glycine max
  Peptide Sequence Number=SeqID_118886
atggactttagatgtctatccatgttgctctctagaaagggtccacttaagaggatttatagctcaacaaattatgttccaacaatttcaagctcagttctgaccaaggttgaagccttggttgatattgacaagcttcagaaggaaatattgtcactccaaaccaagaaagagtttgagaggagtttgtatgaacactcctatgaaaagtattgggaaattgaagaccagatcaaacggccacaatatgaagacaatgatgctagtgctttgatggcggccccaactctaaaatcatgccaacagaccctggacaagttgaaagagatacagacacaatcatctaatgatgctaaagaggagtatcaaagggaacaaataaaaaaatgtatagatgaagaggtggagcaagaggagcataacatggggatgttgagagagaagatcaaacaaaatttggaggaatattcaagtaattccctcactgtgaatgaaatggttgagtgcattcatgagcttgtaaataaggtttgtaccttggaaagtgcggtttcatctcggaatagaatggtaaagagactaaaatcagaaatagatggacttcaaacaaatttaaagaagttggaagaagacagggaaatgctcatagaaggctcagaagttaccaacaagaagctaatggaattggaggaagagttgcagagagttaaaatgttcaaccaaagtgttagaactcaagacgacaccctccaaacacactttactgaagctagctgtaaccttgagcacttttttggaaaattgaataacatgaagccagatgaggaggaggagaacttggtactttacaaaaagaagagaactacttctgatgataaatcagggggaaatctaaagagcatgatgataacttgtttgttgataacacagatgtcaagacaataa

SEQ ID NO: 2109 - DNA, 189 bp, Glycine max
  Peptide Sequence Number=SeqID_118887
atgaagaacggtggaaaaccttcgcgaaatcgcccatggaaacgtcccggaagggaaaagagggaggtggttgccgccagcacgcccaggcgagctgggtttcttccaccagaaggtaccgccttctgttggaacaccctagaaggcccaagtgggcatgattgctatttacacacccttgtttactaa

SEQ ID NO: 2110 - DNA, 537 bp, Glycine max
  Peptide Sequence Number=SeqID_118888
atgacatgggctgatcacgaaagaatttatataacgaagctacccttcgattcgaaagaaatcccaaagagtttgcatgagagactaacattagatgtaccctactatcacaattggcttcgggcattttccacaagctcttggtcagatgagttttcttctcaaatgtgcaagtgcgaaacctcgaggattctttttttcatatatatattttttcaccaatcacaagtgtgtgcgggtttcattctagaatcccgacttaaaagcaaattagtcattcttgatctacgagggctttattgggcttgtaacgtggtcaggggtaagagggatatgaaagaaaaggtcatagaggctcaaagagtgtttaagggttatattgacggtggttcctatcgcaacctacccttcggcgggagggcgacgcgagggctcacgggtgcatcttccatgggaggaaaatgcgcggagttgccaccaacgtttattcgaggaaaacgtcagaaaaatcggaaaggtgtggtctacaaactttaa

SEQ ID NO: 2111 - DNA, 397 bp, Glycine max
  Peptide Sequence Number=SeqID_118889
atgcaacaaccaattccagggtgtccttcgcaacccttgaatattcatggcataacgctgaaaggcaaacaagatgaaaattgggagcaactgttcaccccaatgatcagtcaatggaacaagcaagttgattttagggtcgacggttatcctcgacaagagggcttattgaactttaactccaactacatggtctttgcatcagagcatcaatttccagcacaagagtttcacattctccaatcaagtgttgaaactcaaggcatagacaggcgaagggtggttgttgaagcggaagaatattcccaacaaatggcagagcgtggccatggaatgtattacacaccaccaacattttctcagtatccaacacagatgtatcagtatcctttcaaag

SEQ ID NO: 2112 - DNA, 495 bp, Glycine max
  Peptide Sequence Number=SeqID_118890
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgatgctacatagttggttctcatccttcagagactacgagtataataggagcatccgtcaacaaaaggatcaccctaagatga

SEQ ID NO: 2113 - DNA, 309 bp, Glycine max
  Peptide Sequence Number=SeqID_118891
atgtctcctccacctctagaacctcacaatcactcacatactcatctcaagttctcaagacggcttcttcttcaagctcgattctctataggtcttcacatagcaaaatctctcaaactctctggaacttggacctttctctctctagaaaaccctagacatgcagaagctttaagaaaagcggatggactgaagcggtgcgcttcgctggatgacccttcgcttagtgcaaatgcacaactcatccttctttcagattcttcctcgcgctcagccgaggagtgttgcgctcagtggatggcttgctaa

SEQ ID NO: 2114 - DNA, 276 bp, Glycine max
  Peptide Sequence Number=SeqID_118892
atggtggaacatttggggttcataatatattttgaaggtcttcaacctttgtttaagattccaagtcgaaacacaatcaatagtgatattgtgaagatatatgagtatgaaaaggtgaacatcatgggatatttagaaagcattggaagtagaattgctttaactacaaacctgtggacagttggtaatcaaaagaaatggtatatgaccatcacagcatgttcgcacatggttgaagttctttctaaggtgttgttacagtgcattatggaatga

SEQ ID NO: 2115 - DNA, 207 bp, Glycine max
  Peptide Sequence Number=SeqID_118893
atgaaacttggtccggtcagtggcccggttaaggtagtgggtcaatggtccaatcgttcaagtcatcaggtttactccaaatcggccgagtctgatcaagtcatcatggacaagatgcatgaccggtccaataatcaaatcgatctggttatgccatcagatcccgattggactcattcgaccgactgggttgtaccggatttttga

SEQ ID NO: 2116 - DNA, 480 bp, Glycine max
  Peptide Sequence Number=SeqID_118894
atgacatcggtagcattgatcaacctccaacaagcaaataatgaatcattacatgacttcgtggcccaatttttgcaaatcgcggtcaaaatccaagatctagagcccagagtggcccttcatgccatgatagcaacaatgaaactagaagcatttgcaaatagtctctacacctcatataacatcttacttggcatacctactttgaacaagttaggagccattgtctctacacctcatttagcaatgaagtttccttcatccactagggaaattgtcattatgaaggctaaccaagttgacgcttgtgaatgctatgtaaaaagttgcaagattgagataaatcaactggaaaatggaggatgtatgtggattattgttaacgttttaattacattaggatttacgttggccaagtgtaaccaaatcccaattgtagtgaagctcaagtcatctcccaagggagtagtgcaaagatga

SEQ ID NO: 2117 - DNA, 272 bp, Glycine max
  Peptide Sequence Number=SeqID_118895
aattggagaaaaaggaaccatatgggaaaatgaacacactgccacacctcttgggcttgagattattcctcaagtaaaggagttgatggatgagggtttggttcataaaagcttaaatccttgtgctttgttggtgcccaagataagtattatgaggcaccaagtccctatgataggtggtatgatgaatgtgttgagtggtgcaacccttttttctaaaatcacccatgaatccaacatcttcatgattcacacacatagggactcattag

SEQ ID NO: 2118 - DNA, 678 bp, Glycine max
  Peptide Sequence Number=SeqID_118896
atggtggcaattctcaaagagttccagctgagacttgatctagatctactagtagatggtcttgaaatcaagaaccaggctgggggagaagcaagctatactgtggaagcagagaatgatggaaaagtgtcaaagctctatgatggagcttggaagaagattggagggaagcagagcttacccatggggaacaatccaaacaagagtgaaagaaaaggaaaaaatagttctctttgtgggagtcttgtgactgacttttgtggaagaattgcagaagaagtgcctatggaaatggtggctaggaaattacaacaattgaattgctcccatgtcccaatgggcaaagtccagcaaaataaagaagaggaccttggtaatcatcagctacgaccatgtgcactagtgcagtttgcaagagagccaactcagccaagggatcttctcgatataactataaaggctttgatgctctgtttcatgaccaactggagtaggaggtgggctgcaggtcgtcatcattgttttaaatatcggtccacaaccgcaattgcggccacaacgtcaaggtatttcgactcaccacaaccgcattgcggccgcatcagctgcattttcccgccattgcccaaaaggcagcagccacaagatgttcaccttgaggacaaggtgaaactttag

SEQ ID NO: 2119 - DNA, 723 bp, Glycine max
  Peptide Sequence Number=SeqID_118897
atgcttgttattggcctatgtgtactagcagtggtgttggttgtgtatgtcattgttggtatccttggaagtattgttggtggaacaacctatggatttcttccacccatatttgctacttttgaagctgtacaggaaggaaaagtttttcaattacttactgtaaagagtattcccaaccttgtcctttcactcatttcaatcccctttacaacgttctctaacttagccaaattctttgcagttgttttgtggcctccttttggtagtccctcactctatccaatgcctatatatggggaggcttctaatcacaagtatcgaggatgtgagccgctggtcttgtcataccctagctactctggtacatttgactacccacctatttttaaatctatttgtttgttgggaagtgaaaggcaaagaccaaccaatgtagcctcggaggaagctgagtacaattttttggcaggtttactagtggtttcatcatccttggctgattttgcatctagtgtgatgatgaaacattacataaaagcagacttgtataagctgttctcatattttttccatgtgttcgatactgttttttgtatagaaaagatgaaggcaaaatctagaataccgatagagaaagagttgataaaaactagggcggtgattaaatcggcagcatcaacagcacaggagaccaagatcgttgcacctttgggtgggtga

SEQ ID NO: 2120 - DNA, 312 bp, Glycine max
  Peptide Sequence Number=SeqID_118898
atgtctttttctggttctgatagtgatggatctccagtttcccatcgaaaatctatgctaaaaaaagatatcttagacataggggaagagttagaatcattctcgaactctactacatctcttcccttttctaataaggagaaatttctgaatttgatgaaaggtctagaaatttcctatggtgttaacatcatcagcggcatcgatattaacgtcgtttcagtggattccgacgtggggggatttcaagttgatgtatttaaaccacttacaaaagtagatgaggctattggtggtggtaatgaggggtag

SEQ ID NO: 2121 - DNA, 192 bp, Glycine max
  Peptide Sequence Number=SeqID_118899
atggcagaagcaacaaaaaggtatgctgtggttactggagcaaataagggaattggatttgcaatatgcaagcaattggcttctaaagggatcattgcggtgctcacagctacaaatgagaagctcaaagatctggtctttctggccgtgtggtttttcatcaacctgatgttacagaccctgcgggtatag

SEQ ID NO: 2122 - DNA, 234 bp, Glycine max
  Peptide Sequence Number=SeqID_118900
atggaggaatcaaccggacgacagagcattccattacaatttcttccatctgaatgccatgtgtcgcaacgtgcccttcgcgggcgagcaaaggcgaggctcacgagtgcactttccaaaggaggaaagatgagcggagtcgtcaccaacgtttatttgtggaaaacgtcggaaaaaccgaaggaaaccggtcaaaatgaaaattctaagttcgggagttgtatttacgcttga

SEQ ID NO: 2123 - DNA, 222 bp, Glycine max
  Peptide Sequence Number=SeqID_118901
atggaacagaggaacatacccaacaggcagagagaggggactgggcctgccaccctctctgaccctcatctgacttctcccacaccctttttccttggctctccttttgctcctctggatgaccctgctgccactcattgtttaactattgaagagaaagctttacactgttctattgtaacttgtttgtcatcaaaggtttttgtagtgtacaggagataa

SEQ ID NO: 2124 - DNA, 204 bp, Glycine max
  Peptide Sequence Number=SeqID_118902
agagcaagaaagcttagatggagaagagacagagagaaggagaatacagcgctaaggagacgaaacatacctaggtatggtggcgaaggagaagaagcagagacttgtgacgatgctcgagtgcgacaaacacgatgctcaaatgtagacagggaccttgaaggtagacggagattagaagaagaagagagtgcgaaagcttag

SEQ ID NO: 2125 - DNA, 1158 bp, Glycine max
  Peptide Sequence Number=SeqID_118903
atgcctgggagtttagaaccgttagatttgggtgttcacataccctaccacttccgatgcccaatctcgctcgaactcatgcgagacccagtaactgtctgcaccggtcaaacctacgaccgcgccagcatcgagtcatgggtcagcaccggcaacaccacatgtccggtcacacgcgccactctctccgacttcaccctaatcccgaaccacacccttcgccgccttatccaagagtggtgcgttgctaaccgcgcttttggcgtcgagcgaatccccactcccaaacagcccgcagaccctgccttagttcgctctctcctcaaccaagcttcttccgattctgcccctgctcaccttcgcctttcttctctccgccgactcagacaactcgctcgcgactcggacaagaatcgttctctcattgcctctcacaaccttctccagatccttctcccaatcgttttcaacaacggttccgacgagttgagtcacgagtcgctcgcgctgctcgttatgtttccgctcggcgagtcggaatgtgcttcgctcgcatctgattcgatgaagattggctatttatcgcggatgttggcgcataactcgttcgacgtccgagtcaactcggccgcgttggttgagatcgtcgtcgtcgggacgcactcgccggagttacgcgcggaggtgagcagtgtcgacgaaatctacgacggagtggtggatctgctccggagcccgatctctcacccgcgcgcgctcaagatcgggatcaaggccttgttcgcgctttgtttggtgaagaatacgcggcagaaggcggtggccgccggcgcgccggcgggcgctggccacggtggagctgctctgccggattccggcgggatgcgcggcgtttgcagcgcacgcgctgacggtgccgatgctggtaaagataatcctgaagatctccaaccgcgcgacggagtacgccgctggtgcgctgctctcgctgtgctcggagtcggagcggtgccagcgcgaggcggtggcggcgggcgtgctgactcagcttctgcttctcatgcagagcgattgcacggagagagcgaagaggaaggcgcagatgctgctgaagcttcttcgggattcgtggccgcaagattccgtcggaaactctga

SEQ ID NO: 2126 - DNA, 336 bp, Glycine max
  Peptide Sequence Number=SeqID_118904
atggatacttactcgggtcataaccagatccggatgcacccagacgacatggacaaaatggctttcataactgggcaatccaattattgctataaggtcatgtcgtttgggttaaagaatgcaggggcaacctaccaacaactgataaacaagattttgaccaaacttatcaagaaaattgttgaggcctatgttaatgaactggtagtaaagtccttagaagttggtcgaccgatgaggcctttcctctattttgctacctacgcaaaaatcaaaggtttgcttggaccaccgtgtggggtattgaatctcccttacatggtcgacaaatattag

SEQ ID NO: 2127 - DNA, 211 bp, Glycine max
  Peptide Sequence Number=SeqID_118905
atggtgtcgaaaaatagaaacaattccaccaccgaagtttctttccaccaacaaacaaatctggccatgcacactaagtgcaaattccatcacgacatttgttgcccggcagatctcaatgatgaggaggagttgcatgattcgaaggcattcaatgacagtcatggcattcgtcgctacggcggatctcgacagcaaggaggagttgcac

SEQ ID NO: 2128 - DNA, 342 bp, Glycine max
  Peptide Sequence Number=SeqID_118906
ggagctgtgggatcggtgaaacttgcagatagggcggatcatgatgtcgatgatcacctatatctgataacattgactatcccacaactttttctgaagtcgttgcaggcatatgaccgagagagaagcatgcgagtagggaatgccaatgtgtatggattccttgagccacagtccatacaaagatctgggttagtcctatttttcaatacatttgcattagcattagtcgggaacatcaatattttaattgtacaatacgcaaccatgtttgtattcaatagtgctttgaaaggacttgacgatactccacaaagtaaatccaaggttgttgctaggtag

SEQ ID NO: 2129 - DNA, 372 bp, Glycine max
  Peptide Sequence Number=SeqID_118907
atgggtaccgccattgaaattggcgagaagtttggtggcgagtggagggtgccgcccgtgccacaggcgatacatccaggttggatccgccaactccattggcgttacgggcctgacaagggtgctctcgccttcatcattggcgagatatgtccactttccagacaaggcgcttcttgccaattgcattggcggatcatgcatagcgcttctcgccaaccgcattggtggatcatgcatctcgccatcttcagtggcggcaccaacgtacaccctccaactcagcatcgttctcgccatctgcaatggcggaacagcaatatcgccagttcttctggcggcatccatggaggaacagaccctccctgttaa

SEQ ID NO: 2130 - DNA, 279 bp, Glycine max
  Peptide Sequence Number=SeqID_118908
atgtcagaaaatctatctatagcagttgtgaatgtaagtgacaagtttagattgtctcttaactgcaaaatttctataaacatacaggctgggagaaggctgaaaatgaagggacaaaatagaacagcattgctggttacctcaaacttgaagagtgcaattgatgaatggatagcccagaagaaagcaaaccaccaaggtagaggtagaggtattccctatgccttgcaactaaatctgccacagagaagcaaccaaaagccaaagaagagaaaataa

SEQ ID NO: 2131 - DNA, 306 bp, Glycine max
  Peptide Sequence Number=SeqID_118909
atggttccagcaggtgaggtgtgcgttgtgccaggccaggcatcagatcctttgccagatggtaatgctccgcagccccgggtcgtccctcaggccccacagacagatatccctcatgtgccagatctaggagcaccgtcgacatctgtaaggcccgctgtggaggagcctagacatgtagtggaagttttccatgggattgttgagaggtcggagcgccatctgagcctagggatggtcacgccaggctcatcgacacatgaggtgatcgaagaatgcctcaggatggccaagagtgtcacatag

SEQ ID NO: 2132 - DNA, 552 bp, Glycine max
  Peptide Sequence Number=SeqID_118910
atgggccaagaaaaaacaatacaactcaggtggactactaaactagacaccgcaagaaacccaaaatctaaaggcattttaggtgtataccttgtcagtagccacttatatattgttcaacttgctttttcttatccaatgcattggagccttaaagaagcatatgttaaagctatagggagtggacttactggagggctgaataaagtggaattttctcacacaagatggacaaatatatcagctaaagtggatgggaagaccatgacagagtggagattttggttgttagaacttggggatagacattgtgtttcaattgcgagagttcacccaatatcagctactactagttacaaaacaacattgaagaaagtggactttactgaagaggaatatactctaggtcttcatcttccaaacgacgaatgcatgccgccagccggaatggcgagtcctccacggatggtccacgtggcagtggactcgccagcaccagaggcgatttcatgccagctggtctcgccaattaaactggcgagttgttcctag

SEQ ID NO: 2133 - DNA, 174 bp, Glycine max
  Peptide Sequence Number=SeqID_118911
atggggtcggaccaagcgccatcttttgaaaagaggttctattatgtcagagtaaaaaatctagagctggccagcttgcgaaaactggggcagcgaatggatcaagttcaacatcaggctttcagcaaggctcataacacaaagaaagaattatactcaagctttcaagtgtaa

SEQ ID NO: 2134 - DNA, 225 bp, Glycine max
  Peptide Sequence Number=SeqID_118912
atgatgactaatgacaacatatggtatgtggttggtggcgcaaagagacatgccaaacgaatgagtatgaccatgggatcaaaagttcgctatccggtgataactcccaaaggtggttgtatgcaactttcaaaggcctctagagatatcatcctctttggtaacaacattatggaggtagggactaccagcgacaatgcatcatcaaaaaaaggaaaactctag

SEQ ID NO: 2135 - DNA, 669 bp, Glycine max
  Peptide Sequence Number=SeqID_118913
atgaggctccttagcatcatcaccacctccttaacactgttcttccttcttctctttctctccatacacctccaagcgtataccctagaagacaacttcaccatcagttgtggcaccaccgggatagtattcgacgacgaaaggacatggacgggggacgcagacacaaaatacttatctggtggtcaaggcagaaccgttttaactgaagcaacaacacaagatccttctgtcaatcaagttccctacaccacagcacggttatcccgttctcagttcaattactccttccccgtttctgcgggccccaaattcgttcgcctcttcttctacccagcttattacccttcctttccccgcactgatgcctctttctccgttcaatctaacggattcaccttcttaaaaggtttcaacgcctctctaaacgctgacgcggaagccaccaaaaccatcttcagggaatatgtggtaaacatcaacgatggtgagattctcatcctcagcttcactccctcgcaaccaaactcctacgctttcatcaatggaatcgaggtacaaggtggagaagaagagaagaaaatgggtttgagcttcgtaagcgtggagaagaagggaagcaaatgggttttgcgaaataataaagcttctacgtttaaaaaatcataa

SEQ ID NO: 2136 - DNA, 582 bp, Glycine max
  Peptide Sequence Number=SeqID_118914
atgtgcgagacaaacgctacccgcatgtcggcgtgtagagacggcacgacaacgcacctaaaagtgatctcgatctttgtcatcttggtgacaagtgtgtccacgtgttccccaacgcgtatgccgcactcgtcgactgccagtggcatcgcttcaccctgggagggacctccccttcgcaggcctcgtcatgctcgtcggtgcactcctagccctagtcgtgaacctcgtcgccaactcgcacgtggagcagcacgcgcacgtgcaatacgcactggtggagaaagagggtgtaaaatgtggtatttatggtgccaattctacaaaatcgattatgagtatgcaatccttattgagctaaggagaataaggcttgcaatgctcatggactttattatgctcctttatatgataccttggcaattgcaagctttggaaaggttacctctgaacaaaagcaagaagttgaaaattctaggttggcaatatattcatgggatgaattcttacaagtggtgggttattcatttcaagtactattgcgctttatccacaagttgtatatacttggcaattgactaa

SEQ ID NO: 2137 - DNA, 648 bp, Glycine max
  Peptide Sequence Number=SeqID_118915
atgaaaggtattgatactatttccaaggaagtttgtagaagttttgaactaggtatctgcaatatcttaccatttgatccggagtaccgaaatggaaagctagttatatcagccaataggatcttggttggtcttccatctgttgagtacagggaaatgatcttgaagactcttttggctaaagaaaaacataaaaacttggacttcaaagagctggcaaccatgacagaaggatatactggaagtgatcttaagaatttgtgcatcactgcggcttatcgacctgttagagagctaagacagcaggagagaatgaaggacatggaaaagaagaaaagagaagcagaaggccaaagctctgaggatgcttcaaacaataaagataaggaagaacaagaaattaccctgacaccttcaaacatggaagacatgagacgggctaagagtcaggaattaaaaaatgctggttcaattgaatacggcgatggatatatggcactagggtcatctgatccatttttatttccacttaaaatggtaacttgtacatgtttggcatcagaaggatccgtaatgaatgagttgaagcactggaatgatttgtatggtgaaggaggttcaaggaagaaactgttggtagttgattaa

SEQ ID NO: 2138 - DNA, 255 bp, Glycine max
  Peptide Sequence Number=SeqID_118916
atgaagaacacgaataaagaagaagcaacaaggaaggagcacgacccacaaaggaagaacaagaagcaagaacagaggaagaagaagcaggaacacgaagaggaagaagaagcagaaaaatggcacagaaaagtgactcgtacgaacgaattactgttattttataagcaaaaggtgggcattttagccctttcaccttcgttgcagggtgtcccagcaaaaacgttgaatgcccaaagcaacgaccctaattag

SEQ ID NO: 2139 - DNA, 366 bp, Glycine max
  Peptide Sequence Number=SeqID_118917
atgccgatcttcccctgcagaagtatcagttgggatcatgctcacaaaacaccaagtggacccggagaagtgcaacagggccctggagtttccagcactggttatgggcctctgtcagtcctaccgggtgctcgttcccccccagcaaggtcatgccatcgtgacatagggatcgcgcccacaagacacctagtggacccagaggagtccaatagggccctggggtttccagctctgattatgggcctttttcagttctatggagagctcgtcacccccaacaaggtcatcaagccccctattaaccgggctttcatcaagaagcattgcgcccccaggcaggcacagggcgaggcatcacagtag

SEQ ID NO: 2140 - DNA, 783 bp, Glycine max
  Peptide Sequence Number=SeqID_118918
atggacgcacagcgcgcaccgggcccgcgcccgaagctggtgatcctggtcgtcggcgagaccgcgcgatcacagaacttccagctcaacggctacccacgcgcgaccaatccccggctctcgcgcaaggaaggggtcatcagcttcaatgatgtctcctcatgcgggaccgccacggccatctcggtgccgtgcatgttctcgcagatgacccgaggccagtacgacgacgtgcgcgccgcaaccgaggagaacgtgctcgacatgctgcagcgcaccggcatccgcgtgctctggcgcaacaacaacaacggcggctgcaagggcgtgtgcgaacgcgtaccgaccgaggacatgcctgcgctgaaggtggccggccagtgcgtcaacgccgacggcacctgctacgacgacgtgctgctgcaccagttgggcgcacgcatcgatgccatcaacggcgacgccctgatcgtgctgcatcagctcggcagtcatgggccgacctactttgaacggtatcccgcagcgtcgcgggctttcagcccgacctgcgacagcaaccagatccagcattgcagcaacgaggcgctggtcaacacctacgacaacactctggtccacaccgaccacctgctgggcaaggccatcgacctgctgcagggctatgcggaccagcgtgatgtcgcactgatctatgtgtccgaccatggcgagtcgctgggcgaacgcgggatgtacctgcacggcacgccctacttcatcgccccgcgcgagcagacccag

SEQ ID NO: 2141 - DNA, 1171 bp, Glycine max
  Peptide Sequence Number=SeqID_118919
atgccggtgcccggctcccgttaccgcgacgcccactctgggatgagcggccctaatgccgccctgcgccgcgtgctgcaggcgtttgcgcatccgcagtgggcctgggatgtcggcctgctcggcaagccgcacgatctgggcaacgtctcggcctaccgcggtaaaccgaccagcctggaagactacatcggctggctgggtgccaacttcgatccgtcgatttcctggaaagatctggagtggatccgtgaattctgggacggcccgatgatcatcaaaggcattctcgatccggaagacgccaaagacgcggtgcgcttcggcgccgacggcatcatcgtctccaaccacggtggccgccagctggacggcgtgctgtcgaccgcgcgcgccatgccggcgatcgccgacgcggtgaaaggcgacattaccctgctggccgactccggcatccgcagcggcctggacgtggtgcgcatgatcgcgctgggcgccgacagcgtgctgctgggccgcgccttcgtctatgcgctggcggcggccggcgaagccggggtggctaacttgctggatctgatcgacaaggaaatgcgcgtcgccatgacgctcaccggcgcgaaaaccatcgcggaaatcaacgccggatcgctggccccggccggtgacaccaacacccggccggcggcgtccagcccgaggaaggaacatctcgtcctcaaacttgtagtaggtggcgtagtccatgtcgccgtggccgaattgttcgccgcgcagattttgccaggcgtagcgctcggtgttgacatagaaatgttcgtaatagtggttggggctgtagacattcagcgtgcgatagccgataagctcgcgggtcagatgcggcgcgacgccacccggcgtggcgccgacaatccggccgacgtggaagctttgcttgaggcgggatcccttttccaccgcctgttccggcaacagcgtgctgcgcaccagcagcgcccggccgctgtcacgattgagtaccagcgtcaggcactcgttgcccggcgactgcagcggaatattgaagaaatagcgcgcggcggaggtttgcacctcttcgtaagcgtcctcgccgctctccccgccccaggcccacagcacccgctgccgatcggcgctgaagcgcaac

SEQ ID NO: 2142 - DNA, 183 bp, Glycine max
  Peptide Sequence Number=SeqID_118920
aggtgtcggcgggaatatcaagaatatcataaagcgacgagcaagaggacttcagatatgaaggatttgacgcggcacgacaacgaagtcatggtgttgtcgaagaagttaatggcgggaagagacaccggaaaggacacgaaagaaattatgtttgctacttgctatactgggagtctgtga

SEQ ID NO: 2143 - DNA, 219 bp, Glycine max
  Peptide Sequence Number=SeqID_118921
atgggccccgacaggtgcagagaaacgcaagaaactggaaccagagaggtggcacgcaaaccgaaaaatttcagcagcttcttccctccttccacgttgctttttctcttcttcttctccaccattgaagctccaaattcctcttcctttctaccccaaattgcaaggaaaagccattttcggagtcttggagcatacctctacttcgtggggctttaa

SEQ ID NO: 2144 - DNA, 442 bp, Glycine max
  misc_feature (350)..(350): n is a, c, g, or t
  Peptide Sequence Number=SeqID_118922
atggcactcgccacggtcaggtccggatgggtgaccgatgaagtgaaggtcgtgccgacgaagggattgcccttcttctggaagttgctttcgcaggtcgcagcgaaggcgggtgcggcagcaccgcacagcagcgcggcgatcaggatcgggtgcttcatggttacagtccttgtgaaatggcagcacaggcccaggccaggtggccgggcagcgtcgaatctggcttgcggcggcccctttgccccgggccggagcccgattgtggggtgcttcggtggtcgctgcaatgtgccctgcgctccgcacagggcgcagtccatcggtgccatacggcagcggggcttcgnccttgatcagcggcgacaggtaggcgcgcgccttggcggtgataccgaagccgtcgcggcggatgaagccggcgggcattcttcttttcatg

SEQ ID NO: 2145 - DNA, 522 bp, Glycine max
  Peptide Sequence Number=SeqID_118923
atgaagcacccgatcctgatcgccgcgctgctgtgcggtgctgccgcacccgccttcgctgcgacctgcgaaagcaacttccagaagaagggcaatcccttcgtcggcacgaccttcacttcatcggtcacccatccggacctgaccgtggcgagtgccatcggccagatgcgggtgatcgccaagaacgccaacatggacgtcctcagcgaggacgtggaaggcggctcgatgctgatcgaagagccggaatccatggcccacaagccgatcccgatgatcatcagcgccacttccgaaggcggccagggcaccgtcggcatggtggtgaaggtcaacaagggcgccattgcctcggccgatggcgtgcgtgaagaaatgtgcaagctgctcaaccagatcaagccgggcaaggctggcgaacaggcggccaaggccactccgcaggcgtcggtggtaacgattgccgccgaccgcttcggcttccagctgcgcaaccagaacaaggacaacccggccgcg

SEQ ID NO: 2146 - DNA, 339 bp, Glycine max
  Peptide Sequence Number=SeqID_118924
atgaaccttagggtagaggacgccggaaaaaatggcggaagcttggtgacggtgagccttccggaagacccgttaggggttcttccggaacttccagaagaagatcttccggaagatttccggaagaagggttcttccggaagtaatgaaacgattttcggaataacaggtcttccggaaagctctcggaacacctcttccggaatgtttccggaatatgtactcctcgaaatattccggaagagggttcttccggattaccttttagtggttccggaagcactttccggaagatcccttcttccggaacattccggaagaattgtgtatgtttactaa

SEQ ID NO: 2147 - DNA, 414 bp, Glycine max
  Peptide Sequence Number=SeqID_118925
atggaagagagaagcctcgcggagaagaagaaggcagagaagcctcacggagaagaagaccaccaaggaagcttgctgtcacggaagagagaagaggaaggaagctttttcgcggaaaaaatcccaattgtgctctggggtttggaaaacgcagggaggcaaaacaatgaacaaggccaactacttcacctcaccatgtgcgtaacccacctgttgctgccaccgctccggcgccacaaccacttttcagcctctccaaacacgccgcatgcgataaggtctcaaccgtcccaacaacctcgccgtcaccgcttcagcccccgccaccgtcaaacactccgaacgcacccacgctttcattgcaaagtctacgacgctcgcggagcagctcaagaaggagagcgagtggcttaa

SEQ ID NO: 2148 - DNA, 474 bp, Glycine max
  Peptide Sequence Number=SeqID_118926
atgataaaaggaggagatgaatatgcacaaaacaacaaagagggacccctaagggtgcatagatcatattcaaaacttaaaaataaaactaaccgaaaatctcatgaagaacaccgaacaaggaacaatgtagggtttgatcacagtcgcgatttggcagcgcctcggcttcgtttcctcttctttcttcttcttctctcttatttctctcaatttccttcactactcaatgctggaaccccttctcaaccccccactcgcccaggcgagctaaggcttagtctagaagtcatgagctcgcctaggcgagctggagctcgcccaggcaagccagatgctggcctgggtgagctggggcctagaaaatgcaaggaaaatacccctttaccctccttccttggtatgttttgttttttggatcgaaacaccgagtggttcatcgctttgcattgtaactggcgtctaacattgtaa

SEQ ID NO: 2149 - DNA, 4269 bp, Glycine max
  Peptide Sequence Number=SeqID_118927
ccatttgcatctatcatttttggtgctcttgttgatccttccatggccgatccttctctcaccctcgaagatgctatccgcaaattgacagcccaccagctttcccttggggagactcttcaagctatgacccttaagcttgacgacctcctccatcgccttccctccgtccttcctgaccctcacacctcctccccatccccatcctctggccctacccctgttcaagccacaacccacaaaatcaaattaaatgtacctcgcttcgatggtactgatcctttggggcggatcttcaagatcacccaattttttgaataccacgggactctagagaacaagaggcttaccatcatgccgttttacatggacggtcgtgccctagcctggtttcagtggatggtcggcaatggccagttcacctcttggccagctttccttcaagccctccagacacgtttcgcactgtctcagtacgaagatcccactgggactttattcaagctgactcaacgcggcacggtggcggagtatctcaccacctttgaagacctagcaaatcgaacaatcggtctccctacaccatttttgttgagttgtttcatttcgggtcgcaactctgatatccgttgtgaggaagagaaaattcttgatgctcgcccaataccactccttcggcctccaccacctctgccatccccttcccttgtccaaccccttcccctcagaaccataaccccaccattttcccttctccttccctcacccactcatcccccgcctcctgccgtgaggcgcctgacccaagaggaaatcgcctctcgtagaaagcgtgggctctgctttaattatgatgaacgatatcatcgaggccatagatgcacctccagggctttcctctttatctttgaagaaggggaccctaattcccctcttataaatcaacctgacccacaactcgagccccaaacactaaaccaactcgactcacttgacccatacccgacccaaataagcttcaactcattggcggggaatgtcgcaccagaaactctccggttcatgggcaccatcaacgaccaccctgtcgtgctgctgcatcactccattgcgggtcatggtgggcaatgggcagtaattggagtgcaattgcttgtgcgaaggcctcgtgatcaccattcaagccactcagttcgtcgtggacctacacgtcccgtactcattgattacaactccttgtgcatgaagttcttccatgcaggccaatttgtcgagctcaaagactccttcatccccaacccaatggtttgtacttccaaggatgaagcttcttcagaggtagctaccaccagcgtccccgcccttcaagctctcatcgacaaattttactctctgtttcaggcccctgaccaccttctggctgtaagagctattgatcatcgcattcacctcattcctcaagcttcgtcaatggacgtgcggccctaccggtatcctcatttccaaaagcaggagattgaagcccaggttgagatcatgcttcaaaagggtctcatacaacccagcacaagccctttctcatctctggttttgttggtgaggaagcaagatggctcgtggaggttctgtgtggattatcgtgccttaaatgctttaacaattaaggaccgtttttcgatacccaccattgatgaacttctggatgagctaggtggtgctcgttgcttctccaaattggaccttcttcaaggataccaccagatttgcatgcacgtcagtgacatccctaagactgcatttcggacacatcacgaccattacgagtttcgagttatgtcgtttggcctgtgcaacaccccctcctccttccaagccaccatgaattccctttttcggccttacctttgtcgcttcatcatcgtcttctttgacgatatcctcatctacagtgcctcaattgaagaacacctcactcatttggaggttgtgtttcaggtattgcttgaccaccaattcgtgcttaaactatctaagtgtttctttgcacagtctcaggttgaataccttgtgcctcagaccatcagggcggtgcgaagtttcttgggccttgctgggttctacaggaggttcattaaagggtacgcctccattgcagctccattggtgaagattaccactatgcccaaattccagtggtcaatggcgccccaggcagcttttgaccaccttgccttttacgatagagacggacgcttctgggaactatttgccatcaccacaacagtcaagcggaggcgccagtatctgcttgggcatcgttttctgatcatcactgatcaccggagccttaaagaattgctcacacaggcaattcaaacaccggagcaacacacttacttggcaagtagcttcttcctcactgatgacactctcagtgccctgtctcgcctttatttcgcagcttcggattgtccatcagcccatcctcatttcaccattactaacgatttggtccttcacaagaaacgcatttggctgtcgcgaggatttgccatgatccccactctgctcacggagtatcattgcacaccgacagggggacacatgggtatagctaaaactctggctcgtatcacagagaatttctattggtcaggtattcgtgaggacgtcgctcaccatgaagacctttccctggacttcatcgcatgtctccctccttaccatggcaatacagtgatcttggtcgtggttgaccgcttttccaaaaggattcatttgggcatgttacccacatcgcacactgctcatacggtggcttctttattcatggagattgttagaaaaatacatggattaccatgcagcctagtctccgacagagaccctttattcgtgagtaaattctggcaagaattgttccgatacagtgggactcagctacggatgagctccgcctaccattctcaaagtgatggacagatggaggttatgaacagggtaatagaacaatacctcagggcttttgtgcatggtaaacctaagacatggggcaagcttctcttgtgggtggaatggtcccacaacatttcgttgaacgctgccacagggtctacgccttacgaaatcatcttcaggcgtcaaccatttaactttcccgattatttgatgaggtcatctaagttggatgcggtggaggatatgctcacaaatcgagacgagacttttagagtcatcaggaagaagttgctcaaagctcaggccaccatgaagaaagttgcagataccaaacgccgtgatgaagagtatcaacctagagattgggttcttgttaagctcaggcctcgccaacaattttcagctaaggaatctttagaaatacgtggcaaattgacgaagcgtttctttggacccttcaaagtggttgaacgaattggacccgtggcatatcacctgcaattgccagagaaagctcgcatacaccctgttttccattgctcccttcggaagaggttccagggtaatccagattcccctaacctcagtgaagttgtccaattaccaagccaatttatccagaaccaacctctcatatcccctctggctatactgagttatcgcaaggcatcatcgacaggttcttgggaagtgcttgtgcagtgggaaggtctctctccagatgagacatcatgggaagattggaacattctacaacaggagtatcaccttgaggacaaggtgattttgcaagggcttccggatgatagcttaaccgatacaggggagatcatgacaagcaaagaccaagatacagtagcaacaacaacaagggtgccattagcagctacacaccaagcaaatataggggtgcaaacaccatttgcatctattagggaagttgtggatgaggaaggaggcatggagtttttcgagagagttgaggagtccataggaggttggatctggagatggttgatggatgcgaaacaagattgccaagttctcgatgcaaatccagaagggccccgtgcgcgacatctccctcaagctctaagaggaggagtgcaagcgtggcatggatttcgtccccgacctctctaccatcaacaccgaccacatcgagaagcagtagtaaaggggaacatcaaagagcgatcaggaggtggtggtggtggtggtggtggagggtggcacagagacgatggatgcaacaagggttgggaactaggaagacattgtgccattgagcttttgggactggttttagtg

SEQ ID NO: 2150 - DNA, 264 bp, Glycine max
  Peptide Sequence Number=SeqID_118928
atggaaactcaacatgatatgtctccttcaaaggaatttgcaagtagtaatcctgtggatagttctggtgttaaagatcaatctacatctgaagctgaaacccctcttcctattattaatgtaggtgagggtaatgaatctaatgataatgaagtaattgaggatggcaaaaaagggagatatatgttgtttggaaccacttcaagagaagaaatatcaatggtgaggataaggcgggttgcaattattgcaacaagcatttaa

SEQ ID NO: 2151 - DNA, 306 bp, Glycine max
  Peptide Sequence Number=SeqID_118929
atggaaaaagggaaagaaaaaggaagaacaaaacaatgggatgaagagcaacaaccaataggcattcaaaccaccacaagtggcaccaccctgagatcggctagatccttgttgatggacatcgagaggagggtggggcgaagaggaaggatggtcatggagaggatggtggttgcagaggggaaaggttgttgtggaggtcgagaggagggtggggcagaggaagatggggaagccgtgaagaagaagagaatgaaggggaagctgaggatggagaagggaggggaagccaagggtgagtgttag

SEQ ID NO: 2152 - DNA, 420 bp, Glycine max
  Peptide Sequence Number=SeqID_118930
atgtctaaagaaactgacgtggaaagccctagtaataacctcactgttcaaaaagtgtatggtgtggctgctaggtattgtttacctggatcttttctttccataatcaacaaatgggctgtcatgaaattcccataccctggtgccctaaccgccttgcagtactacaccagtgctgttgggtttcaagccaaagaagagaaggttcaagtagctgatgactcactcagcgaggcaaatccgcttagtgagtggcatctgcttagcgggttgggaaaccctagaagaggatcagttagagatgtgctcgcccagtgcacagccagcccacccagcaagagagcacaagagaaagctgagaagacagaaggaaaacaactgagagagcttaggttagaaggagtgaagtctaggatttag

SEQ ID NO: 2153 - DNA, 809 bp, Glycine max
  Peptide Sequence Number=SeqID_118931
atggtggaagaagtagaaacgtacctcgaagaagaagctttccacttgatcccagcaacaatggcggcaacgaagatgaagaagaagcagaaacgcgaagaagaagccttcacttgggaagaagatgcagaatcgcggcgcgaagaagaagaagaacgaagaagatgcataatctcgaagaagaagcagaagaatgaagaagcagaagcagaaccgtccgaggaaggaagaagaagaagcagaagcagaaccgtccgaggaaggaagaagaagaagcaggcgcgggaaagagagaggcgagacactcggtctccaattggtcgatgtatgcaacctggccacaaggataccctcctccgcgccactagaggccaccgagtaggcccttctccagatccccgacgtgatcctcaacctcatcgacaaggactacagcgtcgagctcgcgtgtggcgacttctccgtgattcgcctccggacgccaccaccatgaaagtcgaagattcgcgctacttcttctccttccgcgtccccaagggttccgatcctgacgaggaggaagaagatatgctcagcttcggcttaacgattgcgtcgaaggggcaggagggattactgaaggaactagacgcgattttggagaactgcagttgtttctccatgcagagtgtctcggagaatgtcaagaagaaaggggaggcgctggatggttccgtggtgagggaggtttcgccaaaggatttggagtcgaggaagaagaaggagatgatggaggggcgatgcatggcgtattggacgacggtgagcag

SEQ ID NO: 2154 - DNA, 264 bp, Glycine max
  Peptide Sequence Number=SeqID_118932
atggccatcactggtcattttattgatgataattgggagttgcaaagttgtgtcttaaggtttgtgtatgtagcatgtccacacacgactaaaattctttctcaagatgggttgaatgttcttggagaggttatagagaaggttaggaatgatgttgcattttggacaacttcacctaaaagagaagaaacctttagggaaacagcacgtcaaatcaaagtttttgtcacaaagaaacttattcttgattgcaaaactagatga

SEQ ID NO: 2155 - DNA, 126 bp, Glycine max
  Peptide Sequence Number=SeqID_118933
atgtatgcaaaaagttggttgaaacataaacaacaagtttatatagactttggagataaacgcttgcaaaaatatgcagaagttgattctaatgatgaggttttggagaatactatcaccacatga

SEQ ID NO: 2156 - DNA, 789 bp, Glycine max
  Peptide Sequence Number=SeqID_118934
atggcaatcttacatggctggcagcaagaagcagaggctgctacaatgtcaatagctagacgagcagcttcagatgcttcttcaacacaggaagcaattaagatactgcgtggcaattggcttcttgcgattgaacaacaccatatacagtattcagaatcatctgtgatcaatgacattctagatattggatgctctattggtataagcacaagatatcttgcggacaagttcctcacagccaaagggctagatctatcaccctattttctagctgtggctaagcataaggaaaagagagcacagccaagaaaatttcccatcagatggatacatgcaaatggggaagacacaggcctgccttctaaatcattcaatcttgtttctattgcatttgtgatgaagtcaaaggtcgttcaggaattatctcctgtcctgtttacattgtataagtgcacagaaccctttatcgatgagttttacttgactgacatggatgaaacactgagggaagctggtttggtgaacataacatcaattagtgcctcaatgaaacaagtatataccaagatctggtgcaacattaattcctttgaacatcagcatgattgtccattgacaaagatgtacttttgtccttttcttgaagcaccgatcaattgctatcgtgtcttacttataggggttttgctaacctcttgtgctttgtttgcttgtgcctttttaatagtaaacgttgaaggaaaaggtagcatagataacaagacaatacttgtgtctcgaatatga

SEQ ID NO: 2157 - DNA, 249 bp, Glycine max
  Peptide Sequence Number=SeqID_118935
atggaggagttcatggcacaggagcctcagccagagccagaggttgcacatgaggccactccagaggctactccacggacctcaccaatcacttcacctgttgtagaggtctctgagggtgaagaagacgccgaagacacagactatgcagcagatttacaggaggcacagagtacctgggaaccctggcctacagcagcacaggagacacctcaatcagcccaggatacttcttcacctcatggctag

SEQ ID NO: 2158 - DNA, 306 bp, Glycine max
  Peptide Sequence Number=SeqID_118936
atggctctgtcgttgccacttcagaacctctctgcagtgatctccccaagcggcaatgccaccacccccacggcccggccaccgagagggcggcactgggcggttcacgtggcggcattggtgcaaatgggtgggtatgaagaagggaagctggagcgacccaagtgggttggggagacccctctttcacgtatcgttcaagctctcatctctttcaagcccgtgttctctgtcctcaagcatgggcccacaaaatggacttggtctgatggattggctggcctagttaggaccagactgggctag

SEQ ID NO: 2159 - DNA, 2037 bp, Glycine max
  Peptide Sequence Number=SeqID_118937
atgggaaagattggttgggtctccttgaatagtgtgcccaacaagctgttcaagtttaacttgaacgtctttctccgtttcaaggactattttttcaaggtcttggactcgggtgtcgtggttaatggtttgccactaatgctcaacaaggatggggagtctcgcttcctgttctactggcaggctgatcccaccaagtttaagtctttcaatgaagacttgttgatccttgtggagagggtcaaacctacaggtgggactgtgtcattgtctgctgctgctcccgctgaagggggtcaatctactattgaggttggccctgttgttgttggtactgctgagattgctcccaatgccctttcctctgtattggttaagaggaagcaggatgatagtgttggaccttcgagccgtaagaagtcgagggcccctttgagccttcgtgccctgaggcaagttataaggttgacacccgatgtgggttgccattcaagtgtgcaagatgtgccttcggcttcaccgatcgtcgaggcttctattgttgttgatgttgttattgttactcctgttcctccacctctttctgttgtgcttgttcgagaggccactctgattgttgctgaagagagcgcgccagtttctttggctagttttgttgtggcgtccttgtccactgttgctgcacctttactgagtgtcagtgtggtaactaccaatgcccttgtggttccttcttcttcctcttcaactcatatggtccctccgcccactacattagcttcaacttacacctcttctcacccccgtgtttccctaaatcacatctacacttctaatgatgatgattccttgtggggcatggggttacccgagttccaacatcttatggattctacgaaggtcttccttaagcggagtcaggtaatccttgaagaaaataggcagcgacaccaagaggtgatgaacaaagtggcgtccatggaggctgaaactgctaaatggagggcgtctgcttgcactgtcaggagattggagcgccttaaggtagctagtgtcgttgttgctcttaccgaggctgtgaggtcgaaccaccaactatcttctaaagttggtagtgtgttggccaagttgttgcgcaccaggttggacggtgatgaactattcaaatgctacaaggacttgaaggaaaagaaaatgaacttggcgggcagggtggaggatgttgtaatgaagaaatatgagcttgccaagaaggtggcagatctcgaggcccggctgaaggagtcagagtccatgctggaggagtccgagctacgggcagctagggagagggaggccagtaaggagcttaaggaggagctgctcattttcaagaaggaggtcgtggagcagcatgaaaagggcttcaacaaggccgttaagcaggtcgggttcttcaccaaggaacttgacttgggtctttttgacccattcaaggacgttgttgtgatgataagtgtggaatctttgacgatgcagaaagcgagaccttgtcgatgtagaggtcttgctaaccagtctggggtaggtcgcttgacctacggagtttctcctctgatggttatgaggagtaagtatgacttccacctgattgaaggagtgcgtaccaagggtggaccttgggttttgcaagagtgtgtaccaagggcagaccttgggctcaccaaaggacgggccttggattttgtgaacctgcaaggatcgccaaatgtggagcttgggtttgacaagtcttatgtgcagcgcatgtgttgtgcttttgcatacatgtcactcgtggactcaccaagggcggaccttgggtattgcaaaccctttggaggatcgaccaaggaattgttcgaccagggttttgggcatcgtgcttttgcatacatgtcactcaccatgggtagcacgtactggagatgtaatggtgtgctcttgcatatgtgtcactcgtggagtggcacatacaggaaacttagtgatgtgctcttgaatacatgtcactcataa

SEQ ID NO: 2160 - DNA, 435 bp, Glycine max
  Peptide Sequence Number=SeqID_118938
atggcgacaacccctttccccgttgcaccaacacctcagcaccaccactgcaacccctttaaccccattgcggcaacaaaaatcacatcaaaatgcaagggagtcatattacactccctttattacagaatgaccattgcaaaaggtggcaaacttgttctttgtaacttttccctttaccctaacctgcctcaaccttgtgtcacaccacatcgatgcaacctcacaaagcttgttcagattgcaatgtttgctttctcaacctcattgaatgatcaccgacaacaacatcgctccctcaacctcacttcacgagcatgttcaatagtggtagagtttttcgatgatgcaaaaaaatatcaaagggaggggatcaatgtagctggaggtggtagatgtcattgtgatgaggggggcttgaaggtgaagggttaa

SEQ ID NO: 2161 - DNA, 348 bp, Glycine max
  Peptide Sequence Number=SeqID_118939
atggcttatactttacaacatcgtcccttacccacttatagtcaacaacgacaggtggggacgatgacaacccagtgttatctatggctacatcgcatacagggagacaccctgacatctccactgtcactacctctcctcactccccagaagcagaaggggggaggatcacaattactggataggctcaagcagcggaagttcgcgttctcccgtgaaggcgagaagtgcctctaccagtacggtgcgaagacctcaccttcttcaagaggaggattcgttgtcagaggcgccatggcgagtatcctccaaggagaaaccgccaatggaaatgacctctcatgctga

SEQ ID NO: 2162 - DNA, 1164 bp, Glycine max
  Peptide Sequence Number=SeqID_118940
atggatgtgaaaggtataaaatgggttggaaatatgtaccagaaatttgagaatatgttcctggaggtggaagacgtgatgtacgaggcatatccgcatatggaaagtgctggaaggggtcagtacctctcgctgttgaagcacttcccttttgtgaggggtgatgcgtgcatttccaattctgttaaatacatagagaatcagatgcaagctgttggggaaagtgttaaaaagttatattcagaaattgtgggagatttacttcccccagaaaaggtaggcattgaattgcctatagataagcgtgcggatgctgggctctgtaggaagccattccatgtatataaggaaagacatgcaaaagctgataccaagcaaagaactgaggattcaaggattgttcatggtgttgataatgttgcaacacttgctgctttatatgatggaacttccaaggctgatgcttcatccatgttatctttgagaaattctgtcaaagaaggaaaatttagttcaccttcaagacagtatgttcgaagaatggatgttaaatcaaacgttcgtattgatgaaaatccagtaaataagaaaatggatgcgaccaagataatcaacaaaaccaatttggcagaaacagatgcatgcaggacatcacaatcttatgagatctcaaacaaaaatcaaaatcagaatcatggagttactattgcaaagccagcttcagaagaagtggcaaggcttgcctctgacacacactgttctaatgaaattgaaaattcttgtaccaaacagttccccaatgttccactactacttaaatcagctgaagagaaaccggttgatacaatttcttcttcctcttgtgccccatttggagagccagttgaacaaggccatgaaaccatgcaagaagatcatctgaagcttgaggaagcctgtgttatggtgaatggagatgaaattcaattacctcccaaagaaggtggtaatttaaatactaaaaagtctgcaagaaagcaagagtataaggagcttgtagcatggcatatgaacagtgaaaaagtaaagggagattgcatgaagaatttagatccaactttaccacaagaacaaaacaaattactgcttcctagtatgtctgaaccagaatgggagcttctctaa

SEQ ID NO: 2163 - DNA, 681 bp, Glycine max
  Peptide Sequence Number=SeqID_118941
atggaatcgaagtacattgaggattacatgtcattggataaaacgatgaaagagattgagaagaagagagacttgcttcaccagactcgtgctgaagatgatcatgtaaattgtgctccagtgttgaagtcgatgatggagaaaaaagctgccagtgatgcactgttgaagcttgaaaaagagatgggaaatgaacaaaagttgaatttagaaattgctgaactagaggaacaactcaaggttttgaagtgtgtgaactcggagaaagctgatcgtgagaataaaagaaagatagaaatagaagagatagaagaaaaattggaggacatgatttttgatatgtccgtaaaagatgatgaaaatcaagctttgaagaagaaggtacaagaagctaaaaccgagttagaagattctaggcaacaaattattaagctaattgaatgcatttgcttgacaattcatgaattaccatggttcttgaaaggggttactaagattcaaataaaaaaatttggggaggtcagtgctaggtcatttaaaaaagtgtgcatgaataggtataaaaataacaaaaaagcatcatcggagtctgtgaaactgtgcgcaaagtggcataaagaaattctggattcaacatggcacccttttaagattgttgaagtcgaagggaaggaaatatag

SEQ ID NO: 2164 - DNA, 276 bp, Glycine max
  Peptide Sequence Number=SeqID_118942
atgagcaagactgacgacaatggtttcagcgtcacaagagtgagagtgagagtgagagtgacaaagggtttgaggttgccagaagcattatcgttggggtctccttcgtgtcctcctccatcaactcccaaacttcctctaggacctcctcctacaactcgtatgcctaaagcattgcctcatacgacgtcgcctcctttacatcagtctcgcacaatggaggacatccagtccctcaaaggaagagatcagcggaacggatcaaacggacagtaa

SEQ ID NO: 2165 - DNA, 138 bp, Glycine max
  Peptide Sequence Number=SeqID_118943
atgagatatttaaaacttgtaaaacagatatcaagggcacaccggaatccggcttacaaaccccaggttttcgaaagcaaagaaaccgaagcggcggcagagccgcacaggatcggtgaagggagaaaggagatgtga

SEQ ID NO: 2166 - DNA, 693 bp, Glycine max
  Peptide Sequence Number=SeqID_118944
atggaatcgctaattttagcaacagagaagcagatgaaggccagaagtgatgttctcagtttgcttgaaaagcatcagatggagaaaaaagttgtcagtgatgcactgttgaagcttgaaaaagagatgggaaatgaacaaaagttgaatttgcaaattgctgaactagaggaacaactcaaggttttgaaatgtgtgaactcggaggaagctgatcatgagaataaaagaaagatagaaatagaagagatagaagaaaaattggaggacatgatttttgatatgtccgtaaaagatgatgaaaatcaagctttgaagaagaaggtacaagaagctaaaaccgagctagaagatgctaggcaacaaattattaagccatcaggaacggagagagacagaaaagaaaggccaaaggaagtgaaattctatttctctcattttcaaggaaatcaaagtgcaccagagagaagttcctatggagaaagcaaaatttatagtgttggaaatggagtcggaatcgcctgcatgaaggaagaaacaaaaagaataaaaggaaaagagaagaagattcaaatgataaagatggagaaagagaagattgagggagaaaacacaacaacggagaaaactcgggagagagaagaaagagtaatggataagatacgcacaattatgagtattaagcggaattaa

SEQ ID NO: 2167 - DNA, 212 bp, Glycine max
  Peptide Sequence Number=SeqID_118945
agacacgccttgtaaagtggtggtcacaattcgatacctcaaaggctgctccagaacaagtcaagaactggtttcagagcaaccctaagtttctcaaacctgctgatccagagacatctttgtttctgaatcagaagtctcaacttgcagcattcatggcaagctcaaaatctaaagaaagtcttgctcaaaatcttaaggagctccggtaa

SEQ ID NO: 2168 - DNA, 126 bp, Glycine max
  Peptide Sequence Number=SeqID_118946
atgggatgttacaacattggctgggctaaagttgaatttgaagacaacaaagttgcaatgtacccaggaaatgtcttggccttgcacatgtctaaaccacaaggatttaagtactctagtggatag

SEQ ID NO: 2169 - DNA, 444 bp, Glycine max
  Peptide Sequence Number=SeqID_118947
atgctggtggtgattacaacactgttaagccatgaccacttactactaatctcaggttcaacaattagcacaaccacaatcacagacaaaagaaaaccaatttttttcctacagtgtagaacgaggaagatacacacaatccataaagcttcgagagaaaaacctaccgtgagagcaagaatgagagtgacacctagaccaacagtgagagtgagaccgaaagtgatagtgctgatactggtttcagtgccgcgagaattatcgttggggtctccttcgtgtcctcctccatcaactcccaaacttcctctaggacctcctcctgcaactcgtatgcctaaagcattgcctcatacgacgtcgcctcctttacatcagtctcgagcaatggaggacatccagtccctcaaaggaaggtctgagttgccctcaatacaatcctaa

SEQ ID NO: 2170 - DNA, 999 bp, Glycine max
  Peptide Sequence Number=SeqID_118948
atggaatcactaattttagcaacagagaagcagatgaaggccagaagtgatgttctcagtttgcttgaaaagcatcagatggagaaaaaagctgtcagtgatgcactgttgaagcttgaaaaagagatgggaaatgaacaaaagttgaatttagaaattgctgaactagaggaacaactcaaggttttgaagtgtgtgaactcggaggaagctgatcatgagaataaaagaaagatagaaatagaagagatagaagaaaaattggaggacatgatttttgatatgtccgtaaaagatgatgaaaatcaagctttgaagaagaaggaacaagaagctaaaagcgagttagaagatgctaggcaacaaattattaagctattggctgttggtactgttttatcacaattaatgctttccgtgcaaaagctaattgaatgcatttgcttgacaattcaggaattaccacggttcttgaaaggggttactaagattcaaaataaaaaaatttggggagaaattctggattcaacatggcacccttttaagattgttgaagtcgaagggaaggaaatacaggaagtaattgatgaaaatgatcctaaattattatctttaaaaaatgatttgggagaggaggcatacgttgttgtggtgacagctctaaaggaattgcatgagtatcataattctgatgatgctgagaacacccataattcaagtgagaaacaagtgatacctgagatatgggactcccaaaatggacgtagagccaccgtaactgaagctttgaacaaaatttatagtgttggaaatagagtcagaatcgcctgcatgaaggaagaaacaaaaagaataaaaggaaaagagaagaagattcagatgagaaagatggagaaagagaagattgagggagaaaacgcaacaacagagaaaactcaggagagagaagaaagattaatggataagatacgcacaattatgaatattaagcggaattaa

SEQ ID NO: 2171 - DNA, 168 bp, Glycine max
  Peptide Sequence Number=SeqID_118949
atggctatccaaaatgtccaagtggacctagtactcatcatgccaagaccacaccttattccgttgcaaaataactggatcatggactattgtgcaaaaatctacactgtaacaatccctatcatgacaaaggatcaagctgaatgttttgatgatgccaatggatga

SEQ ID NO: 2172 - DNA, 1165 bp, Glycine max
  Peptide Sequence Number=SeqID_118950
atgttgcaggctcttgtttctgctcaacaccatattatgtgcattaagactgagagggaagcactcctccaattcaaggctgccctcctggatccctatggcatgctctcttcttggaccacagctgattgctgccgatgggaagggattcgctgcagcaacctcaccggccatgtcctaatgctccaccttcccggtcagtttcattattcatatgccttcaatagtatcactgttgcctcgctacgttatatgaggggagagatccacaagtcgttgatggagttgcaacaattaaagtatttaaacctcagttggaatgattttcgaggcagaggaatcccagagtttcttggttctctcagcaacttgagataccttgatctgtcatgttctcaatttggcggaaaaattccaactcagtttggctctctttctcatttgaaatacttagatcttgctgggaatttttatctggagggttcaatcccacgtcaacttggaaatctctcccagttgcagtatcttgatctcgggggcaaccaatttgaaggaaaaataccctctcaaattggaagtctctcccagttgcagcatcttgatctaggtgacaattctttagaaggaaatataccctctcaaattggaaatctctcccagttgcagcttcttaatctcaggttcaattctttagaaggaagtataccgtcccaacttgggaacctttcaaatttgcagaagctttatcttggcagatattctgatgatgttggtgctcccaaaattgacgatggagatcattggctgtctaatctcatttctttaacccatctttccttgtacaacatatctaatctcaacacttctcatagcttcctccaaatgattgccaagctaccaaaacttagagaactgagattatttgattgtagcctttccgatcattttatcctttcactaaggccctcgaaattcaatttttctagttccctttccatccttgatctttccgtgaacagcttcacgtcatcaatgatactccagaggctgtccaacgtcacttccaaccttgttgagcttgaccttagtgataacctcttggagggttccacatcaaaccattttggccatgtaatgaattctcttgagcacctcgacctctcaa

SEQ ID NO: 2173 - DNA, 162 bp, Glycine max
  Peptide Sequence Number=SeqID_118951
atggttggagcattcttgcaaaacactgtgaccctgactggtctccctatgatattacctagtgagagtgacttgacttattattgtgtgatgaataggtggatgactatgaagaacctcatgctagaggacacgggaacaccacgctctgataggatgtga

SEQ ID NO: 2174 - DNA, 342 bp, Glycine max
  Peptide Sequence Number=SeqID_118952
atgcaagcaaaggcaattgcaaatgaagctagtgttcaagtttcattaatgtctcaatgtcaaccatcattcacatcaaaatggtttggagaggatgaaaagaacattcgagttctgttcacacagcctgctaaggttgatagtatgattggacagaggactagaataggagagcatgaggccatgaggaagagaatgaaagacatggaaaagaagcaaagagaagcagaaggcgaaagctccgaagatgcttcaaacaatagagacaaggaagaacaagaaattaaagcgaggcctttaaacatggaagacatgagacaggctaagagtcaggtagggtga

SEQ ID NO: 2175 - DNA, 628 bp, Glycine max
  Peptide Sequence Number=SeqID_118953
atggcggcggtgttgcggcggcttcgagacctgcagtcctcggcagggaataagatctgcgtggactggtcccaaaagaaccctcagtgggcctccgtctcctacggcgtcttcatcgtcggcgaggtacaggtcgacgaaggatatctacacacaatcgcagctggaggcgtcagccgcgaacaaggagggattcttcacgcggaagatggcggagaacgagtcgcggccggaggggctgccgccctcacagggagggaagggattgggaaattgtctttggtcgctgcctctgcggctaatgttgttcaggctggcacgaaggagttcacttccaaggaagctactgttgatttgccttatgttgcctttgcagtaaggccaaatcttggagtttgggaatttcactatgctagatatgtcgcagtcaacgaaactaatggccgagcactcttttattggttctatgaggccatgaccaagcctcaagacaatccattagtgttgtggcttaatggaggtcttgggtgttcttctgtgggatatggagcaacacaagacattggcccatttttagtggacaccgatggcaggggccttaaattcaataacttttcatggaacaaag

SEQ ID NO: 2176 - DNA, 342 bp, Glycine max
  Peptide Sequence Number=SeqID_118954
atgtccctttattatagatcccataaacacatgatcatagtttgttacaaccaaactggcataatctgtaaaacatggcatgttatctgcagggaagtaattgatgaaaatgatcctaaattattatctttaaaaaatgatttgggagaggaggcatacgttgctgtggtgacagctctaaaggaattgcatgagtatcataattctgatgatgctaagaacacccataattcaagtgagaaacaagtgatacctaagatatgggacccccaaaatggacgtagagccaccgtaactgaagctttgaagtacataagcaatagggttatcaagatgcggtga

SEQ ID NO: 2177 - DNA, 243 bp, Glycine max
  Peptide Sequence Number=SeqID_118955
atggaatcactaattttagcatcaaaggagcaggtgaaggctagattcgacttcgtcaatttgcttgaaaaacatcagagaaagactcaaactgatgaactattgaagtttgaaaaagagatggaaaatgaacataagttgaagttagaaattgttgagctagaagagcaactcaaggttttaaagagtatgaatgtgatgggagctgatcatgaggagactataaagaaagaaatagaatag

SEQ ID NO: 2178 - DNA, 285 bp, Glycine max
  Peptide Sequence Number=SeqID_118956
atggctacacttgttactggtggtggtggtgaccccaatccaccgcacagcagtgttgcgccacctgtgcatcctgctctagagaaaactaatctaaatcacaccattattgaaatgcttgattcgacaaattatttgttttacatgtcgcaggtggaacttgtaattcgtggttacaatttgcttcattttattcatgaggttcagattttgcaaaggtttgccaccattggagatgcaaatgttggcagagtcactgaagtgttcaaacttcgagatcaatag

SEQ ID NO: 2179 - DNA, 291 bp, Glycine max
  Peptide Sequence Number=SeqID_118957
atgattgcttctgttgcagagctgttgtacgaattgaagcctgactgtgaagctgagagtggccctctcaataacatcgataacacccaggaattttctccgctgaaatgtaaggaagcgtatccaagtggaacaaagacacaacaggttgaaacaagcattcgtgtaggccagacattaatgatgcatgccagtcatgctggaggattaaatgtcagtatctgcaaaaatggtaaggcaagcacaactgatgctgatctagagcatttttgggaatggcatcagtggtga

SEQ ID NO: 2180 - DNA, 240 bp, Glycine max
  Peptide Sequence Number=SeqID_118958
atggctgcaacaatcaatggcttggagcacggtgggaaagtgggtatggtgtttgaaatgtacaaaaattgcggcaaattcttcaaactattggaggagacaattaaagctaaggtggaagagaaacactttgagaggagacaaaatggggaactctttgaaatgaagatagctttgatgttggggacaagtgtgtcaaagctcagcctcatgtcggaccgagggaattgtcgtcgatga

SEQ ID NO: 2181 - DNA, 597 bp, Glycine max
  Peptide Sequence Number=SeqID_118959
atggactcaaaaatctaccctaaggttaatgagaaccctagggccttctttagtagctctagccctatcctctttgagtcttctatccaatacccttggggggcaggattgcgtcagtatctgttgaaaaccatttactcatgctattcaaataatatggattttatacaagaaaagccatacgatggagacataccaagctcaattgaggaactactcttgctgccaggaataggccctaagattactcatccgggacaatgtccaagggatatgtgtagatactcatgtgcaccgcatttgcaatcgtcttggatgggtttcatcgtggcatttatacttacgataggtaatacttcaagagcaatatgggctaacgtaataaaagagaaggccatagaaaaccctaaaatgcccatggctgagagcttgacatgtggcacttttgttgggtttttgttgagtttgccaactgctatggatttccattttcatgcacagtttgtatcaattgatttgccgggcttttctccaggccgttcccgtttgttttgtagtttagtttggtacaatattctctttggttgtagcgaatga

SEQ ID NO: 2182 - DNA, 408 bp, Glycine max
  Peptide Sequence Number=SeqID_118960
atggaaaattttgaatatggattgaaaatgtcattcataactttcttgaattctgaagaggcattctttagaccaaatggcacaacattccattcatatttcccaaagggaactgtgaaggtagtcttgtacctatcaggttcctttatctggatctgccaatatcctaacttcatgtcaaattttgagaatattttagaagagtttagcctattgagtaaatccttcttgtttggaataggatacctaatccattgtaaggcttggttcaaagagaaatcaaaggtgatttttcttcccaagtgccaagtggttattccttccttggatatgtggagggggaacaaagatccgatgaatggtgttcctaggattacttcattcttaaggttttgtaccagcagataa

SEQ ID NO: 2183 - DNA, 183 bp, Glycine max
  Peptide Sequence Number=SeqID_118961
atgacggcaacggtggagtcagggaatccggcagatttgttggattccactgaggaggacatgttggatgccaagtattgggagatcaacgcacagttgatgaaggggaagattgtggcattggagctgttgaagatcttactggagaatgctggagctgtcttcaggactagtgaaaggtaa

SEQ ID NO: 2184 - DNA, 539 bp, Glycine max
  Peptide Sequence Number=SeqID_118962
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgg

SEQ ID NO: 2185 - DNA, 255 bp, Glycine max
  Peptide Sequence Number=SeqID_118963
atgtacaaaccccaatttgctgggtttgtagatgtggatttggccgcagataagaacatttttcttaggagtttgattgatcactcagttgtggagagttttggagcaggagggaagacaaacattttgtcccgggtccatcctgagctagcagtgatgaaccaagcgtacttgttcgtgttcaacaatggtattgaaccaatcgtagtggaaaacctgaaagcttggagcatgatatctgctgatataaaatga

SEQ ID NO: 2186 - DNA, 138 bp, Glycine max
  Peptide Sequence Number=SeqID_118964
atgaagccaccagttacctacagattcagattccacaacatttgtttgatcaatcattatggattcagatggggaaaagagaaattatatgtgacggctcggtatattggggatcatactcttcttatagcgagttaa

SEQ ID NO: 2187 - DNA, 3735 bp, Glycine max
  Peptide Sequence Number=SeqID_118965
atggctgaccacaccaccagtaaaaccaccactgatagattagaagatgcagttactcgcctcacccacaaccaagcttctcttaatgagaaatacacaaagctatcaggtaaggtcgactccattcttgaccacttgcgtctccacgaggcaaccccgagccattccagtcctcgagtctccttctcacagcgaaacaatgtcaagctagatatcccgaggttcgacggccgcgacccgatggggtggatcttcaaaatcacccagctgtttgactatcagaacacgtcggaggaagaacgaattacggtggcctcattttatcttgatggcacagctctaagctggtatcaatggatgttccgcaatggattcatcacatcgtggccaggattcttgcaggccctcgaatcaagattcgcaccaaccttttatgaagacccaaaaggagctctcttcaagctatcccaacgaggtacggtcaacgactatctcactgaatttgaaagactagctaatcgtgtaattgggctacccccaccgttcatgttaagctgtttcatctctgggttatcacctgagatacgtagagaagtcctggctctccagccaatctctcttcctcaagcaactgcattggccaagttacaagaagacaagctaagggatagacgccgtttctctcctcgacctggcgaccttccttcatcgtcaactaacaaccccaaccccaaacagaagtcacaatttgttcaaagaaccctagaagaaatagcctttcgaagagaaaaggggttatgttataactgcgatgaaaaatggagttcgaatcatcgttgcaagagcaggatcctcatgctcatcgcagataaccccacgccggaaacggacgagcccaaccacgaaaactccacttctccggtggccaacgtcaacaaagcaccagactcactctcggaggatccataccctcatataagcctacatgctctgtcaggtttgccgtcatcagacacctttcaactctacggcgagcttaaccacgcacgaatcaccgtcctcatcgataacacaaacttgtcactccaaggccaccaattcagcgtttcgttccacatacttccgatcagtggggctgacgccgttttgggcatcgaatggcttaaacagcttgggtcggtagtcactgactacacctcccttattatgaagttccatcatttgggccaggcaatcgaacttcaggcagatgttactaatgggccagaacccgtttccgcaacccagaaaacagaaattgaaaagcaaatttccgacctcttatcagcgggtttgatacgtcccagcactagtctttactcatccccagttctcttggttaaaaagaaagacggtacctggcacatgtgtgtggactatcgggctcttaacgcagtaaccatacgggaccgatttccgatacccaccattgatgaaatgttagatgaactgggtcaagcagcatggttctctaagctcgatctccggcaagggtttcatcaaatactcatgcatgagcctgacattgagaaaacaacatttagaacacatcatgggcactacgaataccgtgtcatgcctttcgggttgagtaatgccccttccactttccaggccgccatgaacaccctactagcaccgttcttacgccgatttgccacagtattctttgacgatattcttgtttatagcaagactttgtcctctcatattcaccatctcgaagcaatcttcaaagcactattgcagggccaattctaccttaaacgtgctaagtgtgtcttcacacaagatcaagtagagtatctagggcacgtcgtgtctggacgaggagtcgaaccagacccaaccaaaattcaagctatgacccaatgtccaactccgtcatccgctaaagaactcagaggattcttaggcctcacgggtttctaccgcaagttcataagaaactatgcttccctagccaaacctcttacgacactcctatgcaaatatgctttcgaatggaaggaagactcacaagcctccttcgataaacttaaaacaaccatgactcaagcaccagttctcgcgctccctgacttctccgagccatttgtcgttgaaacagatgcatcccaaacagccatgggagcacttcataccatcgtaaccgcaattcgaaaatggcggcaatatcttctaagaagttcattcaccatcctaacggatcataaaagcattcaggagctcatgacacaggcaggcgcatccaatatagttgcagatgcactatcacgagctccttcctctccaggccaactgctgttactttcagtacctcacctggaattcattgaagatctccgacgcacgttacatgatgaccctcagttccaagcactattatccaaggtgcaggaggacccttcagcacacatggactgtcgtgtccacaacgaactcatcttcttccaaggacgtatctggttacctcgctcgaatccttacattcccaccatcctgcttgagtaccatgcaacgccgttaaggggccacgtgggtgttgcaaaaacctcacatcgccttgcatccagcgagcactcgccggctgtctggattactgcaacctctcccagccctaacgggaatttgggaggatatttcaatggacttcatcacacacttaccagcatcttaaggcttcacagttattctcgtcatcatggatcgctactccaagggagttcacttgggagcactgccaactcagttctcggccttcaaggtcgcgactctcttcttagacctcgtctgcaagcatcacgactttccccggagcatcgtgtccgacagagaccctatgtttctcagctccttctggcgcgagctctttcgcttgcatggaaccctcctccgcatgagtacggcctaccacccccagaccgacggccaaacggaggtttcactcctttcgaagtcatctacggcaaggctccaccggcgctaccacattacattccaggactcaccaacaacgaagctgttgacgatttggttcacactcgccaagaaatccacaagaaactgcaacaacggctacttaaggcacaagctgccatgaagcaccacgcagacgccaagcgcgaggacatttccttcactgtgggtcagtgggtttacgttaaactccgcccataccgccaacgttcagtcaccggagccccccattccaagctttcgaagagatacttcgggccttttcaaatcacaacacttatcggtcaagttgcatatcgtctccaacttcccgaaatagctcgaatccaccccgtcttccactcatcgcttctccgtgcccaccatggaccacctccattaacgccggacacttggtccttagaagtcctcgaccacaagcctgttccgcgacccttatgtttcctggactccaagctagatgactctacctccccaccaacacgcatggtccttgttcaatgggacggacaacctcccaaggacaccacctgggagtcatggcccgagctgcgcacgacctaccaccttgaggacaaggtggtattcggcgaagggagtattgttagcaccgtacacgagcccgacactgctagcaccattcacgaacttaagagtcccagacccaggagagaaactagcaagccccactacttacgtgattacgtaaccacgtaa

SEQ ID NO: 2188 - DNA, 810 bp, Glycine max
  Peptide Sequence Number=SeqID_118966
atggtgcatggctatttcaagggatttggcatttttcagtttgttggcctctattctacagctaaggtcaacgttggtctccatgatgtcgaagacgattctgaggacgaacatgaaaatgacttggaggttccagtagatgctaaagttgttgttgagaagcctgctcaaccctcaaccctcatttaccctaaagaagatgatcaaagtggtgcagtggtaaaggagaatgttcattggaaaagcaaaagtgcaataaaacagaaaaagaaggataactcttcaaaggaccagaaagaatcacaagaccagtctgatagcatcaatgttggaagtaggacttttgaaactactgacatagagaaggcagaggatgtgtctgccattgatgttaaagagaagcttaagaaagtcacttctatgaagaagaaaggagatggatgctgctgcacgagcaacttaaagcctcaggtctttgttgatgctcaggcagacactgattggggtctatttggtcgcaaccagaatggcttgagtggtggtgtagcaacaagtgttgatactgatgatttggcaatccatttgatctgttcgaatcattgtttgagggcaattatcgtggcacaggttccagaggttcttggaatggagcaaatgatgctgaacatgagggctaaaccagggactacaccatccagatgtagcacttgtggaggtcaaggccgggttgtctcatcaatgagaactccattagccatcttccagcggtcaatgacatgctctgcatgcaatgggactggagaaatttga

SEQ ID NO: 2189 - DNA, 222 bp, Glycine max
  Peptide Sequence Number=SeqID_118967
atggcggcggcaggtcggaccaatgttagagacgctggtggtggggaaggagatagagaagaagacgattacaagcttgtcaacggttataaccgcttaaccatcataacagtaaagcttaacgtggggcttgctagtttctctcctgggtctgggactcttaggttcgtgaatggtgctagcagtgtcgggctcgtgtacagtgctaacattggactataa

SEQ ID NO: 2190 - DNA, 2022 bp, Glycine max
  Peptide Sequence Number=SeqID_118968
atggacaagtgttgtccggtgtcaaaagtggtagcctcaacaagtgtgagagttacaagtcttttaaaattgtcaaacccacgagcttggacaagtgttgtccaggctgtttctgtcaagttgtccagggaaaacaagcttttggttttgaaaatgaggtctgtgcgatgcacgcgcaatactcttgcgaatgtgtcattcgtggagtggacacatattggagttgtgatgcgtgggatacttgctgtagtgcctccaaaaactaatcctcctcctaaaagaagggagcctatccctgtcatagtgattctccatctttcggcttctaggggagcaaagagaaagtggtggggacgtgagggcatctctccatgtgcaacatacatcgaatttcaggagaagctttgtgccatacaaactagcctcactaactaccctgattttcttatccatgattacttaatcttctacaaagggagcatttggattcctgatgacaacccctttatcccctctctgctcaatgaattccactccaccccattgggtggtcatttcggggttctgaaaaccacgcaccgtttacaggccaatttcactttgcccaacctccgccgtgatgttcgtaactacatcaagcactgccagatttgtcaacaaaccaagcccgtccctggcaaaccggccggcttattacaaccattaccacttccttatggcgtttgggaggaccttttgatggatttcatcacccatctacccaactcccagaatcacaccacactcatggtggtcgtagaccgtttctctaagggagtccattttggcgctttacactctaactttacggcttacagggtagccaatctcttccacgatatcatatgcaaacttcatgggttccccaaaagtattgtttcagatcgtgatcccatcttcgatggtcaaacagaagtcgtcaacagagtcctcgagcagtatcttcgcccattcatccacgctaagcctgttgaatgggtcaagtaccttcctctagcggaatggtcatacaacacctctctgcactccagcaccggggtcactccatttgaaattatatactacaaaccaccaccatctatacccacctccctgctaccctcttccaacaatgaagctgcagagtcccttctccgtgactgtacttcagtgcaccaaaagctccaacattgtttactcaaggcacaaagcactatgaaacactttgctgacatgaagggcctgccagaatccttcgatcgcttcttcagaccattcgaaatcacggagcgaattggtccagtggcttatcgtctgaatttacccacggcctcaaagatacaccctgtctttcattgttcgttacttcgacgatactatggacccattcccccgaccactcataaccttccccctacagctcaaggcaatcagcccatcctcgaaccactcgcgattttggcacataaggatgacaacaccacctctccaccaactcccttggtcctggtgcagtggaaaggtttgcctccagaagagacatcctgggaaccattgtcagctatctcggacaagctacaccttgaggacaaggtgcctttgccagctggaggagttcttccttgttctcgaatacaaggatcccctactaccccaattcgaaccatagcaccagggcacattcttcttccagcaccaaatggggaagacagaatgaattcaagtgctgggtttgaggatgcttcagcatatggaggatcggtttcccctactaaggaatcgccatcatgctccaagttggatgctgagaaaccatattcatcttcaatcaaacagagtgatgcctgctttttcagaggccaacgcctaacgagtaggcaaagtggcttttcaataggctcctcctcctatggggctgtcccagaagtggatgacttgtcaaggggtgatttcatatcagaaactaaagctttggcaccggatgtggaaatgctgagtgagtag

SEQ ID NO: 2191 - DNA, 261 bp, Glycine max
  Peptide Sequence Number=SeqID_118969
atggggtattatcttgcaaatggtatttatcctgattgggcaacatttgtgaagaccgtaccaatgtcacaaggtccaaggagaaaattatttacaaaatgtcaagaagcaacaagaaaggatgtggaacaaataatgacatataaaatgttgaagtatctcatggtgctcctcctgactttactacatgcaaacaagagcgttgtacatacaagaggaattcatcaacaacttcaaacatacttggttgagcatatttga

SEQ ID NO: 2192 - DNA, 369 bp, Glycine max
  Peptide Sequence Number=SeqID_118970
atgggaagaagtgactccgggggttctattcagcagcccctaggggaacgagaggttattccaatcatcgattccttaacaaaggaagcatgcctcgaaacttttgacagcgagtcctctttcttcgagaggttggtggactcgcgtcgtgtcaatggggatacttctcatcccccgagaaggagtgtcggcaggaatgttagggtttctccccataacaggcatcgacacagtgtcgtgtcacctttgtccccttctatcgttgctagcaatgagtggagaaggaggaaaggtgattggagatgccagttcaaggagatgagtcaagaacaagctcaccactataggaagccatggataagagcttga

SEQ ID NO: 2193 - DNA, 1725 bp, Glycine max
  Peptide Sequence Number=SeqID_118971
atggctggctatgaatgggtgaaggatgacattctgaagtacaagtcctctctcacctcaatggaccatttcttcaaggtcatggctacttatgccatggttgatggcatgccactaatgtttaacaaggacggggaaacttgcttcccgttctactggcactctaaccctaccaggttcaagtcgtatgacgaggatttgctgacccttgtggagaaggtcaacaaagcaattttggagcagctaccgacctcacttgtttgtattatggatgacttcgcctggaggccactcttgaatcaagtcgaacctgcaggtgggactgtgccatcgtctcttgttgctcttgttgttgaagaagtgggtcaacctgttggtgaggttggccctattgccattgtggctgaggttccccccagttcttcttcctctattttggcaaagaagaagaaagatgatggtgttgggttgtctagccacaagaagtcgaaggccttttttagccttcgtgccctgaggcaagctgcagggttgatgcctagtgcaagtcgcctttcgactgtgcaagatgtgcctccggctccaccaaccgtcgaagctcataatactcttgctactcttgctccttcacctcctccccctataaatgttcttaaggatacccccactgctattgaagttactgtgctagccactcaggctgactctactgtggcaccatcatccactgtcgtggcacctttgttaagtgccggtgtggcaaccattggtgctcccatggtacttccttcttctgctgtagctctggtggcttctctctctgctattttagcaacggtggcgtcgccttctttgtcttctcgccctcgcgtctcccttgatcacttgtacacctctagtgatgttgactcactgtggggtgcaacttataagccggagcaaaagaccccaattggctttatgtcagcctccgacgagaatcttattaggttagctagggtggcgtcctgggaggcgaaggtcaccaaatggagagctactgctcgtactctttggcgagtggagtgccctaaggtggccaatgccattgttgcttttgctgaggccgtaaagttgaaccaccaattgtctttcaaagttggtggtgtgttggccaagttattgtgcacccgactagatggtgatgaattgtttaaacgctgcaaggacttgcaagcagagaagacggacctgggtcgcaaaatggagaccgtagtggctgagagggatgggcttgccaaggcagttgttgatttagaggcctggcttaaggagtcagaatctaggttggaggagttcaagttgcgagctaccaaggaaagggaagccatcaagaagattaaggaagagctacttctatacaagcagacaagtttctttgtgaaggaccttgacatgggtctcctcgattctttcaaggatgtgaaggataacatccttcttgatgaggacgacattgttgttaaggaggaggaggaaaaggttgttgatgaagggcaaggtgctatggagcaaggcgatgatgcctgtttctttgtgaaggaccttgacttgggtctcctcgattctttcaaggatgtgaaggataagatctttcttgatgaggatgacattgttgctgaggaagaggaggttattgatgaagggcaaggtgctacggagcaaggcgatgatgcctgtgtctag

SEQ ID NO: 2194 - DNA, 1379 bp, Glycine max
  Peptide Sequence Number=SeqID_118972
atgccgggtatccaccctagcatcatatgcgtcaagatggccatatgctctcaagctaaactagtttcacaaaagaagaggaagatgggagaagagcggcacaaggcagtcaaagacgaggtctacgtggacaacatggttgtcaagtcttatagcgtagcccaacacgtggcagacttggaagaggtgttcggagaaatatgcaagtacaacatgcgcctcaacctaaaaaaatgcactttcggggttggcaaaggaaagttcctcccaaaactcgcaaaaaaggcaaagccattctataagctactccaaaaaatagagccattcttatgggacgaagcttgtgagcaagctttcttggccttcatgaagactattgccatgccgccagtcctaagtcgactcaagccaggagtacctttacttctatacctctcagtggctgacaaagttgtaagcttaacctttgtacaggaggacgggaaacaccagcttcccatctattttaccagtcgtatccttcatgatgctgaaaagtggtaccagatgatagagaaggtagtgctggcactcataacctcagatcgacgcctcaggttgtacttccaaagtcaccaagtggtagtcaagacaaactaccctgtcaaacagaaggatgggaaacaccagcttcccatctattttaccaatcgtatccttcatgatgctaagaagtggtaccagatgatagagaagggaagcgtggcaggtatcatccttgaagggcccgacaatgttactttagagaaagctctcaagctcgatttcaaaacatcaaacaatcaagccgaatacaaggcacttataacactccaaaaactatccaatgaagttggggacaaaaagctaaagtgctacattgactcgcatcttgtccaagggcaaatgtaccatataccaagagaaagcaacaccggagtaaacttactctccacactggccaacaccaaaaagatcgggcatctcaaaaccatcatccaggagacactccaggctgcaaccatagacaccaaagaggccaactactatgtcatccttgacggtgaactgttcaaaaaaggtttgacaacacccttgtacaaatgcctaaacagcccgcaagcagactacatcatgcgagagctatatgaaggaatctatggcctccataccggggaacatttcctagcaaccaaagcagtacatgtcggatactattggtcgacgcttagggccgacacccttgacttaacaaggagggtggacgcggttatgtggggtcccgaacttcacacgttggcttggagagatacctttgacaagaaagggggacctgcaaaacaaagttctccgacactcaa

SEQ ID NO: 2195 - DNA, 849 bp, Glycine max
  Peptide Sequence Number=SeqID_118973
atggctccaagccagttcagtgttttcctgccaatcaaagcaaagttggaggcgagacttgagactctggaatgtcttccagtaaagtatgtttgtggagataccttggtcaataaggaccttgaacaccatgaaattagtgatcgctatgaagaccaccatggggtcatcatggttgacacgattaatgcctttgaagtctttgtcagtgaaattgatgttgatatccagaatggtgtgaagatgacgctttcgggattgattggacaaccctccacagggaaatccacccacaaagctcgttttcttgctcttactaaagatgatgttcacgcttatgttggtctggctcctgctgggttattgtcaggcctcttcacaaattgggctaagtatccagcttatatgaaaggaagtattgagggtagctttaggggtatctccatgttgaaggcctcttcaagaatagtggctcaatttatggttaaggtgaacttgccaagtcgtagggtgagcaacatggactgtagttcaacttcaggatttaggtttctgatctggacaacaattcagccgaacatgttcatgaacttctggagtgattcatcttccgcctgtcacagactagccaaagcagtggaagtcatgcagtatgaccaactgggagtcctccgtaccatgttaatgccccctttgaaggacgttgggaagacacaacagaagattgtgtcatcattggtcggcctccatgatgtggttgacaaggaagtgtcgacgagtcgtccgcccttcatggcggtatatatgcgagaggttgggatcgtcttgggtgttgatggtgtgtcaagg

SEQ ID NO: 2196 - DNA, 489 bp, Glycine max
  Peptide Sequence Number=SeqID_118974
atgattgaagcaaatgataatgatttgagaaattcaatagaagcaaatgacaagtattcgacaaaaagcttggacatgaacccctacaaaatgtatcttgattacaacaaatttttcatcactacaaaggagttgcatatattgttagacaaggtagtactcagacaggagagcagctcctgtgataatcgtcaagcaaagcaagcatataagagaaaagattgtgagatgcaaaaaggtagtgtggtaatcaatggttcagaaggtatcaaacttaatagtttagagaaaggaataaatggatggcatttgatgacaatgaggtttgaacggagtataaggactttgttggaaatgacggagaaatttgtttatccgcttgcgttttctgctttgttggaggatgttttggcgtcgatttcatctctgttggagtcgtctcggttgctggcttcttcaacaaaggtggatgcacatccgtggtactag

SEQ ID NO: 2197 - DNA, 540 bp, Glycine max
  Peptide Sequence Number=SeqID_118975
atgaggggcatcgtgcataagcctcaagtgaacataggggcaaatcaaaaagggctacatgtccacgccatcagagggctgcacgccctcgccttcagagggtcgcacaccctcgccttcatagggctacacgccctcacctttagagggctgcacgccctcgcctttagaggactatacgtcctcacctttagagggatgcacaccctcgcctttagaggactatacgtcctcaccttcagaggactacacatactcgcctgcagaggactacacgtccttgccatcagaggactacacgtcctcaccttcaaagggctgcatgccctcaccttaagaggactacacgtcctcaccttcatagggctacatgccctcacctttagaggactacacgtcttcaccttcatagggctacatgccctcacctttagaggactaaacttccccgccttcagaggactagacttcctcaccttcagcggactagacgtcctcgccttcagaggactagacgtcctagccttcagaggactagat

SEQ ID NO: 2198 - DNA, 441 bp, Glycine max
  Peptide Sequence Number=SeqID_118976
atggatgtgggagggaaaagagatggtaattgcagtgctgtttggaatcaaaattgttattttatgtggttgtggagaaacaagcatgagcacaaagatgatttcattagacctttgaagccttgggaagtcattttgaaggcttgtgatgagtattctaatggtggtgttgttcatgtcatggcttcagggaatactagttcggaaattatgattggttggaagccgccgttggtatcttgggtggcaatcaacactgatggtgctgctagagggcaaggcaggtgggcaactagtggtggtcctatcagggttaatgatggccgttggatttgtggttttgctaagcaaattggcagtaccacagcctatgttgctgagttgtggggagttttcagaagggctcagattagctcattccaggggtgtgaagttcattaa

SEQ ID NO: 2199 - DNA, 705 bp, Glycine max
  Peptide Sequence Number=SeqID_118977
atggacatgaacattggcggtttgatctctggacaaatgaccatgatggctcagtctaactcttctcgcttaggcttcccagctttaatcacagccttgtgtagattgaggggagttggatctgatgctcttacctcctacaagaacctaagaccggtcattgacttagcctatatcataaagaactgttggaatgcgaatgaccaaacagttaattttccagaggcaaggaagagcaagctcagagcagctgatgttcccttttcctttgcaccaatagctggcatccttgcatcttctacttcagccccacttctagctttagcagacccatctgcccagagctcccagacttcagatgccaaattgcaaagcctgttggaaggacagattctcattatgcaaagcttgcaagaactggctcagcaaaggccaattatgagtgtagagcaattcattgagaaggtggccaggcctggaacccgaccttcttttatgggggataatgaaagttttatagccttggcacctcaacaaaatgagttagagccagaaaaagatcactcatttgaagccatcatccctggagctgtttattttttgaaaagaatattagagacgagatccaatgaggctgctcatcctaggccagtgccagtatcagcagatgcaccatttccaggggtggatccatcttcaccttaa

SEQ ID NO: 2200 - DNA, 596 bp, Glycine max
  Peptide Sequence Number=SeqID_118978
gtcgactctagaggatcccacggtggcccaggaacggttaaaaggaaactactggccccttaaccgggagtgcaagtctcgcacactgaaaatgaggacacgtaggcctctaaaggtgagggcgtgcagccctctcaaggcgaggatgtgtactcctctggaggtgagggcgtgcagccctctaatggcaaggacgtgcaatcctctaaaggtgagggcgtgtagccctacaaaggtgaaggcacatgaccctttgacggcgaggacgtgtagtcctctgaagttgaaggcgaggacttatagtcctctggaggtgagggcgtgcagccctctggtggtgaggacgtgtagtcctctcaaggcgaggacgtgtagtcctctgacggtgagggcgagcacgtatagtcctctggaggtgagggcgtgcagccctctgatggtgaggacccgtagtcctctcaaggcgaggacgtgtagtcctctaacagtgagggcgaggacgtatagtcctctggaggtgaaggcgcgcagccctctgatggtgaggacgtgtaatcctctcaaggcgaggacgtgtattcctctcaacggtgagg

SEQ ID NO: 2201 - DNA, 384 bp, Glycine max
  Peptide Sequence Number=SeqID_118979
atgatattggggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctcgatgaatctaggaacttttgcttgcattgtatcatttggtctacgtaccggaactgataacattcgagattatgcaggattatacacgaaagatccttatttggctctctctttagccctatgtctcttatccttaggaggtcttcctccactatcagcatctactataccaggaatatcaatgaaccctattattgaaattgctcaggatacccttttttag

SEQ ID NO: 2202 - DNA, 902 bp, Glycine max
  Peptide Sequence Number=SeqID_118980
cacgggctcgcgcactcggtgttcaaggtgggcggcaatgccggctccgcgctcgggccgctgctcgccgcgctcgtgatcattccgcacggccagcacagcatcgcgtggttctcggcggccgcgctcgtcgcgatgatcgtgctcacgcagatcggccactggtacaagaagcatccgtcgatgaagaagaaggccgtggcggccggccacccgacgctgtcgcgcggccgcgtgatgggcgcgatcggcgtgctggtgctgctcgtgttctcgaaatacttctacctcgcgagcatcaacagctatttcacgttctacctgatcgacaagttccacctgtcggtgcaggccgcgcagatccacctgttcgtgttcctcgcggcggtggcggccggcacgctgatcggcgggcccgtcggcgaccggatcggccgcaagtacgtgatctgggtgtcgatcttgggcgtcgcgccgttcacgatgctgctgccgtacgcgaacctgttctggacgagcgtgctgtccgtgatcatcggcgtcgtgctggcgtcggcgttcgccgcgatcctcgtctatgcgacggagctgatgcccggcaaggtcgggatggtcgcgggcctgttcttcggcttcgcgttcgggctgggcggcgtcggcgcggccgtgctcggccagctcgcggacgcgacgagcatcacgttcgtctacaaggtgtgctcgttcctgccgctgatcggcgtgctgacggtgttcctgccgaacctcgaaagcagccggcgcaagaaggcatgacgaagcggccgcggcgtgcgcgccgcggccggtcgatcggctcgaagagaaagtacgacggcggcttcaggccgccgtcgtcgcatgcagcgtcaggaaccgcttga

SEQ ID NO: 2203 - DNA, 378 bp, Glycine max
  Peptide Sequence Number=SeqID_118981
atgttgctaagtagcaatgtcatctatatctgtgtaggagtggtcatgttggtgcgcatggtccgcactcttctctttgcagcggcacgggtgaaatcttgccccagtatgcatagtagctgtgtgatagcctccctctctggttgtgctcgcacagttggccctcctccaatatcagggggtggcccaggaaccgtgtggatatggagcccactgaaagtgaggacgcgtagtcctctaaaggcgagggcgtgtagccctctgaagttcaggacgtgtcgcctttcgaaggcgagggagtgtagtcctatgatggcaaggacgtgcaatcctctgaaggtgagggcatccccccctttgaaaatggggaacatgtag

SEQ ID NO: 2204 - DNA, 358 bp, Glycine max
  Peptide Sequence Number=SeqID_118982
atgagtcatgggcgcttgtaccagcaaagaatgaagagtgcattcgacaagaaagtacgcttacgcaagttccatgagggagaccttgtgctaaagaaaatgtcccatgctgtcaaggaccatcgagggaaatgggccccgaactacgaagggccttttgttgtgaagagggctttttccggaggagccctggggcaggatcaccttgggctaccttctggagtagagacgaaacatgaacggcagaaaccaatcaaggtacttaaggacggatgcaagtggggatggggtcacgaccgaccgtcgttgtcccttctctgtgcgaaacaagcagaggatgtcgctgcaaggcagcccc

SEQ ID NO: 2205 - DNA, 562 bp, Glycine max
  Peptide Sequence Number=SeqID_118983
atggagattgttcaaatgcttttaatacgtctcaggtattcgctactcgagatgatgttttgcaatgggctcgaagttgcccatgaaaacggatttgttgcagtgattatgaggtctgacacagagactggtagcagaggaagaagttcatttgtcttaattgagtgtgaaaggagtggtacgtacaagtgtagaaataaagaattcgttagaaaagataccgggagtaggaaatgtggttgtcccttcaggcttcgtgggaaaccagtgcatggaggggaaggttggatggtgaagttgatctgtgggattcacaatcatgaattggcgaagtccttagttggacatccatacgccgggcgattgactaaggaagaaaagaaaattattgctgatatgacaaagtcgatggtgaaaccgaaaaacatcttgctaacgttgaaggaacccaatgtcgacagttgcaccacgataaagcaaatttacaatgcaagaagtgcatatcgttcttcaataagaggagctgataccgaaatgcagcatctgatgaagcttctcgaac

SEQ ID NO: 2206 - DNA, 606 bp, Glycine max
  Peptide Sequence Number=SeqID_118984
gtggggttctcacggaccctaagagaataaaggtcattcctgagtggcccactccaccaacaccactcattgagttggtgaggaaccatgctcccgcatgggaagatgcccaggaaaggggttttcagaccttaccctgctccaacataccaaacaccactaatatatatgttccctcatggaatgacttgaaaagtgcccttaggaagaggcacatcccctcctactatgaaagggagcttatggacaagctccgaaggcttagacaagggagtatgagtgatgaagagtattgtcaacaaatggaactactccttttgagagctgggcttagggaggaggaaagaacaagtattgctaggttccttagtggactaaatatggaagtgagggacaaggttgagctttttccatatagggacctagatgacctagtccaactttgcataagggtagagcaacaacttaaaaggaagcctacttcaaaatcttatggctctcactcttatccaaagaaagaccaaggccaagtcatcttaagggctgcaccttttaaacccaaaggtgataatgggaagacaatagaaaagcaaccccctaaggcta

SEQ ID NO: 2207 - DNA, 726 bp, Glycine max
  Peptide Sequence Number=SeqID_118985
cgtgcgctgattgagcgccgccccgccaaagatcatgatgtgacagccattgctgccggcctgaagcgtgatgtcgtcacccggccggaagacgagcaactggtcggcggcgaagatatcgcctgccacatcgagcgaaccggagagaatatagatcgcccgttcctcatgatcggcggaaaagggaaatttcactcccggctccagcgtcagatcgacataaagtgtatcggtaaaggccgaaacgggggaggtaaggccctcgaattcgccgatcaccaccctaccggaagcgcccttgatatcgatcagcggcatgtcttccttggcggtatgggcaaaggccggggcgatttcttccatatggtcgggcagggcaagccaggtctgcaggccggacatggaaagcggatggccgcgcaggttttccggcgtgcgttccgaatgcacgatgccgcgcccggcggtcatcaggttaatgtctccggggcgaatgacgagttcggtgccgagactgtcgcgatgcttgatttcgccgtcgaacagataggtgacggtggaaagcccgatatgcggatgcggcttgacgtccagcgcctcaccagccttcagtatcgccggtcccatgcgatcgaaaaagatgaaagggaccgacaagccgccgctgccgcgtcggtagcgcgcgccgcaccgcaaagccgccaatatcgctggtgcgggggatga

SEQ ID NO: 2208 - DNA, 318 bp, Glycine max
  Peptide Sequence Number=SeqID_118986
atggataaagttgatatctttgtccctcatcctctcacaaacgcatgtttgcttattcaactttcatcggaatgtgggtgcaagccattggtctgtttgctcaagcgacctgcgctcctgagtgttgacttccaagactcttcaatcagagattactcgtcttgcacgttggtgggggaatcctctacaacaagagacccacggtctcttaatcccttttcagaaataagaagaagagaagaagaggtctctcgtaaaagggatagattgtacaatgaagaccaatcaaaattcattattgaatatgcaagtggttga

SEQ ID NO: 2209 - DNA, 558 bp, Glycine max
  Peptide Sequence Number=SeqID_118987
atgggggtgtcgttcatcgagggaaagataggaaatggctccgaagaactctccacgaagaggtctagaagagacgccacaggagaagggtccagtaccgcccccgagtttgatagtaatcgtttctggagtgccgagcaccagcagcgcttcgaggccatcagaggatggtcgttccacagggagaggcatgtccagctcagggaggatgagtatacggactttcaggaggagatagcttgcagacgttggacattgctggtgactcccatggccaagtttgaccctgagatagtcctagagttctatgctaatgcttggcccacggaggagggagtgcgagacatacgttcgtgggtgaggggtcagtggattccctttaacgcatatgccctcagccagttcctgggtgacccgctagttttggaggaaggccagcagtgtgagttcagccagaggaggaacagggccgacggattcgatgaggaagccattgcccagctgttgtgcacactgggccaggatttcgcccggactgctgcagggaggcgggtgtag

SEQ ID NO: 2210 - DNA, 375 bp, Glycine max
  Peptide Sequence Number=SeqID_118988
atgacccaagagctggtaacccgcggaaacaccttccggttatccgcacctcgtcattcagtgaccccaagtgtgattgatgagcagaggccaatgtggtcatctgtgccccttccggagatgtctgagttcctcattggaggatacgtaggagcaagagcctcgcttttgtcgaccacaccgcttttcgttaccatgacccaagagctggtagcccgcggagacaccttccggttatccgcacctcgtcgttcagtgaccccaagtgtgattgatgagcagaggccaatgtggtcatctgcgccctttccggagatgtcaacatcttccggtggagactttttcaagtctcacaagttatctagaactacctag

SEQ ID NO: 2211 - DNA, 519 bp, Glycine max
  Peptide Sequence Number=SeqID_118989
atggtaaatggtaatgtagttttgagaatgcaatttgcagatggaaatggaggcatgaaggctggttcgtgcccaaatcgtgcggaatcaccatctatgaacacaacatcaagatcactagttctagtgaatttctttagagatcttcctgatgtaactaaatcttgcaaggacaattcagctcctttgcttagcatggtcaatacatgctatgaagcagctggcaaacgttggcctaatttcattgctgttgatttctacaagagaagcgatggaggaggagccccagatgcaatagatgttgctaatggtcatctagtgtgcgggtgtgaaaacatggcctcctgcaaggctaatatgacatttggagtgtgtcagctacctgaggctgaagccactcctccccgtgaagcagcagcagcacgtgacactagctttggtattcgaaattgcaagccagtttatttgctgtggtcttttgccaccactgtttttgggggcatgctcgtgtcattgtga

SEQ ID NO: 2212 - DNA, 861 bp, Glycine max
  Peptide Sequence Number=SeqID_118990
atgaagcagatgccatatgttgttggacgtgacccctccgatgaaggtccattgcaacaaggagtagatggaccactgtattggccacaactggatcccttaggagcggtcagagttgaagcttgtaagccacaatggccaggctcagtgaatgggtttttggagaggtggcaccaagagacgtctttcttccacctatccattagagagatgaccatcacattagatgatgtgtcttgtttgttacactttcttgtgataggcaagtccatcaatcatgtcccgtcactttttgatagagaggcagtaaagatcctattgatgagtcatatgcacattccgacagagactgaggcctttgcggcaacaaatgctgtgatgacttatctcttgcacttgatcaacaatatgatatttgccgacaactcctccactcacatccatgtcacctacctcaagtacctcaacaacctaaatgcttgtcacgagtacgcttggggaggggaggattatgttgtggacaaatcggtagccaccagattgaagccgttaagaggttctgggcgtgcccttctaatcatggagagactggatgacctacatatggatgctattatgtggtgtccatataaggcacatagggcagtgagaccttttggatccggggatgctaatcaaaacaccatttggagaagcaatagcagtttgaacacaacaaatgtctcaagggatgatggtgtaaatgaagaatcaaatgaaaattccgttggagtaggtggtgggaacaagagaggtggttaccaaggtagacgtgactttagaggtaaaggagaacccaatggctttggtctgacaatatag

SEQ ID NO: 2213 - DNA, 936 bp, Glycine max
  Peptide Sequence Number=SeqID_118991
atggctaaggaatcgacaaatagaaaaaatatattggtaatatttggaaattgccctttggattttactggttcgaacttcacactggcatcctctctatgctccaaccatggtgacaggggaaaatgttgccgctacatcaatactaatgttgcaatttctgttgctcgttttgctaatgcaacaggcaacctaggggtccctcaaaatgcgtctgacacgtgcctccaaaccatatttcaaaccttgcaacttaatggagttgcacaaaatgcaacagctttctgtggttttgggacaaaaattcctgttaattatgaatgcagggggagaactagtgttgcccaaatgctgcaatcccccagatttacggaggtcacaaaaaattgcaaagcaccacttggagaggaaagtaaatgtaagaaatgcttaaatgccggctttggttatctgcatcatattggaattgaagataatatatcactaagtacatgccgtgatgccacttttgctgcactagcaagccaggttgatgagatatctattattgacattgcaatttgtttctttggggttcaaggacttctcatacctcctgtttcagagtcatccccatcctttcctgctcctaaggcttcaccaagccccccactggttgctgatgggccaattacagctgttgctgttatcacactcatagtcttgatagttctaattcgccagaaaagcagagagctagacgagcccgataattttggtaaatcctgttcgaaaacattacctccttgtgcaacgtggaaatttcaggaaggttcttcatctatgttccgaaaattcagctacagggagataaaaaaggcaacagaggactttagcactgtcattggccaagggggatttggaactgtgtataaagctcaattttctgatggcctg

SEQ ID NO: 2214 - DNA, 253 bp, Glycine max
  Peptide Sequence Number=SeqID_118992
atggcaaggattcctgacaagattaagtctattgatgggtcaaaagagacgcttaagcttgctgtgagaatcaccgacctttggttcgttgggactcccaacaagtttgagcaagcggaaatggttattgttgattctgagggtgatcaaattcatgttgtttgtaaagcggaccacctaaagtcttggaaagctgatttgaaggagaattccacttatgttatgcataatttcaaagtggtcaagaatgatg

SEQ ID NO: 2215 - DNA, 1209 bp, Glycine max
  Peptide Sequence Number=SeqID_118993
atgttcttatttgctcttgacaaccctccgccatcctctataatgcttatatctggagatgtagattttgcaccagcacttcacattcttggtcagcggggatatactgtaattcttgtcatccctgctaacgtgggtgtttcttctgccctatgcaatgctggtaaatttgtctgggactggcccagtgtggttcgtggggaaggctttgtgcccccttcgaaggctttagtgccaccccgtggaggtccagttgatcttgctggatatttgatgggatgccatatcaatgacaactctgatggacaaaatgaagaagaagcaatagtttatagaggtatgtcacagagctattataactcgagggaattctcaatggtgtcacaatctctgtctgaatacaactgtggcacatcgaacacgacttacttgccaacaactatgagatcacatagctttccatctgtattgaacgatgctccaggagggtctatgatgccctcaagtgaccttaatgaatgccagttatgggtacagcctggggatttaaatggtctcaaggggcagctggtaaggttgctcgaactttctggaggatgcctgcctctggcccgagttccagcagagtaccagaaactttatgggagacctctttatgtatctgaatatggggcaataaagttggtcaatcttttcaagaagatgggtgacaccatggctgtggaagggaaagggaatcgtaaatttgtgtatctcggaaactggaggacaggcccaagtgctcctcctctctctctggcaaagaaagataagaaaggaaagggagcccaggaagagaatatgaatattgtcactggtggatgctcttcagatgagttctcagatgaagaaagagtagtcatcgaagaacctgatgaaagcagttgcataggaaagggcaatcagggtagagccgccaaatgtgaagtcgatgaccattttatcgagcaattcaagtatgagctgcaagagattctggtaagctattcttgtagaatattcctaggttgtttcgaggctatataccagcagcgatacaagaaacaactggaatatcagagatttggtgtggacaagttggaaggtttgtttgagaaagtgagtgatgtggtagtattgcatgaggaaccagcaagcaagaagaagtttctggctgctgtgggtggttag

SEQ ID NO: 2216 - DNA, 2259 bp, Glycine max
  Peptide Sequence Number=SeqID_118994
atgtcatcccctgcttcaccttcttcgtttcatcgcatcaaactagagtacaaagatcctaccggtgctctgtttaaattaacccaacgcagtattgtcaatgcttatctctcagagtttgaagacctcgtcaattggatcattggccttccaccgtcgttccttttaagcttctttatctccggcttggctcccgagattcgtcatgaggctacaggattagcgcgccttcaagaagagaaattccttgagagctgtcgaacgtggcgaggacctttcaccccagtttcttccgccaatttgtcaccgtcatcgtcgccagtcatgcctttatccccttcactttcattgcctcctccaataaaaccttctccacttctcgaggtcaagcacttgtcgctggaagagttggcattacggcgggaacatgacctttgttttaactgcaacgaaaagtttcatcgcggccactgttgcacctccaaggtcttcttgttgattgcagatgaagacgagggtttttctttagataaccctgacttggacttgtcacccgacccgcctgacccacccacggtacctttgacccaaattagcttacacattatggagggccatcttgctcttgaaacattgcaactattgggcctgattgcagaacatcaagtattgatcctggttgatggggacagtacccacaactttgtccaagaacacctggttcaaggggtaaccttcactgctaaccttcatgttctctctttgtctggtgcgaatttggtcctaggagtacaatggcttaaatccctcggtctagttcttattgactacaatgccttaacaatgaaattctttcataatgagcgcctcattgaactcaaaagggacacaaatgctacccttcatcctcttacaccacctcaattgcatcgtctcattcgtacagagggttccaaccacccacctctttaccaccttaaagacctaccaatcaccatatacaccttcttcctaactcagagcctattaatgtacgaccttatctctgctatgcctacagaacaccaagattattcacttgcgaataatttgattatgcaccatggttgcatttggttacctttagcctcacctttcacccagacactgcttaaggagtatcattcttcacccattggggggcatttcggcatctcgaaaacattagcacgtattcgcgagaacttcacgtggcctgaaatccgaaatgatgctgagaaatttgttacctcttgtgttgattgtcagcatgccaaatatgagactaagagggatctctccctcgatttcataattgggtcgcctgctttccgtggacacacagttatactcgtggtggtagaccggttctcgaagggctttcatctaggcatgttgcctacacaccatactttgcacacaatcaccgttctttttatggatatggtcgacaagatccatggtaggtctcggagcttaacttctgatcgtgacccattgttccttagccaattctggcaagctttattcaaattgagtggtacatgtttacgaatgagtttggcctatcatccgcaatccgatggacagacggaagtgcttaatcgtgtgattgaacaatgccttcgcgcttttgttcataacaaaccttcattgtggggtaagtttttgggctgggtagaatgggcatacaacacttcatgtcactcaagcactggggtctcaccatatgaagtaactttagacaagaaaccgttcaattttcctcaatacctcgcgggcacatccaatgtagaggcagtaaatgatcttctgtcaaatatggaggttgtcttcgcaaaaattcgaaagaaattgttgaaagctcaagaaggtatgaagcacatcgcagacgccaaacgacgggatgctacttttaatcccagggattgggtgatagttaagttacgaccgcaccgccaaacctctgcttctagaaatactacatcttattctaagttagcaaaaaggtattacgacccttatcagattttggagcgtattggcaaagttgtgtataaattacaactacccgaggctactttgctcgataaccaacccattatcaccccgttggccattctgagttctcgtcaaggacctgagtccaagcttcaagtgcaactctttgaagtggtgagggatgatgacagtaatgaacctcaagcacaacatggaccaaggtacatgcctgtaaggaag

SEQ ID NO: 2217 - DNA, 309 bp, Glycine max
  Peptide Sequence Number=SeqID_118995
atgacactcattataccatcaagtacgactttcaagttgcttcttaatgaatacaaggccacgtgcaacaacttggatgttccaagtagtatgcactactttatgaaagagaaatggttcactcaattgaacatagcagactgtgctgtcaaatgccacattgtttacaatcactggcgaaagacgacaaaaattggatctggatggagagatttttccaaatcccaaagcttcaaagttgacatggaattagtgttcgaatttcctgattccaatgtcaactatgctttcatttggccttgcttataa

SEQ ID NO: 2218 - DNA, 225 bp, Glycine max
  Peptide Sequence Number=SeqID_118996
atgacggagagtgataaggtgaatctgaagtgggctaatttggaaatgacatcttccaatctatcagaactggttttggatcaaggccagtacctccagagcactaatttggataaggcttgtgtcttggtccatgttgtgcttgaggttcattggtccatgttgtgcttgaggttcattactgctatcaatggtactgaacctcagcataatgcagttcaataa

SEQ ID NO: 2219 - DNA, 211 bp, Glycine max
  Peptide Sequence Number=SeqID_118997
atggctaccccaagtaaatcgacaccaataatagcttcagacactttggaaccaaaagggaagactatgactatgactgaatcaaacgcaaacattcttcaatgtcctttaaaccagcaactccatagctccttagatggcccagtagcaatcctatgggatattgaaaattgtcctgttccatgtgatgtacgccctgaggatgtagcag

SEQ ID NO: 2220 - DNA, 1251 bp, Glycine max
  Peptide Sequence Number=SeqID_118998
atggaatctggcaaattagccaccattctctcctccctcatctcccaactcctccttctcctcctccacaacattttccctttccccccaaattccgtccctccaaacaattccactgattccatcctcccgctcctcctcttctcccaccaactcgccgccacactctccctctcccccaaacaccgcaaaaacaaacgcaaacgcgattttcaacaccccaatcccctcacccgcaccccggactccttccgcaacaccttcctcatgtcctcctcctccttcgagtggctctccggcctcctggagcccctcctcgagtgccgcgaccccgcccccctcttccactccctccacctctcctccggcgcccgcctcgccatcggcctctcccgtctcgccgagggccaggactaccaacaaatctccgcccgcttcgccgtctccgaccccgtcgctaaattctgcgtcaagcaactctgccgcgtcctctgcaccaacttccgcttctgggtctccttcccctccccttccgacctcccctccatctcccaatccttccaatccctctccggcctccccaattgctgtggcgccgtcctatgcacccgctttaatatagtagtcaacgccaatagcaccaccaccaccaccaccaccaacgacaaagtctcagtttctcaagtcgccgcccaaatagtcgtcgattcctcttcccggatcctcaccatcgccgccggcttcctcggacacaaatccgattcccaaattctacaagcctccactctttacaacgacatccagcagggaaccctcctaaacgcgccgtgtaatcagtttctaatcggcgattcagagtatcctctgcttccctggcttatggttccctatgcaaaccctgctcctgcctctgctgaagagaatttcaactctgctcatgaaatcatgcggcttcccgcgctcagagccgcggcgagtctaaggaattggggggttctgagtcgaccggtgtgtgaggagcttaagacggccgtggcttacattggcgcgtgctccattcttcacaatagtttgctgatgagggaggatttttccgctctggcttcggagtttgaggattgtaatcaaggttgttatggcgagccttgtaatgctatgttggatggtgaggctgtgtcttccaaggctttggctttgcgtgacaatttggctgccgtggcaaagaaaattcgtgactcgaagaattcttga

SEQ ID NO: 2221 - DNA, 111 bp, Glycine max
  Peptide Sequence Number=SeqID_118999
atgcaagatgaagccatatcaacctggaatatattgccgactgttttttcccagcattacaagatatgtcatgaaggtatccataaaaaggttgtcaagagaattgattga

SEQ ID NO: 2222 - DNA, 609 bp, Glycine max
  Peptide Sequence Number=SeqID_119000
atgtcgttgaagccggcggcgatggacggcgccacagcaattggggaggccggagagggattggaaggattgggagatggaggggaggtcggaaggggaggggaaggagacccagaagcggaagttggtgcagaggacgcggcagagttgcttgacgcagaatttagcgacggggtcggagacggcgaagcgggcggagatttgttggtagtcctggccctcggcgagacgggagaggccgatggcgaggcgggcgccggaggagaggtggagggagtggaagaggggggcggggtcgcggcactcgaggaggggctccaggaggccggagagccactcgaaggaggaggaggacatgaggaaggtgttgcggaaggagtccggggtgcgggtgaggggattggggtgttgaaaatcgcgtttgcgtttgtttttgcggtgtttgggggagagggagagtgtggcggcgagttggtgggagaagaggaggagcgggaggatggaatcagtggaattgtttggagggacggaatttggggggaaagggaaaatgttgtggaggaggagaaggaggagttgggagatgagggaggagagaatggtggctaa

SEQ ID NO: 2223 - DNA, 339 bp, Glycine max
  Peptide Sequence Number=SeqID_119001
atgtgggatgtcgtggaaaatgggaactacattcctatagatgagaaaggtggagagaaccctcgatctgcatggacaaaagatcaccagaccaagtattttctatattcaaaggctaggaacacgagaccatcgaacaattgtttggacaactccaaagtccaaaacattatgaacaatttaaggtctctaaaagagtttgatggaactctccaagttcacgagttggagctgatggaggatgaaggacaaagaaaaggcaagtttattgcctcaaagagtagcaactactgctcaaatcaagcaacaaaagagcattcaaactcactgtgtccgtga

SEQ ID NO: 2224 - DNA, 357 bp, Glycine max
  Peptide Sequence Number=SeqID_119002
atgggatgtcagtgtttattgtggcttgaatcaatagctacaccagttaccaaagacttgtgggataattccattctgaaaagtgaaaccccagtccttgttatattctacgcaaattggtgcggcccgtgcaggatggttcaccggataatagacgagattgcaactgagtatgctgggaaactcaagtgctttatagtcaacacagacactgacatgcaaattgctgaagactatgaaattaaggctgtaccagtggttttgatgtttaaaaatggtgagaaatgtgattctgtaattggtaccatgccgaaggagttttatgtggctgctattgagagggtgctcaagtcgtaa

SEQ ID NO: 2225 - DNA, 273 bp, Glycine max
  Peptide Sequence Number=SeqID_119003
atggaggaattcttcaaaaacatgttgaagaatatttgtttgaaggactacaagagtgagcatagcatggctttatccttttcttatgctatcacaaaaccgtttttgagggtccaagacaaaagcatgaactgtgaacttcagagaccaaaaaatggtgttgtagctttgattaagtgtgaatcaaaagagtcatcaccagagttgccagaaaaaccttccaagttggagatagggtcacccattatctttattgaagctcccaaggcctag

SEQ ID NO: 2226 - DNA, 414 bp, Glycine max
  Peptide Sequence Number=SeqID_119004
atggaagaggcacgtaaaggggagcaagagaaagagagaggagaggaagaagtgaagtaccgtggagtgagaaagaggccatggggtaagttcggagcagagatcagagacccaacaaaacctacgggaaggcaatggttagggacatttgacactgctgaagaagctgctagagcttatgatcgtgcagccattgctttgaggggtgctcttgcaatccttaattttcctcatgagttccattctcatctccctttcatttcatcatcatcgtcttcttcttgttcttctactggtgtcgttggaagttcttctagtgcacaacaaggggaagttattgagtttgaatatttggatgacaaggtgttggaagaccttcttgagttagaggagaagagagggaagaaagaataa

SEQ ID NO: 2227 - DNA, 342 bp, Glycine max
  Peptide Sequence Number=SeqID_119005
atggaatccaaatcaataagtcatgaatgctctcttgaacacacacaaaacacgatcttgccctcgatctcaaaaagcttaaaacaagaaatcccagaagcgcaaagaggaaataaaactaaaaaaaatacctctagttttgtggcgcaaagattgaatcttgggcaaaacaagaggggtttgaaggcgacggggttggtggggcattcgcaaaacgaaggggggacggtgagggaaggcatgagaagaagaagaagaagaagaagaagaagaagaagggtcgatgatggtggctttgtgaagggtaggagacgaggaggtgagagaaaaggaagccattga

SEQ ID NO: 2228 - DNA, 366 bp, Glycine max
  Peptide Sequence Number=SeqID_119006
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 2229 - DNA, 651 bp, Glycine max
  Peptide Sequence Number=SeqID_119007
atgggacctctccaaatgcaagccttccgcaacgtgtacagaaagattttagatttgaccatagcagagatatccacggaagccattgtatcactcacccaatactatgaccagcctttgaggtgcttcatgtttggagacttccaattagtaccgactgttgaagaatttgaggagattctaggatgtccttttgggggaaggaaaccgtatcttttctctgggtttcttccctccttgagcaagattgaagttgtggtcagggattcggcaagagaattggatcgtgtaaagcaaactcgaaacggtgtagtgggcctaccatggaagtacttagaaggcaaggcaagggatatggcgaatcaagaggagtgggtcccgtttatggacatattagcattgctaatctttggggttgtcctctttccaaacatggatggtttggtggacctagccgcaattgatgctttccttgcatatcaccatagcaaagaaagcccggtggtagctatcttggcagacttatttgacacatttgaccgcaggtgcgagaagagtagcgcacggatcatctgttgtttacccgctctttgtgtatggttggtttcacacctattccaacaagacataaggcatccatgtccgctctga

SEQ ID NO: 2230 - DNA, 618 bp, Glycine max
  Peptide Sequence Number=SeqID_119008
atgaacctcatcggactgccgcctgaactcggccttgcctggctgaccgcgatgctggtcggcatttggggtgccgtgccgctcatcttcacacttgtacccgcgtcgtcgctcaccgttgctgatatcaccgttttttcagcgctcatcctgttcgcccatggcctgcccatcgaacagaaaatcattgaaaaggcgggaccgggaatgatcgtcaccacggcgctgcgcgtcggcggcggattgctctatgcctttctcctgcaccagcttctggaagcgacgggatggttgtcaggcccggtaaaccctgcctggattgcgatgagcgccacgcctgaatggaccgcctatttcctcggtctcggtgaaaccatggtctggatgctcgtcatcctgcttgccctttccttttgccttgaaatcctcaggctcaccggcctgctggcgctgatgatgaaagcgctttcgcccctgctgcgtcttgcgggcattcgcggcgaggccgaacatctcaccgccatcggattgttcctgggaatttcctacggcgccggcttcctgattcgcgaggcgcaatcggggacgatatcaccgcgtcaggtgtttctgtcctga

SEQ ID NO: 2231 - DNA, 498 bp, Glycine max
  Peptide Sequence Number=SeqID_119009
atggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgccagtcagacacagttgtgtccgatggcaagcagagaccaagtttggtcattctgcacccaagatacgcggagataccttacggttatctgcaccctcttttgctatggcagacacagtacgtttccgatagcaagcagaggctgacacagtcttctgcaccttttgttcctccggggacaacaaagtcatttacatgcggaaattttatgacaagtaaagaggggcaactgtcataccctaatttcgtccggggacctttgcttgatgacatgcgaccattctttggtcctcgtgaggtgcttggcacccatcattag

SEQ ID NO: 2232 - DNA, 1644 bp, Glycine max
  Peptide Sequence Number=SeqID_119010
atgggacatgacttgtatgaagaacccttgccttctggtggggttgttactgggataggtcccgtgcatgggcgactgtgtatgtttgtggcgaatgatcccactgttaagggagggacctattatcccattactgtcaagaagcacctcagggcgcaggagattgctgctcagtgcaaattgccctgcatatatcttgttgacagtggaggagcttttcttcccaagcaagctgaagtgtttccggacagagagaacttcggtagaatattctacaatcaggctgtaatgtctgctcaagggattcctcaaattgcattggtgttgggctcttgcactgctggtggcgcttatattcctgctatggccgatgaaagtgtgatggtcaagggaaatggcaccatttttttagcagggccacctcttgttaaggctgccactggagaagaagtctcagcagaggatttgggaggtgctactgtgcactgcaagacgtcaggtgtttctgattattttgctcaaggtatttgccgtggatactttctcttgcatacatctgaggatgaactccatgctcttgcgcttgggaggaatataattaagaatttgcatatggctgggaaagatgtcttggcaaatggattgcaaaatataaattatgaatataaagagccactgtatgatatcaatgaacttcgttctattgcccccactgatcttaggcaacagtttgatatccgatcagttattgatagaattgttgatggaagtgaatttgatgaattcaagaaattgtatggcactacacttgtgacaggatttgctagaattttcggacagcctgttggaattattggaaacaatgggattttattcaatgaatctgcactgaaaggggcccatttcattgaattatgcactcaacgtaacattcccttggtcttccttcagaacatcactggattcatggttggctcaagatctgaggcaaatggcatagcaaagtctggtgcaaaaatggtgatggctgtttcttgtgcaaaggtacctaaagtcactataatggttggaggaagcttcggtgcaggaaactatgcaatgtgtggtcgtgcctatagtcccaacttcttgttcctttggccaaatgctagaatatctgtaatgggtggtgctcaggctgctggtgtgctggcccaaatagagaaaggcaacaagaaaaggcaaggaattcagtggagcaaggaagaagaggataagttcaaagggaaagtggtggaggcatatgagagagaagcaagtccttattactcaacagcaaggctttgggacgatggaatcattgatccagcggatacaagaaaagtgattgggcaagaccacgatatgaaagagaacaagcggagtggtgcaccatacatttttataataaaaatgtttcttgtacgtcaattcgtattcccaacaaaatcttgcatgcggattcgttccaaagcaaactcactattgtgcatagatagttcctatgctccaataaaattaaacaacatgtacaacatcaaaggagtgacttaccgggaaaagttgatcaaaatagatagtgcaaataaccaagctattcactgtgttaatttagatcctctctga

SEQ ID NO: 2233 - DNA, 204 bp, Glycine max
  Peptide Sequence Number=SeqID_119011
atggcaagtaaaagtctacagtgtgttaactatgagaggatccattctctaaatgatgaaaatcatcaagttcctgtctcagtcaatagcaatggcattcccaggtcgacatcccctccagaaatcaaactcagaagattgattgttaccatccaagtgtgtgaaacgaatgccaaaaggggatatgaatcgatacagagctaa

SEQ ID NO: 2234 - DNA, 813 bp, Glycine max
  Peptide Sequence Number=SeqID_119012
atgataacttgccaccccgcattctacgacaggcttccaagattttgggccgttaaatcaaatcttcaggtttccagaggactcacaaccagccgggggcctggaactacttaccagtttgctttgtccttggcggagcagctatttggggactctgttgccaatgaggttgcagaatcgatgtttatgagaacagatgatgatcatgcagctaaggagttcaataaagttgaatggtctgttggccaccacacccctagtgtcctcgtaccagttgcacatggttccgaagagattgaagtagtgactgtggtagatattctaaggcgagcaaaagctaaggtcatagttgcttcagttgaaaaatctcttgaagttttggcttctcaaggaaccaaaattgttgctgatatattaattggtgatgctcaagagtcagcgcatgatctgattattcttccagggggaactgctggtgctcaaagactaagcaaatctagaattctgaagaagcttcttaaagaacaaaattcagctgaaaggatatatggggcagtctgctcttcacttgccattctacaaaaacaaggtttactaaaggacaagagggccacagctcatgcctccaccttagacaagcttaaagacaaagaaataaatggtgctaaagtagttattgatggcaaactgatcactagtgagggacttgccactgtaacagattttgcattggccattgtgagcaagctatttggtaatggaagagcaagaagtgtagcagaaggccttgtttttgagtatcctaagaagtag

SEQ ID NO: 2235 - DNA, 729 bp, Glycine max
  Peptide Sequence Number=SeqID_119013
atggatgttcccaaacaacctcctcctcctttatcattaaactcaaaccactcccaaagacaagcacaacagcaccaacaacagccaccaccactttttccaaagccagcaaatgtaacttttgcagctgctcctatgcatttgttgaacaatgcacaacttgctagccctggcagaaggagagggttgattggagttgctgagcattcgatgaatgttggaatggttggtttagccacagctaatgtcacagcttctgcctcaagtaaaatatcacctgatgttattacaaggagtaataatgttgataactctccaatatcaccgcattatgtaatcaacaggggaaggaaattcagtgccatagagaaagtggttgagaggagacaaaggagaatgataaaaaatagagaatcagctgcgaggtcaagggctcgtaagcaggcctacactttcgaactagaagctgaggttgcaaaacttaaggaattaaacagagaattacaaagaaaacaggaagaaatcatggaaatgcagaaaaataaggatttggaccctgcatgcagaccaagggtaagtaaaatacactgcttgagaaggacacttactggaccatggatgatatacaagaaaacacaaaagctttttcgtgttagtaaacgatgcgtattcgtgttttgggaagaaagtaaaggtcttcatgggtcggttcggattgattatgggtga

SEQ ID NO: 2236 - DNA, 165 bp, Glycine max
  Peptide Sequence Number=SeqID_119014
atggcggtgagaatgaaaggggaaattaacattaaaattataattattaccttgggtagttggcaacgttgggagtgtcgtgtcgcagcgatcttgagattggggagtgtggtggagtcgacaagtgtcttgtgttgtgccgcctcgacaagggtcgggatttaa

SEQ ID NO: 2237 - DNA, 131 bp, Glycine max
  Peptide Sequence Number=SeqID_119015
atggagggtcagtggaaggtcatggagggtggtggagggtcaccagaggtagcacagtgtgggaggaagagtaaagaagggaaagttttgataaagagggtagctaataagatcttgcgccttaaattaag

SEQ ID NO: 2238 - DNA, 1935 bp, Glycine max
  Peptide Sequence Number=SeqID_119016
atggctattcctggtttagctcttttaccatcaaagctgacctttttatctgaggctggtttgataagccatgcattgctcttatgctacattgagaaccgatttttcaattactccagcatttactattatggatttgaggacgaggtgatgtatcctagctatatggttgtgatgacaactttattgggtttggctttggtgagaagtctatccgtggatcatcgaattggaggaaaagcagtttggattttgacttgcctcttttcttcaaagctggccatgttgtttatttcatcaaagtccgttgtgtgggtttcagcagttctcttgttggctgtttctcctccattgcttctttacagggatagatcaaaaactactgctaggatgaaaccatggcaaggttatgttcatgcctgtgtggttgccttgtctgtatggttttgccgtgaaacaatttttgaagccctccagtggtggaatggaaggtctccttcagatggtttacttttgggcttctgcatactgttgactggattggcttgtgttccaattgttgctattcatttctctcatgttttgtctgccaaaagatgtctagtgctggtagtggcaactggtctactttttattttaatgcagccacctcttcctgtgtcattgacttaccaatcaaacctaatcaagactgctcgtcactctactgatgatatctcaatttatggctatatagctggcaagcctacctggccttcttggcttcttattattgcaattttgctgactctagcttccattacatctattatacccattaaatacattgttgaattacggacattttactccattgctatgggggttgcccttggtatctacattgctgctgaatactttctctgggctggcattctgcatgttctcattgttgtcactatggtttgtgcctctgtttttgttgtcttcactcatctaccctctgctacaagcacaaagcttttgccctgggtatttgctctacttgtggctctctttcccgttacttatcttttggagggccagctgagaattaaaaatattcttgaagatagcgagataggaaatttgggtgaggaggagaagaagcttacaacattgctggcaatagagggtgcccggacatcccttcttggtttgtatgcagcaatcttcatgcttatagccttggagataaagtataaacttgcttcaattttgcgggagaaggttattgattcaggtggaattagacaaaatcattccggtcaaagtgcatctgctagtttcctgccaaggatgaggtttatgcagcatcgtcggactactacagcaccctcctttacaattaagaggatggctgctgatggagcctggatgcctgctgttggcaatgttgccacagtattgtgctttgccatatgtctagtcctgaatgttaaccttactggtggctcaaaccgctctatatttttcctggctcctattctgctgctgcttaatcaagattcggattttgttactggttttggggacaaacatagatattttcctgttactgttgtcatctcggcctacttcgttataactgccctctacagaacatgggaagatgtttggcaaggaaatagtggatggggtcttcaaatcggtgggccagactggatttatgtggtgaagaatttggccctcctcattcttaccttccccagtcatatacttttcaacaggtacgtgtggagccatacgaagcagagtgactcatccccgtggataactttgcctcttaatctgcttcctattgcttgtacagatgtactcaagattaagatcttgggtatattaggagttatatattccctggcccagtatctaattactaggcaacaatatatctctggtttaaagtacatctaa

SEQ ID NO: 2239 - DNA, 180 bp, Glycine max
  Peptide Sequence Number=SeqID_119017
atgaggattctgctctggttaaaacgttcctctctgtatggtggttcagcagcaagtaacagcggctcgtggtggccatcgatggtcgtggatggtggaagaggagtttctagggtgatctcactaagtgcaatttctctcgggttgggatgtgtgctgagcgcgataattcatgcttag

SEQ ID NO: 2240 - DNA, 828 bp, Glycine max
  Peptide Sequence Number=SeqID_119018
atgtgtgataactggagtgagtatctgaagacaatttacttggaagttgctggaaatatctttttggaccagtcgacgagatggacggatcagcagcacagtctatatattcgttctttagaggcctcatttgtgaatgaattgcatcgatctatgcgtttacatcatttgagcttaaaaaatagcacagatgaagcatataaatgtagatttttgcaaaattcacataatatgcctaagcagtctctggctctacaagatggctgccagaagaagatcaaccttgaaagagttgcacctatgttagagagcacagctgattctcatgttcttgcaggaagtcaattcaaacttacatctgtggatggaggctgtagtttgagagagcatggcttgctttgtgatgaggagattcatgcaagaggaagttcaatatttactctagaaatggcttgcagttctacagaggtcaccgatcaaaacttcaaggatgaggatgccaggtcaagctgcatgcccttggtgaaaaggttgaagacagctacagctgatagttcaagcactgatcaagttgtgccatttggaaaagttcacactccagatgtttcaactagtagtaatgcaagctcagaaaataaaggacatgaattgctatcagaacccccagtgagctaccatttcccaacatctgatctgccatactttttaaggggaagggtttacaaactagggttagggtttgaagcattggaattcctgatacactgtcgtaaaataaaagtgtcttcgtcgcactggcaaaaggcaaaagcgtctccaaatgagtga

SEQ ID NO: 2241 - DNA, 198 bp, Glycine max
  Peptide Sequence Number=SeqID_119019
atgcttggaggggcttctgccaccgccgcttatgccatgggtatggtttctgatgccctcagctctgttgctttcactacttccgctattgtggtcagtgctgctggagcactagttgtgggctttcccttacttaccatagagttgtacggttgtatctactcctcaagcctttgcaatcctattcctacacattaa

SEQ ID NO: 2242 - DNA, 321 bp, Glycine max
  misc_feature (263)..(263): n is a, c, g, or t
  Peptide Sequence Number=SeqID_119020
atggaagacgaccctgacctccaatgcaacgacgacaaacaccaaggcaatggcgccattaacgacgcggatgctgtggagctggtcggggttgctggtgacccaccagagcgcccctcgggtggaagcataaagctgaaagaggaaagggatgaagaagaggagaagcaggtcgcagaaggaagcagcggaagagagaacgagggagtaatgagaagcgacgtggaacaagagagggaccaagacaaggttaagagtgtgancgcagctctcgagtgggcccaatatgaagctgtcacgggggcctcgccgccgtgtagc

SEQ ID NO: 2243 - DNA, 504 bp, Glycine max
  Peptide Sequence Number=SeqID_119021
atggtgcgacagggtccgggcacgacggggctctcaccctctctggcgcccccttccaggggacttgggcccggtccgccactgaggacgcttctccagactacaattcggacgccgagggcgaccgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggtgctcgcgggaggtcagcatacaccccgcgcagcaacattgttacatgtttgcgttggggaaacgatatttgagttccttggcgcacgaagcgccggggtttgtgtttgtcgcgaggacgaggaggccgggcgcacggggcgccgtggtcatcccctccctcccgacggtagatgaataa

SEQ ID NO: 2244 - DNA, 276 bp, Glycine max
  Peptide Sequence Number=SeqID_119022
atggtggttcctagggcatctcatgtcaatcccataattgcatttgccatgcatatcataagtatgcccgagaaagaatgcactttacgacgccgttgccgaatacgtgctaaagccagagtaatgagtgaaatagaagaggtacaagaggggatgaaggccgacatggaggccatgaaagagcaaatggccacaatgatggaggccatgatgagcatgaagaagatattggaggtaaatgcgactgcagctaccgctaccagcaccgttgcatag

SEQ ID NO: 2245 - DNA, 405 bp, Glycine max
  Peptide Sequence Number=SeqID_119023
atggccaggctcctctcgcagccgatgtttcgccaccgcatgacgatggcgccaaggagatattcgtgccgccgctcaacttcgtcatggtcgacaacggcactaatttttagggttggctttcccgattctgccaacttcgaattcctgaaatcactccgtctccgttacgtaatatgtttgtgccctgaaccgtatccagaaacgacttttgaattttttaaggccaacggaataaggctttatcagtttgggatcaatggttgtaagttacttcaaacagtacattggttcaaggccattgatttctatgcttatgtgaatgcaaggttttttattgctacaaccaatgtccttggagataaacaaatatatattcttaataaattatggaaaaggaggtag

SEQ ID NO: 2246 - DNA, 642 bp, Glycine max
  Peptide Sequence Number=SeqID_119024
atggctagtgagaaccttggcttggagcctactctgccgtatttgagtcctctggttgtcggagagaggctcctagttggtgcaaattttgcgtccgcagggattggaattctcaatgatatcgggtttcagtttctgcacatcatccacatctacaagcaactgaagctattcgcgcattaccagcaaaggttgagtgcacacattggtgaggagggagctcggaggcatcactcttggaggcaacgattttgtcaacaattattacctgctcccatattcactaagatctcgccagttttctctcccagactacgtgacctatatcatatccgagtacagctgcctaattctgaggaagtacttttagagaagtttatattcaaacagacccttaatccacaacttgttgaaatgatcaaaggagtcaaccaagagattggcgctcacgtcttcattgctgtaaatgcatatgaaatgcacatggatttcgttaccaaccctcaagcttttgagacctatacgcgttttgggatccatttcagccattccgagaaagctaaccgaatcatagtccaacagatgatgactggctctgccctccctaagttttgttatctgatgatgatttcctctagctag

SEQ ID NO: 2247 - DNA, 438 bp, Glycine max
  Peptide Sequence Number=SeqID_119025
atgtatccccttttccctttaccatctaatcccttatatcagcatggtatacttgttagtattgctagcaaatttatctgctcaagtgaactctctcccaatgctgaatgggatgaatttcaaggtttggaaagaagtcgtagaaactcacttcctgcacactttaggcaattcaaagtgagctataacactctaaaggacaaatggtcccttaacgaacttatatctcagtgtgcaatagaggaagataggcagaaagacagatctaaaagcgctcatttaagtttgacctctcagaataagaaaagaaagaaaattaaggatgatgcgaaagggtcttctcagcaaaagaaacaaaagaaagatgaagaatttagttgctacttctgcaagaagcttggacacatgaagaaaaagtgtccaaagtacgccgcatga

SEQ ID NO: 2248 - DNA, 114 bp, Glycine max
  Peptide Sequence Number=SeqID_119026
atgccggcgaattcctcaccctctagaccttcatttccggtggcaggatctgagatttcacctccagttcccgccattacgggagaggattcaggtcaactagtgaaaaagtaa

SEQ ID NO: 2249 - DNA, 2888 bp, Glycine max
  Peptide Sequence Number=SeqID_119027
atgtcctcactcatcttaccttacacttacacttacggttacgcccgcttccccttcaaactgaaccggttttctccccgaaccgtgacggttcgcgcggcggtttcatctccggacaaacgaggcagaaagaaaaagcaagcaaaggatgacgatagcgcggtcgagaacggcctccggttcagtttcatggaggagctcatggaccgggccaggaaccgcgactctaacggcgtctcggaagttatgtacgacatgatcgccgccggcctcagccccggtcctcgctcgtttcatggcttggtggtgtcgcacgccctcaacggcgacgaagaagccgcgatggaatcgttgagaagagagttggctgcagggcttcgaccggttcacgagactttcttggcattgataaggttatttgggtctaaaggtcgcgccactagaggtcttgaaatacttgcagctatggaaaagctaaattatgatattcgccaagcttggcttattcttattgaggaacttgtttggaacaagcatttggaagatgccaacgaagtgttcttgaagggtgccaagggtggccttaaagctactgatgaggtttatgatcttctgatcgaggaagactgcaaagcaggggaccattctaatgcgttagacattgcctatgagatggaggcggctggccgaatggcaaccacatttcatttcaattgcctcctcagtgtgcaggttgccttcctcgatctggctacctgcggaatacctgaaatagcttttgcaacatttgagaacatggaatatggagaagattacatgaagcctgatacagagacatacaattgggttattcaagcttatactagagctgaatcttatgacagagtacaagatgttgctgagttacttggcatgatggttgaggatcacaaacgtatacagccaaatgcgaagacccatgcgctgttggtggagtgttttaccaagtactgtgtggtacgggaagctattaggcattttcgtgcccttaaaaactttgaaggaggtataaaagttctacataatgaagggaaccatggagatccactttctttgtaccttcgggcattatgtcgggaaggaagaattgttgaaatgcttgaagctttagaagctatggccaaagacaaccagccaatcccctcgcgggcaatgattttgagcagaaaataccggacattagtgagctcatggattgaaccattacaagaggaggctgaacttggctatgagattgattatatttctagatatattgacgagggtggcctaactggggagcgtaagcggtgggtgcctcgaagaggtaaaacacctctagatcctgatgctcatggatttatatattcaaacccaatggagacctccttcaaacaaagatgcctggaggagttgaagttgcacaataaaaagcttctgaagaccttgcagaatgaagggcttgcagctttaggggatggtgtatctgaatctgattatattagagtgcaggaaaggctaaaaaagctcataaaggggcctgaacagaatgttttaaagcctaaggcagctagtaaaatgctcgtgtctgaactgaaggaagaactagatgcacaaggcttgcctattgatggaaatagaaatgttctttaccagcgtgtacagaaagcaaggagaataaatcgatctcgtggtaggcccctttgggttcctcccgtggaagaggaggaagaagaggtggatgaagagctggatgcattaatttcacatataaagctggaggaaggaaatacagagttctggaaacgtcgctttttaggagaaggcttaaatggtgatcaagaaatgccaacagatgcagctgaatcagaggtccctgaagttctggatgacgttgatgctatagaagatgctgcaaaagaggttgaagatgatgaagcggatgatgatgaggaggaagcagagcaggcagaagaggaagtagaaccagcagagaaccaagatgtaaacaggataaaggagaaagaagttgaagctaaaaggcctcttcaaatgattggggtccagttgttgaaagatattgatcaacctactgccacatcgaaaaagtttaaaagatctcgcaaagtgcaggttgaggatgatgatgatgatgattggcttccgctggacctatttgaggcatttgaggaaatgaggaagcggaaaatatttgatgtgtcagacatgtatacattagcagatgcttggggatggacatgggagagagaactgaagaagaaacctcctcgtagatggtcacaggaatgggaagttgagttggcaatcaaagttatgcagaaggtcatagaattgggagggagaccaacaataggagattgtgccatgatattgcgtgcagctataagggcacctctaccttcagctttcttgacaattttgcaaaccactcatagtcttggctttaagtttgggagtcctctttatgatgagatcatctctctctgcgttgatcttggggaactagatgcagctgttgctgttgttgccgatttggaaaccacagggatctcggtttcagacctgactttggatagggtgatttctgcgaaacagaggattgacaatacctccaatggtgtcattacggatgcaggattcaacggaaggctcccagcctcccactgttgccagttgcaacgacaatgcttattcattccaccaacacgaaatgatgctgttgaaaatttaacgtcaccaacaaccaataactcgggtttcacggtggataagaaagtggtcgtgttgtcaagacccggtccacttcattggctgattcaacttaatgatgctcttgactttgttgatag

SEQ ID NO: 2250 - DNA, 297 bp, Glycine max
  Peptide Sequence Number=SeqID_119028
atggacctccacggcaaggttggcagcgacaaaggacgtgcgcgacgtgaagggaaggtgctccacgaagcggcgaacttcatcgttcgcttcgcctttgcgaatcctgacaccatcgcgtgcggtttgtcaaataacgtgcggacatatgcgccgcggttgagcgattgtaaaatccaaacgataaaggcttccatggaagtatcagagagtgagtgcaagttgaggatgattatgccaacgatcttggaggatccgcgatgtgatgaagaagacattgttggaggtgtagagtga

SEQ ID NO: 2251 - DNA, 699 bp, Glycine max
  Peptide Sequence Number=SeqID_119029
atgaaggttttttacttcttcgttgtgctattggctttggcatcctccgttgcctttggttatgatccaagccccttgcaagacttttgtgtggctatcaatgataccaaaactggtggtctatatggagtgttcgtgaatggaaaattttgcaaggatcctaagtttgcttatgctgatgatttcttctttggtggattgggacccggaaacactgcaaacccacaaggatcaaaggtgacagctgtcacagttaatgaaatattagggctcaacacacttggtatatccttggcacgcatagattttgcaccaaagggtttgaaccctccacacactcaccctcgagggacagagattcttgtagtcttggaaggtaccctctatgtcggttttgttgcgtccaatcaaaacgacaaccgtttattcaccaaagtgctgtacaagggtgatgtgtttgtgtttcccattggtctcgttcacttccagcagaacataggttatggaaatgctgtggccattgctggtcttagtagccaaaaccctggagttattaccattgcaaatgctgtgtttggatctaaacctcctatctctgatgaagttctcgccaaagcttttcaagtggacaaaaacgtaatcgactaccttcagaaacaattcgggtacaacaacaaagttaacgggaaacataattaa

SEQ ID NO: 2252 - DNA, 639 bp, Glycine max
  Peptide Sequence Number=SeqID_119030
atgaaacaccttacaagcatcagcaatatccctgcatttcctatacatgttgatcaaaatggtgcccttgtagagatcatggtcaatgctgcacagaaacgcgaaaccatgaagcaattttccctcccttaccttgcatgcaccagaataggccttaatgacaaaagggtaggtgaagctataggggagttccccatgtgccttcatgcgagcgaagacggagagggtgtgggaaaagagattcttttggcagtgggatttgacgagagtgttccagaggaaggtgggaagggcgagaacgtggtagaagatggaaaaggcataggagaaagtggagaggagggtgtgggcgcaggaaatgaagagggaaacgaggaagtggtcttgctcgagggcgtgatggatgacgcacgcttgcatttgtttcaggtgctcacttttcttgctggctttgaggagggtgctatatggatccgtattttgactgccgttgccaccgcaatactcaccaccacgatgaaggcaatgcagccaagaaaaattctatttttggtttgggctacttcgtttctgaacatggcccagcccaatccttctccaggatttgcttccatattttatttcggtcccaacaactag

SEQ ID NO: 2253 - DNA, 620 bp, Glycine max
  Peptide Sequence Number=SeqID_119031
ctgtcacggggggcctcgccgccgtggtagcgtgcttcgtgtttggccttgaaggaggaaacacgagggacagagaagagccagtagaagcaacagttgaagccggcgaggtagtaggcggcgttgttcatgccgagggcggcgatggaggcccaggcgaagagggcggaggcggagatggggaggcaggcgaagaggaggcgctccagggtgacggcgatggaagggttttcgaggaggagccacttgaagttcagggaggaccagacgccgaggaggaaggtggtgtgagcgcagaggaaggaggccaggacagcgacggcgacggaggagttgaaggcggcaaagagggaggaggaggaggagaggaagaaggcgagctgggagaagatgagggagaaccagacggcgaagaaggcggcgggcttgaggttgagggagtcgaggatgtaggagatcatgaggccgacgagaagggtggcgaccacggtggtgccaccgaggtccaggaggaagagggcggaggggagcagggggatggcgatccggtagttgtgggcgaaggaagaaggggttttgagggatctggaagacgaggtgttgccatgggcgtgaagtga

SEQ ID NO: 2254 - DNA, 351 bp, Glycine max
  Peptide Sequence Number=SeqID_119032
atggggcggggttggtggtggaaagtggcggtgttggcggtggtagtggcggtggtgtggagagggtggcaggtgggtggattggagaaggagtcagcgttcaattttgtcagagaatggtcggagaagttagggatttgggcgatccctctctacgtgtcgctccacaccgtctccatcgctctgtgtttaccctctgcgatcttcttcgaaaccgccgctcctctcctcttcggtttcttaccttccgtcttctgcgtcttctccgccaaaatcctcgcagcgtcactctccttctccatcggcaggctttatgccttttcgtgggcatcccttgtacaaatattctaa

SEQ ID NO: 2255 - DNA, 144 bp, Glycine max
  Peptide Sequence Number=SeqID_119033
atgaagatggcaaggcaggtgaagaagcacatgattgagttcaagttccattcaaataggatttgttcaaggttgtctataattgacctcaacaacaacaagactggagaggtggagatgcttgctaaagccaaagaaaaataa

SEQ ID NO: 2256 - DNA, 483 bp, Glycine max
  Peptide Sequence Number=SeqID_119034
atggccacttaccggtttggaaccatatctaatattttcttgttaatgaggctggtattcaggagttcaagctcagcaatggagtgggcccaaagaaacagatactttcatttaatctctagaggagttgagcgagatggttggaaatttgttcttcttgcccgcttctcgcctgtgccctcttatgttattaactataccttagcggctactgatgttaggttccttttggatttttttcttcctactgctattggatgtctccccatgatcttgcaaaatacatctattggaagccttgctggtgctgctgttgcttcagcctctggctctaagaaatctcaaatttggtcctacttttttcctgtagttgaaatgctgttgcatagcgtaaatgcgcgtaacaggtggcttcattggcatttaagaggaaccacccgtcccatccgtcattatcatgtcatggggcttaatgaagcttaa

SEQ ID NO: 2257 - DNA, 258 bp, Glycine max
  Peptide Sequence Number=SeqID_119035
atgaagccatatatatctttaggtgaaagagagtacagtaggagattatatagtgatagacagtatttcagcacaagaggctcttcgctatgcgaaggtatgggggagggatgttgtacgcagccttacccttgcatatgcaaagaggctgtttccggattcgatcctatgaccaacaagtcaccaaggcacaactttaccgctgcaccagggctcgccctcatttcagcacaaggtaattggccaatttttgcttag

SEQ ID NO: 2258 - DNA, 495 bp, Glycine max
  Peptide Sequence Number=SeqID_119036
atggacgaatggaagagagacggacacaatattccagcgtttgggaactgggatttcaccgacgagtttccaatcacttgttatttcgagtgtgccacaccggcccgtcttcataacaaacctcgtcctctccgaaatcatatcaaacaggaaacgaggaacaaggagaggcggtgccgacatgttaatggtaatgctaacaaaggaaaattgtacgacgtaagggaacagcaaaggaagccaattagaataagcaagcatgtgcaggtgcaacaatacgacaccgttccacgaactcctaaacctgttgacgaagatctctataagatccctcccgaactcctccacactaccaacaaacggtggagtgaatgtctaacgttaattaatagtcaaggcacctgttggtggcgactggctgtggtgaagttccttgtcgtgtctatttttttgttggaatcatacacttggcactttggtgggattgcacattga

SEQ ID NO: 2259 - DNA, 1860 bp, Glycine max
  Peptide Sequence Number=SeqID_119037
atgaattgcttcccttgttgtggccctaaaaaaagcaatagcaagagggagcatggttctccacccccagaacttgttacagcaaaagcacaagatatgaagaaacaaaaagcagacgaacaaaaccaagctggcactgccaatattcaggcacaggctttcagtttccgtgagctagcaactgcaacaaagaatttccgtcaggaatgcctacttgacgaaggaggtttcggcagaatctacagagggataattcctgccaccggccagcttgtggccgtgaagcaactcgaccgaaatgggatgcaaagcagtaatgagtttctggctgaggttgctgagctaagtctcttgcaccatgaaaatctggtcaatctcattggttattgtgctgatggagatcaacgtcttttggtatacgacttatttgctgcgcgtactcttgaaaatcgtctttttgagaataaaccggatgaaggtccattaaattggtttgacagaatgaaaatagtagtgggtgcttctaaaggactagagtacttgcatgagactaccaaccccccgcttatattccgggacttgaaagcgtccagcattttggtggacagtgatctccttgcaaaactatgtgatgttggcatggccaagctttctggtggagacaagataaacaatggacctccaagacttatgggtacctatggtcactgtgctcccgagtatgtaagagctggtcaactcaccatgaaatcagatgtatacagtttcggagttgtcttgctagagctcataactggacgaagagccattgacaccacaaggccaaacgaagagcaaaatcttgttgcatgggcaacaccattatttagggatcccaagagatacccagacatggcagatccacttcttaataagaactttccagaaaaagatctgaatcaagttgttgcaatagcatccatgtgcttacaggaggaagcagaagctcgtcctttgatcagtgacgttgtaaacgctctcagctttctatccgcgcctcctcctcctgctgctcctgtccctaaaaagagtgatgttgctgaaagcgaaagggaaagcgagagtgagagtggaagcgaagcaatatctagcaagggaagccgcagatcatcggtggatgaaagccaacatgattctgatagccatcttccaccagcggtttcctcaaaaccaagccgcaaaagcagcaccagatcaagtaagggagcactcagttcagaatcaggagatgaagttagcgtttcttccagcagcaagagcagtaggaaatcgcacggtgatttaagccacaagagcagcaaaaaatcttcagtgaaagatttaagccagaagagcagcaagaaatcttcagtgaaagatttaagccagaagagcagcagaaaatcttccgtggaagatttaagccagcagaagagcagcaaaaaatcctctgtggaagatttaagccagaagagcagcagaaagtcttctactaccaaagacttaagccagaagagcagcagaaaatcttccatcagagatctgagccaaaagagaagtagaaaatcttctagcaaagttttgagccataagagtagcatggcatcggatgatggaagcatttcctcatcaagctgccgtagcagcagtgtgggatcagagcgtagcagcatgaggctatcacaagggagttttcactcagacccatcatatagcagcaaaaggaaagaggatgagagcatgcatttattagaccgtgcaagcagcttgcgatctgatgaggatagtggtcacccttttgaccaaactagcagcagtggatcaagtgtttattcgagataa

SEQ ID NO: 2260 - DNA, 1332 bp, Glycine max
  Peptide Sequence Number=SeqID_119038
atggtgacagaggagaaagtacatgcactgaaagacaagttgcgggagtcggtcaagattatcgtggagagtgatgactacaccgtggacgccgcggacgaggccatggatgctctttctgctctcaaggatttgaaatgcaccacttctctctctcgcaacttggacgatgcagctgttcctccacactttcgctgccccctctctggaaatttgatgacagatcctgttatcttggcctctggacagaattttgatcgggctttcattcagaggtggctgaacgaggtccgcagaatttgccctaagactcagcaagtcctctctcactccatcctgacccctaattgctttctccaaaacatgatttcactgtggtgtaaagagcatggagttgagcttccaaagcccgtttgggacattcacggtgaaaaattagccgaagatcacagactccatatgcgttctcttctctacaagctatcactttctgtctccgaacaaaaagaagctgcaaaagagcttcggcagttaacaaagcgaattccgacgtttcgaacactctttggtgactcagaagtgattcaactaatgctgagacccttatcacccggcacggcctccgtggaccccgagctccacgaggacttgatcacaactcttcttaatctctcaattcacgataacaacaagagggtcttagcagaggacgaaaaggtcatttcacttcttatcgaatcgttgaaatattcaggaacagttgaaacgagaagcaatgcagctgcagccattttctcaatgtcagctattgatgcaaacaggcacataattggaaaatccggagttatcaaatacttggtggatttattagaagaggggcatccaccagcaatgagagatgctgcttcagcactgttcaagctatgctacacgcatgaaaacaaagggagaaccgtgcgagaaggtgcagtgcaggttattctcggcaagatcgttgaccatgttttagttgatgagttgttggcactgctagcacttctctcttcgcatcacatggctgttgaagcattggtgaaccatggtgctgtaccattcttgttggatatcttaagggaaaaggaaaacacatcagaagaacgcatcaaggaaaactgtgttgttattctgtgcacaatctgtttcaatgatagagaaaaaaggagggaaattggagaggatgaaatggtcaatggcacactgtatgagcttgcacaacgcgggaattcaagggcccaaaggaaagctagggctattcttgaaagtctccacgtgtctcaatcctctactagctag

SEQ ID NO: 2261 - DNA, 1609 bp, Glycine max
  Peptide Sequence Number=SeqID_119039
atgggctatgagctccttgactcttaagggtaaaccttctgatcatgctccagttgcttctgtcagttctagtgcacgtactccaacatcttccaatgccagcccagctgtagatgctccttcaacagcacctgttcgtgttagctccacaccagattttgctgaacaccttgtccctacatccccaacgtcaacagatggctggggggaactagagaatggactaggtgaaaatgacaaggatgggtgggatgatctggaaccacttgaagaaataaagccaactccagctcttgtaaacattcaagcagctcaaaggaggccagtttctcaacctgtttcacagataaaacaagcctcaagtttgctatccaaaagtacgccaaagttgagcaaggatgaagatggtgatttgtggggttccatagcagctcctgctccaaaatcatcaaaacctttaagtttgaagtcaactgtaactgacgatgatgatccttgggcttccattgctgctcctgcacccactactaaggccaagcccttatcagctggtagaggaaggggtgctaaacttgctgctccaaagttaggtgctcagcggataaaccggacaacatcatccgggatggaaatcttaagggcagcaatagttgaattattccagggcaacaaggctatggttgaggagttggcttttcttgtcaaggacaatcttccttgcaagcatttagttctcacaatggaagaagcactggttaactttcttcaggatgatgacactagttcagatggaatcttggaattggagccaatgaactcttacaaccgtcttttattgcatcgccttgctgagatatttgggtttgcacatgaatcggttggtgaaggagatgatcgccatttgattctggaaagatgtccagatacgtccatacctccaatccttgttagtgatatcctatggaagtatgatgaaccacaatctttggttacatcccaccaaatattaaggagaagtgtagcctctccagtctcgcagaaaaacacagcatccctttcacagtcactggaggagagaaaagcagcttatttaattgcccgtgagcgaattttctctatgaagttggaagaggtaaaagagcctggtgaacaaaagccgcggagtgtgcctgtggttgcccgcagaatgattgcccatgcccttggtcaaagaatccatacaaagaatcagaatgacttggctagtgatagtatgaaggatggagtcctcacagatgaattgagtgcacaagataagaatcaggaagagtccactctcaagaaagtttctgaagagtcttcacacctaagagggaattcaaacaacagaataagaaacaacagttctaatgcagccacacttaataaaaggaaggatcaaacaacagttgacaaagatttgccacaattctctgcagaaagaaaacaagggctaagtgtaagtaaagactacatgaaaaaggagcacttgggagctgcaaagagaatgtttgctcatgctttaggagtgcattctgggaaggatggttctgttcctagaagtagaagtggagaaataaagaagaattag

SEQ ID NO: 2262 - DNA, 1713 bp, Glycine max
  Peptide Sequence Number=SeqID_119040
atggaattggaagaagcagaagatgaagaatggtatactactagtagtaaatactcgttcaaaaataatgctggaaatggttgtaaggtgaggaggtggttgctcaaaaggggactctgtctgggaaggaagatcttagtggctggcttcttagcttctgctgccccggtggttgttccacctcttgtggttgcttctgctgttggcattgttgtttctatgccttgtgctattttcttggctagccatgcttgcactcagagtttaatgagtaagttgctccctaggcctactcctcaggatactttgttgcgtgaagagatgtgttttcagacaggcaatgatgttatacacacatatgaagaggaacaagtccttgtatatgaaataaagagagacattgaaatggttggtgttcaatgtttgaagaatggggaaaatatgacatcagggagtgagtgtggtccacaagaagaagatgccaccgatggaatagaaggacactcaagaggagaaactaatggggtgcaagtgcaactaataagtggggataaaaatgtagttgtgacaatgattgaagaatttaagactccctttgatgttacaactgtggttttagaggaatccgaggatcaggccatggagggtgacatagaggaagcagagttacaaagagaaacaaaggggctgttagaaaaaattagagatgaagctagaactgatatgacacgggagagaggagaatatgtagaaggaatatgtggaggggcaaatgaaagtgataaaaaatttggtccagctgttgaagatatggaggtagcatgggaagacacacatagtggtatcgttgaagaagacttgggaaaggaacaagatccaaatgtatgtgaagagatgcttcattcaagaaatgatgaaagtaaggatactatgttagaaggaaaagtatttgataacacaaatgattcacataagccaatggctgaaccttctgaactgctgattccagctgaaccaattggagatttgcctatagaagcgctggtttataatatttcagttgaggaggactcgtctgaaaatattgacatacatatagttgccaaagaggaacaggagcctccgccggattgtcctactatactgcaaaatgagaagttagataataacaattctgactttgaaaatcaagaatcacagctgcatgaattaaataaaaggacgtacccgctagatgcagaagctatagaaattgctaatgaaggtgaagttgatttgtttgatggaaaacggatagaccctgacgagtgcggatacacaatttatttgcatgaagccctgacatctgaattaatgaatatgcttgcaggatcttcaaaagttgatgggcagacagattctacggaggttcttgtttcgtctgtagaagaagagtccaggccatctgaatgttcctctggagaaaacattgtttgcccttctcaagaggttgttgtattggatgaggagaagatatggaaagcgatgaatattatacgtaagatagtaggatatgaaggtagaatgcaaggatcatgttcagatgaattaaaggctctctacatcttcactggagttgagcccccaactggtactctcgatgaccccgctgaaatcaaggagaagctccacttccttatgtccatcgttggaattaagtcgaatgatgcttag

SEQ ID NO: 2263 - DNA, 2181 bp, Glycine max
  Peptide Sequence Number=SeqID_119041
atggacaagtccctgatgcctcaagtctttgcaagccatcacgattggtacgaatccaccattcattccataaacttagcaacagctgatgatccctctgagcaacagaaattagtgtacacttacgatgatgcaatgcatggattcagtgcagtgctatcatcagaggagttggagaccctaaagaacactcatggttttgtcacagcttaccctgatagatctgccaccatagacaccacacacacctttgagtttctctcttttaatccctccaatggcctgtggaatgcttcaaattttggagaaggtgtcattgtgggtatgattgacacaggtgtctggcctgaaagtgagagcttcaaagatgatggcatgagcagaaacatcccttccaaatggaaaggaacatgcgagccaggacaagacttcaatacctccacgtgtaacttcaagttaattggggctaggtacttcaacaagggtgtgaaagcagcgaatcccaacatcacaataagaatgaactcagcgagagacactcggggacatggaagccacacatcatccactgttgctggcaactatgttaatggtgcttctttctttggctacgccaaaggggtagcaagaggcattgcaccaagagctaggcttgccatgtacaaggtcctttgggacgaagggggtcacggctctgatgttcttgcaggaatggaccaagccattgctgatggggttgatgtcatttcaatctcattgggctttgatagtgttccactttatgaggatccggtggcaatagctgcttttgcagcaatggaaaaaggggtgttggtttcatcttcagcaggaaacgcaggtcctatacttggcaccttgcacaatggaatcctttgggtcttaaccgtggcagcaggcaccatagaccgcacatttggaagcttgacactgggagatggtaaaatcattgtgggttgtaccttgtttgctgctaactcaatagtggagaagtttccacttatttacaacaagactgtatcagcatgcaactcggttaaactattaaccggagtagccacaagagagatcattatatgtgatgccttggactcagtttctgtcttaacccaaatagcttctgttaccgcggccagtgtgtatggggctgtgtttatctctgaggatccagaactaattgaaagaagacgtttgttcactccaagcattgtgatcagcccaaatgatgcaaaatcggtgatcaagtacgcgaaaagtgctcaaaaaccatttgccagcatcaactttcaacaaacatttgttggaataaagccagcaccagctgttgcaatttactcttcaagaggtccttcaccaagctacccggggatcttgaagcctgatgtaatggcacctggctccaatgttctggctgcttttgttccaaataaaccttcagccagaattggcacaaatgtgtttttgtcaagtgactacaatttcttgtctggaacatgcatggcatgtcctcatgcatctggtgttgctgctcttttgaaagcagcacaccctgattggagtgcagctgctataagatctgcattggttacaactgctaatccccttgataatactcaaaatccaatcagggataatgcaaacctatttcaatatgcttctcctcttgctatgggagctggtgagattgaacctaatagagcacttgatcctggtctcatatatgatgccacccctcagaactatgttaacctcctttgtgctttgggatacacaaacaaccaaatcttatccatcacaagatcaaggtcctatgaatgttctgccaacccctcatctgatcttaactacccttcgtttatagttttgtatagtaacaaaacaagatcaacagtccgagagtttaggaggatcgtgaccaatgttggagatggtgctgctacttacaaagtcaaggtgacacaacccaagggctctgttgtcaaggtgtcacctgagacattggcatttggctataagaatgagaagcagagctactctgttactgtaaagtacacaagaaacaagaaagaaaacatctcatttggggacattgtttgggtcgaagatggtggtgcacgcacggttagaagccccattgtagtggcacccaatgaacttgcatga

SEQ ID NO: 2264 - DNA, 912 bp, Glycine max
  Peptide Sequence Number=SeqID_119042
atgacacaaagcgttgtcgtagacttcaacaatctccccgaaggttgcatagcaaacattctctccttcacatctcctagggacgtgtgtagactctctttgctttcatccactttcagatccgccgctcaatccgacgctgtctggaacaagtttttgccttcagatttccacaccatactttcccaatcttcctctttatctcttccttctaagaaggacctctttctctatctctgccaaaaaccgctcctcatagacgatggtaaaaagagctttcaactggataaagtatacggtaagaaatgctacatgttatcagcgaggaatctcttcattgtatggggagacactcccaggtattggcgctggacttcgcttccagatgccaggttttctgaggtagctgagctaaggagtgtgtgctggttggaaatccggggctggatcaacacggggatgctgtccccggagacattgtatggggcgtaccttgtgttcaagccaaacccttctggattctacggcttcgattaccagttagtggaagtgtccatcggaatcgctggcggcgagaatcgcaagcgaaacgttttcttggacgccgaaagaggacggaggctaaggtaccagattgttcctcgccgtgccgggactgggatattcaaccgtgcacgtttccttgcccctgttgaggcaccccctgtagaagataacgatagtctcgatctccagcacccaaaggagagagcagatgaatggttggaggtggaattgggagagttcttcaacgatggacaagaggacaaggaattggaaatgggtgtttatgagatcaagagtggtgattggaagggtggccttcttgttcaaggaatcgaaataaggcctaaaaggacgcccataaattaa

SEQ ID NO: 2265 - DNA, 885 bp, Glycine max
  Peptide Sequence Number=SeqID_119043
atgaagccacatatcagcatgtttagattaggtgataggatattcttctccccctacgggaagcaggagagcagtggaactactacgataaatttgctgccggagggatgcatctcatacatactgtcctacactacacccgtggatgcatgcaggctctccctcgtttctaaggccttccgttcagccgctcaatccgacactctatgggatcgttttatcacctccgctctatcctctctcgtttccccttcttccttcccttcctctcactctaagaagcatctctatttcgctctctgcgaccgtcccatcatcatccacaatggtacaaagagcattcaattggacaaaaggactgggaaaaggtgttacactctttccactagagtacatctcatcgactctgagtggggtctggctcctcttcaatgggagcacatacgcctgccaaattccaggttccaacaatttggtgtgcttgttagcgctcctgaggcctggtttgacattagtgggaggataaaagccctttccctgtccccaagaactgaatatgcagcttttcttttgttcaagatggtctatgccacgcccaccgaagttcattaccatccttgggtgttgggctatttagtaattactcttccagacagtagcagtgtgaggacaatagatgtttgtttgctgaagaacttacagcaacattcttgtgtgagaagaagcgatgggtggttggagtttgagctggtagggttctttgatttgggcctagaagatgaccaagtgcagataatcaaagtcactgacacaaggcctaatagcaactggaagcacggtttcattctcgaaggaatagaaattaggcctaaacatgtctattaa

SEQ ID NO: 2266 - DNA, 993 bp, Glycine max
  Peptide Sequence Number=SeqID_119044
atggaaattcttagtttgaaagatagtgttgagaaagacaccttcttccgcaagcttccaaatttggcagaacagcttcctcagcagattgtgttgaaaaagttacttcctttattagcttctgcgcttgaatttggttcagcttctgcccctgctttgactgcattgctgaaaatgggttccagtctttctgctgaggagttccgtgtcaaggtgcttccaacaattgttaaactttttgcatccaatgaccgagctattcgagttggccttcttcaacatattgatcagtttggggagtcattatcagcacaagttgttgatgagcaggtttaccctcatgttgcaactgggttctctgatacatctgcttttctgagggaacttactctcaagtccatgctaattctggctccaaagctgtctcaaaggaccttttcaggatcattattaaagcatatgtcaaagttacaggttgatgaagaaccagctatacgaacaaatactaccatcttattgggaaatattgcaagccacttaaatgaagggacaagaaaaagagtgttgataaatgcatttacagtccgtgctttacgtgatacctttccccctgctagaggagcaggcattatggctttatgtgcaaccagttcctactatgacatcacagaaattgctactcggattcttcctaatgttgttgtactcacaattgatcttgatagtgatgtgcgatctaaggcatttcaagctgttgatcaatttttgcagatggcgaagcaacattatgaaaaggattgttgccatgggcatacagctgaagacttacctaatacaaatacagcagaggctactgagggtacagccattggaatctcttcacttccaggaaatgcaggtgccacatataagtggaggacaggcgttgctgaggattacagagtgagagtggatagtaatgatcagaagcttacagttacgactacctattga

SEQ ID NO: 2267 - DNA, 203 bp, Glycine max
  Peptide Sequence Number=SeqID_119045
atggaggaggtttggtgggtgacgatggtgctagtgacgacagtgggtggtgattcaagggtaatgacaatggtggttggttattggctgacaataacaatggagaagtcgttggaaatcgcctctgacgacaacgtgcaagataatgctgaggttcacatgaaagaaagctggaggaggaatgatagtgtagaaaatccaat

SEQ ID NO: 2268 - DNA, 351 bp, Glycine max
  Peptide Sequence Number=SeqID_119046
atgaccttgttggtgatatgggcagtgttgtcaactttgctcgtagatcttacaaagcatcatgcacaggaagggagagtgcgcactagatctcggtgcaatagcgttgcggatgggaggcgaaacaggatcttcacttcgcagatgatggaattagggaagacgttggagcaatgcgagaagtgttccatttgggttgtgagggagtcgattggggcaaagggaggtggcgagaggatggtggcacgaggagaggggggcgatggaggtgggatcaaaaagaaagggaaagaagaatatggaagagggatagagaatgagaaagtatatggtgcgggagatgcatcatag

SEQ ID NO: 2269 - DNA, 852 bp, Glycine max
  Peptide Sequence Number=SeqID_119047
atgatctattttgtgactgactctgaaacttcctttcaaaagggtgatgtacatggtcaatattctgatcttttaaggctttttgagtatggcggactacctcctgaggccaactacttatttttgggggattatgtggatcgagggaagcagagtttggaaacaatatgccttctcctagcatataaaataaaatatcccgagaattttttccttttgaggggtaaccatgaatgtgcttctattaaccgtatatatggattttatgatgagtgtaaacgaaggttcaatgtaaggttatggaagacatttacagaatgcttcaattgccttcctgtggcagcactgattgatgaaaagattttgtgcatgcatgggggtctttctcctgacttgcttaatttggatcagattagaaatctacaacggcccactgatgtgcctgatacaggtttgctttgtgatctcctctggtcagacccaagcaaagaggtccaaggttggggaatgaatgacaggggagtttcatatacatttggtgctgataaggtctcagagtttcttcaaaaacatgatttggatcttatttgtcgtgctcatcaggtggtggaagatgggtatgagttctttgctaaccggcagcttgtaacaatattttcagcacctaattattgtggagagtttgacaatgctggcgctatgatgagtgtcgatgagacactaatgtgctctttccaaatattaaagccagctgataaaaaagtaaagctcaacttcggaagtactactactactaagccaggaaactctccagcaggcgtaaaggtatggagatatcttgatatctgctga

SEQ ID NO: 2270 - DNA, 1317 bp, Glycine max
  Peptide Sequence Number=SeqID_119048
atggagaccaacaacaacctcaacctcatcgtccctaatcctcaagattcactgtggatgatgaatttgaggactggggaaacaatggattctggatcttatccggagcgtccaggggagccagattgctcatattacatcagaacaggcctttgtagatttggtgcaacatgtcgatttaatcatcctcctaacaggaggctggctattgccactgcaaggatgataggcgagttcccagaaagaatagggcaaccagaatgccaggcacgaacgtgcaaatttggagccacatgcaaatttcatcatcctaaagatcaggctgggattgctggaagagttgccttaaatattttaggctatcctctccgccctaatgagcctgaatgcacttattatttgagaacaggacaatgcaaatttgggaacacttgcaaattccaccatcctcaaccaagtaatatgatgctctcattacggggttctcctgtttaccctaccgtccattctccaactacgccaggtcaggagtcatatgctggaggaattacaaattggtcaagaggatcatacattcctagtcctcgctggcaaggtccttcaagttatgggcccttaattctacctcagggagtggtttcagtgccagggtggagtgcatacagtggtcaaatgggatcaatctctacttcagacagtccacagcaagcaatgagaaatggtcaaacatatgaaacttctcatcaaggtgagctagcaaatgcaggatcacaaggggcatattctcaattccgttctggcactgttccagtagggttttatacactgcagagggagaacatatttcctgagagacctggtcaacctgaatgccaattctacgtgaagacaggagattgtaagtttggagcagtctgtcagttccaccacccgcgagagaggctaattcctgctcctgactgtgtcttgagtcccataggccttcctttacgtctttgcaatctgatagaggcagtgtcccatttcttacagggagaacctttgtgtgtcttctattctcgttatggcatatgcaaatttggcccaagttgcaagtttgaccacccaatggaaattttctcttacaatatcaccacatcaccttcagctgatgccccaagcaggcatttgttaggatcttcatctggaactgctgcattgaatttatcttccgaaggacttgttgagtcaagctcagcaaagcccaggccgctttcattatcagagataagacagattccttctggtgatgataacattgatgatgatgtagcttga

SEQ ID NO: 2271 - DNA, 1066 bp, Glycine max
  Peptide Sequence Number=SeqID_119049
gattcatgttcttccaaatttcatgcagccgaaactatcaagctggaaaatggacacagcagtggacgcagatcagaatgtaatagtggacccagtaattgataaatgcaagaaccagtgcaggcctagtggaagtgaggcattacctgcaggcatagtctccatcacttccaatttggaattgcgacctttgtggaatcctcccatgcctaagaagggtcgtcacacaatagaacttaaggtaaatgcatcaaccaatttgtttgcaatggtagttgggataaaacagaaagatcttgtgaacaagatggttaaaaagtttatagacagtaatttcgtcgtgatgctcttccactatgatggtattgttgacgaatggaaggatctcgagtggagtagtcgtgtcattcatgtgtcggcaattgatcaaagcaaatggtggtttgccaaacgattcttacaccccgacatagttgcagaatatgattatattttcctttgggatgaggacctaggagttgagcattttcatccagataagtatgtttctatcatcaaacgtgaaggactggagatatcacaaccagcactggaccctaaaaaatcagaagtgcatcatcagattactgcacgtgggaggaggtcatcggtgcacagaaggacatatagagctagtaatgatggtaaagggtgtgataaaagcagcactgccccaccttgtacagggtggatagaaatgatggctcctgttttctcaagagctgcatggcgttgtgtttggtatatgattcagggtgatcgaacaaaaaaagttggtgttgtggatgctgaatacattgtccactacaatcgtcccacccttggaggcatagataagactatggtttcatctcaggaaaaggatcatagagttgatgtgaggagactttcttaccaagaattagatatctttagaaaacgttgggaaaaggcagttgaggaggataaattgcttgatcatggtcatgacagagaaagcttagaggatctcaaggacaacatgactcctggaataaagttgtcttaa

SEQ ID NO: 2272 - DNA, 135 bp, Glycine max
  Peptide Sequence Number=SeqID_119050
atgaagcaagctatttgctctgcaacatacgaatattatttatcttgggactcgtgtcatgaggcaaagataccaaatattgaaaagtgcttagacgttgttactacattgaaagctaagaagggtactagtgag

SEQ ID NO: 2273 - DNA, 342 bp, Glycine max
  Peptide Sequence Number=SeqID_119051
atgggagacagaatggaaaggcttgtcattcttcctttctcttttggttgtgtctctgaggccagtattgttgtaggtagtcctcatccaagaagatcaagatcagacactgattcaccaactgcagcaacaaaaggaccaaaaggtgacaaggatatttcagagagtttgtctggtgaaagcatgaggaacttgctgaggtttcatgaggatgtccagaaatctaaaacattccttagcttcaataggctgttgaagggtttcaagaacattcctcagttgtttggtgagtataagcttaatttgaaaccattcattctttctgtgataatgtatgcttaa

SEQ ID NO: 2274 - DNA, 351 bp, Glycine max
  Peptide Sequence Number=SeqID_119052
atggtgaagtttccatttgatcttaatgctaaacctgatgatgaggaggaagcaagtgccaaagttggtggagggagtgaaactaagctctctgtgtctgaaacagctgacaacattggacctgacaatgatttggaggtcactcctgataatgatgttcatccaacacatgctgctgacagtggttatgatgaagatagagccagtattgtggagggaggatctggtactgggaacagcaggaagaggaagagatccttcttggaggaatatgagaaaggaactggaaagtctttcaaaatgggggaacagcagtggcagtgcgatttgagagcaaaaaagagacgctag

SEQ ID NO: 2275 - DNA, 495 bp, Glycine max
  Peptide Sequence Number=SeqID_119053
atgttgactatttttgttaattatggtctcagtatcggccaccaagaacggcctcagggatatattgcccgatttccttggaacggttatattcttagggtactttcgagaagtagaactaagacttttaacagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 2276 - DNA, 357 bp, Glycine max
  Peptide Sequence Number=SeqID_119054
cgtctcgatatatgatgcgcctgaatctgacctccgtgtgaaaagttatgaccatttgaatttctcgagagcttccgttgttcaatttcgagcgtctcgatatgtgatgcgcctgaatcggacctccgtcgtctcgatatatgatgcgcctgaatctgacctccgtgtgaaaagttatgaccatttgaattttctcgagagcttccgttgttcaatttcgagcgtctcgatatgtgatgttcttgaattggacctccgtgtcaaaagttatgaccatttgaatttctcgcgagattccgttgttcatttcgagcgtctcgatatattatgcgcctgtatcggacatccgagtgaaaa

SEQ ID NO: 2277 - DNA, 834 bp, Glycine max
  Peptide Sequence Number=SeqID_119055
atggcgaaccggtggtggaccgggtcggtgggtctggagaactctggcgactcaatgaaaaaaccggatctggggttttccatgaacgagagtgcggtgacggggaaccatacaggagaagaagaggagaaagagaacagcgacgagcccagagagggagcgatcgacgtctccaccacgcgccgccctaggggccgtccaccgggctccaaaaacaagccgaaaccgccgatatttgtcaccagagacagccctaacgcgctgcgaagccacgtcatggagatcgccgccggagccgacatcgccgactgcgtggcgcagttcgctcggaggctccagcgcggcgtctccattctcagcggcagtggcaccgtcgtcaacgtcactatccgccagcccacggcgccaggcgccgtcatggcgctccacggccggtttgatatcctctccctcacaggctcctttctccccggaccgtcccctcccggcgccaccgggctcaccatctacctcgccggaggccaggggcatgtcgtcggcggcggggtggtgggcccgctcttggcggcgggtccagttttgttaatggcggctacgttttccaatgctacgtacgaaagattgcctctagaggatgatgatcaggaacacggcggcggcggaggctctccgccgggaattaccggcggtcccggcgaggcctcgtcgtcgatttcggtttataacaataatgttcctcctaatttaggtctttcgaatgggcaacatctgaaccatgaagcttattcttcttctccttgggttcattctcctcatgccagacctcctttctaa

SEQ ID NO: 2278 - DNA, 1200 bp, Glycine max
  Peptide Sequence Number=SeqID_119056
atggcagacgatctgtttgaaggattgccccctccttcctcaaacactcttcttcctcgtcaacaacaacaactccaaccacaaccaattgttgttgctaccaacatcaacgacactgaatcctctgcagttccggctccaaagccaatcctcaaaagtgccctcaagcgccccaaccctactcaacctgacacccaagctgcagcacctaagaaaagcttgaagttcaaaacctcgacagatgcttctgaagcacaagttattgaggctatgcagaagatatcttcacacatcaagaaccctgcaaagttcagcaaggctgcaaagcttgctatacagctgattcaggcaggaagtgtaaagtcagaaattagtgattatttttttgccatattagaagctgcaatgtcatcatccattacttgtacagatccttcagttcgagcagattatcattctctgttctccgtagctcaaaacaccaaagaacacctcaataagaagcaaaagaatcaactggcaacttggacaattaatgctgtggtggcaaatgatttatatacagatgatagctttgtgttttctaaagcagctgggcaaatcaaggaagctatatctaatcttcctgttgcaacagaagaggaggacgcagaggaagctaagtctctgaaagatagcacagttatagtggatgaaggtggtaagacacctgccacagataatgataatgatggggaggaagctcaagctgacccatttggacttgatgctctgattcctaattccacaaagaaaggtgaaaaattaaaggcaaagaatgaggcagctgtgaaaataagggaggatgaggaagaaaccaatagattcctcaagtcaaaaagagaagtcctgataacttgtttagaaattgctgctcggcgttataaaacaccctggtgtcaaactgtaattgatattttagtgaagcatgcctttgataatgtggcaagatttacagctcgccagagggatgctgttgggaaattgtgggcttcaatacgggagcaacaaactcgtcggaagcaagggaagtcagttaatggaaaacttgatgtgaatgcttttgaatggcttcaacaaaaatatgctggtgaaaagattagcattcgtcattctgttggagctagcggagaccgtcgtgcccagcaatggcttggttaa

SEQ ID NO: 2279 - DNA, 1188 bp, Glycine max
  Peptide Sequence Number=SeqID_119057
atgctttccctctcctgcgtcactcccaaagacctctttcactcaacaccttctccctcccctcaccgtcgccatttcgtgaagcccatctccgccgtcctcaactcatcttccttcaagaagcaccagcagcctccgccgccgcagctgcaagtctaccagcccttccgccctcccccggcgcccctcccctcgcaattcggcaccctcgacatcgccggccgcatcgacgtcctcgccaaccgcctcgccctctggtacgagtacgcgcccctcatcgcttccctaatccgcgaaggcttttctcctcccacgatcgaagaaaccaccggcatctccggcgtcgagcagaaccgcctcatcgttggcgcgcaggtccgcgactccctcgtccagtccaacgctgaccccgacctcctcgccgccttcgagactggcggcgccgagctcctctacgagatccgcctcctcagcgcgtcgccgccgcacgcttcctcgttgagaatcggtgcgacgggaaggccgcgcaggagctcgcacagtaaggagcataggaacccgtcggagcagaggacttcggcgctggagcaggcgctgcgcgtggcggagacggaggcggcgaggaatgtgattttggaggagttggaggggaagggtgaggagggggatacggtgggtgaaggggaggctgcggcgcgtgttccggtggtgaggctgaggattggggaggtggcggaggcgagttcggtggtgttgttgccggtctccgcggcggaggagagggagattttggaggcgccgtttgagagcagaagccagggggagtttggtgtagtggtggcggagaaggggtggggaaaatgggtggtgttgccctcgtgggacccagtcgttggtttaggaaaagggggtgtcgtggtgtcatttcccgatgctagggttttgccgtggaaggttaataggtggtataaggaggagcctatattggtggtggctaacaggagtaacagagaggtgggtgctgatcatgggttttatctcgtgaatagtgatgctgagggtttgaaggtccaaagaggttttgcattgaaggaaaaggggttcactcagagtttaggaactgtgttattggttgttagaccgcccaaagaagagaatgatgaattgagtgacgaagattgggagtga

SEQ ID NO: 2280 - DNA, 426 bp, Glycine max
  Peptide Sequence Number=SeqID_119058
atggtagggtgtgatgctagggtaaaaacgacaataaccagttcaaaaaagaagaagaaagcagaaattaccgcaaatcttaatgggtgcttcaagctccaacaaattaggttgctgcaggaaaatctctctggaagcggcacagagctggcggatctccgactccgacagttgcacctgcttgcccgggcggccgcgaacttcgagaaggcggttgattatgtcgtccacaagagcttgagtaaaggcagtgagcagcgaatagcatgcctcgacgaccaaaccgcagtcgttttgctagcggaagggaatcgtttgagggtgacggcgtggggtgattgtgaaaattggtttgagtttggtgaggggaagagaggaaaagtgggaattggtttgagaagagggattgatgattttgattattag

SEQ ID NO: 2281 - DNA, 960 bp, Glycine max
  Peptide Sequence Number=SeqID_119059
atggtgctaactttggtcaagaatcacttaatggtggatggtggaggtggtggtgatgattctacaaaaattctatcctttaaagacatgtgtctaacaggaaaagtccctcaaataactcgtctaacaatggatttgatagagcaaaaattggctaagatcgaatttgaagatggcaatcctctcaagccaacagtcatcattgatgattcgatgtttgaaggattatatgctctatggcaagaggcattggttatcaaacttataggtaagtccattggttttcatgttatgaaagaacgattaacaaggatttggaagctgaatgcaggctttgaaatcctagatattgaccatggatactatatggtaacctttgaccaggaagcatacagggtgaagcttattggtgaggaaccatggatgatctttgataattatttaatagtggagttgtggactccagacttcatctctcccgtagcaagcattaacaaaactatggtttggatacgttttcctggattgaataatcttgtttattatgatgagactatacttctagccctggcctctgcaataggtaagcctgtcaaagtggatatcaaccccaaggatgtcagaaggggaaggtttgccagagtttgcattgaggtcaatctaacaaagcctgttgttgggagggtatggttgaaagatttatggtaccatgttgagtatgaagggagtgcaaggtggaaccaacaatggaaaaaaaataataatacacagggagtgaacaacgacggtgctggccaatttcaacctccaataatggtggaaacaaccataagaggcaagatgccaccaatcttggaggaagtccgagagacaatgaatgttaccccaacagttatgaatgatttgaataagaaccggatttggcagttacagattcccctcttcatggagaatggctag

SEQ ID NO: 2282 - DNA, 108 bp, Glycine max
  Peptide Sequence Number=SeqID_119060
atggatgaaagttcatatatgatattggctaaagtggctgaggcaaagcagcttgccagcttattatctgagttgtgggcatgtgttctcatccctgttgaaagttga

SEQ ID NO: 2283 - DNA, 1836 bp, Glycine max
  Peptide Sequence Number=SeqID_119061
atggaaatcactcctcctcctcttcttcttctttttctgttgttgttgttctttctttgttatcttgttctctgtgcttctgccaccgacgtagattttgacaactgcaactgcgatgatggggaagggatttggagcatacatagcatactcgttggccaaaaagtcagcgattttttcattgccgttgcttatttttccatacccattgaactcctttactttgttagccgttcaaacgttccattcaaattgctcttccttcaatttattgccttcatagtgctctgtggcatgacccatttactcaatgcttattcttatcatggccctccttccttccaattgctgctctccctaaccgtcgctaaattcctcactgctcttgtttcctgtgcaaccgctttaacccttccccctctcatccctcttctcctcaaaatcaaagttagggagcttttcctgaggcagaatgtgatggagcttggccaagaggttgggatgatgaagaaacagaaggaggcaagctggcatgttaggatgctcactagggaaattaggaagtctcttgataagcacaacatcctctacactacccttgttgagctttctaaggcgttggatttgcataattgcgcagtttggatgccgaatgaggaccggcgagagatgcacttgactcacgagttgaaaaccaactctgccaagaattttcagaattctattccggtgaacgaccctgatgtattggagataagaaagaccaagggggtgaagattttgaggcccgattctgcaataggagctgcgagtagtggtggctctgcggagttgggtgctgtggcagctattcgcatgccgttacttcatgtatcaaatttcaaaggagggacaccccagttggttgagacttgttatgctatacttgttttggttcttccaagttcaagcactagggtttggacctaccatgagatggagatagttgaagtggttgctgatcaggtggctgttgccctgtctcatgcctctgttcttgaagagtctcagcaaatgagacagaagctggaagagcggaaccgagcgttgcaacaagctaaaaagaatgcaatgatggccagccaggcaaggaagtcatttcaggaggtgatgagccatggaatgcggaggcctatgcattctattttggggatgctttcattgtttcaagaggataatttaaggtctgagcagaagattattggtgatacaatgttgaaggttggccatgtgctctccagtttgattaatgatgtaatggagatttcagaaaatgaaaagggaggctttcggttagagatgaaacctttccttctgcattcaatgatgagggaagctgcttccattgccaagtgtttgtgtgtttatgaaggctttggttttgaaattgatgtccagaagtctttgcctgaaacagttatgggtgatgaggcaaggactttccaagtaattttacacatgattggctatttattgaacatgaatgacaaagggactctcaattttcgagtttttcttgaaagtgatggtggagacagggatgataaaaatattggaatatggagatcaagcagtcaaaatgagtatgtacatataaaatttgattttcagattactgagagttctcagtcagacaaagcaatttcaacaatacattatagtagtaggaggcagtactacaacaatgaacctaaggagggcctgagcttcagcatgtgcaaaaagttggtacaggacacattccccctcctctctagtgaatttatgcgatcatccattaactgtataaattgttag

SEQ ID NO: 2284 - DNA, 180 bp, Glycine max
  Peptide Sequence Number=SeqID_119062
atgaccatgcttcgatttgagccagacaagcaagtgggattcagggaatacatgcggtcagatggaacacgatcatatttcttttgtttggatactgtccggagcctatttttgggtgcaggcttcactgaggttgacttgtgctcctgcatacagtttaatacttgtgctcctgcatga

SEQ ID NO: 2285 - DNA, 1215 bp, Glycine max
  Peptide Sequence Number=SeqID_119063
atggagatcaaagaggcggcatgggaatatggaaaccaaaaatgcccgggcccaaatggattgaattggaaattcatcaaacaatttgggaacttgcttaaggatgatgtaaagagattcctagatgagttccaccaaaatggagtattaccaagaggtacaaactcttcatttatcacttttattcccaagattgatgatcctttagagctgtgtgattttaagcctatatcacttgtgggcccatcgagtgaatttgggatgcaacaagggcttagacaaggtgatcccttggctcatttcctatatgttgttgttgcagagaggctaagtggcttgatgagggaagcagtttcaaaaaatctatttgctagctatcttgtaggcaaaaacaagagtagatttgggatgcttggtgttgagagaagtgaaggagtcaagtttgctagagtgctcaattgtaatctcctcgctttgccttttacatacttggggattccaataggagcaaatcctagaagggtggaaacatggaaatcagtcatagacaagtttaggaagaagttggcgccatggaaatataaaactttgtcctttgtcaggaggatttgcttgatcaatttggagaaaggaggaaagtttgttgggttatttggaaaaaaaattgttgtccaaatgagcatggaggtgattgattcaaaatataagggttggaggggtcttgtgaagggtgagagtgaaaaaatttcttctatgtggtggaaagacttatgtctttcttgtggtgagggagatgtttctagttgggtaaataggagttttgtgtggaaactaggtgagggagatcaagcacgtttttggcttgataattgggggagtgaggagtgctttgcaagcaagttccaaaggttgtttggcttatctctacaacaatttgagatggaacaactgagagaattgatgcgaatggtggaggacatgagaattgttagggggattaaggataattgggtgtgggtagaggatggctctggaatctttaatgttaaatcagcatataggaccattcatgatgatatggtcgggtcacaaatctcaccaccgatgaaaagcgtctggagtctaaagacagtcttgccaagctctcctaagatacattattggcagcattgtcatcacttacagagacaaattgaaaaggagatccaagccgtg

SEQ ID NO: 2286 - DNA, 558 bp, Glycine max
  Peptide Sequence Number=SeqID_119064
atggtaacaccgtttacgccttctgacccgagactgactgttgaagtaactggtcacaagtcccatggacctgttccacagcctggatctgtcgtcattgcgcgggtcaccaaagtgatggctcggtccgcttcagctgatattatgtgtgttggaccaaagtctgttcgagaaaaattcactggcatcattaggcagcaagatgttagagcaactgagattgataaagttgacatgcacttgtcttttcatcccggtgacattgttagagctcttgtgctttctcttggagatgcacgggcatactttctatctactgcaaagaatgaacttggtgttgtttctgcagaaagcattgctgctagtgctgaaataaaatctaatagttacattataagttgtacagtttcatcggctgagcacctatcagatagggattttcatcaatgctgggcaatattgaaatggtgcaactatgatccagtaagttggacagagatgcagtgcccgttaactggtcaaattgagcaaagaaaggttgcaaaggctgcaagctga

SEQ ID NO: 2287 - DNA, 339 bp, Glycine max
  Peptide Sequence Number=SeqID_119065
atggcatcgacatcaacaccagggtcatcttcagaactaactatcacagttgaacacaatccttccaaatcacgattatcagagctgggtataaattggtggcccaaatggggttgtcctcctgggaaattcatgctcaaattcgatgcccaagagacgtgttatttgctcagagggaaagtgaaggtttacccaaaaggttcgtctgagtttgtacaatttggtgcgggggaccttgtcaccatacccaagggacttagttgcacgtgggacgtatccattgcagtggacaagcattacaagttcgagtcttcttccactacaccatcccccgaatga

SEQ ID NO: 2288 - DNA, 867 bp, Glycine max
  Peptide Sequence Number=SeqID_119066
atgggtgcctctccctccggcgactacagcttcttcctctaccagtgggccttcgccatcgccgccgccggaatcaccagcggcaccatcgccgagagaacacagttcgtggcttacctcatctactcttctttcttaaccggtttggtttaccccatcgtttcgcattggttctggtcctcagacggttgggccagcgcggctcgtagcaacggaaatgttttgttcgggtctggagtcatcgactttgcgggctcaggcgttgttcacatgggaggacagctgtcacgacggcattggctgggagcactgcggttattggtgggccattggaacgcgattgacgtgtgtaacggcctgcttgacgggttcgctgcgattacatcgggctgtgccgtagtagaaccgtgggccgcgattgtgtgcgggtttgaggcggcgtgggttttgattgggcttaataagcttgccgcgaaggtggagtacgatgatccactggaggcggcgcagcttcacggcgggtgtggcgcgtggggagtgttcttcacgagattgtttgcgaagagagtgtacatggaggagatttgcggcgttggaaggccgttcggggcgttgatgggcggcgcaggtgattcagatattggtggtgtgcgggtgggtcacggcgaccatggcggcgttgttcaaaagatgaatctgttgagaatttcgagggatgaaattggagaggggattgtgctcagcactctcgtggctgccttcaccgtcaccacatggactcgccggagcatcgaacacggtcgtgggaaccctaattggaggaggggaacggggagaagtaaaaacatgatgaaattggagaaataa

SEQ ID NO: 2289 - DNA, 405 bp, Glycine max
  Peptide Sequence Number=SeqID_119067
atgattgcagctggtagagttctgactgctagttcaacgtcagcagtgatagttgaagaacccaaagaggaagctagggtgctgaaagtctgtaattattctgtctctggcattggcaagttttattttggagaattgcaggttgaagtaaccccagataaggccaatattggggctgtaattgggtttctttttgggattctttgttggcaaatagcgcggggagttcaaaacgttcctgacagttcattgcagtatgcaaatgacaatgctttgctgcttgctaagtctttaaagggagcattgcttgctatattctactcctcaacgttcttgtctgcatttacctcggtgggacttgttctacttgggttacagctcaaatcaaagaaaaataaagattga

SEQ ID NO: 2290 - DNA, 1243 bp, Glycine max
  Peptide Sequence Number=SeqID_119068
atgggtattattatcgggagaaagagaaggtgctcctgttcaactcctcgtgaggaccatcatcttctccttctcactttctttgttgccatacttctacaaagggctgtggttgaatcttctacgctaaattacacgaggcataggcataccagtacccttagacttgaaaggattagtaagcacttgaacaagatcaataagcctccggtgctcaccatagagagtccagatggagatcttatagattgtgttcacaaaagaaaacaactggctttagatcacccccttttaaagaatcacaagatccagaaaatgccaacggagatgccaaaagggatgaaagtgatgagagttgaggatgatatggaaaaggtgagagtgagagagaaggcatggcaaatgtggcacctaaatgggacacggtgtcctaagggaacggttccaatacggcgtagcacagtgcatgacgtgatgagagcaaagtctttgtatgactttgggaagaaacgctcacgagttgattccctctctcgccgcaacgatgcacccgatattctcagcggcaatggccatgagcatgcgatcgcatatacgggatcatcgcaagagatgtacggggcaaaggccacaattaacgtatgggatccatcaattcaagtaatcaacgagtttagtctatcgcaactttggatcctttcaggatccttcgatggcaccgatcttaatagcatcgaagctggatggcagagtgactcgtaccgggcaaccggatgttacaaccttctttgtgctggctttattcaaaccaatagcagaatagccattggagctgccatttctcctgtctcttcttatgatggcaaccaatatgacatcacaatcctcatttggaaggatccaaaagtggggaattggtggatgagttttggtgacaacacattggtagggtattggcccgcagagctattcacacacttagcagaccacgccacgatggtggagtggggaggagaggttgtgaactcacgaaccaacggccaacacacctttacccaaatgggctctgggcacttcgcagaagatggtttcggaaaagcaagctacttccggaaccttcagactgtagacacggataacaatctgagttctgtgcagggcatctcaaccttagccgaaaatacaaactgttacgacattaagagctactacagcaacgaatggggcacctacttctactacg

SEQ ID NO: 2291 - DNA, 261 bp, Glycine max
  Peptide Sequence Number=SeqID_119069
atgggggaaatgtgcgaggaatttaagatccaacaccacaattccacaccctacaggcccaagatgaacggagcagtggacgtagccaacaagaatatcaagaagattattcagaagatgaccgtgtcatacaaggactggcacaagatgctccctttcgtgctacatgatgctcagggacgggtacgagcaggcactaggctggtggtcagcagatcatcatcccgcaactggctctgcatgttgaggaggccctattaa

SEQ ID NO: 2292 - DNA, 222 bp, Glycine max
  Peptide Sequence Number=SeqID_119070
atggaggaatggcaatgtaatcacgcgctcagtgtggcaatgtctggactttgcgagaatgacagtgatcacgcgcttagcatagaatcctcgttaaacatgtctttaggctttctcatgggccttcttcgcgctaagcgtgagctaactgttaagcgaggagatgcactagacatgtcttgtgcactaagcgagctgtccaaatctctaacttttctttaa

SEQ ID NO: 2293 - DNA, 204 bp, Glycine max
  Peptide Sequence Number=SeqID_119071
atgcagacaaatgatgttcaagctccactttttccattcattgcaagttgtaagcagaatgtagaatttgaaggaagttcccagaatggtagaaagcaagggacagatgaaacggccacagctaagaatagtgcatcttatatcgggaagagattgttagaaagtttggttgcagttgcagggcttctaatttggctttcatga

SEQ ID NO: 2294 - DNA, 678 bp, Glycine max
  Peptide Sequence Number=SeqID_119072
atggattcaaatgcttgtctaccacacttgctagtgttagcaataacattggtattggttagtcatgcaatgggagattcagctcaagacaaacagagatgtgcagaatccctgacaggtgttgcaacgtgtctgccatatttgggtgctgacgcaaaagcacccacagcagattgttgcagtggtctcacacaagccatgaaggccaacaagaagtgtgtctgccttattctcaaagacagggatgatcctgaccttggcttaaatattaacatgacaattgctgttggtctcccttctctttgcaaaacacctgataatctctcacagtgttctggtacttggcatattggagatgctatatgggaatctaaattttgcttaacacaaatgtgtaacatgtacatgaaagtcaatccaaaccgaatcgaggatttgtggcatttaacttttatcactttctgccctcaaagatcacactccaatcatctatattgtgctgtcatcccaagagaaggatcaaacattgatgatgcagaggtgttaagatattgcaagaagaatcttgcatctttcaaagtccctgaaaaggtcttcattactgattctttgcccaagactgccaccggaaagattttgcgtcgtcttgtggcagaacacattgtctcacaaatttga

SEQ ID NO: 2295 - DNA, 805 bp, Glycine max
  Peptide Sequence Number=SeqID_119073
atgaattcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataatcataccaactgttgccactggtatggagtcctctgccacaacgtcacttcccatcttcttcagcttcacctccacacctcagattctgctttcgagtatgaatactatcatggattctaccgtagattcgatttggaagcttatcggagatggatctttggtggagagataagtccttgtttggctgatttaaagcatttgaattacttggacttgagcggcaatgaattccttggaaaaggtatggcaattccttctttccttgggacaatgacttccttgactcacctcaacctctcttatactggattctgggggaagattcctcctcagattgggaatctctcaaatttggtgtatcttgccctgagagatgttgacaacggaacagtaccctctcagatcgggaatctctctaagcttcgatatcttgacttgagcgacaattatttccttggagaaggtatggcaattccttctttcctttgtgcaatgacctccttgactcacctcgacctctcttatactcgattcatggggaagattccatctcagattggtaatctctccaatttggtgtatcttggccttggaggttattctgttgtcgaacctctgctagctgaaaatgtagaatgggtatcaa

SEQ ID NO: 2296 - DNA, 300 bp, Glycine max
  Peptide Sequence Number=SeqID_119074
atggcgctgggaggctttggttgttgggtttatcatcctaccatggaaactgattgggatcttcaggcagtgcggattatctctaaagcacctctcctattttgcagtttgttgaacgtccaagctttagggttagggatttttaagaaattgatgggtaaaaagatgcatgcagtttcaaggtgcctaacagacattgacacatggcagtcaacgtcgttgcttaacggtcaacgtccaattgaggcatctgggatcaacattgcaggattttataaaacagagggacccaatttgtga

SEQ ID NO: 2297 - DNA, 931 bp, Glycine max
  Peptide Sequence Number=SeqID_119075
tagaggagggggaaacctgcctgcttactctaggtttagtcagctgaggccaaatccacaagaactggcagcccgattatgcatcccagggaagggatttgagcttaatgttgatggtaatgctgatgggctgcccctgaagattctgaggaagaatctgaccactcttgctcagacctggagtgttctctcattctccaacctggtccctacttctcacacatcagacattacactggacaaggccaggttgatttacggcattatccagaagatggacacgaacttgggacatatcatctcatgtgagatttccttgattgcacaacataactcctctaggctaggtttccctacacttatcactgatttgtgcaaggctagaggagtcacttctgactcattgacttttgagagcctcagtccagccattaatgtggcatatgtgaagaaaaattgctggaacctcgatgatcttgctgttactttcaaaggaccatgcaaagccaaggggaagatgtctgaggctccttcatcttctgatattcctcttattctagctctttccacctctacatctccattagttccagctcctcctacaggaccatcctctatcacatcaaagacattatttgctatgctgcaaagccttcataaaggccaggcctccgcaacccaagagccagagccagtagaggatgatgttcctcctgagtcgtttatcatcgagactgatccagtacctcgggaggaagtagcagctcaggagccttcttctccaattcctgtctctccagctccagttattgatgattctcatccatctgcactagcattggagccagagcagcctattgttcaggatccaccagctgctccggtgttggatcttaatgagcatgcagaggatcacccacaggaggattga

SEQ ID NO: 2298 - DNA, 273 bp, Glycine max
  Peptide Sequence Number=SeqID_119076
atgccaagaaggctgaacccttttcttcttcactcctcccctatttatagcaaaataggggaggagcttgccacccagctcgcccaggcgagcaaggttgcttccttcagaagcaacaaccttctggaggaaggatctggaaggcccaagtgggccagattgctatttctttcgaagaagttacggaaactcacggattgcgcaaaaacacctcttttcaatttccgccacattacggaatttcatggatcgcgcaagcctgcttccttttga

SEQ ID NO: 2299 - DNA, 270 bp, Glycine max
  Peptide Sequence Number=SeqID_119077
atgctaactgagcaattaattgactcaacgagattccacgagaaaaatagactatcacatgggatattggccgacaatggggggagaaaaactgcaacaatgcttgcatctggccatgtttataagcaagtactaaacaaggccattgaagacgcacagagaaaggcaaacactcacgctgttcttgagtttgatcaactcgacacgatttttggtccaggaaacaataaacctgtgaaaggttcaacccactggagatttcacgattag

SEQ ID NO: 2300 - DNA, 285 bp, Glycine max
  Peptide Sequence Number=SeqID_119078
atgcatcaatttcttcctggtatggtcgtggagaaggaaacacagccaatgccaccacaaggaggtcaagaagtagaggatttcatgatgtgtcatcgtcttttctggagtttcaaaccgtgtattaatgggtttcaatattgcaggcccgtggttcaggtcgatggaatatggttgtatgggcctagggaacactacaaaactccaatggaacatataagctttgcccatttctgccatctcgagggtcaaattgagcttggaagtcagaacctctgcacttga

SEQ ID NO: 2301 - DNA, 492 bp, Glycine max
  Peptide Sequence Number=SeqID_119079
atggggacgaggggttgcattaattacaatctcgtcatcgccataagacaacttggctaccctatgaggggggcaccattagaggaagacctcacaccttttattgcgcgaggtttcaatagctccaacgcgggggtgcttcagagggtctgcaaggcatggggaatggtgcaaaagaaggatgaagaacttatgggaagtagcaacgggcccattggcggttaccataagtggttgaaagcctacgcacaaggtctggattggctcccgaatttgagagccattaaagaggtggaggttgaagctccggaagaagacgaagaggtacaagccctcagaacagagcttgagaaagccagagcaatcaaagaaaagttcaagtcaacagccgttaggatccgaaaagagaacgccgaactgagagacgtcaacataaccaccaccatggttgttaaactcgcgattctacgtagaatcgtggaggttccgtaa

SEQ ID NO: 2302 - DNA, 357 bp, Glycine max
  Peptide Sequence Number=SeqID_119080
atggtcattcccaagttcaaggcgctggactttgacaagtacaaagggactacttgccccaagaaccatctaaagatgtattgtcggaagatgggggcatacgcaaaagatgaggaactgttgatacatttcttccaagaaagtcttactggggtagctgctacttgggatctggcagcccaagtggcacccccaatgatggaaagggagttgataatcgtgatggtagacacattaccagtattctcctatgaaaagatggtgggttacacacctttaagctttgtggatttggtcttcgccggcgaaaggatcgaagtgggtctgaaaagaggcaaatctgatcatcctgcttag

SEQ ID NO: 2303 - DNA, 321 bp, Glycine max
  Peptide Sequence Number=SeqID_119081
gatgcagctacagaacttgtgcaaaagggagcacaagtctttcaaaaggtacacccaaaggtggaaggatatggcaactcaagtagcgcccccaagagggagttgataacgatgatagtagacgcattatcggtgtcctactatgaaaagatggtggattacatgccttcaagatttgccgatttagtgttcgccggtgaaaggattgaagtgggtctgaggagaggcaaatttgattgtctcgctttgacaaataaaaagcctgggacaaatggagagaaggagaatgaggaaggaacccatgttgaaggttgttgttag

SEQ ID NO: 2304 - DNA, 243 bp, Glycine max
  Peptide Sequence Number=SeqID_119082
atgggtgcaactgatatcatcattgagaaacagataatcaagtcaaactgttcagtatgcttcaaggcatgcatactactatccacaatcaagaaacatgaatttaaaattcttgtgattggtcatcctgctgggtctcctgatcctgagtgccctcctcatctatcaaatgtagcacaggagtggctggaggagtggtcatcagtcccagggctagtgtggcagggtcctttggaatcttaa

SEQ ID NO: 2305 - DNA, 396 bp, Glycine max
  Peptide Sequence Number=SeqID_119083
atgaaggtgtacaaagaaaagttttttggtaaatggcaatggatgtctagtttttgtgaacataaaaatgaaacaaaaagaaaaagaaaggaagacctcgaagaatctgcatcctttcccccgaagcagaggacagcggaatctcctcaagggagagcaaatagaatgctaaaacccgatttcccaaagaaaggaatggagaaggagaaaataaaaagaaagaaaagaaaaaatgaaaagaaagaaaaggaaaaaatgaaagaaaggaaaagaaggattcccgatcgaagatcggaaggaagtaaaaaggaaatcggaggaaaacagaataattcccgatcaatgaaagaaagagaacagaagatctttagaccagataaattttcgataaggtaa

SEQ ID NO: 2306 - DNA, 233 bp, Glycine max
  Peptide Sequence Number=SeqID_119084
tgtccgtcacccccaacaaggtcatcaggccccctattaaccaggctttcatcaagaagtactgcgccccccaggcaggcgcagggcgagacaccacagcagcctggggatggccggcagtgggcaatagacgcactgccgccacctccagagcccctcagctcatctacaaaggctggagcgttgcctacgacccgtggccgaccagcaggcgaccaagtccaaagccaaag

SEQ ID NO: 2307 - DNA, 330 bp, Glycine max
  Peptide Sequence Number=SeqID_119085
atggaattgcggttacaagttacaacatgcggtggagcgaggagcatgggaaccgaaggctcaaaacataaaaatggttccaagtttgtagccacagagaccgcttggtctgaagcaaagcgaaggaaaacctcggagtcagaggaaacagagtatgtcacgtaccgaatagcaatgctttgtttttgtggaatgcgagtatggtgcggtgttctgcaccccaacctctcccctcaatgggtgtatgagtatgagagagagagagagagagagaaatggtgcaggtgtccaacggggaagcgtttacgtccgcttcgtagtgcaacttag

SEQ ID NO: 2308 - DNA, 273 bp, Glycine max
  Peptide Sequence Number=SeqID_119086
atgtacctatgctatgtgttcaccaacctccccgtgatcgtgatcttagacctgacggagcaggattataacgactttgactacaacatgatcaaggatatgcatgtcgtgtcgtgcttcatcaaagagtggggtgacatcgtcataatgctcaaggacgacaccaaggttgatctcaggagttttcccaagttcagagagatcgccaagtattgcctcgctatggctcaaaaacccttcatcctgatcgaaactagacccaaagccttctag

SEQ ID NO: 2309 - DNA, 324 bp, Glycine max
  Peptide Sequence Number=SeqID_119087
atggcttcctatggtgatgccattgatcttcaagaagcaaaatactccattgatgaagaagatccaaggcctacaagctccacatggagctacatcaggtatcgaaatgagacattcaagttgcgtgcaaagttgttttgtatcatcaatgactttccagcatacggaaatttgagtggatacagtgttaaggttcatcttgcatgcactatttgtgaagaagacataagctatgtacaattgaaacatggaagaaaaatagtatacactcagcatcgacattttctaaaagcttatcacccttactgtggcgtccttaaataa

SEQ ID NO: 2310 - DNA, 549 bp, Glycine max
  Peptide Sequence Number=SeqID_119088
atgctttctcataaggatggacccttgggtactagtaccctcaccttcggaggactacacgtcctcccctccaaaggactacatgtcctcacctttagaggactatacgtccttgccttcatagggctacatgcccttacctttagaggactacacgtcctccctttcagagggctacacgccctcgccttgaaaggactacatgtcctcgccatcagaggattacacgtcctccacttcagaggactacacatcctccatttcagaggactacacatcctcgccttcagagggctgcacgcctttagaggactacacgtcctcgccgtcagaggactacatgtcctcaccttcagagggctacgcgccctcgccttcagagggctacatgtcctcgccatcagagggttacacgccctccacttcagaggactacacatcctccatttcagaggactacacgtcctcgccttcagagggctacacgttctcgccttcagtaggctccacatccgtaccttaagagaatttagggtcctctgcccttaa

SEQ ID NO: 2311 - DNA, 1350 bp, Glycine max
  Peptide Sequence Number=SeqID_119089
gctgcaaagagtatttaccgtgatggccagcgcgggcgccatcgtgttcgccaacctggcggtcctgatcgcagtaggcgtggcggtggggttgaccaaaagcgacaagggcacggcggggctggcctcgatgatcgcctaccgggtgatgaacgccaccatcaatgcgctgttgaaaatcaacggcacgctggtcgcgcagaacgccggcgcggtggggcagggaacgattctcgggatccagacgctggagaccggggtgttcggcggggtggtcatcggtctggtgacttggtatctgcacggccgctacaacaagatagcgctgccgccgttcctgggttttttcggcggctcgcgctttgtgccgatcgtcagctcgctggcggcgatggcggtcggtgccctgatgaccgtggtgtggccgcctttccaacggctgatcttcggcatgggcgggctggtggacgccagcggctatctcggcacctttatctacggcttcgtgctgcgcatgctcgggccgttcggcctgcatcacatcttctacctgccgttctggactaccgcgctcggcggcagcgaagtgatcaacggacagctggtggaaggcacgcagcgcattttcttcgcccagttggccgacccgaatacgcagcagttctacatcggcacggcgcgcttcatgtccggccgctttatcaccatgatgttcggcctggtcggcgcctgcctggcgatgtaccaaagcgcgcgcccggagaaccgcaaacgcgtcggcgggctgctgctgtcggcggcgctgacctctttcctgaccggcatcaccgaacctatcgaattctcgttcctgttcatcgcgccggcgctgtacgtggtgcacgcgctgttcgacggcctggcgttcgcgatcgcgcacattctgcatatcaccatcggccagacgttctccggcggttttatcgatttcatgctgttcggcgtgctgcagggcgaagcgaaaacccactggatgtaagtgccgctggtcggggtgccctggttcatcctgtaatacttcacgttccgtttcctgatcgtgcgcttcaatttcaaaacgccggggcgcgaggtggaaaccgcgccggaagcgttgacgaccggcaccgaacgctcgcagcaggtgctggcggcgctgggcggcaaagagaatatcgtcgaactggattgttgcgccacgcggctgcgcgtgacggtaaaacagagccggttgctggacgaaagcgggatgaaggccagcggcgcgcgggcggtgatcgttcgcggcaacggcgttcaggtgatctatggcccgcacgtgaccattattaa

SEQ ID NO: 2312 - DNA, 528 bp, Glycine max
  Peptide Sequence Number=SeqID_119090
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgtt

SEQ ID NO: 2313 - DNA, 246 bp, Glycine max
  Peptide Sequence Number=SeqID_119091
atggacagaaaaaagaaatttttttcagttgtccatttgctaagcgcagcccttgccctaagcgccatgtcttcacgcgctaagcctgagcttgctcacgctaagcgctttgacccttcaccgcgcaagcgctacgctaagcctggaaccataactgctaagcgaaaattacaagaccaattagagttgcagacagcgctaagcgcgtgtccttgcgctaagcctgaatacctttctggaatttga

SEQ ID NO: 2314 - DNA, 297 bp, Glycine max
  Peptide Sequence Number=SeqID_119092
atggcatccaggaagagaaaggcccctgcctcaacatcccaggcctgctatgacagatccagattcacatctcaggaggtctgggatcgttattatagtgttgtcattggcaggaaaatattacctgagagaaatgtcatgctctattatagagagtttgatgaattcactaaagagttggagagaagaaaatggcacaaggagttgacgaattttatggatggcagcattgatgttgccattgtgaaggagttctatgctaacctctatgacccagaggataaatcacctaagcag

SEQ ID NO: 2315 - DNA, 231 bp, Glycine max
  Peptide Sequence Number=SeqID_119093
atgaacgcgttaagcgcgcttgctgcgtttagccagttcatcgcaactgttaaatttttgtatttccagatgatcgcgctaaacctgaccgtgttgtgctacgtgttcatccttctgatgagtttcaatgatgagcttgctaagcacgtttgtgcgctaagcgagactacactaagcctggcttctcaggctaagcgcaattacgtctttgtttttcaattgttggaataa

SEQ ID NO: 2316 - DNA, 653 bp, Glycine max
  Peptide Sequence Number=SeqID_119094
atggaggccatgatgagcatgaagaagataatggaagccaatgtggttgcagataccgctaccagcgctgttgctaaggtgaacccgatgcccccatctagcctcaaccaaatgaatcatccaaccttagttatggtaggcaaagatttgggaagtacgagcggcccctattatgtgcaaattcaaaacaagcacgcctttccaccatatggcttgcctcccaactatacaccacccagtgtggcatacattcccagtgagccttgcctcggatatgccacggaagggcaagcagttggtggtatacccctacaaaaccctttggaaggccctcagtgtcacccacaaccacaaccctcacattccacagcggttaaaaaccctcatgctatggcagaaaagggaaagttggatcatctagaggaaaggctcagggccattgaaggaggtgaagattatgcctttcctaacctagaagagttgttcctagtacctaatatcatcacccctcccaagttcaaggtgctggactttgacaagtacaaggggactacttgccccaagaaccatctaaagatgtattatcggaagatgggggcatgcgcaaaagataaggaattactgatacattccttccaagaaagtcttactgg

SEQ ID NO: 2317 - DNA, 342 bp, Glycine max
  Peptide Sequence Number=SeqID_119095
ggctctggagttcataccacccggcggttcatcagaaactcttcccccggcccagtagtggagcttgaccctcgccctacgccgattgagatctttccttgtgcggtacaggtaaattttgctcttgagggaatacccggttcatcggaacttcaaccagaagaggtaggctcggggataaactttcttagtcagacttccttgataggtgagacttccacgaaagcacttattagaagaatcttagtatgcaaggccttcgatctaaagggagcttcggtcggtgaaactgtccctgtagctaaagtcaagccagttcattcattcatggcaatcggtcta

SEQ ID NO: 2318 - DNA, 498 bp, Glycine max
  misc_feature (487)..(487): n is a, c, g, or t
  Peptide Sequence Number=SeqID_119096
atggcaaatgaaaatgttaatgatatccccgataacgaaagcaccggtagcaacgacgacgacgctgtcacttctcccaccacggagtgccaaatatgctcaaatcccataccccgaaaccctaataaacaaacgtcaagtaaacacccactgcaaggtcccaaaccaccaaccctagtatcaccaccaccgcaatcactttcaattaaccctaacaatagctttgcaagggtgattccttcgcgatctcaaccaattaacgctaatagaacccatgcagatgtggttcgctcaaccccgccaccgaaaacaagcagaaccacaccacaagatccgacactagcagcgttatggatgaacagtaacgctgctcgtggttgtgcaacctcacaagcagcagcgttatggaccttcgatgacgctgctgaaaatggagaaatcctacaccatcgttttcatccatacctaaggccggtgggtcagcagncaccgagaacg

SEQ ID NO: 2319 - DNA, 387 bp, Glycine max
  Peptide Sequence Number=SeqID_119097
atgaagaaaaaaacttattctaatatttacaaagaagagtggactcaatcttggcccatgggctcaaaaatctaccctaaggttcatgagaaccctaaggccttctttatcagctctagcccaatcctcttggagcctcttgctcatggctctggtaactggtcctttcctagggaggattgcatcacaagagatcaaggctctggtaatcgattaccagacagtcaacgacacttcaaaaaatactgtagacaaaggatcaagctgaatgttttgatgatgccaaaggttcacatgcgtctcaaagctttattcaagacaaagaaattaaagatattcaagatggatgatcaagacaagtctctagtcttagaaagggtatattaa

SEQ ID NO: 2320 - DNA, 879 bp, Glycine max
  Peptide Sequence Number=SeqID_119098
cgccatcagccaggtgctggactgcggctggttcgcgcccacgcgcttgccggccaggtccttgagcgacttgatcttgccgctgtcgaaatcctcgcgccgcacgatgacgttggcgtaggtcagcttgcggtcgaagccgaacaccaggatggccggcttgccggccagcgtcagggccggcgcggcggtggccgcggtggcgccgaagacgatctggccggccgccagcagctggttggtgcgcgggccgctctgcgaattcaggtattcgacctccagccccgcttcgccgaaatagccctttttgagcgccacgtagccggccgcgaagaacgggtcgatgctgccctgcccgtagaccacgcggcccagcttgggctgggcgaaggcgacacggccgccgatcagggtgacgccggccagcgccccggtagcggccagcacgcggcggcgggtggtgaagtgggggctcgtgctcatgtcttcctcggtctcgatcgggtgtggttgtttggcgtcaacaataccgcagcggcgcctgacgtccaacaatggaaaacgcccggttgcccgggcgttctcgtcgtgccacgcaagtgtagaccgtggcggcttatgccgcggtcttcttgggcgcggccttcttcacggctttcttggcggcggtcttggtcgccgtcttggtggccgttttcgtggcggtcttggtggcggtcttcttcaccgcggccttcttggccggcgccttcttcgccgccgtcttggtggcggcgccggcggtcttggccggggcacggccgcggccgggtttctccggacgcggttcgaactcgaagccgatcttgccgtcgggctggcgcaccaggaaagccttga

SEQ ID NO: 2321 - DNA, 153 bp, Glycine max
  Peptide Sequence Number=SeqID_119099
atgaccactcttacacagattatagatgacattgctactttagcaacattctgcccagcgaccgcaatgccaatctccccctgcaaaagtatcagttggtctgtgtcgtcccgacatggggatcgcacccacaaagacacccagtggacctga

SEQ ID NO: 2322 - DNA, 284 bp, Glycine max
  Peptide Sequence Number=SeqID_119100
ggccgacagaggcccgtaaccagagctggaaaccccatgtccctgttggacttcttcaggtccactgggtgtctttgtggggggagattggcattgcggtcgctgggcagaatgttgctaaagtagcaatgtcatctataatctgtgtaagagtggtcatgttggtgcgcatgatccgcactcgtctctttgcagcggcacgggtgaaatcttgccccgttggccctcctccaatatcagggggtggcccaggaaccgctaaaaggaaactactggccccttaa

SEQ ID NO: 2323 - DNA, 572 bp, Glycine max
  Peptide Sequence Number=SeqID_119101
agggctacacgccctcaccttgggtactagttaccctcactgtcagaggactacgcgtcctcaccttgagaggactacacgtcctcaccatcagagggctgcacgccctcacctccagaggactacatgtcctcgccttgagagggctacgcgccctcaccttgggtactagttaccctcactgtcagaggactacatgtcctcgccttgagaggaccacacgtcctcaccttcgtagggctacacaccctcaccttgagaggaccacacgtcctcgccatcagagggctgcacgcgctcaccttcagaggactgcatgtcctcaccttcgtagggctacacgccctcacctttggaggactacacgtcctcgccaacagagggctgcacgccctcaccttgagaggactacacgtcctcgccaacagagggttgcatgccctcaccttgagaggactacacgtcctcgccaacagagggctgcacgtcctcaccttgaagaggactacacgtcctcgccaacagagggctgcacgccctcacctccagaggactacacatcctcgccttga

SEQ ID NO: 2324 - DNA, 477 bp, Glycine max
  Peptide Sequence Number=SeqID_119102
atgagtaaggagaagatggttatgcaattcccaaaaagaaaaggcattaccgagacaccaccggcaccactaccaccactgctaccaaaacatcacaaacccgttccaaaggtggttgttcttccaccaccaccttcactgaaacgtaccaaaaaaagcactccaaaaagggttcccttgcccccaccactgaaaccctgtaaccatccctactactatccgacgctgaggaaacgcccgccacaggtaaccttggatcttctctcttcgatggtggccggcggcatggtgccggtgcaagttcgtagggaaaaccctccgagcaacgaaacgcttaaagcatgggcttcctcgctcaggcttggagatgggagaaagcagatcgtggatttgagcctgaagcttagggtggtcaaaccgcgcgtgagtggggttcgcttcaatcgttcagaaccaaaacgatcaaagaaaatataa

SEQ ID NO: 2325 - DNA, 361 bp, Glycine max
  Peptide Sequence Number=SeqID_119103
agagccaggttccccttaaattctccaacctacaatcaaagttacgcttccattcctcaatttcgtggcacattgctcgattttctcgttcgtgacacggaggtcattcaagctaagacaagtgaggctgatatggccacaagtgtggtcatggaaatctcaaaaaccctagcagaagctgatgctggaagatacactaaccttgaagaaaatcctttcttcccagaaaatttaccaccttcggttgagccacattaccccttctcacagtttttgcatccttcagccgctatgatcaacataaacaatgtcatttggaaactgtacattgatgagctgcttccaatatttgttgcttctg

SEQ ID NO: 2326 - DNA, 552 bp, Glycine max
  Peptide Sequence Number=SeqID_119104
atgacccacaccgcggcggtaaacagcagcgcgcacagcagggtcagtcctcttctgtcgccattcaatgccgcccgccttgatgcttaccatattggggttggcgatgaggccaatcaccagcatcagcgccagcagcattttgccgctgacctgcttcacctgaatcagcggcgagagcagataaatcaccacaatggcaaagaaaaaccacagattcgcgatatcccattcgaacaagctgatgctatgaggatgggtaatgtaccaggtggtactgtgaatcattactaccatcaggcatgctatgccgcgcaagcggttgagaaaaatggtgatgaaatatttcgtatctgccctggcggcgctgctgctggtcggctgcagccagacacctgctcaacccgttcaaaaagcgcaaaaagcacgtattacgccgcaaactacgctgaatatggaaaaattatgcaaggatcaggcggcgttacgttacagcaccgacacccgtcgcgtcgacgtcaatcatttcgagcagttccaggcaagctatga

SEQ ID NO: 2327 - DNA, 281 bp, Glycine max
  Peptide Sequence Number=SeqID_119105
atgctgctggcgctgatgctggtgattggcctcatcgccaaccccaatatggtaagcatcaaggcgggcggcattgaatggctaccgataaacctctatatcaacggcgataccttttactacgtactgtacgggatactgggccgggcgatcggcgccatgaacaccgacagaagaggactgaccctgctgtgcgcgctgctgtttaccgccgcggtgtgggtcatttcacgcggcacgctgcatgaactgcaatggcgaggcgattttggcgatacctg

SEQ ID NO: 2328 - DNA, 216 bp, Glycine max
  Peptide Sequence Number=SeqID_119106
atgattgaatccaaaagactttcctatgttagaaacaaccaaaagaaactcaaagttgacaagttttgtagcttgcagcagtcatcggatgctggaaatacagaaggtttaggccaaggcaagaggatcatcttaccttcaacctttgttggcagcccacgttacatggatcaactttattttgatggcatagttatagtatatgcagtcacgtag

SEQ ID NO: 2329 - DNA, 266 bp, Glycine max
  Peptide Sequence Number=SeqID_119107
cgattgatgctttcgtcgcctttcatcatggcaaggaaagcccggtcgtcgccattttggccttgtatgacacgttcgaccggggatgcccgtctatccgctacaaggtcaccgctcgtgcgtcgaaaagggaaagggagtcaagaacttccccgattgctagccaaggccaaagcagtggcggacacctactccgcccccgaggagatccacggacttctcagctattgtcagcatatgatagacttaatggaccatatgattag

SEQ ID NO: 2330 - DNA, 611 bp, Glycine max
  Peptide Sequence Number=SeqID_119108
gcaaaggcaccaatctggataacaacacgatgaaggaaatatgcgaggagctcaagatccagcaccacaattccacaccttataggcccaagatgaatggggcagtagaggcggccaacaaggatgtcaagaagattattcagaaaatgaccgtgtcatatgaagattggcatgaaatgctcccttttgcgttgcatggttatcaaacatcgatacgcacgtcgaccggggcaacaccattttcattggtgtacggaatggaatttgtgctaccgtttgaggtggaagttccttctttgaggatcatggtggagtccggatgggtgaagaatgctttcgacaaaaaggtgcacctgcgcaggttcaacgagggagacctggtgttgaagaaggtgtcccaggccctaatggacaataggggaaagtgggctaccaactatgaagggccgttcgttataaagaaagctttttccggaggagccctggtgctcgccaatatggatgatagcggattgctctcgcccgtgaacgccgatgtcgtcaagacaggaaaagacctatttcgagcgaaggtcaatgtcgcgccgaacggaagaccaaaggagaccaag

SEQ ID NO: 2331 - DNA, 425 bp, Glycine max
  Peptide Sequence Number=SeqID_119109
gttctggaattccatggagagttgggggtttcggttcgaaggttataaaatgcggtgcgggttcatctctctcgaccagttcagggaaagacggattggatcgagaggcgatgcctactctactcgttaccactaaacgacgaagccaagagcggaaggagggacttgaaccctcaacctcagccttggcaaggctatgctctaccattaagctatttccgccagcaacggtagtggcgaagcactacggagcaattaacgcggggggaggggcggctgccttttcaatcaatctccggccgctcagtgccgctattggtgcgagttgtaaggagtcttggtctcgagtcgagctggggcgtcatttcattctcgtaacgggagtgagtgcaccgcaagatcagacaagttactccctcgcagcg

SEQ ID NO: 2332 - DNA, 501 bp, Glycine max
  Peptide Sequence Number=SeqID_119110
atgactggtgacaagttcaaacttactgaccttgagttaaggaaagataaatatgtcacttttggagacaacaataatggaagaattatgggagaaggaaaaattggaaatcagcacaagaatgaaataaaaaatatgttggctcacgggtgcgtcttccaagggaggaaggagcgcggagttgccaccaacgtttatttaaggaaaacgtcggaaaaactggaaagtcaaacccaagtagatgtaccctctacttgtaccacaaaggatgtaccctccaatgtgttaagacaaagatctcaggctgttaaacctttgatactttgtgactggggatacaaaagaattctcaggcgggagaagggagacacaaaagaattcaggcggttagtcctttgttcttttggaaaagggagaagagagacacaaaaagaattcaggcggttaatccttggcgaattctttttggcaaagggagaagagaatgaagaggatgaatag

SEQ ID NO: 2333 - DNA, 500 bp, Glycine max
  Peptide Sequence Number=SeqID_119111
gcaggtctccggctttgatgaggagtctatcgcacaactattatgcataccggggcaagattttgcccagaccactgcagggaaacgagtgcggatcatgcgcaccaacacatggatgatgttgctacttagtaacattctgcccaacaaccacaactccaatctccccctaccgaagtggattgtgcccacaggacactcagtggatccgaagaagtccaacagggccctgggatttctagctctgattacgagcctctgccagttctacgaagtgcccatcacccccaacaaggtcatcaggccccctactaaccgagctttcatcaaaaagtattgtgcccctaggcaggcacagggcgaggcaccacagaggcctggggacggccagcagcgggcaacagacaaactgccaccacctctagagcccttagctcatctacaaaggttggagcattgcctacgacatgtggtcgaccagcaggcggccaaccaccggg

SEQ ID NO: 2334 - DNA, 1737 bp, Glycine max
  Peptide Sequence Number=SeqID_119112
tgatgaagagcttcctgaggaggggaggaaccacaatctggcgttacatatatcggtgaactgcaagtctgatgctctgtcgaatgtacttgtggacactggttcctcattgaatgtaatggccaaatccacattagatcaactttcctaccaggggcctcccatgagaagaagcggggtggttgtcaaagcgtttgatggatcaagaaagtctgttatcggggaggttgatttgcccattacaattgggccgtttgttttccaaattacattccaggtgatggatatccaagccgcatacagttgccttttgggtaggccatggatccatgaagctggggccgtgacatccaccttgcatcaaaagctgaagtttgtcagaaatgggagtttgatcactgtgagtggagaggaagccttgttggttagtcatttgtcagctttttcctttattggtgctgatgaaacagaaggaacctctttccaaggcctgactgtagagggtaaaaagccagagaaaaatgaagtatcttttgctacttggaagagcgcacagaaagtggtgcaggaaggaacaggtgtaggatggggaaaagttgtgcagttgctagagagtaaaaaccgtgaaggactgggatttgcttcttctgcaggatccgcaacgaacagtgttggatcaagctccattactagcaccttttgtagcgccgggttcatcaacaactcgccagaagccaatgctgtcttggaagatgttcctgaagagatagtgcttgcatttgtcacacctggaaaacttgttcgcaactgggacgcggttgacatcccttcagtggacgaaggcgcaattatactaggcattcatgagcccgttgaacataataaccctgcactctctcccaacttcgaatctcctgtctacgaggctgaagaggaggaggatgatgcaatcccggaagaacttgctcggttattggaatatgaaaagaaaaccattcggcctcatgaggaggtagtagaggtgattaacttgggaaccaaggaagataagaaggaagtcaagattggggcatcgcttgaggcaactgtcaaacgaagggtgattgaattactcaaagagtacgccgatgtgttcgcatggtcgtaccaggatatgcccggcttggatccccgtattgtggagcaccgtttgcctttgaagcccgaatgcccaccggtcaaacagaaactgagaagaactcaccctgatatggctctcaagatcaaagaggaagtacagaagcaaatcgatgcaggttttcttgtcacatcagagtatcctccatggttagccaacatagtgcctgttccaaagagggacggcaaagtcaggatgtgcattgactaccgggatttgaacaaggctagtccgaaagatgactttcctctacctcacatcgatgtattggttgacagcgctgcaaagtccaaggtcttctccttcatggacggtttctctgggtacaatcagatcaagatggcagttgaggacagagaaaagacatctttcatcacgccttggggcaccttttgttacagggtaatgccttttgggttgataaatgcaggtgccacttaccaaagaggcatgaccactctctttcatgacatgatgcacaaagagatagaagtgtacgtggatgatatgattgtcaagtcaggcactgaagaagaacatgtcgagtacttgctgaagat

SEQ ID NO: 2335 - DNA, 544 bp, Glycine max
  Peptide Sequence Number=SeqID_119113
attctcccctgctgcgatcaacaagtacctgggcagacctactgaaggagtggtggatattgatgtttctgagcatcagattgccaaggaaatcactgccaaacgagtccagcattggccaaagaaagggaagctttctgcagggaagctgagtgtgaagtatgcaattctgcataggattggcgctgcaaactgggtacccaccaatcatacttccactgttgccacagaatcatttgctgtcaaattacccattgccttccctactggaaaagctgctgcttcaggtgctgtgtccaaggatgccttgattgctgaactcaaggacacatgcaaggtgctggaagcaaccatcaaagccaacacagagaagaagatggagctggaactactgatcaaaaggctctcagagagtggcattgatgatgaagaagcagctgaggaagaaggagaagcagctgaagaagaagaagaagctgctgaggaagaggaagatgcagcagaagagacagaatcagatgatgattctgaagccaccccatga

SEQ ID NO: 2336 - DNA, 350 bp, Glycine max
  Peptide Sequence Number=SeqID_119114
atttcaaaggactaaccaccagagatacttttgtatcccctgcacaaagaattcaagggactaaccgcctaagaattctttgtcctaacacattggagggtacatcctttgtggtacaagtagagggtacatacacttgggttgttatactgagaacaagagagggtacatctcttgtggatcagttcaagtggagggtaacttggaagcccattaggggcaatgtggctgaaagggtcgaagacccctttattctactgagaatcacgatgaacgcgctaagcatgcctgttgtgcttagtctgttcatcgcattagagaaaatttcaatttctaaaagaacgcattaa

SEQ ID NO: 2337 - DNA, 270 bp, Glycine max
  Peptide Sequence Number=SeqID_119115
atgaccactcttacatgtatatggatgacgttgctatttagcaacattctacccagcgaccataatgccaatctccccctacagatggatcgcacccacaagacgcccagtggacccgaagaagtccaacagggccctggggtttccagctttggttacgaccctctgtcagtcctacagggtgcccgtcccccccagcgagggattgcacccacaagacacccagtggacccgaagaagtccaatagggccctgggtttccaactctag

SEQ ID NO: 2338 - DNA, 342 bp, Glycine max
  Peptide Sequence Number=SeqID_119116
atgggtcaactgatttctgataccatctattgtttgcaggaatcgcacccacaaagacacccagtggacccggagaagtccaacagggccctggggtttccagctttggttacgggcctctatagtcctacagggtgcccgttcccctcggtaaggtcacgtcatcatgacatagggatcgcgcccacaagacacccagtggacccgaagaagtccaatagggccctggggtttccaactctagttacgggcctctgtcagtcctacagggtgcccgttcccccagcaaggtcatgccatcgtgacataggtaagtatacatatggttcaactgatttatga

SEQ ID NO: 2339 - DNA, 900 bp, Glycine max
  Peptide Sequence Number=SeqID_119117
atggcagatcatgccgctgccgccgccgaccgcgccttcctgcggcaagccgccccgggccgcctgctgcgcctggcgcacgtgctcggccttgacgtgaaagccgttgatgtcgttgagcaggccgtcgaaggtttccatcaccaccggcatattccaatacaccgcgttatcgcccgcgggcagcgtttcacgctccagcgcgatcagcgcatcgcgcaccacgcccacgctgtgggtgttggtgaaggcgatcgggctggtcagcaggcccgcttcgcgcacccattccagaccggtggcgtcgccgttgccgttcaacacgtgcaccccggcgaagcagggcgcgtggcgcgcggagccggggcgcggttcgatcaccgtcacgccggtgcgcacgctgcgcccgtccgccaaatcggcatggatgctggtatggccgacgcgcacgccgggcacgtcggtgatggcgttcagcgggccgggcgtgccctgtccgatgataatgcccagatcctgagcgcgctgcgtcatggttattctccttctattgagggggcggcgaggggcgccggttggcggccgcgcagatggttcagcgccagcccgaagccgatgatgccggcaatgataataaagtctttcaggctgctggcgatcaaaatcgtccacagcacgtacaggcagcacagcagcgccaccaccaccggcagcggccatagcggcatcaggtacgggtggtggaagtggcggcgacggcggctgatcagtgccgccaccgccttgatcatgtacaccagctgctactggatcacggtcaacgaggtcagcgattcgagatcggagcaaaacgccagcgtctccgacggcactccgaacagtagggtggcgatccagggg

SEQ ID NO: 2340 - DNA, 372 bp, Glycine max
  Peptide Sequence Number=SeqID_119118
tccgatgacatgcagggatatcgtatggttatccgcacctttggtcaccccgagacagcgagtccgatgacatgcggggatggaaagtccgatgacatgcgggggtaccgtatggttatctgcactttttgtcatcccgagacggcgagtccgatgacatgtggggatggcaagtccgatgacatgcgggggtaccgcatggttatccgcaccattcgtcaaccaggggcaaacgggcctgttgacacgcagagactaacatcgtcttctgtaccttttgtcatcctgacccatgaagtcaggggcaaacgagcccgtttacgcgcagaggctaacatcgtcttttgcaccttttgtcatcctgacccatga

SEQ ID NO: 2341 - DNA, 174 bp, Glycine max
  Peptide Sequence Number=SeqID_119119
atgaggggggagagtttttgggtgcagaaaccttcccccctcccccattttaaccctcttcgtgcaggggttgctcgcccagcggcactttccgtttgtccagcgctgggcaagggacgacgatctatcggtcgtgaccctagcctctacttgcgtccgtccctaagtacctga

SEQ ID NO: 2342 - DNA, 480 bp, Glycine max
  Peptide Sequence Number=SeqID_119120
atgtccaatgcattcataggttgcaaaaagcttacaaagccaagtatgaagcaacttggaagatctggcttgaaaaagaaaccaaggaaaaaagctgatgcagaagttagattgaaagctactgtcaaaaggaaggccaaagctaaagttgcaaagataaaacctagcaaagtggtttctaaatcaattgttgcaactgttgaagcaccaaaagtggctgagtccactctacacatagttactaagaagccaaaagataaggtagatgaggccccaactaaatcaacctcacatgaagtcacatctaaagatgcaactgctatcattgtccatattaccacctgttggacaagtggcctcaataacataagaggggggggggactttgaacacaccttgggatcccatacccttatgttcaagattctcacactccaagagacacatcatctcttgattacaactgagttcaagagatga

SEQ ID NO: 2343 - DNA, 261 bp, Glycine max
  Peptide Sequence Number=SeqID_119121
atgacggagtatccaaagccactatggcatctgggggcaaagctacatattcaacagatggcgtatggatataatcatactttatccattaaggaaagcaactggaaaatttctgtgagcaatcacctctctggtttgttggacccatggtctctaacttcttctccatgtagatccaagaaatggaaacttggatgtgttgattggagtaagagacttcttgtaacgacctgtctcgtcgctacgatatcaccactctaa

SEQ ID NO: 2344 - DNA, 393 bp, Glycine max
  Peptide Sequence Number=SeqID_119122
atgcccactagtaccaccagaaccacttatccatcccatgttccagctgagcagaagataaagcaagcaatcacttccagttatcaatatgacaatgctcactttgcttatagcagtcatcaatatggacccttccaaggagaatcccactcctcaaacactatggtcctaagagatgtacgtatcaaaccaggcaactatttatcccctagactccacatcagcaaatgcactgacatcaagatggtgcctgacagagtctgcccaagactgcccatctatgatgaagggaaaaagaaaggcttcaagctctacttcaacaaagacatgcccaatagaggtcaaaagacacagttgatcaactaccctcgtgactggaagactctattctag

SEQ ID NO: 2345 - DNA, 443 bp, Glycine max
  Peptide Sequence Number=SeqID_119123
ccagcaattgctatcttgcactttgtgggatgattattgcttgcagtttttttaagttcttagatgattatgaaggtgatggcccaattacagttctattgagccattgtaggatcaaggaagcgcaggagttgggcattgaggcccggtcaagttttaaatcccatggtgaagggagtacacagctttcaggttctatccaattatcatcaaaagaatcattctttggcaaggctgaggcaaagactattgctgacattaacaccatctctgaagaaattgtttgtgtcactgttggcacaattactaggattgttctggacaatcattcatggtgttatacagcttgcattcagtgccataaaaaaagtgatgtagagatggcgccctttacatgtgcatgcgacaaatacgataaggaagttgtgcttaggtcatcgtga

SEQ ID NO: 2346 - DNA, 623 bp, Glycine max
  Peptide Sequence Number=SeqID_119124
atggcagttcaagcggaggacagtaaagctgataagaaggtggagggatttaaacaaccgctagttgatgaattggcactggaactggttgatgatttagttgaacttgaagaaattgttgaggaagtagaaggggatgaagaaggagagaccccaataagagattgtcaagagaaaatgaagaagaaggaagaaaaagaaaaaagaagaagaaacaaaagaagaagaagaaaaagtaaaaagttgaaaaatgaaaaacaaaaagagaaggttgttgagactgaaaagaagggcaagagtgaggctaacttagaaaagaagaaagaggctactcctattgaatgcaaggagaagttggaaattactttgccatttggagaagcacttcagcaaatgcacctctatgccaaatttttgaaggatatgttaaccaagaagaaccggtacatccatagtgacagaattgttgtggaaggtaactatagtgcttctattcaacgcattcttccacccaagcacaaagatccgagagttgtcacaatactgtgttctattggtgaggccgacgtaggcaaagctcttatagacttgggagctagtatcactttaatgcttctttccat

SEQ ID NO: 2347 - DNA, 109 bp, Glycine max
  Peptide Sequence Number=SeqID_119125
atgggaccaactcattttatttcaaaaaggaagtcatatctagtcaaggtgtctgccatcgccttggccttggctaacaatcgggggaagttcttgactcccgttcaag

SEQ ID NO: 2348 - DNA, 243 bp, Glycine max
  Peptide Sequence Number=SeqID_119126
atgggtgccaagtacctcgaagtggtcaaacgagggtcgcatcccaacaaacagatggcgcagaatgaccataatttgtctctgcgcgccatcggacacgatcgggcctggatggaaaggcgcagaatgaccataatttgtctctgcgcgccatcggacacgatcgcctctggatggcgaaaaggtgtgcggaatgaccataatttgtctccgcccaccactcgactcactgctcatgaatga

SEQ ID NO: 2349 - DNA, 192 bp, Glycine max
  Peptide Sequence Number=SeqID_119127
atggcagtgcagaagggaaaagcagacgtgcagggtgcaggccaaatcgccactaccattggtggtttgccttgcactgggatcgccagcatggctggcgggctgtgctttgtacgtgatttcacttcttatacgtggtttctctcgtcctcttgctacgtgatttctgtgcttggtttatttagaatgtga

SEQ ID NO: 2350 - DNA, 477 bp, Glycine max
  Peptide Sequence Number=SeqID_119128
atgggaacgaggggtagtatcaattataatcccgtccttgccataagagaacttggctatcccatgagaggagcaccgtcagaagaaattatcacacatttcatcgcacgaggtttcagtgaccccaatgcgaggatacttcaaggagtccacaaagcgtggggcacgatgcaaataaaagataaggagcttaggggaagcaacaacgggatcgtcggtggctatcacaagtggctgaaggcttggacacaagagttagattgggtcccgaagctaaagacctcaaatgaggaagaggctgaaacccctgaggagagtgaggaggttcaagccttaaaggtgaaacttgaaagggcacaagcggtcaaggaaaagttcaagacaatgaccatcaaggtctggaaagagtgtgatgagctgagagacatcaatgtggccacaaccgaaacattggaatgggaaacaaagagggcctga

SEQ ID NO: 2351 - DNA, 261 bp, Glycine max
  Peptide Sequence Number=SeqID_119129
atgggtgccaagtacctcgaagtggtcaaacaagggtcgcatcccaacaacggatggtccctggacgaaattaggatgcagaatgaccataatttgtctctgcgtgttattggacatgatcgagcctgggcggcaagacacagaatgaccataatttgtctctgcatgccaccgaacacgatcacctctggatggcgaaaaggtttgcggaatgaccataatttgtctccgcccacctctcgacttactgtccccgaatga

SEQ ID NO: 2352 - DNA, 243 bp, Glycine max
  Peptide Sequence Number=SeqID_119130
atgggaaggggtagggttcagctgaagaggatagagaacaagatcaatcggcaagtaactttctccaaaaggagagctgggttactcaagaaagcacatgagatctctgtgctctgtgatgctgaggtcgctttgattgtcttctcccacaaaggaaagctctttgaatatgccactgattcttggttttactatactttatatgtgcatatatcgacaaagttttgcatgagtgtggagtga

SEQ ID NO: 2353 - DNA, 375 bp, Glycine max
  Peptide Sequence Number=SeqID_119131
atggagaagatactggaacgctatgaaaggtacgcatatgcagagagacaacttgttgcaaatgattccgagacacagggaaattggaccattgagtatactagactcaaggcaaagattgaccttttgcagagaaatcataggcactatatgggagaagatttaggttcaatgagcctcaaagagcttcagagtctggagcagcagttagatactgctctcaagcaaattcgtacccgcagaaaccaactcatgtacgagtccatttcggagcttgagaagaagctaggtctctgtatggttgtaacggttcaccgtaataagtttcagagaccaatcttgattatgcgtgtccctctagacaaatcagcctga

SEQ ID NO: 2354 - DNA, 612 bp, Glycine max
  Peptide Sequence Number=SeqID_119132
atggcttggcatttggataccaattatgaagggaagcctacgaggttgttcaagccccttcctatccattttcataccaggaagcaatattggctaccatcaataagcttaatcttcctggagaccaagcagttcaaggcaaaaaagggcggtgaggaaaccacaaaggaggatggagctaatggtgaagctattgttgaagagcctatggagcttgaggtcagagatgctactagcggagctgatgatggtgctaaagcttatgtgggtgctaccaacgacaataagaagcctacaaatgaggatgctaataagcatatggagcctactactgaagctacaactaatataaatatggatcctaaggagggtgagcttaatgatgatgttgtggttaaggagaatgatgcagaaggtgtcactatttatggagctgcttctaaagacattgatgaagttgctaagttcattggaagtttcatctttaacattgatgaatatatcattgctatcattcgtgataaggaatctgaaacagatgaggaagcagctggtaacactactgagggtgttactaatgcagttcagatggaggaggagatcatcccatga

SEQ ID NO: 2355 - DNA, 675 bp, Glycine max
  Peptide Sequence Number=SeqID_119133
atgactcttggtcaattggaaatggcgaagattcgccatagtgaagttgcacttcaccacaacaaattttcaaagttgatgaccttggagttagtagaaacttgccacaacgagttaatcttttgccaaagcgaacaaggttcacttgtctattatgtcacaagcaaattcttttggttccaagcaaagtttgagtttttctatggaaggccatctaggactacttaccaactagaagcaagttgtagcaaagaggtgtccaatgtccttaacgagtggcgctattttgtaggcttctcctttgctacaaattattggtcagaaacggggttgttgaatgtgatcagggactatgtggattgctccccttttctggtagtccagagagcgagtgtgtccctccttgaatggattaaggtgaagaagaaagagcatattcaacctcagcaaagaatgcacaacttgaggtggcagaaacctccaccagttatcgttacaaagacgaagtctttgtccattgctgatatctttccccttgttgaagctgaagctttagcgtgcttggaagccatcaattggcttagggagcttggttatcaatgtgctattattgaaattgattgtaaaggggttgttgatggggtcaggggcaattgtacagctcagtctaattaa

SEQ ID NO: 2356 - DNA, 300 bp, Glycine max
  Peptide Sequence Number=SeqID_119134
atggagcaagtgctgcttctaggtcctgcactgaaaggacctgaggtcgaaatgagcttgacaacaataacagtaggtgcacctagcaacactctaatcacattggggtttggcgataaagtggtttctggtttgggaaaaaaccagggcggttttgctaacgttgcgctgtcgagcccggattgggtggtcagttaccatgttgctgtctgtgtcactgctttgagctttcaagtgtccgatggtttaaacagtggcaatgccgtacggacccgaacattacgtgcatcctctcattga

SEQ ID NO: 2357 - DNA, 195 bp, Glycine max
  Peptide Sequence Number=SeqID_119135
atgacctgctatgatgaaagaagtgagtttcccactaaagtacaagacacgctagcctatcaacatggattttgcttgaagggatgtgcatttaatgtaaatgctccaatgaactcaagacatcaaacgaggaacaaagtgaagaatccaaccattgtgagacaacaaatacttgtagatgaaggctatacatag

SEQ ID NO: 2358 - DNA, 378 bp, Glycine max
  Peptide Sequence Number=SeqID_119136
atggtgttcaagaaacttctgcaaaagcttaatgttctggataatgctttgctagacaaatccaagaaccccaactatctcttcaagttgacacacaaagtacccattttacccctacactcaccttttccatgttgctccgtcagtgactcgtcctcctcgtcgaccacggtgctagacaaaaatgccttttcacccgaacataattctcgcattgtagtttcaccagatgacttgagcttcgaggaagatctcatcattcatcgaccaatgatggatttttctggtgaatactccgatgaggaggaggaagaagagaaggaggtagaggagaaagaagaagaagatgatccaaagattaacattgttggtaaatga

SEQ ID NO: 2359 - DNA, 189 bp, Glycine max
  Peptide Sequence Number=SeqID_119137
atggtgatggtggtggttgggttggtggtggtagaggtgcttcagactgagatgttgctgctggtggtggtgatgctaaatatgtgtctaagagaaactagtgaactgatcagtaataacactttgaatagaaagtcgatattgctcattctccaagcttttccattcagtgaaggcttacagctttaa

SEQ ID NO: 2360 - DNA, 570 bp, Glycine max
  Peptide Sequence Number=SeqID_119138
atgagtgcgcccacgtccaattttgtagattggccagtagaggatgatcacaaagagtccattcaactgttgtgtccaactaaagtatatcactttgacgatgtcatagcttgctttgtcaaaaatcatgaagatggatttatcaagagattgctcaagcttccagtcatcttccaccacactgtctttaatctaaaaaagatggatgaagacgagttctctgcacttgtattgcatatatttaaagaattgaagcctaaaagagctaagtgggagaagcacattcaatgcaagcttgctgaaaagggtggacaagcaaaagcgaagcatgatgaagctaccaacatcacccaaaagtcatcgaagatattgattcatctaatgatcaattacttcaactcattaggaggtagttgtgtactcaacaagttaaaacattcccaaggatgttgctctgatgcaatcctccctaggaagggaccagtcactagagccatgagcaagaggctccaagaggattgggctagagctactgaagaaggtcttagggttttcatgaacctcagatag

SEQ ID NO: 2361 - DNA, 296 bp, Glycine max
  Peptide Sequence Number=SeqID_119139
atggaggcagtaatggtggctcttgaaggagatgcactttcatggcacaagaacgtccagggaatgccaaccataattaaaagggttaaaaataggaatttgtcttcccaaacctcccagttatcaatctacaaggggggagtggaagtagtccttctgttagaatggttggctgagttgggagagatcaaagctaattttgatgatttaaggaggatggatcaaggaaaaggtttcattttggagcttaatcatattcctgatcagcctgtgatagagattgaagttgcaacagg

SEQ ID NO: 2362 - DNA, 804 bp, Glycine max
  Peptide Sequence Number=SeqID_119140
atgacgacgacgaattccctcttcttctcccttgactggcacaatgaattctatcctacctatcatgatttctaccttctcccccttttcgctctcttcttcccttcccttcgcttctttctcgaccgattcatattcgagaaagtggcgagacggttgattttcggaaaggggcatgcggcgctggactaccattcagacgagagaagaaaaaagattaggaaatttaaggaatcagcttggaaatgtgtttattatctttcagctgagattcttgctttgtctgtaacatacgatgaaccatggtttacaaatactagaaacttttgggtgggcccagggacccaggtctggccagatcaaaagatcaagttgaaattgaaggcagtctatatgtacgctgctggattttactcatactccatttttgctttgatattttgggaaacgaggcgctccgactttggagtgtccatgagtcatcatgttgctactgtaattctcattgttctgtcttacattttcaggtttgcacgtgttggatcagtggttttagcacttcatgatgctagcgatgtgtttctggagatagggaaaatgtccaaatacagtggtgctgaaactatggctagctttgcttttattctatttgttttatcttggatcatattgcgtctcatttactacccattctggattctttggagtacaaggtttatatttgtttgcttcccaatttacattatttttccttctcgctgttatattttatggccttcacctgtctattatgtggcttcttaa

SEQ ID NO: 2363 - DNA, 224 bp, Glycine max
  Peptide Sequence Number=SeqID_119141
gtgtggcgactgatcctaagaaattggaggcaacgtggttgtggcctattcctaaggatatcaaggggttaagggtttttcttggtcttggtcttattggatattactggagattcgtcaaggagtatgtactattgggtaaggaaaattcagttgcagatactctttcttgtgcttcttttgctgccctttcattagcacagggagtggaatggcttgattag

SEQ ID NO: 2364 - DNA, 276 bp, Glycine max
  Peptide Sequence Number=SeqID_119142
atgtctcctttccgagctttgtatgggcaggaccctctattatttaaaggaaccacagttctttccaagattgaggaaattgatcagctgactcaactaagagatagcctactgcaggagctgcatgagaatttactaagagtcttcaacccatataagatgagatcaatggctaaaagattaaatgagaagttgagcccaaaattttatggaccctacaaggtctcaagaaggatgggggcatttgcttataaattagagctttcagcccattaa

SEQ ID NO: 2365 - DNA, 240 bp, Glycine max
  Peptide Sequence Number=SeqID_119143
atgcaaggaagatgtgttctatgtgaccttcatgccaccttgaacgcatttgtccgtcaagctagtgacgttaaagaagtgcttattgggaggcaacccaggatttctacccttttcttctctttttctatgatttgtttaataattatgcacaggctaagcgagtcatgcattctcgctaagccaatggttctcgctaagcggattatgcaggaaatttccttctgtaaaactcgctaa

SEQ ID NO: 2366 - DNA, 249 bp, Glycine max
  Peptide Sequence Number=SeqID_119144
atgaccaaatgtagagttatggttgagatgggtttcctaagagtaaggaaagttttatggtcattgacacctagtgagagtaggaggcctggaagatggttgaagaacttgagcacctcactaagcgcatcaacaacggctcagcacgaggagacaacttggaagtcaagcttagcccgcatctgcgacttagcctgcatttggcggcttattgcgcatctgtggcttagcttgcaccttgcagcttaa

SEQ ID NO: 2367 - DNA, 273 bp, Glycine max
  Peptide Sequence Number=SeqID_119145
atgaagcaatccactctattcctgttcctattcctattccccctcgttcatgctctttcttacgaagctgcttatattagagatggcctcaaatcctattcccagcttgatctccctcactccgtttttggttctgaaagtgtagccttcgattgccatgggaaaggaccatatgttggagtgtctgatggtagaattctcaagtggcaagagacaaagagagagtggattgactttgcagttacctcgccacacagtgtatggttagaatga

SEQ ID NO: 2368 - DNA, 486 bp, Glycine max
  Peptide Sequence Number=SeqID_119146
atgtctcttgctactccttccttcgtcgaaagtcactttgccttcctttctatgaaggatggggtttcttctctatggggtaaggacttcattccccgtgcttttattccttcttccatgctcagccaatcgaactacgacatgctaagggaagcaaccctccgaacctctatggactccattggacaagttgagtgtgccaaagctgagcaagccttgcttaaagtcaccaaggccaatgaaactctgtttcaatcggccaaggattcttggaaatatctcaaagatatgaagactaagttaaaggaggtagtgtctcgagaagaggccttaaagaccaagttggctacaaaggctaaggaaaagttgaagagtgatctcaacaaagctgaggccaagatcctaaaacctcatgaagccaacttcttcaaggacacttgccaagcgaagtacttcttcaaagagcctactcatcctatagcttag

SEQ ID NO: 2369 - DNA, 340 bp, Glycine max
  Peptide Sequence Number=SeqID_119147
tgtgtatgcagcatctcaaaagggtttaatagggattatcttgaattctgactggtatgcgccggtttctaaagagaaatctgatcaagatgctgcacgtaggggccttgacttcatgtttggatgggttaccaacttgaggaaggaaattatcgaaggtcacacagacaagaacttcattgaggagaacagttggaagtatgacaatattactaagacagataagagatatggctcttacatttctcgggttcctgattctttgttgaagaaatccattcctgattttgctagaccaaatcatgatggtctgtacagagctatagacatctacttgaag

SEQ ID NO: 2370 - DNA, 333 bp, Glycine max
  Peptide Sequence Number=SeqID_119148
atgtacgaagaaagtagttgctatgatgatcccaatgcaatggtttcacaatcagagggagttatgtctgccacacagacccacaaccacaaccacaacaacaacaccgcctttgcctactcttattccagtggagaagatgctgcaaatgcaaatgctaacgctgcaatagcaatggaaatcattgcagaacaccctcaacaaaatcaatacaattatagcaacaccccacttgagaatcatcaccaacttccttatcccacaccaacagtaccagatctccttaaccttctccacttcccaaaccctattccaggagataatagcacaaac

SEQ ID NO: 2371 - DNA, 531 bp, Glycine max
  Peptide Sequence Number=SeqID_119149
atgtttaaagatccagcttctgagggtactaccgaagatgattttagggactatgctaaactttgcttcaaggaatttggcaatagggtgaaacattggattactttgaatgaaccgaggagtgtgagcaataatggctatgcaaatggcaggattatcccttcatgggctttatgccatattattgttgctgatcctctttttcttttcctcctcacttcagaagggcatgatgaatatgaatatgaaaatgacgggtttatagtggatgaggacgaagaggaggatgaagaagaagatagagcaaaatctgatgatgagccaccgaagaaaaagaaaaggaagaaaaaggaggagtatgtccttgatgaagatgattatgaattgctggaggacaataatatcaatattcatcgtcggaaggagagcaaaaagtttaagcggctgaaaaaaggcaggagggataccgaggaggagccctctgggctgtctgatgaggaggagtttgttggaagtggtaaagttgggtga

SEQ ID NO: 2372 - DNA, 231 bp, Glycine max
  Peptide Sequence Number=SeqID_119150
atgccggctctaagtaatgatttccccttcgctggccacgccgtcgaaggagaaggcattcaaggctttggaaatggagtggtggacttcactcaagatgttgggaaaaagagaggtggaaaaaggaccaagcagttcactagcaccatcactgagaaacaaaggagagtggatttgagcagtaaatttgatgctttgaaagaactcatcccaaacccctccaagaattaa

SEQ ID NO: 2373 - DNA, 321 bp, Glycine max
  Peptide Sequence Number=SeqID_119151
atggggtgcctcctcacaaagggggtcgcaatgaccaggcctgggcgactgtttatcaaaaacataggtctccacaaagtcatacatgatcttggaaagaagatttggacatcaaagggagaagaaaaagaagctgccaagaaggagttcataaaggcccttaaattgttggaggaacaactgggagataagagttattttggaggagacaatattggcactcattatttatttagcaagcatcaggtttttatttttgcaaaccctccttctgtcaatactcagtacgaatctaacaaattaatcataatcctcttgtag

SEQ ID NO: 2374 - DNA, 246 bp, Glycine max
  Peptide Sequence Number=SeqID_119152
atgggacctggtatttacggtccctccacacattatttttctatattttatcatctcaacagaaaaattgctaatatattttattgtctcaatagaaaaattgctaaattcaaattaatgtataatcagaggagggagagagaggcgaattttggtggagttcctaataaccctcaaccaaagattaaggaggtcaagaagaagatgaaaggaaaggtcaacacttcaagcatatctggaaactga

SEQ ID NO: 2375 - DNA, 225 bp, Glycine max
  Peptide Sequence Number=SeqID_119153
atgggcaatcagagttccttgctttccttccccgagggaacggaactagcactagaattccgagccacctatccatcggtctccttcttggcatcaagagtcgtcagtactgaaaaggccctggcattaccatcgggaaatctaggaggacagctcgccgagcctatggtggacgtcggttgggttgtcgacgattacgaccattcaaaggcatttttccattag

SEQ ID NO: 2376 - DNA, 456 bp, Glycine max
  Peptide Sequence Number=SeqID_119154
atgacgaagaaaagtgctgaaacgtctcgagctgatgtgagacccaagaaacccactggggtgaagatccaagaagggaaacaagaagagaaggaagaagaggaaagacctcttataagaaaaagaaagttacctgcgacttcgaccaagtctgctgaacaaacagaggcaggcaattcccaggctcaaatgcctaagaagaaaaagaaagtgaagcaggtcgagcctgaaccttctgtggctgttgagggtggtgagccaatcaagaagaaaaagaaaaaaaccaagccttcaaaagaacaaggtgacaatcaacctgttgacgtccaaccaccttcgaccgatattgacggcactgaagtagaggctactccttctgttgctgagatgggcaaccctgtcgatcaaccggactcaccacaagaacaacctgccgtcgaggtatcatcctcttaa

SEQ ID NO: 2377 - DNA, 225 bp, Glycine max
  Peptide Sequence Number=SeqID_119155
atggcgatttcgtcgtcgacgcgacagcttgcaccggtgtcgccatcttcaatggcgtgttgcaccaagcttggactcgccagtttgactggcgagttgagggtaggggtttgcagttctcaggctacgtgcagcagctttgcaggaggagggacagctttttggtggaaaacgccagtgctactggcgatttgtgctgcaggcaggttcaaggtacagctttaa

SEQ ID NO: 2378 - DNA, 336 bp, Glycine max
  Peptide Sequence Number=SeqID_119156
atgacttacaccaagaaaactgatcaaatgatgtttgaggcggcaaagaaaattgctaacaagattgattccatggaggagcaggcttcagaggattccattgtcgctcatggacaacaccctggtcgtgtgcgtgctgctggagccgatgtcatgatcaaacaatactttgaaccggctccaaggacctcccacacgtcttcgtccatgactccgaaagacatggagcagttgaggcaaaaaatcagggaccaactggaggagtcaatcacagaaaaagtgactcgacaagtaatgttgtcctttagccagatgcaatcccggtttcaatcgtag

SEQ ID NO: 2379 - DNA, 216 bp, Glycine max
  Peptide Sequence Number=SeqID_119157
atgggggttcaaatagcagctaggcccacttgggccttcaaggatgttcctcccgaaggcggttgcttctggaggaagcaacctagctcgcctgggcgagctggaaaatccaagttgaggcgcttccgtaacgtttccgtgggtgattttgcgaagattttcaaccgttcttcgacgttcttcgttcgtttttcatcgttcttcggtcttcaaccg

SEQ ID NO: 2380 - DNA, 433 bp, Glycine max
  Peptide Sequence Number=SeqID_119158
atgggtgcaaaatacctcgaagtgatcaaacgagggtcgcatcccaacaacggatggtccccggacgaaattagggcagcctccccactgcaaaatataagggttatagttgtggttgtgggcgatactgaaggccccccaacgtgtctcccccatgggttgagagacatgtgcatgaccagattggggctattggctcttaatgggtatggaagcggagtggtcgacattctcatcaggtgcatgtacaacaacgggtggtggatagttgggaggcaagccatacggtgggaagggatgcttgctctggacctgcacaaaatgggggccacccgtacttcccaaggcatcgcctccctgacctaccatatccaagactggacgattcacttgattgataccagatgggtgagtcgggtctacctaagtggcg

SEQ ID NO: 2381 - DNA, 273 bp, Glycine max
  Peptide Sequence Number=SeqID_119159
atggaggttgatgaacctcggctagggttatggctaccattgcattatcgagtggatatgggagcaagtcagcataggacaccggaatttgggtgggttttgtggtttgatttagggatggcctttatggataaatgggtggtgggtaaggagatgggttgttattggttgagtaatgacattgttgggttggatgaccaatttgcctcttttcagacccacttgatccttccgctggcgaagtccaaatcatcaaagcttgaaggtgtgtag

SEQ ID NO: 2382 - DNA, 876 bp, Glycine max
  Peptide Sequence Number=SeqID_119160
atggagacaaaatcatccagttcctctacaaacttggtagaccaatcagtgtgtcctggagatgtgattcttgatctgtctaacatgacaaaccagacaattaaacttggtggtggtctacgacaggactgtgatgcgatttctgtaatgaaggctggcagactaaggttctcaaagcctaataaatactgggttgaaaattctcagaagaggtatgtgccacatgcagaggattctgttcttggaattgttgtagactccagatcagatgcacaattgcgtgtttatatggaggaatttcagccttccatcatgttccgccatccaccattgattacactgatgtcatctgttaactttcttgttgacataaaagggccagctttagcatttttaccagtgcttgcatttgaaggaggaactagaagaaatatacctaggtttgagataggtactttgatttacgcacgggtcgtaaaagcaaaccctggaatgaatccagagttggcatgtactgatggtagtgggaaagcagcagaatttggtgccctaaaagatggctatatgtttgagtgtacaacgggtctctcaaggatgcttctcagttctcccacatgtccagtacttgatgctttagggaagaaactgtccttcgagatagcagttggcttaaatggacgtgtttgggtatgcaaaaacactctatttctagcgtgccatattatgttctttttcttggcttctttaaacggacttgtctctgcagcatctccacaaacaactattgttgtagctaatgcgattatgaattcagagacattgagtggtgctcagcagagaataatggttgaaaagctgctggagaggatccattga

SEQ ID NO: 2383 - DNA, 661 bp, Glycine max
  Peptide Sequence Number=SeqID_119161
atgttgaccggattaatgaagaagatcgcatccaccacaatggggagctgtgcctcaaatccaagcagaaagagcagtggtcagaaaagaagaaaacaaaagtctgggaaacgcagaggaaacggccttccctctgcacttcctgaattgcctttgaaaagggttagcaatgccggaagccgtgtgggagacttctctctcagtaactttgttcacctggactttgagaataatggtgcttcagccccctcctgcagaagatcagaggtttcaaacatgaagtttcatctcacacaataccatagtcatagtcaaattgatgcaaatggaaaataccaagaagaagcatggtttgactcagttagcattatagaatctgattcagatgatgaattcagcagtgtgcatggagattgttttccctttcccaacaatgctatgggaagtgtcccaaatactcagttactccagtatgaaagtgcatcctgcattgtagattcagtgcataagtatgaggagttttacgaaagttacctcaaaattgatggtggaaactgtaagagtggggagagaactcaagaaagcagctcaaaacaatcaacagttatcatgctttctgtaaaaaggacttcaattgatggacatgacaagactgaatcat

SEQ ID NO: 2384 - DNA, 768 bp, Glycine max
  Peptide Sequence Number=SeqID_119162
atgttgaggctatggatttcttatctgcaattgttggagcttttcgtgagttcgttggttcacatgctttatgggttttacatatttagctccgctgttgctggggatctctcacaggttctcaatgaatattttcacaaggctaataataatgtgaatgttgaggtcaaagaggaaatttccaagctcaataatgctaatgatcttcctcctattgtgttggttcatgggatttttggatttggcaaagggagattgggggctttatcgtactttgctggggcagagaagaaggatgaaagagttcttgtccctgatttggggtccttaaccagtatctatgatagggcacgagaattgttctattatttaaaaggtgggcaagttgattatggtgaggagcacagcaaggcttgtggacactcgcagttcggacgaatatatgaacaagggcattaccctgaatgggacgaggatcaccctattcattttgttgggcactcagcaggagcacaagttattcgtgtcttgcaacaaatgcttgctgataaggcattcaatgggtatgaaaacacctcagagaactgggtattaagcgtcacttccttatcgggagcgtttaatgggactaccagagcatacgcagatggcatgctggtggttgagagagcatgtattattagttcactagttcctgccagaagatgggagaacattgaaacctatttgcctgctacagctgtgccgcattggggtgataatatatga

SEQ ID NO: 2385 - DNA, 294 bp, Glycine max
  Peptide Sequence Number=SeqID_119163
atggagcggtatttacagcacttggtttgccagcaggcggccaaccacaggggacaggtgcagacccatgagtgtctcaaccagctcagcctcagtctgcagagccaaggtttcgctccttttgcctgccctactccagatcagttcagggctgaggttgcatggcccggagattggcctgaggcccaggcaggggaggcgcccgcagaggctcccggcgacgtggaggaggctcgcatggatgagaagatgacagatttactcggtttcttgggagggagtggagccacatga

SEQ ID NO: 2386 - DNA, 153 bp, Glycine max
  Peptide Sequence Number=SeqID_119164
atgtggttgaaaggggtgaagacccctgtggttttgtctggaaatcgcgatgaacgcgctaagcgcgcctgtgcgcgtagcctattcatcgcagctgtcaaaattttggatttccagatgaacgcgctaagcggaccatgtcgcgctaagcgc

SEQ ID NO: 2387 - DNA, 2295 bp, Glycine max
  Peptide Sequence Number=SeqID_119165
atggaatactgcttgcaattgtgtcgggtgttaatgtttgcattagccctggccatggtagttgctgttgcacctgatcgaaccctttctgaagtcacaccttcttcactgaaccaagcagccctttctggctgcaaatcctcttgtggagatgtcgaaatttcatatccattcggtataggatactcatctttaccagatcacaagccctgtttcttgcagtcaaagtttgaacttacttgcaacgacagctccaaaaaattactttgggctaacttggaagtttcaaatataaatgtcacaagtcatcagatggtggtatcctttttcgtctcagagttttgcagtaaagaaaaagcctttaataagccctggattaaaacaggcaggttcagcatttcaagaaaggaaaacaagttcctcactgtaggctgcgatagttatggctatctcaatagttacttcgatggggatttgtattcaacagggtgcttaacgagatgttatggcaataacaacttgattgataatgaaacttgttggggtatagggtgttgccaggtagatattcctcctctaatgaggaatatcactgtagaagcatcttctttcgtccaatcagggacggatagtagtggtgtaaatgcctcatcaactaccttcttcaattcaacatgcagttattcctttgttgtcagaaatgggttttataaattttctactactcatttacaaagtttcccaaacaagacgctccccatggttattgattggactgcgggagacaaaagctgtaaggattccatgggtagaggcgactacgcgtgcaaggcgaatagctattgcgacgacggcgacactgattatggttaccgatgcagatgtaaagatggctatgaaggaaattcatatcttggctgcacagaaattttggaatgtacgaccaggagacacaattgttcaagggaagattattgtcgcgaagtccgtgggtctttcgaatgtttctgccccgatggactaatcggaaatggaacaatagaaggtggaggatgccaaccaaagcagcgatataatgtatttaccaaggttgccattggtgtaggattacttggtctatttatggggacttcttggctatacttgatataccagaaaaggaaagtcctcaaattaaaggagaagttctttcagcaaaatggtggtatgattctaaaacagcaactctcagcaagagaagactcgacgcagtccgccacaattttcactgcagagcaacttaagaaagccaccaacaattttgatgagagtttaatcatcggtaaagggggttatggtacagttttcaaaggagttctctcaaataacactattgttgctatcaaaaagtccaaaactgtggatcagagccaggtggagcaattcattaatgaggtcattgtactatcacaaattaatcacaggaatgtggtcaagctcctgggttgttgtttagagacggaagttcctttactggtttatgaatttgttagcaacggtaccctttttcattatttgcataatgaaggccaattagccaatgtgtgttggaaaacacgtctaaggatagcaacagaggcagctggagctctgtcatatctacactcagaggcctccatacccatcatccatagagatgtcaagactgctaacatcctcttggatgatgcttgcactgccaaagtttctgattttggtgcttcaagattgattccacttgatcaaactgaattagccacaatagtgcaaggaaccatcgggtatttagacccagagtacatgcaaacaagccaattgactgaaaaaagtgatgtttatagctttggggtggtgcttgtggaactgctaacaggggagaaacctttctcttttgacaagccagaagataaacgaagtcttacagttcactttctatgttgcttgaaagaggatcgcttgtttgatgttcttcaaattggtatttatgatgaagaaaataaacaggagatcatggaagttgctattcttgcggccaagtgcttgagacttagaggggaggaaaggcctggtatgaaggaagtggcaatggagttggaaggaatacgactaatggagaaacaaccaaggaccaatgcaggccaaaattttgaggagactcagtacttgcttcatggggcatatagcactcatgaaaatggtgatagtagtggccaacaaaatactggatatgacagcttgagagatattgaattaattgacttcggtgatggaagatga

SEQ ID NO: 2388 - DNA, 1507 bp, Glycine max
  Peptide Sequence Number=SeqID_119166
gatggcgatgcggcggaacaggcggcgaaggcgatgattgccagctcaaccgcccgactcaaggagattttgtgacgcgttatatcgccattgactggggctccaccaacctgcgcgcctggtattaccgcgccggtgaatgcgtcgatgagcgccgttcggaagcgggcgtgacgcgcctcggcgaccgcacgcctgctcaggtgtttgccaccattaccgacggctggccggtggccgaagtcccggtgatcatggccggcatggtgggcagcaacgctggctggctggcagtgccttatctcgcctgtccggtggcgctcaatgcattaagcgatcgcctgacctgcgtggaaggaaaagcgtggattgtgccgggactgagcgtcgaacgtgacgacaactacaacgtaatgcgcggtgaagaaacccagctgctcggcgcggtcacgctgcagcccgcgccgctgtacgtcatgccgggcacgcacgccaagtgggtacagattgaacaggatcgcgtcatcgatttccgcaccgtgatgaccggcgagctgcaccatttactgctgaagcagtcgctgattggcgccggtttacccgcgcagaagccagtccggacgcgttccgggacgatgacgcagcagttaacgcatagccgccagccgattgtcattatcgccggcagcgcgctggcacagcgttatcagcaggcgctggcctttatcggaacagattcagtcacgctggagggcgatcgcgctttccagcacggaataaggactgaagcgcacgtcgcggcgttaatcgacgccggtttcgatgcgattgaaattccgctcaactcgccagagtgggcggaaagtatcggcgcgatggtgcaaaccttcggcgataaagcgctgatcggtgccggcaccgtgctgcaggcgacgcaggtcgatcagctggcggcgctcaacagcaagctggtggtgacgcccaataccgatgctgcggtgattcgccaggccgtggcgcacggcatgctggttgccgcaggttgtgccaccgccagcgaagccttcaccgcgctgcaggctggggcgcaggcgctgaaaattttcccgtcgtcggcttttggtccgggctacatcacagcgctgaaagcggtgctgccgccggaggtgccggtctttgccgtgggcggcgtcacgccggaaaacctgcatgaatttatcgccgccggttgcgtcggggctggcctgggcagcgatctctatcgcgccggtcagccgctgtcgcgcaccgtggagaaggcccgcgcatttattgctgcctataaggacgctccggtgattgaagggcgcgcacgcagcgtcgaagcggcggtgcacgagctgtcggaatatctgattgggcaggatccggcgcggattaatgatctgtggcaggtgatgtatcgcggcggttggtatcgcggaggcccgattttaatgaacgccattgtcggtatcgatcaggcgct

SEQ ID NO: 2389 - DNA, 162 bp, Glycine max
  Peptide Sequence Number=SeqID_119167
atgccactgaaagactctattaagacaaagacgggctgtcaagaacatagaggagttggagttggtggctctcctagggtttcctcatttgggatcctagggaagaggatcaagctagcccttgcaaacaacttgatgcactatctcctttcaaccctctga

SEQ ID NO: 2390 - DNA, 1032 bp, Glycine max
  Peptide Sequence Number=SeqID_119168
atggcagagccatcgaagaagagaaagggatcatcctccaccgctgctgctgctgcccatcaccgccacggaccatctgaagcatccacagcacctattcatccatctttatcatctccaagatcatcaactttgttttcttctgatgatcagcgtctacgggacttctctcaattttcttctaggatcatcttaaaccctaagtacctagatgtagagttctttaatgatgaaacgtttgattgctatcaagtgtttcaaaattctggtcttgttgatttcatgtcattaaaattgccatattatcctgaacttgtaaaggtcttctactgcaatttaaaaattcaggatggtattattatgtctgaggggcatggtgcaccttttgagggcaccattgttgatgactggaaatttgattattcgagtcatgatgctcgtcgcatggtctgcaatgatcaagctgaaatgaccggtagattgctggccgggattttgcttcctcggtcttcaaatttagcacaagcctctgaggaggatttgattcttatgtgggcttttcttaccggtcgtcagattgactgggcccatttggttcggtaccgaatgcataaggcattacgggctaatgcacctcttccttatccacatttgattactctgtttttgcgtcattttcaaattccgcttgatgatgaaccctttattcaagtcaagcgttcctttgcaattggtgctggtgcagtgacctcctttgggtatcgtaaagatcggaatggtcaatggctgaagaaggatgcacttcctcctcaagatgaacatactccttcacctcctcctccacgcgaagatttcgcactcatgaatgaagtcctctccgaattacggggtcttcgttcttatgttggtgaccgcttcgaatcgttagatacacgctttgctggtatggacattcgcctcacacagcttgaagaggatgtcggatacattcgtcagagtttcgatcttccaccaccacctccgtcttcttag

SEQ ID NO: 2391 - DNA, 1170 bp, Glycine max
  Peptide Sequence Number=SeqID_119169
cgccggtgtggaattttgtcgtgccgccgatgctcggcagtcagctgatccagatgggctgcttgattgccgcccgcgacagcgtcggccgcaactatccgctgtgtgcgctgcgccattttacacccgccgagtggtcaccggcgctgctggcccgctcgggcgagtggtatcagcaggtcggcaatatgctgctgcgcgtggtgcaaaacggcggtacgccagagcagcttgaccaggcgctgctaagcattccgcagccccagcagccgcaaactgacggcgaacaatcggacattttacaggtgattggcgacggcgagccgtcaacgctcaactggaaactgccgggtgacagcttcgacccgcagttttacaccagcttctggtggacaaatcagagcgacggtttcccgctttacacccaggtgcacagcggcaacttcaccgcacagctgccaaccgctatgacgatgaatattgacgcgctgctggcgccggtcagcagtgataacccctgcggcgacaacctggagtatcacgcggattaccaggcgatggagcaggccagtaccggtaaagccgaacagcaatttggcgagaccattatcccggctgaatcagcggactggaataaagtcgaaaagctggcgattgacttgctcagccgcagcaaagacctgcgagtgatgttagcgcttactcacgcctggaccgagttgaaagggctaccgggctatgcgcaggggctgaagctgattgagcaggcgctgctgctgtactgggagccgctgtggccgcgactggaagagtacggcgaacaggatccgttttaccgcatcaacgcggtggcgctgctgggcgataaatcagcgctgagcagcgcggtacgccagagctggctgttgcgctacgcctcggatggcatcacgctgcgcgatgccgcagcgctgtgcgacggcagcaagaccgaagttgcggactatcctggcggtctgccgcgcctgaccgatgagctggcgcgcggcgagcagcccggtattgaagcggtgctacagataagtgagcgtttgcaaactattaccgaaactctgaccgaacagctgggggaagcggcggtgccggagctgtcgcagctgcgcaggcagatcgccatgatcgccgaacgct

SEQ ID NO: 2392 - DNA, 927 bp, Glycine max
  Peptide Sequence Number=SeqID_119170
atgcacaccctcacctttagaggcctacatgcccttgccttcagaggactacatgtcctcgccttcagaggactacacttcctcaccttcaaagggctgcacaccctagccttcacaggactacacgtcctcatctttagagggttacacgtcctcgcctttagaggactacacgtcctcgccttcagagtactacatgccctcaccttcaaaggactacacgagctgtcagagggctgcacaccctcgccttcagaggactacacgtcctcgccttcagagggctacaggtcctcgccttcaaaggactacacatcctcgccttttggagggctgcacaccctcgccttcagagggctgcacaccctcgctttcagaggactacacgtcctcaccttcagagggctgcacaccctcgccttcagagggctacacattctcgcctttaaaggactacacatcctcgccttcagagggctacatgccctccccttcagaggactacaagtccttgccttcagagggctgcacgccctcgccttcaaagggctgcacgccctcgccttcagagggctacacgtcctcgcctttagatggatacacgcccttgccttcagaggactacacgttcttgccttcagagggctgcacaccctcgccttcagagtgctacgcgccctcacttttagagggctacacgtcctcaccttttgggtactagtcccctcgctttcagaggactacacgtcctcgccttcagagggcagcatgccctcacctttagaggactgcacgtcctcacctttagagggctacacgtccttaccttcagaggactacacgtcctctccttcagaggactacacgtcattgccttcaaagggctacatgctctcgccttcagtgggctccacattcgcaccttaa

SEQ ID NO: 2393 - DNA, 207 bp, Glycine max
  misc_feature (7)..(7): n is a, c, g, or t
  misc_feature (17)..(17): n is a, c, g, or t
  Peptide Sequence Number=SeqID_119171
atgatgncggattgggnaccgagccttgggaagaccgttggagttgaatccagcgaagtacacaaggttttcgtcaaagatgacggccgttacgagtttacggttggtttttgtcgagtcgttttattagaaggagaacaaggttggtatgaaatgaaattaagtgagagatacatgaatgaagaagaaaagagagagaaacaatga

SEQ ID NO: 2394 - DNA, 231 bp, Glycine max
  Peptide Sequence Number=SeqID_119172
atgcgtggttaccttatggttacccgcacctttcgtcaaccaggggaaaacgagcccgttgacgcgaagagactaacatcgtcttctacaccttttgtcatccagggacggcgagtcaggtggcaggcggagataccttatggtcatccgcgcctttcgtcaaccaaggggaatgaatttgatggtttttactctcgtcgtccggaaacattcaagcccaacgacgcgtga

SEQ ID NO: 2395 - DNA, 984 bp, Glycine max
  Peptide Sequence Number=SeqID_119173
atggatggtcttagttgggatgcctcacaactgtggagtactattcagcaaccaccagactttgaaggaggctactccatgccccccaatgttctcaatcaaatacaagagatgcagaaagctcaaacaggtcatgcatattcaaattctgaaagagggatttatcactcggcaggtgccactaccacttcctctgagatgatggatgtgatgcaaaaacaagacacaaatctatcacagcatgtgtcaatcatgcaagtgaaaccagctggagctggagccagttggggagaaactttaacatcccaatcatacccatccctatcagtcaatagacctcacagtatgaacctgattagcaactacatgccagatttctacatggcccaccaacaacagcagcagcaacaacaacaacaacaacttgagtcttttgactgcttgatttcagctaccaacagcaacacagacatcacttctgttgaagatgatgatgggatctcaatgattttatctgactgtggaaacctgtggagcaacttcagttatggcagtgcagcttccacaggtgagtctgagagcaatgcttccaatggtagaaacaaagacatgcagtgtagtccagtcaatattgaagttgatgaaacagtttctcaaacagtggaatcagaggctaattgttcaaagaggagtcatgcccatgatcaatctaaaatgatcaaagttggtgattcctgcttcagtattgttcaaaattcttctcctattgaagaaggtggtttcagacttgtctcagatattaatcaaccagaatgcaagaaatcaagatgggatatgagttcctcctcaaataatatcaatttccagcaaccaaattcatccatttcttcttccattgaagagcctgatccagaggcaattgcacaaatgaaggaaatgatatatagggctgcagcttttaggccagtgaactttgggttggag

SEQ ID NO: 2396 - DNA, 646 bp, Glycine max
  Peptide Sequence Number=SeqID_119174
atggaggtggcacttgtaggactagctggactgtccttggttatcgattgcatctttgtgattgtgtttctatcttcctcgatgttctgctttgtctcttcttctatctgcgtcgtgattcctatcctgctcctcatgggcccaacactcttctttgttgtgatcgataccgtggtgcttgatgggtacctccaagttgaaagcctcttcaaggattatagtgcaattgtcggtcttggtgcttccttttttcttgttgcacttttgtacagcttatctgacttcattcttgaatatgggcatttcttccgtcttgatgtagcctttggctcgttcgcgcaactcgtcgatgctactagggatctggacaacaatgcgtccaaacctatctatgaatttatggagagattcatcatctctttgttgcagactgaccaggagtccaccataccaggtcagtgtcgcccctttaagggacgtatggaagacatgacacacgattgcatcgtcattgcttggtattttagcttccatgatgaggtcgacaaatgggtgtcgatgagtagtccgccttataggacggcaatgtgtgagcggaatgctcgtcgccttgggggcatctggcacgagcctccagctgatcatg

SEQ ID NO: 2397 - DNA, 279 bp, Glycine max
  Peptide Sequence Number=SeqID_119175
atgtcgggaatccaccccaacattatatgccacaagcttgccatttgtccccaggctaaatcaatatcacaaaagaaaaggaagatgggagaagaacgacacaaagttgtcaaagaagaagtggacaaacttctccatgccaacatcatcagagaagtcagatactccacctggcttgccagcatcatcacagtaaaaaaggccaacgacaaatgggcgtgccccaaatgccctttgcccagcattgacaggctagtcgatggagcgtttgggttctag

SEQ ID NO: 2398 - DNA, 180 bp, Glycine max
  Peptide Sequence Number=SeqID_119176
atgtactccaaagagaaaattgactcctttaacgagcgaccatggggtttgggtattggaaaatcataccgtgatgccaatgggaactgggatggtttctatgtcatgtcatttaaggattcacataacgactgggagcctatcgccggttatgggcatgtcaagaatttagttggaaag

SEQ ID NO: 2399 - DNA, 786 bp, Glycine max
  Peptide Sequence Number=SeqID_119177
atggatacgagacgacaagaactggcagaatttctacaagcaatgcgtcaacgtggcacccctgaagaatttggattcccctctggttcacgtcgtcggacgcaaggcttgcgccgcgaagaggtcgcccaactcgctggtatcagtgccacttggtacacatggatagaacaagcgcgtgaagtgaatgtatcggctgaagcgctagacaggttggcaactgctctaaagctcagtaaatcggaacgcagctatttatttgacatggcagaccggcgggatccgcaagcacatcaaagtgaagtagatacagcacccgaaatactggtcatcatgctgtcgcaaatccaaatacccgcctatgtcatggggcgcacatgggatatcctggcctggaatgcgccagcaggacatttatttaccggtttactcgatatcgcctggccggaatcgcaacgccctaacctactgcgctttgtatttgcgaacccgcaagccaggcaatttgtagtgaattgggaaatgcgggcacgcagactggtcgctgaattcagggcagactgccgttcccgactcgaagagcctgaggtcaaacaactggtcagtgagttaagcacagccagccctgaatttgcccagttctggaaacagcacgatgtactggaaaggcaaggcgggcaacgtgaatttctgcacccacaacaaggtttgattcactttcaacaagtgacacttcgaccagtcgaacaggaacagctcaaactggtactgctacaacccgcctga

SEQ ID NO: 2400 - DNA, 236 bp, Glycine max
  Peptide Sequence Number=SeqID_119178
gtgctggtgtagtaacttcatttggttaccgtaaggatcgtgatggacattggctgaagaaggacgtgcaccctccgcaagacaagcgtactccttctcctcctcctcagcaagatgattcctcagcccttatgaatgaagttcttttggaattatggggcctcctcacctatgttggcgaatgctttgattctttggatggtcgctttgaaggaatggatactcgtatcacatag

SEQ ID NO: 2401 - DNA, 177 bp, Glycine max
  Peptide Sequence Number=SeqID_119179
atggaaagatttgaaattgaggtattcacagggggatatgctgagaatctcataattgcaacaggatgtggcatccatcaagcaagacctgattcagtgtgttcatgtgatccaaagtgtatgtgtgatgctctcactagtattatggagagaaagaaacaagatcgggttatgtag

SEQ ID NO: 2402 - DNA, 528 bp, Glycine max
  Peptide Sequence Number=SeqID_119180
atggcttcttcaagcataacctgcacctttcactgtaacctccatccttcaatatcccttccaacctcagccactcgtttttccttatctttttcccaccctctactttgcacctacaatggcctttcccttcacccttcaagctccagcttcagagtttttgccaagtttgagaaattccaaagccaaccttcccaatcccaagagcctgacccttcaccctcactagaagaaaccacagaaacttctgtccaggatgatgaggaagatgacagttgcttgccttcagacttggagggtgcagtgcggcaatcaagcgaggccgcggccacatttgtatcttcaggagggatgagagccatagttgaacttttaatcccccaactgcaatttttagatgacgaaggcgcgcaaggggaactctgggaattgtcacggatttttttggatacactcattgaaaaaacaaaatcccagaattggtttcttttgcatgcaatgaacattagagacaccagtgaatcatga

SEQ ID NO: 2403 - DNA, 933 bp, Glycine max
  Peptide Sequence Number=SeqID_119181
atgggaaacatgaggctgataaatgcagctaacaccaattcatccaattcaggtagatttggcagaggcaactcaagaggaaagggaggcaagctttgtacacaatgtggtctcattaaccacactgtggatgattgctatagaaagcatggttatcctcctggacacaagttttataagtcccaaggatctaacataagaagaagtgtaagcaagaccagtcaagatgagtggatccttgactcaggtgccacagaccattatatgcagaacctgcagaggattggtacaattgatatggtggaaggtctttatagactcaagatggttccactcaagcctcgtagggagtacaactcaaattccattgatgtttttgtcactaataagcctgatgattcccctttagagtcaacaagtgattctgtcatgtctgtacccaatgataattctaattcttcaactcctcagcagaccattcatacacctagaagattatctccctcctatcacaatattgtttcctctatcgcacaaagtgttgaaccacaatcatacaatgaagcatctcaagatcctaattggattgaggccatgaatgtagagatcaaagcactagaactcaataatacttgggttcttactgatcttcctcagcacaaatcaacaattggttgtagatgggtgtataaagtcaagcataaatctgatggttcaatagagaggtataaagctagattggtggccaagggatacactcaagtagaaggacatgactatttggacactttctctccaatggctaaacttgccatagtgagacttttactagctttagctgccatcaatcaatggtatctcaagaaattggatgtgaacaatgcttttttacatggtgatttgcatgaagaagtgtacatgtacattccttag

SEQ ID NO: 2404 - DNA, 3630 bp, Glycine max
  Peptide Sequence Number=SeqID_119182
atggctctcatccctcctgaagatacaaatgtggccgcggcctcgcttgattgccgcactgcaccctccaaggtgaagggtcaggctcttgggattgggaagggtgaagggaaaggccattgtaggtgcaaagtagagggtgggaaaaagataaggaaaaacgagtggctgaggttggaagggatattgaaggatggaggttacagtgaaaggaatttcgatcttggaatcgttgcgtcacttctcagacaaaccatgaacgatcaatccatgcaaatccaaatgctcgctgaaaaattccaccgattcgttcttgactgcgaactcaagcaaccatcaatcgctcagtgctctgatattgagtcaaagaaagtgaacgagaactctgactccatggatgaacatagtttgtccaatggaatccatgaagtttctccggatacgggccacacgcttcccatattgaagaaaatacttgatctcagtgctaaagttcaggatttgaagaagcagcatataaccatgtgcgatgaagtgaaactcactactcaatcttttcctggcactgatattatgaagtctgtgcagcttctcggtgctgaatatgaactcctaaaaagaaagtactcagaggagtcctctgagcggaggcggctttacaatgaagtaattgaactcaagggaaatattagagttttctgcagatgtagaccattaaatgagaatgaaattgctaatgggtctgcatctgttgtcaattttgagtcgtcttcagataatgagcttcaagtcatttgtgcagactcttctaaaaagcaatttaaatttgatcatgtatttgggccagaagataaccaagaggctgtttttcaacagaccaaacccattgttacatcagtattggatgggtacaatgtctgcatatttgcctatgggcaaactggaactgggaaaacatttacaatggaaggaacaccagaacacaggggagttaactacagaaccctggaagaattatttcggataactgaagagagacatgatacaatgaagtatgaattgtctgttagcatgctggaggtctacaatgagaagataagagatctcttggtggaaaattctgccgaacctactaagaaattggaaataaagcaagctgcagaaggaacccaagaggtcccaggacttgttgaagctcgtgtttatggaacagaagacgtgtgggaaatgctcaagactggaaaccgagtcagatcagttggatccacctgtgctaatgagcttagcagccgttctcactgcttgttaagagtaactgtaatgggggaaaatttaatcaatggccagagaacaaagagccacctttggctagtagacttagctggcagtgagcgcctgggaaaaactgaagccgaaggagaaaggctgaaggaatctcagttcataaataagtcactttcagcactcggaggagactgcaaaactttaatgtttgtgcaagtaagtccaagttcggcagacttgggagagacactttgctcgttgaattttgccacccgtgtccgtgggatcgagagtggcccagctcgcaagcaagtagaccacactgagctgtttaagtacaagcaaatggctgaaaagctgaaacaagatgagaaggaaacaaagaaattacaggatagcttgcaaatcatgcaactcaggcttgctgcaagagaacatcattgtagaacccttcaggaaaaggtccgggaacttgagaaccagattgcagaagaaaggaaaaccagactaaagcaagaaagtagatctcttgcagctgttacagttcaaccttcatcagcagcagctcataaaaccatgacagacaagaagcctccactgaatccttcaaaactgagaatgccactgggaagaataaccaattcattgcctccacggtctcctctaagatcaaagagttacactgccttcatgagtggaaaggaaaactctgtcagaaggaactcagtggtgacgagtgctgtaaggccagcttcatcatcaacaacagcacagttccttcaggcaaggaggcgggtgtccattgctgtgagaccgcctgcaccatcaacaacgcaggtccttcatacaagaaggagggtctccattgccacactaccttctcagacaacttctgacattactactccactccgtacctcagcgttccgtgttaccggtggaagcagccaacaatcacggataagaagccaaaggaaagatcggtactcaagtttgttcgccccattgccagagttgagaacatcagttgagacaactccaatgactgtaaggaggagcagcaagtttatgatgagcagtccggtaagggcagattccagggagggatccgctaggcatccaactcttcttgcacttcagcgcaagcctgtggatattctaaagatggttgcgagaaccccaccgaagcagaggaagctgttggccgctctcaaccctgttctgattaaagaaacactcatcaaggtggatcagtgcgtggctcggctgcaggaacttcagtacactgtgactggtggaaccaaggtggtgtctggggtgaatctcagccctcgcagcaccagaggttatctcagaaccagtctcagatgcaagcaagaatcactcaggatcaagaacggtgcctcaaggagatctcctgtggggaagtttccagcaaacacaggtgaatggaagagaatgtcattgcctgcaatgcttgtaggcgaaactgttggggaaattctgcaggcaagtcagtttgctagagaaatagtcacagcagttggtaagaaaactccccaagaggatccaaaaactccaatgtctcaaaggagcaacaaaaaagcagaacttgaaaacacacaactcagggcaagaaggaagaaagagaagcaaactaaagcacaaaacgatggttcaccatcacttcaaagggctcgttccagaatcaacttcaaggtttctcctcctaaggttagagaatttgataaagaaagcaacaggtatatggcaaatagggtgtctccaaggaataagccatgggctagaaaaacagtactattccccaaccctttgttcctgtccactcattcctcttcacagcaacaattttgcaagacaaggtcacctatcataacaagaaatagaggaacaacaacatctcacaagtttttgatcaagtctccatctttgccgtcacggccgcaacagttttgccagaccaggtctcctgtgatatcaagaaataggggtggaggaacaccacacaagtttttgatcaagtctccaacttcagccaccaaagttcaagtccagatcaaaaatagtccaccaactgtgtctatttcaccaacaaaacctgcaaggttgagcagaagtcctcccaagagatccacttctactgcatctaaattccgtcgatctttctctccttcaagaatagcatccagattagtatcactttcaccattaagaaccaggaaaactgtacagagaaatgatgggtttgtgagtggactcaaacagtgcccagcatcatcatcagtgcaataccctgctaagaggaatttgagaacacatcaatag

SEQ ID NO: 2405 - DNA, 906 bp, Glycine max
  Peptide Sequence Number=SeqID_119183
atgggttgttgttgcgacgaagacgacggtgacattttcaggcacctcatgaattccaatttcccctcatcttcctccacctccgccaccaccacctcttcttgcaccgtgatttcaccgatgaattctcatttctcggcgctctcctccaccgacatcctccgcctcatcttcgacaaccttccaatccccgatctcgcacgtgccagctgcgtgtgtcgtctctggaactccgtggcctcccagcgggacatggtaacgagagccttcgtcgccccttggaaactgaacgacgtcgtcggcaacccactctctggaagcttctggagagacaactccctcgccaaattcgccgtctcccatcacattactcgcggcgacaccgttgccagtctcgccgtcaagtactccgttcagtctataagtgctgtatttagaaatttaggattagagtttcggactatacataatcccttaatgcaagccttttttaattggagaacaacacatacagcacttatagaactgcatgtaatggatataaagcgcttgaacaacatgatgagtgaccatggcatatactcaagggaaaggttattgatccctattagtaatcctgatattcttattaacagaacatgctttattgagctggatgtctatgcaaaacgagaagtagcagtgttgtatcccaatgatttaccagacaggaggactgcctatgtttcaaacagaatttcctcagaagaaagcaacaaaaaagtgcttgaatccttgaagagaagcatgcatgttgataatgaaactgctcaatattactggtctgttgcaaatggtgacccgagagctgcttttgcccagttttctgcagaccttaagtgggattggcaagcagggcattcctag

SEQ ID NO: 2406 - DNA, 272 bp, Glycine max
  Peptide Sequence Number=SeqID_119184
atgtcgaatatgatagacaaaaggattgatgcaatcctccttaggaagggactaatcaccagagccacgagtaagaggctccaagaggattgggctagagttgctaaagaaggccctagggttctgtcataccctaatttcgtccggggaatgttatttgatgatatacaacctttgattggccgcttcgagatacttggcaccctttgttgcacgatatgtgaagtcccgagacgtgccgaaaatcaaaaggaagcaagcttacgcgatcc

SEQ ID NO: 2407 - DNA, 2001 bp, Glycine max
  Peptide Sequence Number=SeqID_119185
atgtttcagaacatcatgaacgctttcaccaccaccggagacgacgacaacgggccagggcaccgagtgaaagggacggtggtgctgatgaagaagaatgtgttggacttcaacgatttcagtgcttcgtttcttgatcgtcttcatgagtttgtggggaaacgagtttctcttcagctcgtaagttctgtcaacgttgaccctgaggaagatgttaccaaaaaaaaaacagaggaagaaggtgactcggtgcatgcaaggaatggcaatgggttgaaggggaaacttgggaagcctgcttatctagaagactggatcacaacaatagcacctttgacagcaggagaagcagcattcaaggtcacatttgagtgggatgaggagataggaacaccaggagcatttataataaggaacaatcatcatagtgagttctacctcaaaagcctgacactagaagatgttccaggccaaggtgtcattcgctttatctgcaactcttgggtataccctgctgataaatatgaaaaggatcgcattttcttctccaacaagacataccttccaagtgaaacaccaatgccactacttaagtacagagaagaagagttggagaatttaagaggtaatgggaagggtcagctccaagagtgggacagggtctatgattatgctctctacaatgatttgggaaatccggataagggtccacaacatgctcgtcctactctaggagggtctaaggattacccctaccctcgtaggggaagaactagtagaccaccggccaaatcagatcctaaatgtgagagtaggctgaatattgcctcgagcttagacatctatgttccaagggatgaaagatttggtcacttgaaaatggcggattttcttgcctatgcactgaaatccatagttcaagtgcctgagggtatacttacggaagttagggataacatccctgcagagatgcttaaggaaattttccgatctgacgggcaaaggcttctcaaatttccggtgcctcaagtgattgcagtggataaatcggcatggcaaactgatgaagaatttggtagggagttgctggctggtataaaccctgttgtaattcgtggtctccaagagttcccaccagcaagcaagctagatcccaaaatctacggtaatcaaactagcacaataaccaaagaacacatcgaaagtaacctggaagggttcacagtagatgaggcaattaaagaaaggaggttgttcattttagatctccacgatgcattgataccatacgtgaagaggataaactctacttctacaaagatgtatgcaagcaggacaattctgttcttgcaagatagtgggactttgaagccactagccattgagttgagtttgcctcatcctgagggagatcaatatggtgcaataagtaaagtttacacgcccgtggaacaaggcattgaaaactccttctggcaactggccaaagcttatgtagtggtagctgactcaggctatcatcaacttatcagccactggttgcatactcatgcagtcattgagccaattattttagctacaaataggcaccttagtgtgcttcaccctattcataagctattgcatcctcactttcgtgacaccatgaatataaatgcactcggacgacagattctcattaatgcaggtggtgctttagagttaacagtttgtccatctaagtattctatggagttttcatctgtgctttacaaggactgggttttccctgagcaggcactgcctgaagaccttgtcaagagaggagtggctgttaaggactcaacttccccgtatggccttcgattattgattgaggattacccttttgcagttgatgggctagagatttggtttgctatcaaaacatgggttaaggactactgctccttttactacaaggaggatgacactatcaagaaagatactgaacttcaatcttggtggaaggaaatcagggag

SEQ ID NO: 2408 - DNA, 300 bp, Glycine max
  Peptide Sequence Number=SeqID_119186
atgaagagaaaaattggggaagcgaaaaagagtgaaagtgaaagaatgaacggttcattgtggccaagtcaaatacttggccttgatcacctttctacttctcatcttacttctcctcattcaggaactcccgttaagcttctcagaaaggaagattccaacaaggcggagtccacccagggtatgctgttaaagaaaaaagagaaatatacacatagagaagatgccattcttcatgctcttcaactcgagaggcaaatgttaaagaagcaagaaaaaataggtgatgcttctgtctag

SEQ ID NO: 2409 - DNA, 1929 bp, Glycine max
  Peptide Sequence Number=SeqID_119187
atggcaccaacaaggaaatctagaagtgtaaataagcggatgtcaagttcaaatgacaattcccctgagaaagatggagttaattcaaataaaagcaagcaacggaagagaaagttgactgataaattgggatctcagtggagcaaggaggaacttgagcgattttatgaagcatataggaagtatgggaaagattggaagaaggtggctgctgttgtacgcaatagatccactgaaatggttgaagctctttacagtatgaatcgggcatacctctctctgccagaggggacggcttctgttgttggccttatagcgatgatgacggatcattacaatgtgatggaagggagtgatagtgaaagggagagcaatgatgcaccaggatctcgaaaacctgtaaaacgaaagcgtgaaaaagttcagcttagtatctctaaagatcagtctcattcaattgcttctagtgatgattgcctctctatattgaagaagagacgctttgatgtaagaaggcagaatacagctgctagatccagcaccgaagctgaataccgtgccatggcagtagttgcatgcgaacttacatcgcttaggcaacttctccaacaactacagtttggagacactcaggacactaagcttatttgtgacaatcaagccattctccacattgcttctaatccggtcttccatgaacggactaaacacatagagatagactatcactttgtaagagaaaaggtgttgtccggggaaatcatgactgactttgctggatctaatgatcaattggctgatatttttactaagtctcttagaggacctcgggttgaaactatatgtaacaagcttggtatccagctcaagcctcatgcggttggtaaaaggactcctcgcgtcccggtttataagaaagatgatacagaaaattatgtttcaccttatagaagaagcctgaagtcgactattgatgctaatgatgatgaagttgcacatgttgtagctttggcattaactgaggctgcacaaaggggaggctctccccaagtttctcaaacaccatctagaagagtagagcaaaaatcctctcccattcagagctgggaaagaaagcaccaaatgtcaaagacagctcgtgcaaagtttcctgatgtttctgtggataaagaggttttagaaggtagtatagaaagcaggggagctgaaaatgaagaatatgcaaaagataatagttcattgatggatacagaaggaatagacactgctgaagtttttcagaaagagggacaattttatagaaagagagagagagtgaaaaatgtgggaaatcatcaacttgatgatggtggggaagcatgtagcggcactgaagaaggacttagttttaattcactaaaggaaaaggttgatattgaggttactaatgaaaaacttgaaaaattctctccaaaaagtcacaggaaaagaaacaagaaactcttctttggagatgaaacccctgccttgaatgcgttgcaaactttggctgatctgtctctaatgatgccaatatctactatggaatctgctgcattttcactttttcaactcaaatgctcagactggagtctactttttgtcgctgctgtcattcatggcgaaagaatggttgctgataagaataataggtctgctttacccgaagcaacatcaacaagccataagagacataaacttaaatacagtgtggtacctaaaattgaggttttgacctccaaagagtctaagactggaaaggaaccgacaaaggatactaatgctctctctgaatcgaaagaaaaacttccatttgctgatacagcatggaaaagaaagcggaagtctatgggttcaaaggttgcaagtgcaaagcttgattcatatccaagtggtcccttgaaagatgag

SEQ ID NO: 2410 - DNA, 404 bp, Glycine max
  Peptide Sequence Number=SeqID_119188
atgccgatctccccctgcgaaagtatcagttggtctgtgccatcacgacataggggtcacgcccacaagacacccagtggacccggagaaatccaacagggccctggggtttccagctctggtaagtttgcagggatcgcgcccgcaagacacccagtggacccggagaagtccaacagggtcctagggtttccagctctgattacgagtctctgtcagttctacggagtgcccgtcacccccagcaaggtaatcaggcctcctactaaccgagttttcatcaagaagtattgcgcccccatgcaggcagagggcgagacaccacaacagcctggggatggccagcaacaggcagcaaatgcaccgccgccacctccagagcccctcagctcatccacaaaaag

SEQ ID NO: 2411 - DNA, 1263 bp, Glycine max
  Peptide Sequence Number=SeqID_119189
atgattttacagagaacttccttgcctaaggaaaagtcttctgattacatattgaaaagtcaatctaacaagaaaagctttctagttgcttgtcatctaatatgtgcaattgattatccatggtttgccaaaagggaattcatggagtacttaaatcatgttggactagggaatatcccaaggttaactcgtgtcgagtggagtgtcataaaaagttcccttggcaaaccccgcaggttttctgaacactttctatgtgaagaaaggcaaaaacttgaacagtatcgggaatcagtgaggaaacattacactgaactgcggactggtattagggatggacttccaacagatttagccaaaccattatatgttggacaacatgtaattgctcttcatccaaaaacaagagagattcatgatggtagtgtgcttaccgttgactatgacaagtgcaggattcagtttgaccgtcctgaattaggtgttgaatttgtaatgagctaccttgtgctgtacagctccttctatgcagtttgtctagggtacggttggatccactgtgtctatagaaggcagccttgcatttgcaagagggacattgattgcatgcctttgaattcatcagataatatgccagaagctctgaggaggcatattggttccccaatatcctctttcatgaataaagagccacaaattagtggaaattcaaattttggggggtgcgaaatgaatcattcctcacccgtgaagtttttatctcaattgttaaaatcttcttacattggtgttaattatgtcgatgcccaggcaaaggttgctaccgttgataatctctgtgcacaagcaggttgtgctcaaccatgtaaagtaacacaccatcaagctaaggaagctgacatacaggcagtttctgaactaaagcatgctctagataaaaaggagacattgttgatggagcttcgaagtgcaaatagcgacatattggaaaacaaaaatggcatagactgcttaaaagattctgaggttttcaagaagcattatgcgacggtttctgatgctatgctacaactgaggcaacgcaatacttacagaggaaactctctgccatcctggatgaagccacaagcaagtttcaatgttcatgatgatcttcccagtatgttggatagttctctgacacaagagttagggtcaactgttgttcaagttattaaaggatccaggctaagggcacatgcaatggtagatgctgcatttcag

SEQ ID NO: 2412 - DNA, 243 bp, Glycine max
  Peptide Sequence Number=SeqID_119190
atgcaaaccgccagctccattggcgcatttgctgtggctgtgacacgtggcgaatacgccattgccactagcgggttccatggtatcgccagccccattggcgatttcgccatgcaagggggagtagccagtcaaactggtgagttccaagcacagggcgcaggcttctcagccttttcaggcttttcagttggcaggctttttcagttggcaggggcaggggtacaggctaaagggaagtag

SEQ ID NO: 2413 - DNA, 219 bp, Glycine max
  Peptide Sequence Number=SeqID_119191
atgactgctctcctgactggcgggtgcagttctacgtgtttccctacgcccgcacccaatcgatgctccacatttcttgaagaagaagatcatcgacgtgaggaaagagtcgcgaattcgagaatgagattttggaaactttcacgtgcaagagaggatggagttttcttagtcaccaactctccaccacatgcaatctttcttttcttgaagaagtaa

SEQ ID NO: 2414 - DNA, 204 bp, Glycine max
  Peptide Sequence Number=SeqID_119192
atgactgctctcctgactggctggtgcagttctacgtgtttccctacgcccacacccaatcgatgctccacgagtcagacaatgtttcttgaagaagaagatcatcgacgtgaagaaagagtcgcgaattcgagaatgagattttggaaactttcaggtggaagagaggacggaggttataaaggaaatacgcgaacgttttga

SEQ ID NO: 2415 - DNA, 480 bp, Glycine max
  Peptide Sequence Number=SeqID_119193
atgcagagggctaatgcatcattatgcaaagaaaaatcttcaagtaccaaagtactcaagacgagacagtatgataatggctcagcacagtcattgtcacttgtagtaaaattgacatatgcaagatgcatgctttttaacgcaggcaagaaaattgccataaagggggcacttttacaaagttattcccgagataggtctgttttcaaactatgcaaaacgccagctccattggcgcgtttgctgtggctgttacacgtggcgaagacgccattgccactagcgggttccatggtgtcgccagccccattggcgatatcgccatgcaaggggagtagccagtcaaactggcgagttccaagcacagggcgcaggcttctcagccttttcaggcttttcagttggcaggctttttcagttggcaggggcaggggtacaggcaaaagggaagtagccactggcattggcgagttaggctaa

SEQ ID NO: 2416 - DNA, 297 bp, Glycine max
  Peptide Sequence Number=SeqID_119194
atggaggagaagaaatcagtagcacattcactgttgttctactgcgtggtgaacaaaacttgggtgtggtgttattcttggattgacttacataatccgttgccacataatccatgtatgtggctggtggtttggggagcagttgtatggcacttatggagggcgaggaactcgtgcatcttccaaggaacaaagattgatttggtgacactaaaacatgacttggtgatggttgaaggaattgttgtggagcaatattttgtgatatatgggaaggagaagctggcttatgattga

SEQ ID NO: 2417 - DNA, 354 bp, Glycine max
  Peptide Sequence Number=SeqID_119195
atgtatcctgagggaaatccgattctctggtgcttaaggattaatttgagcacgaagagatctttgtgtgacgttgttggcaatgttgaggatctaaaagtcgataatgaagatagtgatggtaacagggtggtagtccgtggtgtcactgaggagccaactgatgttggcggtgtaagcaatgataaggacaacgacaaagatgatgacgacatcgatgaggatgaagggcctacgacggtcgaagcggctagtgcaacggtcattaatgtggccgataaggggctgcatgaagaggtcgaggactgggccgcagatccaaatgatgctggcacattgatgggggattcctag

SEQ ID NO: 2418 - DNA, 990 bp, Glycine max
  Peptide Sequence Number=SeqID_119196
atgacaacctcgttggagacaccagtttctcctctccacctcgacaacagccaggagggcacgagcgtgatgggttcttgttcttctcctctgctgagcccttcctctgataaacgtttctggagcactctcaggagcaggatcgacacgctccttgatgctcgtcaatccgaaacctcaactcactctcctacgaatgtagaaggcaacaaccggttgaaggaagattcgatgttgctgatgagagggtttgactcagttgcccacactctctctctgttgtccaataatttggacaatgccctacagggtgctagagaattggcgaatccacccacattaactgacatatttcacagcaaaaatgacaaggtagaaaacaaagaggattcgagagagaaacagaaagaggaggaggagtcaaagcaaggaatgaaaagaaaatttgaccctaatgatgtctctgaagaggatgccgttgactcacaaaaggaggagaatgggaaaaaattgatggataagaacatcaagagagcaaaaaatcttgcggtttcaatggcgacgaaagcgggttcacttgcaagagaattgaagtccattaaatcagatctatgttttatgcaagaaaggtgtagtttgcttgaagaggagaacaggagactgcgtgatggatttgcaaaaggagttagacctgaagaagaggatctggtgaggcttcagctggaagcacttcttgccgagaaatccagactggccaatgaaaacgcgaatctggtcagagaaaatcaatgccttcatcagcttgtggagtaccaccaacttgcctcgcaagatctctctgatgagtcatatgatgagcatgctattcagggaatgtacttagacttctcgtctccgcccccaacaattgctgaagagacaagggatgaagatggtgatgaaaatggaagagccacacacacccaggaacgatatctgcaagttctctga

SEQ ID NO: 2419 - DNA, 942 bp, Glycine max
  Peptide Sequence Number=SeqID_119197
atgggtagaaaacgtgctccaaaaacagcgaccgggttcaagtgtcgggtgtcacgcggatcacgaacacatgatggtggtcacacaatagtttctcccttttggaggctgcttcaaaagaatatcaacttctggaatactgttgtggaaccacagccttccattggaaacatacaattatcaagggcattagactctcagcttgaaatcccactccctgggcttacctcaccaaagcatccaaatttgttggtggatggagtggaaatgcgtcatgcaaaaagcccggcacaggagcaagtgaaccaaaagaacatgagcatcaaaagaagcctcctacctcagctaagaaaaaaaccaaattctgtggtgcatcttgagaaagatgaagcagatactcaacttgagcaagtattattggcagacccagagttggagttgttggagctgccgctggagcacgagcatgagtccgagccagagctggcatataatttgggcgagaagaagagttggaaagaaaaagttgactgtgcattacaaagaatagaagctcttgataagacagtagaattgttgaaatccaaggtagatgagaatattgtcctttgtgaagccccatctatgtcatctataagttacaagagcatgtatattgactcacagaagaaggttgaagctttaacagttgaaaatcaacgactaaatggaaagctggaaaatgctcttggcaaaattggagtgtacaaagacgagatccatgttttggtggatgtaaaggataaaacgaaggatgctgttaaggatacaatgatttcaaatgtggcaaaaactatagaaacggctgttaatgtatcaaatcaagcaatgcaaatccacaatgcgtgctctgcttctgcagttaagagaaagagaaattatattaagaggagaaagaaatag

SEQ ID NO: 2420 - DNA, 297 bp, Glycine max
  Peptide Sequence Number=SeqID_119198
atgaaatactggagtagctggaggagaagtgtccatagccaggactggtgtggttgggtcctctggtccaccactggtgcaggaggctctgaagtggcctcaagagatctctcaggagtggtagtagttacctgtctcacctgtgtctctcacttgcctcctcccctaaagcaaatggctatggaatggtggcctcagatgactcatcctccacatactatggtacctgggctgtgggaccttcatcttacctatgaagagaaggttgagtcccgggccaggctaccatctccctaa

SEQ ID NO: 2421 - DNA, 351 bp, Glycine max
  Peptide Sequence Number=SeqID_119199
atgaacataggagctcttatttcttgtcagatgacttttatagcccaatttaacacttccagacttggatttcctactctgatcactgcattatgtagagccagaggggttgtctctgaaagccttacttttgagcgcctaagcccggtcattaacttgacctacatcaggaagaactgttggaatctagaggatctaatagtttccatccgaggggctaggagggcaagggcaaggccagctgagcttccttccacttctgcagcttctactccagcagctccttgtgtcccagctcagacagattctcagtgctttgaagccatgcttcaaagcattcatcagggatag

SEQ ID NO: 2422 - DNA, 204 bp, Glycine max
  Peptide Sequence Number=SeqID_119200
atgtactcctctcttcatttagttctcgttcgttctcgttccgagggagacgtcgatttgttctccatggagaggtcgacgaaggaagatttcatcgggaagcagttgaagcagcaacttacgagaaccgccacagagctggccttcctgcgcggaggaaacggaaccaaaggcagagcgggagcacgcgcggcagctagctag

SEQ ID NO: 2423 - DNA, 525 bp, Glycine max
  Peptide Sequence Number=SeqID_119201
atggttacatccacgcactataccatagaggcccaaaaggagcattacaaattcaagaaactggagaattatatggttttgccaaatatggcttcaataaaagataccaatgccatttcatacaatctttgtggtttggttaggatggctagtggtgatctgaaagtgaagagtttctccgccgtggtgggacctaacgggagcgggaagagcaacgtcatcgatgcgatgctgtttgtgttcgggaagcgagccaagcagatgcggctgaacaaagtttcggagttaatacacaattccaccaatcaccagaatttggatagtgcaggggtttcagttcattttcaagagattgtggattcgggtgaaacacatgtacaaactcacttttccaaaacagggaaccaggtaaacttgggaaccacacgagatcaaattatgtccgagagaaaaaggagacagctaatggctgagagattcatagcgttttcatctattatacctggcttgaaggtcagtgcttaa

SEQ ID NO: 2424 - DNA, 996 bp, Glycine max
  Peptide Sequence Number=SeqID_119202
atgtcctcctcaagtgtctgtcaagggttgcaatcttgtctcgaaccccgcgtgatggagccacgtatactcaggctcaaactctcactacaacaaggttccaattttcctcaatcctctccctctcccactaacaacaccaacacaatttcactttcacccctctctgactccgaagaaaacccactcaccaaccacgaatgtgacaaaaacaacacaaaatccgacctggctagtggctggagtttagttcaaactctctctcacaacaaaacagaggaccaagtctatgtccaccccacagttaaacgctcctcttcaattctcagtgaaaaaagcttggaaatgtgcactgaaagcctcggcagcgagaccggtagcaatgccagtgatagtggtgatgatatgtccttgttttcctctgacaccaacacatgttccacggaacatactactactactactgttactgttactgttactactcatgcaagttacatgtctaaaagagtgaaccgcacttgcaactttccaccaccactcacaacaatcactggtttcggtggtgttcatgttcggcctcttcgcgaaggtggaaggctaatattggaagctgtagcctctccttccccttccccttattttcacgctgagcgcggtgatggcaggcttaggctgtgtttgtttgagggtttttcggcctcggatgacgatgatgatgtttgtgaaggtgttgatgaccaagaagaagaagaagaaaaaaaaaatgaaaatgaggaaaacagagaagaagaagaagaaaaagaagaaaaagagtgtggtgaagaggatattacaagtggggcagaggaggaggaagagtgtgttgagaacgtggaggatgagatgggagtgaaaaagttggcgagaccaagcaggtgcaaggaaagtgggaaaggagatattttcggtgatgccttggctaatttgagcttccctcgttttctctgtctctga

SEQ ID NO: 2425 - DNA, 606 bp, Glycine max
  Peptide Sequence Number=SeqID_119203
atgggcattcatggatcaaacttgactgaagaacaacttgagacacatactatagcagtatggagagagacacaagaatgcagaactgatagtaatgggagaacatacccacaacatatggttcatctgctacaccttgtttccctctcagaaatactaaaatgtatatacaggcattttgagcactcttctcattgcttgcccattcttcagctaccaattgattcaatacctgtagctgaagttagctcaataccgattgtggacaataatgattcattacttgatataaattcaagaagagatattattgcattggttaaagataaagtgtatgcaaggataagtctgagtgggtttagtatccatcaggttcttcatttcagtagatgcaccacgctagcattgcttttgggacgagatgctagattttcttgcaggcttcacaatggaccgagatgtcatatgtgtttgaggtctgattcattgcacaaagagcgcttggcaaatcctggtgttagacagcttgtggtcatagaggctggcagcaggcgtgtggaaggtatcatttctataggcaacgtgttcaggatcttgttaagttag

SEQ ID NO: 2426 - DNA, 165 bp, Glycine max
  Peptide Sequence Number=SeqID_119204
gttgttgccttggatataactttaccagggaagcaagcattccatgctcgttatcgagagggaatatctatggcttctttatgggattctaacaagtgccagtttgttggaatgcttagtgcgatggactttattctagtactaaaagaggtttgtggggaataa

SEQ ID NO: 2427 - DNA, 660 bp, Glycine max
  Peptide Sequence Number=SeqID_119205
atgccggtcatgcgcggcacaattgcctgcataatcggactgctcagcagcaggatcccggtcgcagccgtggcgaccacgcaccagccggtcaatctgcgaaataaaggtccacacggcgctggagaaagcggcgctcagcgcaaagcggataaagggtttgagcacgcctttcagatcgtcgcgcttctctttgcgcgctgcgcggggcaccagctgacaggatttccagatacagcaggcggcttcggcaatcgacaccagcaattgccagataaagaaggtcagcagcggattcgggaacagctggatcaccagtaccgcgccaaaagtacgcagcgtggtaatgatcaggttcacgccgttgagccagacctgatgctcaaaaccgacaatcacgctgcgatacgggctggtacgccagcgaatcgcggcggtgatcaccatgatcgccacggccaccaccacatcactggcaggcaagtgctgcgcatccagccagtgcgtggcaatccatggcgtcgccagccagccgagcaccaccagcaccagggtggagaacaggaagaagcgggtcagcgtggcaaacagcgccggaaaccagacaaattctgcctgattcgcccggtagcgtgccgcctcgcgcatcagcgtggttga

SEQ ID NO: 2428 - DNA, 720 bp, Glycine max
  Peptide Sequence Number=SeqID_119206
atggctagtttgggcaacacagtattagcgcgcgtgcttcttagttctatggctacccttggattaacagcgtgcatgcacacagaaatgcccgcactcaatgacgacatccccactaactggaatcatcgcgctacgtcacaaatcgctcaaaattcgcagccatggtggcattcgctcaatgacgcattactgaataacatcgcccaaactgcattaactcagaatctgagtttgcaacaagctagtgagcgcattatgtatgcacgagctctccagcaacaagaattggcttcggagaagccgcaattgagtttctatgctggcccaaataacctgtcgagggctttagccagcaatggagcgggatccgggcagtctaatcaatctcaacttgtgtcttccggcgcctatctggcggggtttgatttattttgggaattacctctctttggtcaacagtcggggcaacgccagatcacccaggctgagctgcaaatctcagaggccgatttatctttaaagcaaatttcattaatctcagaaattgttcgtgtctatgctgaactagccgccgctgtgcaacgagataaacaactgaaaatgaccgagacaaattatgtgaactggaagacgtctgcaattaaaggcgttgagcatggtttatttgcttctgatgtcatcgagtcaatgaccgaaggtggccgagttgcaatctag

SEQ ID NO: 2429 - DNA, 405 bp, Glycine max
  Peptide Sequence Number=SeqID_119207
atgttaaaaagtatccgccttttcagccttgccgcatttgtcagcctgctgtctgcctgtgccacgttcaatcgcgttgatattcaaccggttgaaacagcacggcagctggagcagagaacgctgtcagatgagtccatgctgacatttacccagtcagtcctcggccctgcgttttcagttaatcaaccgcaatggaatatagacgcgctgacgctggctgccgtgtatttcaatggcgatatccagatatccaaggctcagcagaaattagctgctgcgtctgtcatcacggcgaagcaacgccccaatcctactcttaccagcaactttacttatgtcaccaatgtggtgaccaagcactgcgccctggattattggcggtgtgctcaatacgccaattga

SEQ ID NO: 2430 - DNA, 1062 bp, Glycine max
  Peptide Sequence Number=SeqID_119208
atggcgaatcactcgagcagcttcggcggtcgcagtggagttcgagtggtggtcgccggcgaccgcgcaaccggaaaatcaagcctgatagccgccatagcgacggagtcattcgccgaggcggttccgccggtccttccgcctactctcctgccccccgatttgtaccccgacgccgttcctcttaccgtcgttgacacaccttccagcttggagaagcagagaaagcgtaatgaggaattgaaaggagctgatgttgtggtgttaacctatgcttgcaatgacaccgcgtcattttcgcggttgagttcttactggttcccggagctgcagaagttggaggtgaaggtgcctgtaattgtggttggttgcaagctggatcttagggatgaaagccaggaagtgagcttggagcgcgtcatgacacagctcctgcaacagttcaaggaaattgtcacctgcattgaatgctctgctgctacacaataccagaaaacagtgttatcaattgtggatgcggaaaaatggcagaaagtcaataatccagtccctgaagttttttattttgctcaaaaagcggtacttcatccagtggatcctttgtatgatcatgaaagtcaagctttaaaggatcgatgtgttagggcattgagaagaatatttgttctttgtgatcgtgacatggatgaagccctcaatgacacagaactaaatgagtttcaggttagatgctttaatgcaccgttgcaatcctctgaaatagcaggagtcaaaacagttgtacagcagaaagtacctgaaggattcaactcacatggtcttacttttccaggatttatttatgtccacaatatgttcctcaaaaaagggcgtccagagacattatgggctgttctaagagactttggatatgataataatttgaaactcatggatgatttccttcctattccatctaagcgtgctttggatcagagtgtggagctgacaggtgaagctgtagagtttctaaatggtatctttcgactgttagatacagataaagtggtattccatatctaa

SEQ ID NO: 2431 - DNA, 690 bp, Glycine max
  Peptide Sequence Number=SeqID_119209
atggctaggctagatgagacctgcatcgagcatggtggagatttgtttttcaatttcggatttctgaaagtgaggataacgataaggcttgacattgacaaggtttgtgttaggaagaaaatggatgtggttctggatggtacagttgggggaatggaactgatggaagagggtgtggagggaagtaggtggtgcggggaggaagaatatgaggtttgggctggcactggggtgatatggaacaaggtggatatgctctgtgtttgggcgaggcacttaacttggtgggctgaagctgaggaagggatgagaggagcgtcagtgcgcaaggttatttgctggcctaaattggagaaggtatttccattgtcgatcatgactcaaagtggtgttgtcgacgatgaaggtagggccaaaaacttggccacacacgattggataaattatgcatgctgccgccgtccaccaatatcacgacctggtggttgcgaagaagccccaaaaggcgaaaggtctttggggtcgaggggtggagtcaacgggaacaactacatcctcatcgacgataatcaaatgcaaatgcggtttacaatggtggccgggcctccacttatcgtcacagtgggcgaaggactcgcaggcttcgaaggaggaagcactggtgcgactggtggcatgcgttggccgtga

SEQ ID NO: 2432 - DNA, 894 bp, Glycine max
  Peptide Sequence Number=SeqID_119210
atgtgtccatgggatgatgctctatacaaggatgctgccgagagaactgacatgggttacatatctcttaatggattcctggcacagtgggcccttatgacattacttgatccaccatgtagcctggctaatttgatttacattggatatagtggtaatcctgctgctgctcttcgtgttactcgtagaagagcagtagatcgcaagaagcaagcaacagaaaggaatgtgttccaatgctatgtttttggttctaaaaatgctgggaagtctgctctgttggattcatcattgggaaggcctttctcaaacaattatactccaacaacagttgagaggtttgcagcaaattccattgaattaatagggggaaccagaaaaactcttgtgttgcgggagataccagagagtgaaatatcaaatgttttgtccaataaggattatttggcagcatgcgatgtagctgtttttgtgtatgacagctcagatgaacattcatggaagaaatccagagatttgcttgagaaggttgctcaacaaggagatctaactggttatagagttccttgtctccttattgctgctaaggatgatttaactccatatccaagggcattacaagattcagttaaggttactcaggaattgggaatagaggcacctattcatgtaagtatgaaattaggcgattcaagtaacgtgtaccataagattgtcaatgctgcagagcaccctcatttaagcattccagaaactgagattgggaggaaaagaaagcaatgtcatcggcttcttcagcactctcttgtttttgcctcagttggaactgctatggcagttgttggtttggcagcatgtcgtgcatatgcagttagaaagaattcctctggttag

SEQ ID NO: 2433 - DNA, 1512 bp, Glycine max
  Peptide Sequence Number=SeqID_119211
atgttggcttggccgatgcccacttcgccaaccgctcttcgcaggttcctcgaactcatcggattttatagaaaattcatcaaggggtacgcgacactagccgctccactcacgaaccttctccaaaaggaccaatttcagtggtcaccaactgcggatagtgccttccagaatctcaagttgatgatgactagagcccctgttcttgtcactcctaatttctcaattccatttacgattgaaacatatgcttcaagcttcgccattggggctgtgttgatccaggataaacatcccattgcatattatagcaaagttctatgtccgagattgcagagagcttcggcctatgtctgggaacttcacgccatcacctcctcggtccgaaaatggcgccattatctattgggttctcccttcactattctcacagatcataagagtcccaaagactttatgtctcaggcactaccaacgtggttgtcgatgctttatctcgcatctcaccgtcggagggtacatgtttttctttatcagtgccccactctgattttctggacaagcttcgttccacccttttttcaggatgataaatatgttgatcttttaagccaaatccactctagcccggcctcccatcctgacctttccttgcataaggatttcattattcgccagggccacatttggcttccatttcctacacctttcactgacatactcttagaagaatttcattcatctcctctcgggggccacaccagcatctcaaagactcttaatcgcctacgccagaacttcgattggcctcatattcatgtcgatgttcgtcgttatgtttcgtggtgcctcacatgccagcagacgaaatatgaaaccaagaagattgctagactacttcaccctctgccaataccgtccaacatattttcaaaagcagctcacttcggcgctcttccaacacaacatttcgcgtataaggtcgctcaacttttccttgatatgggaacttctcccattgatgttgttgatcatatgccgacaaccaggaccgagctgcacacgactttgcaacgcagattacgcaaagcccaggaggccacgaaaactgcagctgacaagcactgccgagatgtacagtatgtcgttgatgattgggtctatgtccgccttcgtccctaccgccagacatcgctggcttccaagtacaccaagctttccaagcacttctatggtcccttccaggtgcaggaacatgtgggacctatggcttacaaacttcagttgccttttttatctcgccttcacccgatttttcatgtttccttcttgaagcctcatcaaggaccattaccaaccacatcagcaatgctaccacccatcgcagacaaccataaccctcttgtctctccgttatccattttggattggaagtgggataacacttcttctgccttaattcaaaaggttctcatgcagtgggatggtctagtgccagaagacacctcctga

SEQ ID NO: 2434 - DNA, 222 bp, Glycine max
  Peptide Sequence Number=SeqID_119212
atggagttggatgatggtggtcaatctctcaatattgtgaccattgtaaaccttcatcctttgatcattcatgacctagctatgcttcgggttggtagaagaggggtccatcaactcaactgctctataaggctttacatccttgatgattttggaggactcataagcattgagcctcatctcttccagctccaacagctgcaacttccgtttctcccctga

SEQ ID NO: 2435 - DNA, 642 bp, Glycine max
  Peptide Sequence Number=SeqID_119213
atggcttctgttcatgatattgctgctcatgaacttggttttgaagaaggcattttctggctaccttctcatgttatggacgaggcatgtgactccaagtgtaatatatatctgagcattcctacagatacatatgaggaaccgccaccaaaaactgctgcaacactacagatatccaagggaaacacagtcacaggagatgcaattaatgtttgcgtagaagttttgtactgctcaaaattttctacaagatcttcatatgatcaaaggccgaaacatgccactggtggacctggaatgcaagctgttttcttagtttcggggcaaggatcatgtggtactggcgtgttcttaccccaaaaagcaggcacaaaatcaatcaggaaaccagcgtgcgctcctgtccttcttccagctcgagtagttcaagctctaaatcttaaagtgcaccaattaggcctgcagatttcaccttctcaagctcccaaatatagcccgagaagcggagaagtatgcaccagtgagtcaacaaaaaagaaaacgaatcagaaagatgctctcaagcaatgcagtgttgttgtttctcatgagagtcaaagttcttctcctgagatatttcttccaaaggaatggacatactaa

SEQ ID NO: 2436 - DNA, 222 bp, Glycine max
  Peptide Sequence Number=SeqID_119214
atgacatatgagaggtcgtacttgcatataaggtgtttccagatgagagaccccagggtaggttttatcgcggtcccacggtgggcaccaaatataattgaatacctgacaagagataaagaggttcaaatatattcaaatattaagaagttagagataacttatcaattagggatcccgactgctaaggatcaaacgtccgtgttcttatgccaaggctga

SEQ ID NO: 2437 - DNA, 990 bp, Glycine max
  Peptide Sequence Number=SeqID_119215
atggaagcaacgcgattctcccctaatcacttttatccacaccgcttccaaacgaaacccaacgcactcagaggtaagttccctgctcttaacgctaatgagaaaaaaaagaaaagagaagctattaatacaaagcattgtagcctcttattgaacgttaattatgcagaaagaagatacgtaaaatgtatcaacggaattggagctagggtttcccttttcacaaatcctgcattcaacgcatcgaaccggtctttgtttccgaagctgaaccggactctctccgttagcttctccgaccggctccgaggtgattatgcacgcgttgatgaggaagttgttccggcgacacgcggcgatgggggggaagcggttatttcgtcgtcgtctccgagtgctaacagctcgggaaccctgcaattgaaacctttgatgttcaggaacaggtttctgaactttgcgcggttgggttctgtgattaacggcgccgcggaatcgttttttaagagcgagattcggaggaggctgttcgtgacggccatgttgattgtgattagtcgcgtcggttattttattcctcttcccgggtttgacagaaggttgataccggaagactacttgagctttgtcgcaggatcatccgttgatgaacttggtgacttcactgctgagctcaagctatctattttccagcttggaatcagtcctcagataatagcatccattattatgcagtgtgttcataaaaccttctatgaactgaatttatacaagatattcatgtgcagatggtggatgtcatttggctttgcaattctggaagctttaatagttgcttgctactcacttccatattcaatttatgctgccacttatagggtcaagcatgtaatggtgacatctattttattggtttgtggtgcaatgactattacatggatatgtgataccatatcagaatctggatttggtatttttcttgccacataa

SEQ ID NO: 2438 - DNA, 513 bp, Glycine max
  Peptide Sequence Number=SeqID_119216
atggcgaaggcgagctcagagccgaagattgattacgcagaaatctacacagcatccgatacctttgacggctccgccgtctttcacactatctacgacgtcgtagggttcgtcctctacatgcaccagcaaatcccctccacggtgcaggatatgagcgtcgaatttgacgcaatgcattcggaatacaagcaactggagatggagttgggaactgaggtgaagccatcgtttcggaggaagcacgttagcaaaatgagggatatcaaggtgggaatcaagagattagataagttgatgaattcactcttgaatgtgcaaaccgcgtttaaaattatgatcagcgagattccaaccatagacggtgtcgttttggcgctcggagctagcccacttcgaccaaagcatatttatgtcttgaatttttcccatgaaagtggtgtttccaaggttgatgatgattttgcaaggagtaaagcggctgacactctttcgagaaaggttccttactga

SEQ ID NO: 2439 - DNA, 710 bp, Glycine max
  Peptide Sequence Number=SeqID_119217
tgagtgctgtaagttggtggccatatgtgcttgctgtattgggtatctttaccatcgttactatgtgggcagttgtagtaactgaaggttgtaggaaagtaaagctgcagtactatggttttaaacttgcttctgctgcaagagagcactcacctattactgaagtggagccgtatattcctttcaatattaatccagcagggatgcaacctgttcttaccacctcttacctcttggcatttccaagcattcttgcaagtctgctgaggtcacctttttgggagcatgccaaggaaatgttgaaccctgaaacttctgttggtgctgagccatgggtttactattccatatatgctttttttgtcttcctgttcaatatattcgatatcgctaacatgccaaaggaaattgctgactatttaaataagatgggtgcgagaataccaaacataaagcctgggaaggctaccatagagtacctctccaaggttcaggcatccacacgattttggggggggctattgttaagtgttctggccactacatcaagtgttcttgaccactatttacggcgtgtcaatgctggatttgctattggttttacatcagttctaattattgtcggttccattattgaactcagaagatcgtatcaagcatataatgtgatgccaagcttgagcaatgctttgagacgatatggtgtatga

SEQ ID NO: 2440 - DNA, 1263 bp, Glycine max
  Peptide Sequence Number=SeqID_119218
atgacagtggtgtgcattccagtgttggagggcgtcgttgagttgggcacaaccgataagatggaggaagacctaaatttcatccaacacataaagagcttcttcatagatcagcagcatcctgctctcacggcaaagcctgcactatcagaacagtactccacttccaagcccacttcttcttcttcttcataccctcttgtcactgccaataatactattccaatccaaaacattgttgatagaggagaagctataatattgaataataataccaaagaagcagaattagcagtccctaacagtagtttcataccgagcgagctaatggaactggatgccaccttggaggaattcagggttggatcatctggagatggctccaaccacttggattcattccccactgagaaatctatggcactgtgttcagcagggttggagctccttcaacttcaacttccaccagctccagcacatcctcccacagaaaacctagcacaaggcggcacagacacacactactctcaaacagtgtccagcatccttcaaaagaactccaggaggtggccggaatcaccctctctcaacctcctcactgactccttccaatcagctttcaacaaatggaactccggcgctgacgactaccagcaccatttccacgtgtcggtggccagcgtcacctcccagtggctcctcaagtacattttgttcagcgtcccttacttgcacaccaactggctcaagggcaagggcacttcaccatacgagaccagtcacgtgatggcggagcgtcaccgaagggagaagttgaatgagaggtttctcattctgcgttcgatggtgccttccgtgacaagaatggacaaggcgtctatcctgggagacaccatcgaatacatcaaacagttgagagataagattgagagccttgaggcgcgtaagcgcctcacgggaaagagaaggatgaggcaggtggaggtttcaatcatagagagcgaggcgctgttggaggtggagtgcgtgcatagggaagggttgttgttggatctgatgacaaagttgagggagttaggggtggaagtgatgatggtgcagtcttgggttaaggatgatggagtgtttgtggcggagatgagagccatggtgagggaaaatggtaacgggataaaggctagtgttattgaagtgaaaaatgcccttaatcagatcataccccgtcatgaaccatacacacttgcttccagtgatcatttttag

SEQ ID NO: 2441 - DNA, 156 bp, Glycine max
  Peptide Sequence Number=SeqID_119219
atgaaaaggacgagtggtggttctagaacagtgtggccatgctgtgcagtgacaatcatgcattgtgtggtgagggctactgtgcaaggagctaggacgtggtgttgcatgtgtgagggcgagggaaaaatagtgatgatgagattgacaaagtag

SEQ ID NO: 2442 - DNA, 366 bp, Glycine max
  Peptide Sequence Number=SeqID_119220
atggctacaccaccgccaaataacagccttcagaccatgttgcgggctgcagtgcaatctgttcagtggacttacagcctcttctggcaactttgtcctcataaagggattctaacatggggtgatggatactacaatggagcaattaagacacgaaagacagttcaagcaatggaagttagcaccgaagaagcgtctctgcaaagaagcgagcaacttagggagttatatgaatcgttgtctggtggggagacaaacgcaaaaacacgaagaccatgtgcttctttgtcgccggaggatctaacggaaaccgaatggttctatttgttgtgtgtctctttctcctttcatcctggtctcgggtaa

SEQ ID NO: 2443 - DNA, 375 bp, Glycine max
  Peptide Sequence Number=SeqID_119221
atgccacccaccaggcaccctctagacccagataagtctaacagggccctagggtttctagcattgatcacgggcctctgccagtcattcggggttcctgtcacacctagtaaggtgatccgaccgccgatcacccgggccttcattgagaagtattgtacgcctaggcaggcgcagggtgatgcaccacaggccgcagacgcaccgccaccacctcatcaggctgatcctgctgggtcattaggcatggagcggtatctacaacgcttggttcgccagcaggcggccaaccacagggggcaggtcacatggcctggagattggcctaaggcccaggcaggggaggcgcctgcagaggctcccagcgatgcatag

SEQ ID NO: 2444 - DNA, 252 bp, Glycine max
  Peptide Sequence Number=SeqID_119222
atgaaagctttgagtgtgaatcgcaaagaactcctcctcatgatggcggtgggagcaatagaaagtccaaagggacataatggttgtagaagcagtgaaaaatccaaagcattttgggagaacgatcttatatgcattttgttcgaagagcatgtttctttgatttacaccccaaatctattgccaggggtcactagcaaaggagcggtggtcgacattgcaacatctccagcaaaaacacagatcgtataa

SEQ ID NO: 2445 - DNA, 178 bp, Glycine max
  Peptide Sequence Number=SeqID_119223
agatcctggggctcccgctgattctttttatgaaactcgtcctgagtgcaccgatgttcccaagtctcgatttaggatcaaggctggcaaaacattaagtgcaagaaaatggcatgctgcattttctccagaagggtatttagatataggcaagactcttagtcgaatccatcgtggg

SEQ ID NO: 2446 - DNA, 489 bp, Glycine max
  Peptide Sequence Number=SeqID_119224
atgatgatgccgttgttccacattgtgttgaggcgaaatagcaaggagctcaaggtagtagaaggtgtcgagcttagggtttttgatgagaggagtaaagcgcacggttcgagaaatagcgaaatatctgaagacaatagaggagggtttggccaaagcaaaatgattgacgaggcatcaagcacgatgcacgtgactctagttcttcaaaacatgaacggtggaaatctggtggtggcaaaccttgttcttgttgttgtagccgggggagtccaattgacagtagagaggggccctagaggggattccgacgtaggttcaagatttggtggaggtgaagtgggagtgctttttcttggtcgggttctaagaagggtttggattcgggccatgagaacgtgggtgggtggaggagggagtgaaggggcaagttttaggtttggagttggaatgcaacggagagagagaaagggtgaaagacagggatga

SEQ ID NO: 2447 - DNA, 510 bp, Glycine max
  Peptide Sequence Number=SeqID_119225
atgagtgacctatgctctcctatgataatacttcttaatgatgaggctgatgcattttggtgctttgagcgtttgatgcgtcgattgcgaggaaattttagatgcactgataactctgttggtgttgaggctcaattaagtactttggctactatcactcaaatgatgtgggctctagaatatgatcccgatttgttttggatgtacgaggatgatgatgacaaatctgaggaatctaaaggaagattaaagtcattgcgccactatggaaagtatgaaagagaaaatatgaaaaatggagcaaagaatggtgaagatcccccccttcccatatctgttttccttgttgctagtgtactaaaagacaaaagcacaatgttactccagcaagcaaaaggcttggatgatgttgtcaagatattgaatgatgtaaatggaaatcttgatgctaaaaaagcttgtgtggctgcattaaaacttcacaagaaatatttgaaaaaggtattgtag

SEQ ID NO: 2448 - DNA, 856 bp, Glycine max
  Peptide Sequence Number=SeqID_119226
atgtctaagttgtcatctatgaggctcattggagtcgcaggtgtgagaaaacacattattgaaatgagggatctagcgactcaacttaagtcactccaggtagaagtttctgagtccttcatggaggaagagagacttgctctagaaattggtgaaggtgctcctaccatgactcaagataaggggaagaaggaaaagaaccatataccttctattgtcaaaattaagaaggagtctagcactagaatttttgagtcaagacatgcaaagtttctagagaatgatgtggctagtgggagtgatttaactcaaggcattggtcttgagaaaaatcaatgtgaaggaacaattcctacatcaaatccagttgaacaacatcaaacacaaaacgttgagcaacctgttgaacaacatcaaacacaagatgttgagcaacctgttgaacaacaaccagaaggtgtggatgagtctcaatatgactttggagttgaaaatgatcctaagtcgtttttacaagcgattaacggttgtaattttaagctatgttatgattctacgaaagatgaattggaatctatggcaaataataaagtatgggatcttgttgagttgcctaatggaataaagcctattggatgtaaatgggttttcaaaaccaagaaggattcattaggtcacattgagagacacaaggcccgatttgttgccaaaggattcactcaaagggaaggagttgaatacagagaaaccttttctcttgtatccatgaaacattccttgtgcatcataatggcattagttgctcattttgacttggaattacatcaaatggatgtgaaaacggcttttctaaatg

SEQ ID NO: 2449 - DNA, 207 bp, Glycine max
  Peptide Sequence Number=SeqID_119227
atgaatgataaagtgaggatagtccttagaagtcctagagaaggttctttagccttactcattcaactaagccaactaaagtacgggtcaacatcagtagaccagatagtacttgagaagtattacatcatcctcgatgttgaaagcactaggacagagatagaagtggccttcatgaggacacaagggttgatcgaaaccccctag

SEQ ID NO: 2450 - DNA, 213 bp, Glycine max
  Peptide Sequence Number=SeqID_119228
atgtacaggagtgcaaaactttttgcccctccggacagccatcactcaaaagattttctcgatttcccttatccaattctgagcaccattagggttgcatccttcattgaaagcaggaaggttgtttcgttggaagcggaggcgcaaaaaggtctctcagatgggccatgggagaattataagcaattgggcttggattcgcaattgagctaa

SEQ ID NO: 2451 - DNA, 716 bp, Glycine max
  Peptide Sequence Number=SeqID_119229
ctgaggaccctttagggcgattctgcaatgaaaacaccatcattggcagtggaggaaaattatcagccaatattgataaaatattgactgaaatagccctcaaaactccctccactggttttgttgccaccacatatggcaaagaccaagacaaagtgtacgcactcgctcaatgtaggggagatgttagcacccaggattgctccaattgcatccaagatgcaacgaaacaaatccgccaacgctgtccaaaccaagtggatgggagaatttggtatgattactgctttttaaggtatagtaacaagagtttctttggtgaggttgatacatcttttggtatattctatttcaatgttgaaaatgtgactgaccctgaagattttaacaaagagcttggggctcttatggatcacattagagcacaagcagtggtgcctagagaggaagggcttgggaagggaaaatctgtgctgtccccatttgtgacactttatgcgttagtgcagtgcactagggacctgtctgagatatcctgtgctcagtgtttgtctattgcagtgaacaactttcccaatttttgcagcaatcgtaaaggatgtagagtactgtacagttcttgctatgttcgatatgaactctacccttttttcttccctcttgattctaacaaaacaggaccttccaatactgcaaaagtcagcgtttatacttaa

SEQ ID NO: 2452 - DNA, 285 bp, Glycine max
  Peptide Sequence Number=SeqID_119230
atgggggaggaggttgttgcccagctcgcccaagggattactccagaagcaacttgctcgcccaagcaagctcagctcgcccaggcgaactgggtttggcagcaagcaacaacgactagtggtggccaccggtggtcgtgggtggtgaagaagaaggtgttaagcgagctcgtctcgctaagcgggagtccacttttcgagcttagtgtgaaaattcatgctaagcatgacaattctcgtttagcgcaattccctctcgggttgaagttgcgcttagcgcgctaa

SEQ ID NO: 2453 - DNA, 1923 bp, Glycine max
  Peptide Sequence Number=SeqID_119231
atgcagctgccgctcggcgacgtcgcgacgctgaaacagccgggtgtctatctggcggtgatgaaacaggccggcacctacaactacacgcaaccggcgacactgttcaccctgagcgacattggtttgtcgctgcaccgttttcccgcccaactggaactgtttacacaaagcctcgccagtggcgatccgctggcggatgtcagcgtgcagctactggatgaaaaaggtcaacagctggcgagcggcagcagcgacagcgagggtcatttgcgtttagcggctaacgccaaaggcaagctgctgctggcgaccagtaaaggccagacttcgctcatcgaccttaatcgcccggcgctggatctggccgaattcccgattgatggcccgcaaggctacgacaaacagttcttcatttttggcccgcgcgatctctatcgccccggcgaaacggtcatcgttaatgcgctgctgcgcgatgccgatggcaaaccactgccgccgcagccggtgaaagctgaagtggtgcagccgaatggtgaagtggcacaaaccttcgtctggcagccagagaacggcgtttatcaacaacgttttgccttaccggcctcggcgatgaccggtaaatggacgctgcgtattaacagcggcgacaaccagccgcgcagctggccgttcaatgtagaagatttcctgcccgaacggatggcgctgtcgcttaaaagcaacactcagcccctgtcgccagatgccgacgtcacctttgatgttgaaggtcgctatttgtatggcgcaccagcggcaggcaatgaactacagggccagctgttcctgcgtccggcgcgtgaagcggtcgctgcgttgccaggttatcagtttggcgacatcactgaggaactgaaacgtagccttgatgatgtggatgaaaagctggacgacagcggcaggctgcagctcagggtcgaaagcagctgggcggagagccactctccgctcaacctgattttgcaggctagcctgctggagaccggcggtcgtccggtaacgcgccgcgccacgcaagcgatctggcctgcggccgcgctgccgggcattcgtccgttgtttaacagcgaatcagtgtacgactatcgcaccgatcgttataacgatgagccaaccgtaccggaaaacagcctcgccgaatttgacgtggtatacgccaatgcgcagggcgaaaagctggcggcgcaggatcttgatgtgcgattgatccacgaacgtcgcgactacttctggagcttctccgacagcgaaggctggcagtcacgttacgatgaaaaagatctgcaggaagagcagcagcgcatcagcgttgcggcgggcggcagccagaaagtcagcttcccggtagagtggggcacctatcgtctggaagtgcatgccggtgacaacatcatcagcagcgtgcgtttccaggcaggttactggtggcaggacaataccaacggcaccggcgcgctgcggccggatcaggtcaaactgaagatcgacaaagccgcctatcaacccggcgacaccgcgcgtgtcacggtggaatccccggcggccggcaaaggctatttgctggtggaatcgagcagcggcaccttgtggtggcaaccgctggatgtgccggcgggcggcgcaaccattaatgtgccagtcagtgcggagtggaaacgccacgatctgtatctcagcgcgattgtggtgcgcgaaggcgacaaagcgaacggcaccacgccgaaacgcgcggtcggcttgttgcatctgccgatggcgaccgctgcgcgccgcctcacgctgacgcttgatgcaccggataagattcggccggaacaaaccgtgaaagtgaaggtgaaagcccgccgcgagggcggtgcgctgccgcagcaggtgcag

SEQ ID NO: 2454 - DNA, 102 bp, Glycine max
  Peptide Sequence Number=SeqID_119232
atggcttctgctgggcaagttgatagtggggcaggggctggtgggagtttctctatgagtgggtgtgttctcgatcttgataacataggaaatagttgttaa

SEQ ID NO: 2455 - DNA, 144 bp, Glycine max
  Peptide Sequence Number=SeqID_119233
atgggtgatttcacgaagattttcaaccgttcttcgtcgttcttcggtcttcaaccaaaagaactacgtaggtctgatttccttatcacaattgaggaatacgtaggagcaagggaaacaccctcgtcgaccacaaaaagataa

SEQ ID NO: 2456 - DNA, 938 bp, Glycine max
  Peptide Sequence Number=SeqID_119234
attggaagcagcttctaaagttgcagtcccgagacggatcattcttgttctctccatcctctacagcttatgccctcatgcaaactaaggatgaaaatgctcacaaataccctgaaaagacggtccagacgttcaatgggggagccagagatcaaagattgtgcgagttatgtttcaaggtatgtgaggtgttatcgagtgctggtatagtgggtatttgctgggcaaggaattcagaggttcaagatatagatgacacagcaatgggatttagactactaaggttgcatgggaatcaagtttcacccgctgtgacaggaatgtttaatctatatcgagcatttcaagtgctacttcaaggagagaagattcttgagtatgccaagaacttctatgccaaatttttaactgagaaatgtgaagcaaatgagctcctaaacaaatggatcatgaccaaagatttacctggagagttcgcgtttttacttttgctcattaacatttgtaaaactactctccagatgggttatgcattggaggccacccgtgcatttgctcggatacccggttgtgacacgatgccctacgtgaacaatgatgtttatctccagcttgcaaaattggattacagcaactgtcaagcagtgcattgtgtggaatgggaaaaaaatccaaagctagccagcatatttgagcctaagaagtttctagagcgatttgcatgggctaaaactgctgcattgcttcaaacactcaggttccacataaaggatgaagaaactaagagtgcacttgaacaagaaaagagagaggaggaactcctggagattttgctgacaaatcttgactaccttgggttccaaatgtttcggagtcatggtcaggaattttcccattatttgaatcaagctgtgagtagaaacccttctaagctctaa

SEQ ID NO: 2457 - DNA, 330 bp, Glycine max
  Peptide Sequence Number=SeqID_119235
atggctggctattgggaactacatctcaatccacattaccagagtttgctagaagtcactaacgaagtctgtcatgcgctccgtagttatcaaagcaacaagatccagattttttatagttctgcaattattgttaggctcaagatagtggcaacggcagcctcagtccaaccagcatcactacctctcacgttgaatcagacatacaagaacttgtgcaattggtgctccaaaattcctctgatggcatgcactccaatgtcaagaattgattcctctcagtggtcaagggcttttacaatggagcatattgtgacccagagaccataa

SEQ ID NO: 2458 - DNA, 417 bp, Glycine max
  Peptide Sequence Number=SeqID_119236
atgacaattagacttcaagttgtctatgggagattgagcattcgttctgtacgtagtgcatttgaagtgtctgtaggaagtaagctgcaaaagtttgggggatcggacaataaggaattgcttcaaaggttcacttcacaatttaaagatgaattcaaaattcctcgtggatctgtaattcatctctcaagagacaagggccatgttcttcgcacatcaatatctagtatgttaccctatgcaattacaccttgccaccttggtgttacggttgtattctttggagaccattcttatgcgtttaacttggaggggcctttcaaagtgaaactgttgatggacaggaagtgggaagcatccagagtaaactcctatgccaaagaagaaattgagctcaacatggcttcttacctgtag

SEQ ID NO: 2459 - DNA, 606 bp, Glycine max
  Peptide Sequence Number=SeqID_119237
atggaatccacacacgtaatagccattacaaatggagaagagaatatgattcgttcatcaaaagagaataaaacattccaatttcaacttccacccattatttcccatcttgggaaaaatgaagtccactgtgtctccattacttcttccaatcccagacacaagcaggtgcaaagtggtggccatgacacgaggaagataatccactgcatcaaagtgggaatctccttggttttggtttcactcctatacctcttgaaccctctctttaagcaagttggagaaaatgcaatgtgggctatcatgacagttgtagtcatgtttgaattctctgcaggagccacactaggaaagggcttcaatcgtggactaggaactattataggaggaggactaggttgcttggcagcagtttttgcccaaagcattggaattggcagggttggcaactcaattataatcggtgcttcagtatttatatttggatcagtagctacatatcttcgactggttccaagcataaagaaaagatacgattatgggggtaatgatattcatgctgactttcaatctagttgtggtttctggcgtacgtgggggatgtga

SEQ ID NO: 2460 - DNA, 1469 bp, Glycine max
  Peptide Sequence Number=SeqID_119238
tggaggcgctgattgcggcttcgaaagaggacgcagcggcggcgaaccagccggcggcaagcggtccgctggccgatgcaccgattggcgagaccatcaccattgatgacttcgccaaagtcgacatgcgcgtggcgctgatcgagcaggctgagctggtagaaggttccgataagctgctgcgtctgcagctggatctgggtggcgagaagcgccagattttctccggcattcgcgccgcttatccggatccgtcggtgctggtgggcaagatgactatcatcgtcgctaacctggcgccgcggaaaatgcgtttcggcgtatccgaaggcatggtgctgtctgccggccctggcggcaaagatctgtttgtgctgtcagtggatagcggtgcccagccggagccagacctgcacatagcaaaaccccgcgcaagactaccccctctcccgcctgcgggagagggctggggtgaggggaaaaccgcaccgcgcttatcgcgccagcatcagacagcgataaatctccgccattaccgcctcaaattcattaaactcctgatgattccagaagcgcagctttgtgctgacaagccagtcctgcacatagcaaaacaccgcacaagtctacctcctctcccgcttacgggagagggaactgctgagtgcggggtttgggttcagagccaggcctgcacctcgctcgattgtctccctcatccgcttttgccaggctggggtgaggggaaaaccgcaccgcgctcatcgcgccagcatcagacagcgatagatctccgccatcaccgcctcgaactcattaaacacctgatgattccagaagcgaattacgcgccagccgcagcgctgcgcattgtgctgtccaccatccagttccacgatcagcgatcgctcaacgcaggcaaaatcaacgatgtaccctcctactggatgctggcggcgaaacttcgcgccacacacatttcggttgccgcgcgctgcggttgcacggtgtggttcatcgctgctccttcgctctgcccaccagcttacgccgctttaatcagcttcaaagcaaaggagcctgacatgcccaccgtgctatctgcctgctggcgctatctgcgcgcctttgccatcgtttatgccgcgctgtatgccggcaacggccttgccgccctgctgccatttaccattcccggcagcatccttggcatgctgttgctgtttgccctgctggcgctgcagattatcccggtaacgtgggtgaaacccggctgtcagctattgatccgctacatggcgctactgtttgtgccgatcagcgttggcgtgatgggctacaccgatatcctcagcgcacagtttggcccgattgtcgtctcctgcatggtcagcaccctgctggtattactgattgtcggcctgagcgccgagcgcctgcagcgtccgaaggagtccggccatgagtga

SEQ ID NO: 2461 - DNA, 384 bp, Glycine max
  Peptide Sequence Number=SeqID_119239
atgacgttatcaagcacagcgcctgaaactttctccaacacttcatttggtagtgcatgcacaaaagaaaacatagaattaaatgttcccaacaccagcatcatcaacgttctctgcaacaatggggtgtacacttcaggggagttagaggaagaaacaccagcacagaggaattatgactaccacaacatttcaccctatcctaatgcctatgcctatggacatgctacttgtaaccttaatctgacatcctctgattgcaaaacatgtcttggtgctgctcaaacggccttctttagcacatgccagacaccacggatcggggctcgttctgtgctctatgattgtacaatcaagtacgagcaatacccatttgacgattag

SEQ ID NO: 2462 - DNA, 270 bp, Glycine max
  Peptide Sequence Number=SeqID_119240
atgtctgattgtcttgaagctgtcaggatgctagaggataacaataacgctggagttgcagctcttattgaagaggagtcaaatctctatttgagcaatgcattttggtgcatattcgaagagaggcaaatgtgttggcagactctttcgcgaaagcaggcttctctttacaatgagttttgtttttataacaatgtgcctaattttgctgttaatttctttgaggaggaggatattggtttaagttattctcatttgggtattaattaa

SEQ ID NO: 2463 - DNA, 269 bp, Glycine max
  Peptide Sequence Number=SeqID_119241
atgttggaaatgctacgggacaagcgactagtttatgttggcgattcgattggtcggaaccaatgggaatcactcatttgtatgctcttttcggcaattgcaaataaggctagggtctacgagggacggcctccttttggtgcacctgatggggtaagaatgactttgagagtggatcatatggtctggatttctcatagttggagagatgcagatgtgctgattctcaatgctggaccttggtggaactttcagaaaactgtcagaat

SEQ ID NO: 2464 - DNA, 705 bp, Glycine max
  Peptide Sequence Number=SeqID_119242
atggcaatttccggctggctcatcgcttcaatcaccgcctcaataccgtcacttttcgcatgcagcgcctgggctgtcgtcggccatttcggtcacgctgtacagcaaatcctgctggcgcagagcggcgatcagcgcgccgctgttgagattcacttcgcagtagccccagtcgctgccgtactgcgccagttggtcagtggccagcgcctgatgcgcgcggtgaaaggcaccaaaaccgatgtgcaccatgcgggttttcagctggctgcggtcgtaacgggggcgctgtacgtcagcgggaaggcgatcggagtcattcgattaaacggaaaccggtttgtcgctggctttcgggctgcgaatcacaaacagcaccagcagcgcgccaagagccgccaccacgcccgccagcacaaaggcgctgtcaaatttgccggtgtgctgcacgatgaagccggtaacgatcgggccgataatgccggacaggctgccaatcaggtgaataaagccgctgatgctgccgacgcggcttttgtgcaccacatcctgaataatcgcccagtaaatggcaccggtgatgtagaggaagaagatggagatcgacatcatgatcaccgccgaattcacctctttgatggtgcccgccagcgccacacatatcgctgccgccagcagcgatactaccagcacaatcttgcgtga

SEQ ID NO: 2465 - DNA, 343 bp, Glycine max
  Peptide Sequence Number=SeqID_119243
atgcttttatgggggatacctcagttgatggatgaacttgttgctgagtatcgggttcccttggagcagcctttcggaatctgtcaagatgaatgggtgatggagatggacatgacacctagttgcctttactatagtattgttgggcaacataactttgactcccagaaccttggatgctattgtcttcttgttgacaaacttaacatgccttcaggaggttctgatgagagcaagttcctgaatgttgaaaaagtgttctacatgaatggatggttcaatgtctgtgtggatagtggtgatttccagggttgggacaatctcgacagcaggggagttagag

SEQ ID NO: 2466 - DNA, 189 bp, Glycine max
  Peptide Sequence Number=SeqID_119244
atggagagcagaggaagcaggcgagctgcaaagtgcaagcgccgacaatatgtccacactgagatgacaacaacaaattggacagggagacatgtggcattggtcaacagaagcaaacgaggcacatttatggacttgtcttcccttgccatagttactagtgtctttgttggtccgtgggaaatctag

SEQ ID NO: 2467 - DNA, 168 bp, Glycine max
  Peptide Sequence Number=SeqID_119245
atgggtggtttagcctctcattgtcatgagaggcttactattacaaaaaggaaacaagaggtgtggaagagaatggaagaaaatggaggaaagggtccccaacttccaaccctcaagttcacacttgtcgtggttttcatgatggaatcatgcaaagaatgcatttag

SEQ ID NO: 2468 - DNA, 270 bp, Glycine max
  Peptide Sequence Number=SeqID_119246
atgaaggctcagagtggagaaaagatgcaagacaaaatggagagaaatgaaggtattaatttgatctgggaaaggcttcgtggtaactttgatgagattggtcggtggaattcatgtccactaggactccatgcaaatggcatgtgctcatgtgagtcttccccaatgactgaggaatctagcactcatgcaagtatttcaagaataatcatgctggttgagactttgtttgaggttttaccttctctcatacttactgtttgctgctag

SEQ ID NO: 2469 - DNA, 267 bp, Glycine max
  Peptide Sequence Number=SeqID_119247
atggaggttgaggaaccctggcaggggttatggcttccattgcattatcaagtagatataagagcaagttggcatatgacactagaatttggggctttgtggatgattggggatggcctttgtggattattgggtgagaggaactgttattggctgagtaatgacattgttgggctgacaggaaatttgaccgtgatgatcagatttgcctttttccatacccactttgatcctttcgtcggtgaagaccaaatccgtaaagcttga

SEQ ID NO: 2470 - DNA, 339 bp, Glycine max
  Peptide Sequence Number=SeqID_119248
atgccttacgtgaacaatgatgtttatctcgagcttgcaaaattggattacaacaactgtcaagcagtgcattgtgcggaatgggaaaaaattcaaaggtggtactctgaagcaggactagaggagtttgggttgagcaaagaaagtctcctatctgcttactttatagcagcagccagcatatttgagcctgagagatctccagagcgacttgcatgggctaaaaccgcagcattgctcgagacactgagatccttcataaaggatgaagaaactaagagtgcttttgtagatttgttcaacaacagcattaacggaccagaccactcaaacaagtaa

SEQ ID NO: 2471 - DNA, 663 bp, Glycine max
  Peptide Sequence Number=SeqID_119249
atgcaaagcagggaagtagtctcaggcctcaattatttactcccttcaaacccttgtccctaccctcctaacaacaacaactacaccaccatgttccaaaacaacattaatcccacatttcagttccaaagattctctaaccaaatatatggctataacaatattaacaacactccctatcataaagttcccgacttattcagtcctcaatcctcatgtataagcagcaactccacttctgatgaggctgatgagcaaaacctgagcctcatcaacgagaggaagcacaggagaatgatatcgaaccgcgaatcggcgcgaagatcacgcatgaggaagcagaagcaccttgatgagctctggtcacaagtggtgtggctcaggaatgagaaccaccagctcatggacaagctgaaccatgtctcagagagccatgaccaagtgatgcaagagaatgctcaactcaaagaacaagctttggaacttcgccaaatgattagggacatgcagatacatagcccttgcccctcctccttcataacccctttggaagatcatcatcatgatgttgatcatgtgattccttcagcatatctcagatctgattcttcaaaccaattatccaactcgtgtaacaacaacatggacgacctccttggctga

SEQ ID NO: 2472 - DNA, 1659 bp, Glycine max
  Peptide Sequence Number=SeqID_119250
atggcggttgctacaagaggagctagaggtggatctagttttcgaagcttgttctcgttccggatcttcatttctgccatgttttctcttctcttcgttgccaccctttcggtcctccttaccaccaacccctccacatcgaacgatgaccctgatcttcccaccactggtaatgcatacgtgcatagaacctttttggcattgaaatctgaccctcttaagacccgagtagatttgatacaccaacaagctaaagatcacatagcactagtgaatgcctatggtgcttacgctaggaagctcaagcttgacatttccaagcaattgaagatgtttgatgagttggcacgcaatttttcggatattgcgtcgaagacaacctataagacatcattgtttgagtccgatggtccaattgacgaggatgtgctgaggcagtttgagaaggaggttaaggatagagtgaagattgcacggatgatcattgttgaggcgaaagagaattatgataatcagttgaagatccagaagttgaaggacacaatatttgcagttcatgagtcacttgcgaaggcgaagaagaatggggcgttggcgagcttgatttcggccagatcgattcccaagagcttgcattgtttggcgatgaggctgatgggtgagaagatttcaaatcctgagaagtatagagacgaggagccgaagctggagtttgaagatcccactttgtatcattatgcaatattctcggataatgtaatagctgtgtcggtggtggtgagatcagtggtgaagaatgcagtggaaccatggaagcatgtttttcatgttgttacaaacaggatgaatgttggggcaatgaaggtttggtttaagatgaggcccattgacggtggtgcatttttagaggtgaaatcggtggaggaattcacattcttaaattcatcatatgtcccgatcttgaggcaacttgagtcagcaaaaatgaagcagcggttcttagagaatcaagctgataatgccacaaatggtgcaaacctgaaaaatacaaagtccctgtccatgttggatcaccttcgattttatttgccagagatgtatcctaacttgtataagatcttacttttggatgatgatgttgtggttcaaaaagacttgacaggtttgtggaaaattgatttggatgggaaggttaatggtgctgttgagatctgttttggttcttttcaccggtatgcccagtacttgaatttctctcatcctttaatcaaggagagcttcaatccaaagtcttgtgcttgggcctatggcatgaatatatttaatctcgatgcttggaggcgtgaaaagtgtacagataattaccactattggcagaacttgaatgaagaccaaactttgtggaaagcagggaccctatcacctggtttgatcaccttctactccacaaccaagtcactggacaaatcctggcacgtgcttgggctaggatacaatcccagcattagcatggatgagatcagcaatgctgcagtcattcattacaatggagacatgaaaccctggcttgatattgctttgaaccagtacaaaaatctttggaccaaatacgtggacaacgatatggagtttgtgcagatgtgcaattttggcctatag

SEQ ID NO: 2473 - DNA, 340 bp, Glycine max
  Peptide Sequence Number=SeqID_119251
gaccataggcgatggagctcaaattcaattttggaatcatagctggattcctgaaggtggtaagcttggggatgtggctttaaccactgtttctgcgcgattaagttcaaatctggtttctcattatgttgatgatcaagttagagttctagctcatggaaacatttgctggaataagccaccaaatgatcattttaagttgaatactgatggagctatcaacaatgacatgaagaaggctgttgcaggcagggtcttcagagactctaatggtaaggtgaacttctttgctgcagatgttgggtactgccctgttgtagtagcagagaactctgggtga

SEQ ID NO: 2474 - DNA, 201 bp, Glycine max
  Peptide Sequence Number=SeqID_119252
atggatcctgaggacaaaaatcggtccaattacatcacgtcatttgacaacgccgtcaaagaagagaggggggtcaccagttgtgtcgtcgcactaccattatgccactatgttgccatcatcgctttcgcgccgtcaggccctgcaccagtgatgccactgaggttggaccaggttgccctgacctggttccaatcctag

SEQ ID NO: 2475 - DNA, 528 bp, Glycine max
  Peptide Sequence Number=SeqID_119253
gaggaggatgccggggaagaggcgctgaggtacctcgaatgggagattctcttggcggttaacaattcggagaggaatgtgaatggtgtgttggagcacgagggcaatgctgttggtggtgctgatttcttaacaattcaggatggttatgtgtatgccgcagagtatgatgttttgttcgggcagtttcttgagaatgagagtgccttgaagggaagccctccggctgcgaagagtgttgtggagagtctcccgttggtggagttgtcgaaggaggagttgttgcaggggaagaacgtggcgtgcgccatttgcaaagatgagattttgttggaggagaaggtccggaggttgccttgctcgcattgttatcacggggactgcatttttccgtggttgggcattcgcaacacgtgcccggtttgtcggtttgagctgcccacagatgatccggactatgagcaggggaaggtcaatagggctgctcgtggtctgttggagcttgcggcagcacggatgcaattttga

SEQ ID NO: 2476 - DNA, 204 bp, Glycine max
  Peptide Sequence Number=SeqID_119254
atggatagaggtcagggatggctgaaaactgtcactgctagccagaaaacacttggaaatgttgccaagaggggtggctacttcataacagaatgttgtcagagagaacagtgccatgatagccactacttgataagccatgataacctgctattcaatttctgtagtttgctctggacactccatgacacgattctgagatag

SEQ ID NO: 2477 - DNA, 458 bp, Glycine max
  Peptide Sequence Number=SeqID_119255
atgtctaatcatcatcattcctccaatcccttcgcatcatcctcatccactcactccgattccgattccgactcagtgagttgcttcgtcaccgatctcttcgaaactcgcctctgctcctgcgacgacgacactgacataaaccccttttccgacgtcgtttgcgacctccaccgtacggagcatgtgttagggttagggtttggcgttgaaattgatccccatagccaaacgaatggggataatcatcatcgtgatcgggttttcgatgctgatagagttttcaatttcacggtgggggatggttcgagcggggttagggttgtagggtttggtttggattccgaatcgagtagcgaggagggtgggattcgcgatggcggtgggtttgaggatttcgatgctcgattgtgttgggatagtctctgtttggaggatcagaggacgctgaatgaggg

SEQ ID NO: 2478 - DNA, 330 bp, Glycine max
  Peptide Sequence Number=SeqID_119256
atgcctggaagaaccctcattctatacatgactgtgttggatgagtcgatgggatgtatgctgaggcatcatgacgcgtctgggaaaaaggagcgggtcgtctattacttgagcaagaacccaccgtctaaggaaatacatgctgagctacaccacttgactggtatcgaagatgaacccagtcaagtatattttcgaaaagcccactctcaccagacggatcgctcggtggtaggttctgctgtcagagttcgacattgtttacgtcactcaaaaggtgatagagggaagcaccttggtagattacctagctcagtagcccatcaatga

SEQ ID NO: 2479 - DNA, 579 bp, Glycine max
  Peptide Sequence Number=SeqID_119257
atgaccttaataacctctatcagtggaaagagatatggtctcgtagtagtggatgactacttaagatggacacaggttatgctcctcgctcacaagaatgactcctttgaggtcttctttaaattttctaaaagagttcaaaatgaaaatggagtatgcattacttcaataagaagtgatcatggtagagagtttgaaaaggagagctttcatctattctatgaagaaaatggaattcttcaaaacttctccactgctagaacacctcaaaaaattggtgttgttgagagaaagaataaatcattgcaggaaatgaccaggactatgctcaatgacaactctacacctaaacatttctgggttgaagcagtgaacactggctattatttactaacacgacttattagtctgactggttcacatccttttgttggaatagatcatgaagatccatacacacatttttctaccttcatggaattatatagtaccatgggagcatctgacgaagatcctgaagctatctaccttagagtttttccattctccttgactggtaaggcaaagagatggctctaa

SEQ ID NO: 2480 - DNA, 153 bp, Glycine max
  Peptide Sequence Number=SeqID_119258
atggctttgccaggatcaaagtttgaaggagtgctagctctcagagaaaagggagatgatcgaagagaagaatggatggtagaaaatgaatggggagggctagggtttataagtagggaactaagggagaagttgacgccgcaaaagtggtaa

SEQ ID NO: 2481 - DNA, 381 bp, Glycine max
  Peptide Sequence Number=SeqID_119259
atgggtgaaggattcccaacgagaggtctacctaggagcttacttgaatcaataaataaatggtgttatcatcgtatatacgttggtgtttttttcctaaccaatgcaatgaagatattaaagactagtgtggatggtaaaactgatcaagttgttcctcagtggattgaagtaaagagctatgttcaaagtggaggctatgagtgtggctattatttcatgcattggatgtggaacatagtaagcgggggtttaaagaattattggagcatgtggtttggtgatggcacaacaatagacatcgagaccataacaacaatttgcaataaatgggaaacatattttgtaaaagttaaaaacactaaatttagaaaggtttag

SEQ ID NO: 2482 - DNA, 381 bp, Glycine max
  Peptide Sequence Number=SeqID_119260
atgtcgtcaacactttcaatcccactcggattctgcttccctccaaccgttgctacctccttccctcactcccaaaccaaaccccaaaacgttactttccaacgcagaaaaacaacaacgaaggcttgtgctgcctcagagaaccccaaccaacgccaaaacccgaagcagaaccagaaagaggccaaaaccaagaacgctggcgacgatgatggcgaaaagggtatcaaccccgctggctttctcgccaaacgcggcatttcccacaaagcctttgcgcagttcctccgtgaaaggcaagaattttggaaaatgagaatggaagttgtgtggtgtttagtggaatttgcgtttggcttttttgggtctgtttggttttag

SEQ ID NO: 2483 - DNA, 1191 bp, Glycine max
  Peptide Sequence Number=SeqID_119261
atgaaggatgaaattttgaaacggcatgagaacttcatgattttggcttctgggtttgagttactgggtatgcatcgtcatccagaacatcgggtggattatatggaatgggctccagtggccaacacattggcccttgcgaagagatgtgatacagaaaaatcattattttgtcaagttgccattgtcaccaagaaaaatatgttgtttgaacatgattttgtccatcctttcttattttctgacaagcaagtaaatgcaggggcccgctattgtgcaattattggtgacttcaatgggtggtcacctacagaagattgtgcaagagagcattactttggtcatgatgattttggatactggtttatcattcttcaagataagctgagagagggagaagagccagataaatattattttcaaatgtataactatgtagatgattatgataaaggggatagtggtgtctctgttgaagagctcataaagaaagcaaatgaaaagtactggcaaccaggagaagaccgatttgtaaataatcgttttgaagggccagtaaagttatatgagcagatatttggtcctaatggacctcaaaccatagaggacataccggacataccagatccagaaacaagatacaaagcatgggctgcagagcatggaccttcccctactgctgcgattgatagtggcaaggagtatgacatatataatgtgatagttgatcctcaatggcaagagaaaattcgtgcactggaacctcctgtactgtactggtttgagacacgtaaaggtaggaaggcttggatgaaaaagtatagtcctggcattcctcatggcagcaagtacagggtctacttcaacactgcaaatggaccgttggagagggtgcctgcttgggctacatatgtccagccagaggtagatggaaggcaagcttgtgcaatccactgggaaccatcccctgagcaagcatacaaatggaaaaatatgagtcccaaagtaccaaaatccctgcggatatatgaagctcatgttggaattagtggttctgagccaaaaatatcctcattcaatgatttcacagacaaggtgcttccttacattaaggaagctggatacaatgccatccagttgattggaattgttgaacacaaggattattttactgttggttacagagggtag

SEQ ID NO: 2484 - DNA, 582 bp, Glycine max
  Peptide Sequence Number=SeqID_119262
atgaccgaaccacctccttcttccgccgacaaattggaagagcttctcatccgcctcacccaccaacaattatccctcaccagcaaaattgacgatctcatacatcacgtttcccctttgataccgcccgcaccgtccttctcctcccctttgcctcgtcatttccctgctcctgtaaccaaccatagaatgaaattagacgtcccacggttcgatggtacagatcctttgggctggatttttaaaataaaccaatttttcgagtatcacggcacccccgagtacgagcgtttaacgattgcatcgttctatatggagggccgcgcactctcttggtttcagtggatgaccagcaatggtcacctcacatcttggcccgtgtttctccaggctttgcaatcccggtttgccccttcgcagtacgaagaccccacaggggcactgtgcaaactcatgcagaaagggacagtagctgcttaccaagcggagttcgaggatctttcgaatcgtgtttccggcattcctccaacggtcctcctcagctgcttcatctccggcctccttccggaaatccgccgcgag

SEQ ID NO: 2485 - DNA, 921 bp, Glycine max
  Peptide Sequence Number=SeqID_119263
atggcagaatcatcaaaaaagcacaaaggatcttccgccaccaccgctgctgctggacactgccatcacggaccttctggagcacccacaacaccaatttctccttccttttcatctcctcgatcatttaccttgttttctttagatgatcaatgccaaagtcaaggtgttccttttgagggcactcttgttgatgactggaagtttgattattctagtcatgatggtcgtcatatggtctgcaatgaccaggctgatatgactggcagattgcttgctggatcattaacttttgattaccgcatcatgcattatattattgttcacattttgcttccacgttcctcaaaccttgctcaaacctttgaggagaatttgattcttatgtgggcttttcttactggtcatcagatcgactgggctcatttgatttggtaccagatgcataaggaattacgggccaatgcacctctcccttatcctcaccttgtcaccctttttcttcattatttcaaaattcctttggatgatgaaccatttattcaagtaaaaaggtcttttgctaatggtgcaggtgcggttaccttgtttggtaatcataaggatgatgatgtcattgtaaaagggattttacaagatagtggaattctcaagcgggtttcttggggactggacgtaggcacaaagtatgtgcctactccgcgagtgacacgtatgcaagggttttgcacgtgcatcgcacacgcttgcagcagcaagcaaatgttacatcctttctttaatgcactctccaacggtcagaaaaggagcagtgtattcaaatttgactacttaccttacatgacacgccaaagacacgtccatcacgaacaacttgacaaaagcagcccagacgacacttgtccagactcaggggcttaa

SEQ ID NO: 2486 - DNA, 321 bp, Glycine max
  Peptide Sequence Number=SeqID_119264
atgaacaatgccggcgagtgctctacgtcaatgctgattgacattgcgctcgacggtgtttcagagaccgttgaccagatgctagggaacgccttctgttggaatcgtaccgactatgtcaggattcaggctatcggattaggagatcaaggaaaagatgatgagaaggtactgaacgagagagtccttgaatcgttaccgtttgggggaaaacggttactgcaggagacaaacggtaacagaattgagagcttcgtgcaacgtcttgttgctactgggaagacaagtcttccacctagtccgtgcaagcttccgccgtaa

SEQ ID NO: 2487 - DNA, 165 bp, Glycine max
  Peptide Sequence Number=SeqID_119265
atggaggtgtggttcaagggctgtgttggtttgctggcagtggcttcaaggagttgctgccccgtgctgtgtgcggttaggcttgaggttttaaatggaattcacggagggtcagagattgctaccatgccttctttgagtggaagagaggctatgagagagtaa

SEQ ID NO: 2488 - DNA, 2782 bp, Glycine max
  Peptide Sequence Number=SeqID_119266
atggaagaattggagatcataaacattggaaaggccagcaaagtgtacaatgccgttgagcctgtggtgctcaatgtgcttaagtgcaagattcctctgttctgtggaattggttttagcttccacaacaatccacagcaatggttgaggaaccagctttatagtatttgccaaccttctcaaaaacactgcttggtggggattctaggcttcacgggcatggtatctggcattggagctatccaaattctattgacatttgttgtgaggtttgacatttcactaggttgtggtgcaaattctgtcctatttgagacagcaactttggtggaaaagagagaagatttacctgttggagctaagcctgtgaaaacccccatcaaaaaacatagggaaaaatggagcatggccttcttccatagaagaactttcttctttgatctttctagtgaacccatcttctttgaaccacctgaagcacaatcttcaggaaacacgctcgtctacacgatcctgcgatccaacgcggcgtgtccagtgattccgctctccgtcgagtctgctcatggtgaagaatcacgaggccatccgccggtgaagaatcacgaggccatccgccgagattcaaccacgattcaggaacaaaaaccagacaagctccgattcatattggtagctgctggaatcgtatacaatcgtgcgatgcgtatggtgaatcgtacgatactaactaccatggaggagttatcaaccaacagttacatcaacttgatgtgcaagcaacagcattacagagaagcacttgatacattcaatttccatctaaagaattcaagtatccagctagaaccaagcacctatgtgaatttaattttggcctgcaccaacgttagatctcttaaatacggcaaaagaatccatgatcacattttaaagtcaaactgtcaaccagaccttgttctccaaaatcatattcttaatatgtatggaaaatgtggttctttgaaagatgctagaaaagcttttgacacaatgcagctgcgaagtgtggtctcttggactataatgatctctggatactcgcagaatggtcaagagaatgatgccatcatcatgtatattcaaatgctgcgatcaggttatttcccggaccagttaacctttggaagcataattaaggcttgctgcattgcgggggatatagatttaggtgggcagctgcatggtcatgtcattaaatcagggtatgatcatcacttgattgcacaaaatgctcttatatcaatgtatacaaagtttggacaaattgcacatgcctcagatgtgtttactatgatttctacaaaggatttaatatcctgggcttccatgattacggggtttacccaacttggttatgagatagaagctttatatcttttcagagatatgttcaggcaaggtgtttatcaaccaaatgagtttatattcggcagtgtattcagtgcttgcagaagccttctcaaaccagaatttggaaggcaaatacaaggaatgtgtgctaaatttggtttagggagaaacgtttttgctggctgctccctctgtgacatgtatgcaaaatttggattcttaccttcagcaaaaagggcattttatcagattgaaagccctgatttagtgtcatggaatgcaattattgcagcacttgctaacagtgatgttaatgaagccatatattttttctgtcagatgattcatatgggattgatgccagatgacattacttttcttaacttactctgtgcttgtgggagccccatgacactcaaccaaggcatgcaaatacattcttacattatcaaaatgggtctggataaggtagcagccgtatgcaactctctgctgaccatgtacacaaagtgttcaaatctacatgatgcattcaatgttttcaaagatataagtgaaaatggcaatttagtttcttggaatgcaattctatcagcatgctcgcagcacaaacaaccaggagaggctttcagattatttaagctaatgcttttttctgaaaataagcctgacaatatcaccataactaccatattaggaacttgtgcagaattggtatctctagaagttggcaatcaagtccattgctttagtgttaaaagtgggcttgtggttgatgtttctgtcagcaatagattgattgacatgtatgcaaagtgtggattacttaaacatgctcgatatgtttttgattcaacccagaacccagatattgtctcatggagtagtttaattgttggttatgctcagtttggacttggacaagaagctcttaatctctttagaatgatgaggaatcttggtgtccagcctaatgaggtcacatatctgggggttctcagtgcatgcagtcacattggattggtagaggaaggctggcacttgtataacaccatggaaatagaactagggattccaccaacaagagagcacgtttcttgcatggttgatttgcttgctcgtgctggatgcttgtatgaagcagagaattttattaagaaaacaggttttgacccagacattactatgtggaaaactctacttgcttcttgtaaaactcatggtaatgttgacattgcagagcgggctgcagagaatatactaaaacttgatccttccaattctgctgctctggtgctactttctaatatacatgcttctgctggcaattggaaagaagttgcccgattaaggaacttgatgaaacaaatgggtgtacagaaggttcctg

SEQ ID NO: 2489 - DNA, 923 bp, Glycine max
  Peptide Sequence Number=SeqID_119267
atgacaacagagataaaactgcaaacagttgagcaacaaagacatattctgagaatgctagagaaatcattggcaagagaaatggatcttgagaaggatataaatgattcgagagaaattcaagaaaatttaagactaaagatgttcttttcagagcaagagtttgttaacatggagggagaagcaattgatgtttgggaaagatggcttgaggcagacaatgcaagtgagattctgttaggaatttcaaaaggccttttaggtaaactccacatttctcagttcagtttaaatggtcaaagtcatcgtgaatctgagcttcgagctaatctaaaagatgctgaagataaactaacctttgccaattctgaggtctctgctttaagtaataaggtctcttcacttgagaagcaactaaaagaatcggaatttcagctactgaatgcaaaggcctctgctgatgaatatcagaagcagtataatgttaagtgttctgaagcaagagacatggggagtgttattgttgaactgaaagaagctgtatataatgcggaaagtagggctaatagtgcagaaactaagtgtaagttattgacagagactaattcgaaactcgatgaggagctggctcttttgagaggctcatctacaagagcagagttgctagagaggcagttgaaagaatctaatctacgattgcagaaaatgacagcatctgctaaaggtagtcaggagaaacaaagtaagttgtattccacaattagagatatggaaaatgtgataaaggatctcaagtcaaaggtttctaaagctgagggtagggctgatagcacagaggacaattgtatcattttgtcagaatctaatgccgagttgaatgaggaactcagctttatgcggagtcgattggaaagccttgaggg

SEQ ID NO: 2490 - DNA, 198 bp, Glycine max
  Peptide Sequence Number=SeqID_119268
atgggtgtacagaatgtcctggtcaagtggatagaagtaaggacagatccatgtgtcttctcagaagatagtcgcatccacagaggggcaacatctacacaatgcttgaagatttgtggttacagatgctggatgatggttatgatccttgtcagagaactacaagaattttttgttttgactgatcccaaaggttaa

SEQ ID NO: 2491 - DNA, 1758 bp, Glycine max
  Peptide Sequence Number=SeqID_119269
atggcgaacgactcgtcgtttttgttcgccggcattcgtttcgatagaaagaagttcggcgccgatattgccaggttccagaaaaaagacagtgatactgattcggcgaagatttcgagcgccgccgaagacgaaggcgagaaaacaatagaaccagtggaagagaaagtcgcagcgtcaacgacgaagaagaggaagcgcaagggaacctcttccggtattcacattctcgtgctttatttatactatgctacctcttgcattcaactttatgtatctcacttttgcttcgtttttcgtaaacgcacaaaagaaacggttgaaggattcaatgtgttcagaagttcgacgtctgtggcgcagtcgaatgatgaagtccgagtcaatgaggagtccgttgagctgaataagaagacaaagaagaaggaacaaaataagcaactcgagcgggacgcaaaattcagaaagcagcacaacattcatgtctctggttacaacgtgccgactccgcttcaaagctttgatgagttgaaatcaagatataactgtccttcgtatttgttgcgcaatctgaaggaacttggatttagagaaccaacacctatccaaaggcaggctattccagtacttctacaaggtcgtgaatgctttgcttgtgcaccgactggctctgggaaaacccttgcgtttgtgtgtccaatgcttatgaagcttaagttcccaacttccgtgtccttggttcaaataatcaactgtgttttacaggatccggaaaaaggtggcattcgagctgttatcctttgtcatactcgtgaattatctgtccaaacatatcgagagtgcaaaaagcttgctaagagaaaaaaatttcgtatcaagttgatgactaagaatcttttaagaaatgctgatttttcaaaatttccatgtgatgtactaatatccacgccacttcgattacgcttggctatcaagaggaagaagattgatctcagcagagttgagtatcttgtcctggatgaatcggataagctatttgagcctgaattattcaagcagattgattctgttatcaaggcatgctcaaatccctcaataatacgctcactgttcagtgctactttacctgattttgttgaagatcaagctcgagaacttatgcatgatgctgttcgtgtaattgttggcagaaagaatatggcttctgaaacaataaagcaaaaattggtttttactggaagtgaagaaggaaaacttctagcaattcgtcaaagctttgccgagagtcttaatcctccagtattggtttttctccaaagcaaggagcgtgccaaggagctgtacagtgaacttgcatttgacaacattagagttgatgttatccattctgatttgtctcaagcagagcgagaaaatgctgttgataacttcagagctggaaaaacatgggttttgattgctactgatgtagttgcccgtggcatggatttcaaaggtgtgaactgtgtgatcaattatgatttccccgattctgctgctgcttatgtccacagaattggtcgttctggcagagcagggaggactggagaagcaattactttttacacagaagatgacattcctttccttcggaatgttgctaatcttatggcagcatcgggctgtgaggttccttcctatctcatggagttgcgcaaaaagaagtggaagaagcacaggccaaaaagagattcaatctcaacaaaaccagacctataa

SEQ ID NO: 2492 - DNA, 438 bp, Glycine max
  Peptide Sequence Number=SeqID_119270
atgggtcccaaggtacttaaccagggttgcataatgttatgtgaacggtcaatatcaataagcacattgaccctgtggcccattatagagcatgtaagcctaagagcttggggtgtagatgttggggtacttgtaagggcttgtggggatagttggaagtgtattggaaaagtattgggatcatcattggggggttatcagcttactcacttactccgttactcgcgactccgtgctgagctactcacctcaccttgttcgagttctgctttgaaagccctcagtcacggtcctcatcatcgctggccctcaatcgcggtcctcatcgtcgttgctcctccgtcatcgtcgctgctcctccgtcgtcatcgttggccgctgccatgctggtcctcactcatgctccaagctttgcttcacgtcacgatgctaaggtaa

SEQ ID NO: 2493 - DNA, 514 bp, Glycine max
  Peptide Sequence Number=SeqID_119271
atgagcactgaaagtgctgaacatgatgccagtgttgttgatcttgaaggtgttgctgtttcatcacccagtggaaatgtgatgggagatctgggtgatgtttacagcacaatgctcacaagccttgatttgggtttggcttgtttctctgagaaagtttccaacttgagcaattttgtgatgcatgtggaaaccaaggagtgtgaacttgaggccttggagaaagaggatcacattggtgaaaagggtctggagtttgatctgttgtctgtggtgttggattcagaggtgagagagttggagggagtgttggacacccttcaaggtggggttgatgaggctagagagtgggggtgttcttgcactcatttgggagagggttttgttgcaatgcaagagaagttgggtgattatgaacaacagttgaagcagtttgaagaggagtttaatggcattaagatgcagtcagccagttttcagaggaatttgtcttccttaaaaaaggcagaaaatg

SEQ ID NO: 2494 - DNA, 843 bp, Glycine max
  Peptide Sequence Number=SeqID_119272
atgaagctatctgcgaaacccatttcgagtccaggtcgcacagacaagttccctcccccactcatgaggtttctcagaagcaatgcgggcagcagaagcagaaggtccaggtcaagccctatgttcgtacgaaagaaaaacaccaccttcgaaacccacacccaggaaccctcttcccccaaggtcacgtgcatgggccaggtccgagtcaaacgcgcttccaaacaacccaccacccaacccgacttagctcccactcggtgccgccgccgccgccgccgctgctgctgcttctggatccgaaggcccaacaacccctgccgctgcaatcccctctggcccaactggcccttcttccgtcgaaagcccaccaagctcaaacaagactcccagtccgagcccaatttctacgcccacgaagaatcggaattaccgttccaagagagagtcaatgtggataaggatagtgattttgcttccaattccagcactcccccgagaaacgctctgcttttaactcgctgtagatccgctccgtacagatcctcctctttggctagtaggttctggagttcccccgtcaaggaccaagaaacggaactacaacacacttccgagggaccccaaacggaacccgaattagggtttctaacagaaaaaattgcttcactcaccgaaccagaaaaggttgaggaagttgaaacagaaacagagtctgtgttacgtcctactgtactcactaggtgcaaatcggaaccggcgagaaccggacacagacttgaccctctgatggtaactagcagtaccagaattcttcctcaaaatatggtcgtgaaatactga

SEQ ID NO: 2495 - DNA, 231 bp, Glycine max
  Peptide Sequence Number=SeqID_119273
atgcaatgtggtacatttttcagtgaaaaacttgtcgggcgcctaggagtacatgacaggacatgcctcacaatggggagactagtcagggtcactctgttttgcgagaatgtccaaccatgtgggatcggcacaggcttaaaggagcactcaaaccggatgacccctaaggcctacactccgaagagtccgtcaggacctctccctcctgatttagtgcacctcaagtga

SEQ ID NO: 2496 - DNA, 285 bp, Glycine max
  Peptide Sequence Number=SeqID_119274
atggataacctgcggtgcggggtggagccggtgaagacgctgagcagggccattactgggcccggaatgatgggccgggtcgaggacttggtggcccaggcccacgcaagcccgcctggagtgaggaaaaacgtgaggaggaaggttaagagaaggatgcatagggcggcttggagggtgacgatagggggttggatgagttccgggaagaacaagagtgtaaaatctgagatgaaaataaagaaaagtgtgggagagatgaagaggttattgtgctggaactaa

SEQ ID NO: 2497 - DNA, 549 bp, Glycine max
  Peptide Sequence Number=SeqID_119275
atgcccttatggggtaggattgcatcacttgttcaccacaccggtgacgatgaatgtgatggcagaaacgaccctcttggccgcgaacccgaaggaactaatgagcaaatcgaaaaggagaaaaagggagccatccctaagagagaggaggttgttgtagaagacgaagtcctatgtgttgaggctgaggctcatgaccatgtgcttgatgtagaccatctcaatggtgatggtgatgagataagcgaaggcccaagagtaggcgatgaaggtgaaggaaaagttggtggtgacgaagtcgaaggcgtcaacgaggatgacgaggagggagaggaaggtgaggttggaggggcaaggctgaatgcagaaggcggtgtcggcaagggcgacgaggaaagaggtgagggatcagaagacaatgaaggtgtcaatgtttgcatgtcggaggagattggtgttggtgaagatggcgaggtagaagacaagtgcggcggggaagaattttttggcagtggggagtgtgaaggggtcatgatggagaaatcctaa

SEQ ID NO: 2498 - DNA, 1088 bp, Glycine max
  Peptide Sequence Number=SeqID_119276
atggctttttcaatcggtctgacccggttcgtcatctcgagtgaaccggaaaccgcaaaggagattctcggcagccccggttttgctgacagaccagtgaaggaatcggcctaccagcttctcttccaccgcgcaatggggtttgcaccatacggagaatactggagaaacctgaggagaatctccgcccttcatctcttctctcccaagagaatcaccggctcggaagcctttaggaacgaggtggggttgaaaatggtagatgaagttaagaaggttatgaaggataaccgacacgtggaggttaagaggattttgcactacgggtcgttgaacaatgtgatgatgacggtgttcggtaagtgttatgagttctacgagggtgagggtgttgagcttgaggctttggtgagcgaagggtatgagctgttgggtgtttttaactggagcgaccattttccggttctggggtggttggatttgcagggtgtgaggaagaggtgtaggtgtttggttgaaaaggttaatgcgtttgttgggggtgttattgaggagcatagagtgaagagggtgagaggtgggtgtgtgaaggatgaagggactggggattttgttgatgttttgcttgatttggagaacgagaacaagcttagtgaggctgacatgatcgctgttctttgggaaatgatatttaggggaactgacacggtggcaattctgctggagtggatcttggctcggatggttctccaccccgacatccaagccaaagcacagcgcgaaatagactccgtctgcggaccctacaggctcgtatccgaagcagacatgccgaacctgcgctaccttcagggcatagtaaaagaaactctccgcgtgcaccctccaggcccgctactctcgtgggctcgcctggcggtgcacgacgttaccgtgggcggcaagcacgtgattcccaagggcaccaccgcgatggtgaacatgtgggccataacgcacgacgagaggttttgggccgagcccgagaggttcaggcccgagcggtttgtggaggaggaggatgtgaacataatggggtctgatttgag

SEQ ID NO: 2499 - DNA, 132 bp, Glycine max
  Peptide Sequence Number=SeqID_119277
tttcatagagaaaagaaaggcataccttcaagtcatgagagaaatgcaaccgcaacaatagtttcaggtgaagtacctccgacgactaacgttggacagatcaggtgcgacgatggtttagacaacatgtga

SEQ ID NO: 2500 - DNA, 1494 bp, Glycine max
  misc_feature (1276)..(1276): n is a, c, g, or t
  Peptide Sequence Number=SeqID_119278
atggagatcctccccacttgcgtggccttatcactccaacatgtttgccatattcatagcatgtctctaagtctaaccatcaaactacacctggcttcttcttcttctttttccaactttaccctcaacagccaccaccatgcaaacaaggtaacgacttccaaaacctgttccaacgccaagattcgtcccaaacccatttatagtacaaaccctttgatcatccccacgtgtaaagtgaggccaagagtgcaacaacaccgtggcaccatgatcaagagttctttgatagagcctgatgggggtgcattggttgatcttatggtttctgagggtgagaggggtgctaagatcaccgaggctgagtcactgccaaaggtgcagctcacaaggattgatcttgagtgggtgcatgttgtgggggaaggttgggctagtcccttgagagggttcatgagggaggatgagtatcttcagagtttgcatttcaattcccttagggtcaaggatggttctttggtgaacatgtcccttcccattgtgttggcaattgatgatgagactaaagagggaattggatcctcttctcatgtggggttgctcgggcctcatggagattgtgttgcaattcttcgaaggtgttgggatgatctgaagaatttagggaataacttgaaaacggatgaagggaagttaggtttggaaggaaattggcttattggaggagatttggaagtgctaaaacctatcaaatacaatgatggtcttgacaactacaggctctctcccaaacaacttcgtgaagaatttgacaagcgtcaagcagatgcagtttttgcttttcagttaagaaaccctgtacacaatggtcgtgccttgttaatgaatgatactcgtaagcgactattggaaataggcttcaaaaatcccattttactgcttcatcctcttggaggtttcgtaaaggctgacgacgttcccttggatgtcaggatggagcaacatagcaaggtcctagaagatggagttcttgatcctgagactaccatcgttgccatatttccatcacctatgcattatgttggtccaactgaagtacagtggcatgccaaggcacggatagatgcaggtgcaaacttctatattgttggtcgtgatccgactggtatgggccacccaactgagaaaagggatttgtatgaccctgatcatggaaagaaggtactcaacatggctcctggtctggagaagcttaacattttgccattcagagtgncagcttatgacactaagttaaacaagatggcatttttcgacccaacccgtgctaaagatttcctctttatatatggaaccaagatgcgagcttttgcaaaaagtggggagaatccgcccaaaggttttatgtgcccaagcggatggaaggttcttgtcaagtactatgaaagtttgcaggcagaagagtcatcacaacagcctgtgctatctacttag

SEQ ID NO: 2501 - DNA, 321 bp, Glycine max
  Peptide Sequence Number=SeqID_119279
atgaacagttctaccttcagctttgagccttttagtacaaatcatggtccccacactactacaaaagcagcttactacgtcagcaattcaacgacggtttcaaagaaacgtcgtagaagctcaaccggtggcatatccgtaattaagggtttcagaacgacgactataaacacgtcatcaatttcgtcatttagatacaaagacggtcctgccgcaacacccgtcttcgtattgtttgtgctacacagagcatcttctccgacaaagaccatcgtctccgacaaccaccatctcatgtccgttgcgtctcgttccgtttga

SEQ ID NO: 2502 - DNA, 339 bp, Glycine max
  Peptide Sequence Number=SeqID_119280
atgacatgccggtggaatgttggaacccaaaacacaatttataatgtgatagattttggtgccgtgggagatggcaaaacagacgatacacaagcatttttaaaagcatggcaaagcatgtgtgaagcacaagggacatcaactctattaataccaccaaacaaacttcaaggggtaatagttgcacctaccaaggatgcatgggtggaaggtaatctgaatactttgattatgatctcaaatgtaaacggtctcacaattgatggaagtggtggattaatcgatggctacggttctgcttggtgggcatgcaaatcttgtccacgaccatcggtttga

SEQ ID NO: 2503 - DNA, 426 bp, Glycine max
  Peptide Sequence Number=SeqID_119281
atgaggcaggttgtgaaaattttggaggtggaaattgacagcattgagtctgatgaagataacatggaaatgagtttgcttggaaaaataagatcagctactacgtggtctaaagctgaatgtgctttaccatacagtggttacccttcttttgatgaagttaagatgttcagttttaattctaggacttctagaagtggctcaaacacaactaaacatgaagacagtaaatctgaagctcaaattaaacatcatgggtttcatcaagttcagtgtactaacttagaccaaacgctcaacgaaactgataatgtggcacaggatgacacaccactgatgaaggatggcagcaggctgttcccgaaagtcgttcactcactacccgcaagtcagcttcatcaacgagccccacataaaccccactga

SEQ ID NO: 2504 - DNA, 780 bp, Glycine max
  Peptide Sequence Number=SeqID_119282
atggcaaacaaaaactttctatgcattatagaagaaatggataggctttggtttcaccaagctattcttttctcagaaccaacagcatcagttatttcattaccatctccaccagatgaaaaaaaacctgttcctacatcagaatccgtgtcttgctcatcatccattctttcttcaccacctccaccagatgaagaaacttcaacggatgaatcaccctcttcagagcaacaactctcatcagaatcaatgtcagtgcctcttcaggatggttcaatcaacaatgaagaggaaaggaaggacgggttgactagaatgaaccttttggataacagaactcgttcacattcatcctcaccatcaactcaaaaccgtcacagaaaattgaggaaaccagctactacttgtgcaaggaaactacagaagtccataagttgcagaacacttggggagctagaacttgacgaagtgaagggttttatggatcttggtttcacgttcaagaaagaatgtcttagtccaagaatgatgagcgttataccaggcttgcaaagacttggtgtgatggacgccacagaaacggttgaaggaaatcatatcgaagcagaggaacaaaagagaggcatcatgagaccatatttatcggaggcatggcctataaagagacccgattcaccgctactgaatttgaaaattcccaaacgttgttcatctgccaacatgaagaaacatcttcggttctgggctaaaacagtggcctcagaaatccaccaagaatga

SEQ ID NO: 2505 - DNA, 483 bp, Glycine max
  Peptide Sequence Number=SeqID_119283
atgaattcagctgcgaaaagatcagcacccactatgagtggtcttcttgggagtgtggctccttgcgtgctgtatggaagcaatgttgagagacttgaatctgctcctgggacatttgccaatcactgcttgccatattctggaatgtatataattggaaattcctgctttggttggaattgccttgcaccgtggttttcctatcctagccgtactgctattcgtcgcaggttcaatttagagggaagttgcgaagcacttaatagatcatgcggatgctgcggaagcattttggaagatgaggtgcagcgtgaacagtgtgagtcaacatgtgacttggcaactcatgtcttctgtcatgtatgtgctctttgtcaagaaggtcgtgagctccgtcgcaggttacctcatcctggctttaatgctcaaccagtactggttatgattcccccaggagagcagaccatgggacgtgaggcttga

SEQ ID NO: 2506 - DNA, 651 bp, Glycine max
  Peptide Sequence Number=SeqID_119284
atgaatatctgcatggcttctaattcagctttccctgcattttatttacagctggttctggttgtgggagctaaacttgaagtcattgtcgaccaaatggctcttaaaatgaaagatgtcaataatgtgaccaaggggaccccacttgtttgtccaagtgacaaattcttctggtttggccatccaggatttgtgttaacactcctacattacactttattcgtgaatgcattcgagcttgccttctttatatgggtatcaggtagccgttcaagtcctatgcagctatgttactctccccctctatgcactagtggcacaggtaaactctatttagacattgatgtattagtgtgtgactgtgttcggatgggttcagaagtgaagagcaaagcattggctaaaatgctgaagcagtggcatcttgaggttagggagagaaggaggaaccgagaacaactcaagtcttttagttttaggcacacaaatatgtcctcagaatggagccaagaaaataagagtgcccctgatttttcttccacactttgtgaaagcattcgttcctctgatgaaggagaaattgtagaagaattggagcatatggagaaaacaaaggcgagctcatcaagtgatccaccatgtgttgtttaa

SEQ ID NO: 2507 - DNA, 389 bp, Glycine max
  Peptide Sequence Number=SeqID_119285
atggagagtgctaaggctagagattatatggaaggagttgtggaggatatggaatcagaggtatcgtatttagttcaagaaatggggctcaccttacaaggaaaagttgatggtcactatggagctgggggagtggagtgcactgtgacaaaaggcattggtggttcatttgacgaggaagagaatcaccttcaaggcgttgaagagcatgctctctttgagggaccatggatgtttactgatcatcatctcttggttcaaaggtggaggccattttttccattaagtgtagagaaagcgacaaacaaaggtggttgtgtgggtttgaagaacctaggagaattagcgagtggtgactacccaactgttggtacactcatttggtgcgg

SEQ ID NO: 2508 - DNA, 216 bp, Glycine max
  Peptide Sequence Number=SeqID_119286
atgttgattcaatatctgaatatgaaaaaatatgacaactatgttttgttgttaggtttttgtggaatcattggactgagtttatcccatgtgcagaatactgtgggagaacatcatattgaggtagaattgccaaaggaactacaaaccgaagaacaagggatacaaccggaacaagttgtgggaataaggatgtttggtctagcaggaacataa

SEQ ID NO: 2509 - DNA, 165 bp, Glycine max
  Peptide Sequence Number=SeqID_119287
atgatcatgttggtggtgatgacaatggtcatgacgttgctcacggtggtggtgatagcggttgacggtcatggtggtagtagtggttgcggtcatgatggtagtagcggttgcggtcatgataattgtgacgaaaataatatgactatggtgatggtcatttga

SEQ ID NO: 2510 - DNA, 1395 bp, Glycine max
  Peptide Sequence Number=SeqID_119288
atgacaattggaagtattgagcataaggcaaagaagacaaaatcaaggaagaacaaagtagttgttgatgagaagacacctttgataccgaagactcatgatgctgatgctgaaggcttagatgaattcaatggtgcttcattttctggggcagttttcaacttatccaccacagctattggtgctgggatcatggggttaccagcatgtgtgaaaaagttgggaatggttcctggtcttcttgctataatcttaactgctttgttgacagagaagtcaattgggttcatgatcaggaattcccgtgcagggaatctttcttcttatgggaatctcgtgggggattcatttggcaaattcggaaaagctcttgtgcagatatgtgttataatcaacaacattggaatgcttattatttacatgattattattggtgacgtgatttctggaacatcttctagtgaaattcatcattctggtgtacttgaaggatggtttggagttcactggtggacaggacgtacatttgttcttctttttacaacatttgctgtgtttgcacctttgtcttgcttcaagcgaattgattcgttgagatacacttctgcattatcatttggcttagcagttgcttttcttgttattgctgtgggaatctcaattttcaagattgcaattggaggcattgggatgcccagactcttcccgatcattactgatgtggcctcagtttttgaactgtttactgtaactcctgtggttgtgacagcctatctgtgccacttcaatgttcacagcatagataatgaactggaggactcctcacagatacacgggattgtgcgtacttcccttactctatgtgcttcagtgtacttactgacaagcttctttggcttcctcctatttggtgaaggaactcttgatgatgtgcttgccaattttgattctgatctgggaatcccttttggttctgtgctcaatgacgctgtccgttttagctatgctgcgcatcttgtgcttgtatttccagttgtcttctatgcagtgcggatcaaccttgatggtctcatatttccatcatctaggcctttggttctagataacttcagatttgcatcaattactatggcccttattgttgcttcctttttgggagcaaatttcatacccagcatttgggatattttccagttcactggagcaacagctgctgcaagtttatcattcatatttccatctgccatcaccctaagggatcggtacaacatcggaactaaaaaagacaagattctatcagtctttatgatagtcctcgcagtcttcgcgaatgttgtggctgtatacagtgatgcctttgccctgatcaagaatagtacaactaaacgtgagtga

SEQ ID NO: 2511 - DNA, 216 bp, Glycine max
  Peptide Sequence Number=SeqID_119289
atggatacaatctcagggactaaattgcctattcactcatttatttatgttgttcaagtggttgctggtaggccaacaaaattggtgttggtcgaaggtactaatgtggggatgaaggtggatgagacgaaggctgatgtggaggttattgctatagatcagggtaaacaattaatggaaaacaaggatttgcaggatctaatcccaagtagttag

SEQ ID NO: 2512 - DNA, 300 bp, Glycine max
  Peptide Sequence Number=SeqID_119290
atgaaagcagatactggagttcgaccattgaacaagagaggagtgaaaaatgaggggatgaatttagctcttggtcttctcttcacagcaataaaaagttatcaatcaaaaagaaagcaaggttggaaattgatgaccaacaaagatactattgtttctaaggtttggtttatgcaagaagtaatgattggcatgaatgatcacgtgatttttgatgctctgtgggctttagctcaagctttaggaatcaaagtgccagcagtggagtggccgatgtttcacgagctggataggttctaa

SEQ ID NO: 2513 - DNA, 579 bp, Glycine max
  Peptide Sequence Number=SeqID_119291
atgaggagtggaagtgttgcacctgaggcagagaagctagaatcaagaaggaacaagagagttgttgatgagaatgctcctttgataccaaaggctcaggagagtgattctgcagggtttgatgagtttaatggggcttcattctccggggctgttttcaacttgtccaccacaattattggtgctggaatcatggggttgccggcgtgtgtgaagaagttggggatggtgcctggtcttcttgctataatcttaacaggtttcttgacagagaagtcaatcgagttcatgattagaatttcccgggcggggaatctttcttcttatgggagtctcatgggggatgcttttgggaaatatgggaaagctttggtgcagatatgtgttgttgtcaataacattggtgacgtgatttcaggaacatcttcaagtggaactcaccattctggtgtccttgaaggatggtttggagttcactggtggactgggcgagcttttgttcttttgtttacgacacttgctgtctttgcacctttggtcagctttaagagaattggtgagtgttttttctgtcattaa

SEQ ID NO: 2514 - DNA, 255 bp, Glycine max
  Peptide Sequence Number=SeqID_119292
atgaccacagtcgagtatgcaatgaagtttgagaagcatattttcctcactacaatggggagacaggagaaagctcaaagaagtcgtattcagcttcagctaaccaatatggcaactattatagcagttagaagactatctctagtcaacctactagtggtgagagtgagagagcgtctccttctaacccacaaaggtaaggaaactatggttgtgctaatcattcaacatttgagtccaaagacaaggatgtga

SEQ ID NO: 2515 - DNA, 806 bp, Glycine max
  Peptide Sequence Number=SeqID_119293
attcattgaaattcacatctgcattatcagtaggactagcagttgtttttcttgtcattgctgtgggaatctcaattttcaagattataattggaggccttgagatgcccagactcttcccgatcattacagatgtagcatcagtttttgaactgttcactgttgttcctgtgcttgtgactgcctatatctgccactacaacgttcacagcataaataatgaacttgaggactcctcacagatgcatggtgttgtacgcacttcccttgcactatgcgcttcagtgtacttactgacaagcttctttggattccttctatttggtgaaggaactcttgatgatgtgcttgccaattttgacactgatcttggaattccttttggttctgtgctcaatgacgctgttcgatttagctatgctgcgcatcttgtgcttgtatttccagttgtcttctatgcagtgcgcgtcaacctagatggtctcgtattttcatcatataggcctttgcgtcaagataacttcagatttgcatcaattactatttcacttattggtgttatcttcctgggagcaaattttatacccagcatttgggatattttccagtttactggagcaacagctgctgtctgtgtagcattcatatttccagccgctgtcactcttggggatcgacacaacataacaactaaagctgacaaggttctatctgtctttatgatagtcttggcagtcttgtcaaacgctgtggctatatacagtgatgcttatgccttgatcaagaagaacaaaacttatacatga

SEQ ID NO: 2516 - DNA, 3717 bp, Glycine max
  Peptide Sequence Number=SeqID_119294
atggatgctgccctgagttcactttcttcgttacaatttcgcagactgagtcgtaagaacagggatgggctctattaccatatcaccctcttacccagtgttgacacctccacgcaggacttgcctccaagtatccttaccttattgaccaaatacgataccctgttccaccctccgaacacactacccccaacccgtgacaccgaccaccacatacatctccttccccaagcacctccggtcaatgtccgcccataccgttatccccattaccaaaaacaggagattgagtctcaggtggattcaatgttgcaaaagggccttatccagcccagctctagccccttttcttctcctgttttgttggttaagaagcaagatggttcatggaggttctgcgtcgattacagagcactgaatgcgttgaccgtgagagaccggttcccaattccgacgatcgatgagttactcgatgaattgggtggcgcaaggtatttctctaagctcgatttgctccagggctaccatcagatacgcatgcaccctcccgatatccctaagactgctttccgcacccatcatggccattacgaattcaaggtaatgccattcgggttgtgcaacgccccctcatcatttcaggccaccatgaatgctattttccggccatacctccgccaattcctcattgtcttcttcgatgacattttgatatacagcaactccttggatgtccatgtgcaccacctcgagctcacctttcaggtactccttcatcatcaattcacactgaagctttcaaagtgctcttttgcccaggaacaggtcgaatacctaggtcacctggtttcccaccggggagttgaaccattgccgtcaaaggtcgatgctatccaacagtggccgactccaagaactgtaaagaccttgaagagtttcttaggccttgccggcttctaccgccggttcatcaaaggctacgcaaccattgcggcccctttggttaaggcaaccactggtgatgcactccgatggacggcggatactcagactgcttttgatcgtctcaaacacgcgttatcgtcagctccggtcttagccctgccggactttaccctgcccttcacggtggagacagacgcctctggggttggcatgggcgccgtcctttcgcagcagggacaccccattgcctacttcagtaaaccatttagtgccaagctcctctggtcatcaacatatgtccgtgaattgtttgctatcacgacagccattaagaaatggcgtcaatatctcctcggacatcacttcatcatcgtcactgatcacagaagcctgaaggaattgctcacacaggtaatccagaccccggagcagcatacctacttggctcggttgcttggttatgattatgaaatccaataccgggccggtgctcataatcaagccgccgatgctctctcccgattgccggaaaacactgcttctctttgggtgttatcagttccttgtctgacattcttcgaggaacttcagcagcaattacaaacccaccctgattatgtccgaaaacgccaagctatcacggagcaaccctccaatcaccctgcattctctatctcgagtaatttgattctccataaggggcgtatctggctcccagagggatttcacttgattcccgctttaattgcagaattccattcaacacccacagggggtcacgccggcatcgcgaaaacagttgctcgggtcttggagaatttttcatggcctaagctccgggaggatgtcacacacttcgtgaccaattgggcagaatgtcagtgcaccaaatatgagactaagcgcctggccggattgttgtgtcctcttccggttcctttccggccatgggaggacctttctctcgatttcatcacgggtttgccggcataccatggacacaccgtcattcttgtcgtcgtggataggttctcgaagggagttcatctgggtacgcttcccacagctcacacagcattgacagtggcctcgttatttgtcgacattgtggtcaagcttcacggtgttcctcgaagccttgtatctgaccgcgaccctctctttattagtagattctggcaggagctcttccggcgcagtggtacccaactccgcatgagcaccgcctatcacccccaaagtgacggccaaactgaggtactcaataggactattgaacaatatttgagaagctttgttcaccggcgacccaacacttggggtaaataccttccttgggcggaatggtcacataatacgtcttggaactcagccaccgggacaactccttatgagctcaccttcggaaagaaaccattcaatttccctgagtacattgccgggacctctgctgtggatgctgtggattccttgttacaagatcgtgaggaaaccttccaattggtccgccggaagcttttgaaagcccaaagttgcatgaaggaacaggctgaccgtcatcggcgtgacgtaagctgcaattcgggtgactgggtttggcttaaattgcgacctcaccgacaaacatcagctaaaggtcctcagagttctgcggggaaactagcaagaaggtactatgggcccttcaagattatcgaggccatcggcaaagtggcttatcgcctgcagcttcccccggcgacgaagattcatgatgtcttccattgctctctactcaaaccgtttcatggtcaattggacaccacttctttcgcgcctctacctgctcaatttcataatgaccaacccattatcactccggcagcaattgtggattatcgcaaaaccccttctgaagcttgggaagtcttggttcaatggcatggcttatccccagatgatacgtcttgggaggattggtctgctttgcttaatgactatcaccttgaggacaaggtgatttcccaagggccgcgggatgatagggaaaacacagatcacagagcaggggtacaaagagaacattcagcagagggatttagtggggatagtgccgttagagcaggggacaagcttaacggaattgattctgtgatattcctcttgcaccaaaagataagaattctgttagcagaggatagtataaataagtactgcaaccaatatgttgacaaggatgcgctagtatatcttatcttggccaacgagatactgcattctcttcacccaaatattatcacaatagcagaagatgcaacattttatcctggattatgtgagccaacttctcaaggtggattgggatttgattactatgtcaacctttctgtgcctgatatgtggtcaacctttcttgagagtgttcctgatcatgaatggagcatgactaagattgttaacacattagtttccaatagagaacatgctgacaagatgcttatgtatgctgaaaatcacaaccagattatccgattgatcacattaacgattggtggtcgtgcctatctgaacttcatgggtaatgaatttgggcatccaaagagagttgaatttccaacatcaagcaacaacaactcgtatttgcttgccaatcgtcagtgggatcttttgacaaaagatggagttcaccgtgatttatttgcttttgataaggatatgatgaagctggatgaaaatgtcaaagtgctctcacgaaatattccaaacattcaccatgtgaatgatagctcaatg

SEQ ID NO: 2517 - DNA, 165 bp, Glycine max
  Peptide Sequence Number=SeqID_119295
atgaatcttcacattatggctagtaaacattttgatccagatgccaagctgccaaaattgcctgatgaatcgtgggcgttgagtgaggaaaaaaaagtgattaatggatgtatgtttgtgttagagggtgaaggaataatgtatacggtgaacatgagagtttag

SEQ ID NO: 2518 - DNA, 402 bp, Glycine max
  Peptide Sequence Number=SeqID_119296
atgggctcatacttagcctatgggcacgaaatctaccctaaggctcatgagaaccctagggccttctcttgcatctctggcccaatctacttggagtcttctatccaatgcccttgtggggtaggattgcatcagatactatgcccgatgggtatggagtatcagaagattcatgcttgccctaatgatcgcataatgtacaagcatgaattccaaaaaatgtccaaatgccctatctgtgggacttcacggttcaaagtgaaggatgcaaaggaaagcagttctgatgaaaactcaaagaagggccctccagcgaagcatatgggaatctcagcggttacaatgttaagggtcatcatgcatgccccatctgtgaagaaaacacaagctacatacaactaa

SEQ ID NO: 2519 - DNA, 819 bp, Glycine max
  Peptide Sequence Number=SeqID_119297
atggaggataaccctatcactaaagcatctcaccctgatacaaggatgctattcctcaatggtattgtcactttcctcattcatgttaaggactttgaacttctgtctgattctgtattgatcaactttgtgttacatgttctgatagtgatagaattagcatctcatatacctctatatctgtatcccttccttaatacaacaagcaagtcaagaccatttgagtacttgaggcttaccagccttggtgtcattggtgcattggtgaaggttgatgatacagaagttataagtttccttctttcaacagagataattcctctatgcttgcgaaccatggaaatgggcagtgagctatccaaaacagttgagtttactgattcttcattctttggtcgagttctggggaacatggtggcagctctagctgagcaaccctcatctcgtctattgaagcatatcattcgatgctatcttcgcctgtcagataatccaagggcttgtgatgcattaagaagctgtctgccagacatgttaagagatgctactttcagcacttgccttcgtgaagaccccacaactaggaggtggctacaacaattgcttcacaatgttggagtgaatcgggttcctgcactacaagctggaggagaggaggaaggattacttgatttgaaggcattccttgatggaaatggtggtggggttgatagtgaatgcatcgtcagagtcgttgtcgctggaggtgtcatcggaaccaccattcgagctttcatcagggactttgggggagggagggatagaaaggagatgttttga

SEQ ID NO: 2520 - DNA, 180 bp, Glycine max
  Peptide Sequence Number=SeqID_119298
atggtgcagagctactatggtgtgcatggaggagcaacaacacaatacccatatggaggagaaggtagtggtggcggcagtactaccagacatggttatggtgtgaactaccctcctcaggcttatctttttcagtattctcccattgcttccacggctggctatgcccgccagtactaa

SEQ ID NO: 2521 - DNA, 273 bp, Glycine max
  Peptide Sequence Number=SeqID_119299
atggtgtacgtaggaatgagtgtcctcaattcctactcgacatcatgtctaaagaatcactcttcctactcaattaaccataatacaaaacttggagggtttagccctggtgaaaagaagaacattgttcgcaaagaacaagtgggagagttaaggcccatttctactaatagtgttaggctcccaagttctattatcaacaacctccttgatcatataccccaatctttccatgcaaaggagaaaacaacaagaagaaaggggatctattga

SEQ ID NO: 2522 - DNA, 348 bp, Glycine max
  Peptide Sequence Number=SeqID_119300
atgtctaaagaagttgatatagatgatgaaaatgaacatgaatctggtgtgaatgaagaacaacatgttgattgttcggatgcgttcaatacttctcaggtgtttgctacccaagatgatgtttggcagtgggctcaattagtttcttatgaaaacggatttgtggtggtgattatgaggtcagacacaaacattggcatgaaaggaaggacttcatttgtgttaattgtttgtgagaggagtggtcgatataggtctaggaagaaaggttttgttagaagagatattgggagtaggaaatgtgggtgtcccttcaagtttcgtgggaaactagtggttggagggtaa

SEQ ID NO: 2523 - DNA, 327 bp, Glycine max
  Peptide Sequence Number=SeqID_119301
atggaggagcgtggccatggaatgtattacatgccaccaacatttcctcagtatccttcacagatgtatcagcatcctttcgaaggtcatcacactgatatgtctgcaagtacacgatggaatgtaccgggaccaatacctaatatcgatgacttattaggtgttgatttgcgtcacgaattttctgcgggggtgacgaagaagaagagaggagacatcggggtaggagaaatcctgatcaccaagcacaaagatgggatcaaccatgtggcacatcctcacggcatcacagacaccaaaatgaatgatttgcgtgtctctgtttaa

SEQ ID NO: 2524 - DNA, 486 bp, Glycine max
  Peptide Sequence Number=SeqID_119302
atggtatgtttttatatacaccgtctagattccaagtcctttagccacacattcaagatgaaagcaatattggtacaaactttggcacttgtgacacttctcgagttgttggttttgatcccaattgagggaaaatcaacaccaaagacattgcaccaaaatggtactactagagtcccatcatcaccaatttcaccatgggtgaagaatgtggtgaaagcaagatcatcagggtgccgtggtaggtcatgggtgtgcaaccaaggagaatttccaccaaggagcttgtgctgtaggaaccgttgtgtgaatgtgacttctgataggaacaattgtgggttgtgtgggattaggtgccccttcaattggaagtgttgtggaggcttatgcaggaacataaacttgagcattttcaactgtggcaagtgtggacatagatgtccctttgggacattgtgcttctttgggacatgcgggtatgcatag

SEQ ID NO: 2525 - DNA, 840 bp, Glycine max
  Peptide Sequence Number=SeqID_119303
atgtcgacgcctgtatcgccattgccactggcgggtcatgccttattgccaaagctaatggcggcttccatgcaaaaagagaccccatgtgcaaatactttcaaaatagaccctgttaccacccacttaaatgcaagaaagaaagaagcagttgttgttggagttgctcttggtgttggagtgaagctttacaagaaggagaacgtgttctttcacttccagttttcaaagttgaggactcctcccgtaatagaaaataaaccactcgaacacaggtggctacgacgtgaaaatcagcatattggcaatgatgatctgatagtttttcgtcgcaaattggatatcatgaaacaacatgagtttctgtgggagccttacacaacaactgttatgtcagtgttgcctccaatttgtttggttggtagtgtactgtggtgcgcggtgggtccttcacaaccactgaatatccatggcctaacgctgaaaggcaaacaagatgaaaattggttccagctgttggccccaatgatcagtcaatggaacaatcgagctgattttagggtcgacgtttatcctcgacaggagggcctattgagttttaactccgactacatggctgaagttacggagacattacagtatatggtgtcactacaagggaggaacacatggacaattgatgatctcgtgccttatgtagagaagataacgattttatccgaagagcaagagagaatcactgagtctatggcacatggtccagcatcagagcgtcgatttccaccacaagagtttcacatgcttcagtcaagtgttgaaactcggggttttggcagatga

SEQ ID NO: 2526 - DNA, 3561 bp, Glycine max
  Peptide Sequence Number=SeqID_119304
atgctccactctctcttcactctccgccgccaccgtcaccgcctttgttcttctctctctaacatccccaccgcccaaaaccacaacattaaccttctcgacaacaatgcctctctcaaaccccacttattggagctctccctcgcgatccccgaaaccactcgcacgtgctggaggctccccgcgctgggcccctcgcacgtgctgcaactcctgctggctctccagtcccacagcgtcactgtcgaaaaggttcgatctttgtgggaaattttcaaatggggtgctcacaaaaacgtggctttgaattccaagcacccttcacagtcccttgaaaccatgacctcgcttctcgtgcaagtggggttgtttgaagaagccgaggacttgctcttcgcgttggaaagtaatgagattttttatgatctcgttaaagggtatgttgctgcgagagattgggaaaaaggtgtttttgtgtatgatgttatgaagggtcgagggaaggttccttcgaaggattgttatggtgttttgattgatctcttggtgaaggtgaagaggacgggtcttgcatctagggtggcttttgatttggtggatttgggagtaccgttgagtggtgatgaagtgaaggcgttggagaaggttatggtgcagctttgcgttgatgggaagattcaggaagcaaggaacatggtgaagaaggtgttggttcttaattctgaggttagtagtttggtttttgatgagattgcgtttggatattgtgagaagagggactttaaagatttgcttagtttctttgttgaggtgaagtgtgcccctagtgtgatggctgctaatagagttgtgaattcgttgtgtagcagttatggcgtagaaagggccgggttgtttctgcaagagctagagagtttaggttttagtcctgatgaagtaacctatgggatattgattggttggagttgtcgcgaagggaagatgagaaatgcattgagttgtttgtcagttatgctatcgaaaagctttgtgccgcatgtgtatacttataatgctcttataagtgggttgtttaagttaggtatgttggatcatgcacgggacattgttgatgagatgattgagagggggatactgcctgatatttcgactttcagagtccttattgcgggctattgtaagtctaggcggtttgatgaagtgaaaagtttgattcatgagatggagaaccgtggattgattaagcttgctttgatggagaatccgatttccaaggcttttctgattttgggcttgggccctttgagtgtgaagttgaaacgagacaatgatgggggactttcgaaaacagagttctttgatgaggttggaaatggactttatttggatacagatgttgatgagtatgacaaacacattactttggatcttgaagaatccatggtacccaacttcaattcatttgtaagtaaggaatgtagcgatggtaacctgaaaaatgcattggttttggttgaagaaatgctttgttggggacaagaattgctatttcctgaattttcaaatttagtgagacaactttgttcatctcggtcacaaatcaagtcaatgaccaagcttttggagcaaatgccaaagtctgcacataaacttgacccagaaactctcaatttggttgtacaggcatacagcaagaaaggcttacttttcaaagcaaaaattatactagatggaatgcttcaaaacgaatttcatgtcaagaatgagacatatactgccatattaatgcctttatgtaagaaaggaaacatgaaggactttagttattattgggatgttgcttgtagaaataaatggttaccaagtttggaggactttaaatgtcttctagtccatatctgccattggaaaatgcttaaggaagcatcacaatttcttgaaatcatgcttttatcatacccttatctaaagtctgatatatgtcatgtatttctagaagtactttctagtacaggtcttgctgacactgcacttgtagttttaaaacaactgcaaccttgtttcaacttggatcatactgattataatcatcttataaggggtttatgcaatgagggaaaattttctctagcctttacagtattggatgatatgctggatagatctttggcaccttgtttggatgtttcagtcttgttaatccctcaattgtgcaaggctcatagatatgacaaagctattgctttaaaagatatcattttaaaagagcagccttcattttctcatgctgcagattgtgcattgatatgcggattttgcaatatggggagcacggggaaagctgacactctgttccgtgatatgttgtctaaagggttaactccagatgatgaactgtgtaacataattattcagggccattgccatgttaatgacttgaggaaagtgggggagctactgggttttgcaataagaaaagattgggagctatccctcacaagttacaagaatttagtacgattggtttgtaggaaaggtagagtccagttcgcactgagcttaaagaaccttatgcttgcacaatgtccacttgatgggcttatcatatataacattcttatgttctatcttttgaaagatggaaacagtttggatgttaataagatactaactgaaatggaagagaagaaagttgtacttgatgaagttggtcataattttcttgtatatggtttcttgcaatgtagagatttatctagttctctgcattatctaactaccatgatttcaaagggacttaaaccaagtaaccgcagcttgaggaaggtaataagcaagctgtgtgatgctgggaatctgaaaaaagccctgaagttgagtcaagaaatgagattaagaggctggatgcatgattcttccattcaaacatctattgttgaaagccttcttctgtgtggtaatatacaaggagcagaaacctttttggacaggatgggagaggaatctctaactcctgatgatatcaattatgattaccttatcaagtgtttttgccagcatggaagattgaacaaggcagttcatcttatgaacacaatgctgaagaagcataacattccagtttccaccagttatgattttatcattcatggattctgtgcacaaaataaactggacatagctttgaatttttattctgagatgttgagttggaatctcaaaccaagaattgatacagtggaaatgcttctccatagattctgccaagatgggaagacagaactagcagaacaattccttgtggacatgagtcatggaggtgaaactccaaccagaaaaatgtattgcactgtaattaagagttatcacatgaaaaagaatcttaggaaggcatcagagctcctgcaagccatgcaggaaaatggctatcagcctgactttgaaacacattggtctctcataagcaacttaaacagtgccaaagcaaaggacactgataatgcgagcaagggatttttatcaagacttctttttaaaagtggctttcttcaaaagaaatga

SEQ ID NO: 2527 - DNA, 282 bp, Glycine max
  Peptide Sequence Number=SeqID_119305
atgaagaagaaatcaccaacttccataacctgcataatgcaaatgcgaaagcgaacccaatttttgccgataataacaaatttaaattttaaacccacaggaaagagagggaatgaaggagaatttccaatggaagcgcatctcaccagaacatgtagagataataatgtacaatgcacaaacactcaaacagcaccaagaaacctgcaattaaaaaccatcaaaacccaattgattctaaagaaatcggataaaaatcagaccaacaacaatatcttctaa

SEQ ID NO: 2528 - DNA, 207 bp, Glycine max
  Peptide Sequence Number=SeqID_119306
atgtctatccatcatcaagcgtatcaggcaaaaatggtgatttacgcccgaaacaaacaggctgaaactgatgaagcgagtgcataccgaaagccaaagaaagagaaagcgtatgatcgtcagcaaaattctcacagaagcagggaaacgaataaacgtcagaatacggaattgataaaggagaaccaacctgataaacgtggctga

SEQ ID NO: 2529 - DNA, 456 bp, Glycine max
  Peptide Sequence Number=SeqID_119307
gagaacacttatgaatcctttcaaagagatgatggtgactggatgagtggtcctgctaaacttgagagcatggaggtggggaagatggtaacttgggaggaagtttgtgctatcattttcttgatgggtgccttaaaggcacctgtaccagatggatttcatgctttgacaaatttggtgactggggtgtttgaggatcctaaaagggaagttattcaaggtcttgtctctccttatcaaagtatctttatacccaatagacaaagtgtggataatgtgataattgtacaagaagtgtttcactcaataaagactaagaaaggcaactgctggtggatggaaattaagatagaccttgaaaaggcctacagtaggttcagttgggagtttcctataagggaaaatcgtgcaatgcatcatgaggttgccagtgccacagatggagagctaggatga

SEQ ID NO: 2530 - DNA, 120 bp, Glycine max
  Peptide Sequence Number=SeqID_119308
atggctgatgaatgcatgcaagttgaagatactaggaaggccctcaacctagtgctggaggttgacattgtggttaacgccgtatgggcctatagaatggatgaatgggcgaaactctag

SEQ ID NO: 2531 - DNA, 750 bp, Glycine max
  Peptide Sequence Number=SeqID_119309
atgagtgtcatcgacattctcaccagagttgattccatttgcaaaaagtacgacaaatacgacgtcgaaaagcaaagggactccaatctctccgccgacgatgcattcgccaaactctacgcctccgtcgacgccgacatcgaggccttacttcagaaagcagaaaccgctgacaaggagaaaagtaaggcatccactgtagcgatcaatgccgagattcgtcgaaccaaggctagattgttggaggaggttcccaagttgcagagattggctatgaaaaaggtaaaggggctttcatcacaagaatttgctgcccgaaatgatttggctcttgcattgccggataggattcaagctatcccagatggggcccctgcagcacccaaacaaactggaagttgggcagcttcagcttcacgtcctggaattaaatttgattcagatgggaaatttgatgatgaatacttccaacaaactgaagaatcaagtcgattcaggcaagagtacgaaatgcgtaaaatgaaacaggcaaaaggattggatactttgaaaaacatggcacatgatatgaatgaggaactggatagacaagttccactgatggatgagatcgatactaaggtggacagggcatcttctgaccttaaaaataccaatgttagacttagagacacagtgaaccagataaaaatatatgctagtctctactcccttctcttgtgtggatttatagctcagttcatattctag

SEQ ID NO: 2532 - DNA, 3045 bp, Glycine max
  Peptide Sequence Number=SeqID_119310
atgccaccaaactcaatcataccacctgttttggtcatcgtttgtctggagaatggccaattttgctaccactctaattcttctgtagccgatgggtacttcagtgtactggctgaggtctacatgcgccaagagataccaaactgtgaaatacagagattattgagtctgatcctttacaaggtagtagacccatcaagacaaattcgggacgatgcccttcagatgctggagacactttctgttcgtgaatgggctgaggatggcattgagggctcaggaagttatcgagctgctgttgttggtaatcttcctgattcctaccaacaattccaatacaagctttcctgtaaacttgccaaagatcatcctgaattaagccaacttctttgtgaggagattatgctgaggcagttagatgctgttgatataattgcacagcatcaggtcttaacatgcatggctccatggattgagaaccttaatttctggaaactcaaggaaggatggagtgaaaggttattgaaaagtctctactatgtaacagggcggcatggagaccaatttcccgatgaaattgagaaactttggagcacaattgcaagcaaaaataggaatatcagccctgttttagatttcttgatcacaaaaggcattgaagattgtgattcaaatgcatcaactgaaataagtggtgcatttgctacatacttcagcgttgcaaaacggcgacttctagaggatagcattgagccggttacaagtaagggtgatgccagtgcaaattttgtgctagaattctcacaaggtccggctgtggcccaaatgacatcagttatggataaccaaccacacatgtctccattgcttgtaagaggttctcttgatggtccactaagaaatgttagtgggagcttgagctggagaacggcaggcatgacaggccggagtgtatcaggcccattaagtccaatgcctccagagttgaatattgtcccagtaaatgctgggcgatcagggcagctccttccagccttggttaatatgtcaggacccttgatgggtgttagaagctcaacagggagtttgcgtagccgccatgtttcacgagacagtggagattatcttgttgacactccaaactcaggtgaagatggactgcatactgggagtgctatgcatgctgtgaatccaaaagaacttcaatcagctctgcagggacatcagcagcactcacttacgcatgcagatatagcactgattcttcttgctgaaattgcatatgagaatgatgaagatttccgccaatacttgcctctactctttcatgttatctttgtttcaatggatagctcagaagacattgtactagagcattgccagcatttacttgttaatctgctatattccctagcaggccgccacttggagcagtatgaggtggaaaataatgatagggagaacaagcagcaggttgtgagcttaattaaatatgtacaatcaaagcgaggaagcatgatgtgggagaatgaagatccaacagttgtcagaactgagcttccaagtgcagcacttctttctgccttagttcagagcatggtggatgccatcttcttccaaggagatcttcgggagacttggggagaagaagcacttagatgggctatggagtgtacatcaagacaccttgcctgtcgttcacatcagatctatagagcacttcgacctagtgtaacaagtgatgcttgtgtatcccttctacggtgcctccatagatgtctgggaaatcctgtacctcaagttttgggatttgttatggaaattttgatgacattgcaagttatggtggagaatatggagccagagaaggtgatactctatcctcagctattttgggggtgtgttgctatgatgcacacggattttgtccatgtctaccgccaggttctagagcttttctctcatgtgattgatcgtttatctttccgtgatcgtacaacagaaaatgtactcctttcaagtatgcccagagatgaacttactactagtgatttaggagaatttcagcgcacagaatctaaaagtagctatgaacctctacaagaggggagtttgccaacatatgaaggggtgcagcctcttgttcttaaaggacttatgtcaagtgtcagtcacagtgtctctattgatgtcctctctcgtataacagttcattcatgtgattctatatttggtgatgctgagactagactcctgatgcacatcataggattactcccctggctctgtcttcaacttagcaaagacatagtgataggtccagcttcaccactccaacatcaatatcaaaaggcttgttctgttgctgccaatattgcaatttggtgtcgagcaaaatcttttgatgaattagctactgtatttatgatttactctcgtggtgagattaagagtgttgataattttctggcttgtgtttcaccacttctatgcaatgaatggtttccaaaacattcaactttggcctttggacacttattaaggcttctggaaaaaggaccggtggagtatcaacgtgtgattctacttatgctcaaagctctcctccagcacacaccaatggatgctacccagagtccacatatttatgcaattgtatcccaattggtagaaagcactttgtgttgggaggcactaagtgtcttagaagcccttctacaaagttgcagttcattgactggttctcatccatatgaacctggttcattggagaatggaattggtggaactgaagaaaagttgcttgctccacaaacctcattcaaggcccgcagtggccctctgcagtatggttttggatcaggactaggctcagtttctactcctggacacgttgggtcaactgagtctgggatgtcaccaagagaggttgctctgcagaatactcgcctgataattggtcgggtattggacagaagtgcgttaggtaagagaaaggaccagaaaaagctagtcccttttgtggccaatattggtaacccatga

SEQ ID NO: 2533 - DNA, 1533 bp, Glycine max
  Peptide Sequence Number=SeqID_119311
atgcaaatgatacccggagaccccttttcactatccacttccctcccagggcttcccaataatgaacaaaacactaacacaaaccctaaccctaatactccaccgcccaacaaaaagaagagaaatctacccggaacaccagatccagatgcggaggttattgctctttcgccaaagactctcatggcaacgaaccgtttcatctgtgaaatatgcaacaaagggtttcagagggaccagaaccttcagctccataggaggggtcacaaccttccatggaagctaagacagagatcaaacaaagatattcggaagaaggtatatatctgtccagaaaaaacctgtgtccaccacgatgcggcaagggctctcggtgatctcaccggaataaagaagcattatagcagaaaacacggtgagaagaagtggaagtgtgaaaagtgttcgaaaaaatacgcagttcaatctgattggaaagctcacaccaaaacctgcggcaccagagagtataagtgcgactgtggcaccctcttctcaaggaaggacagttttattacacacagggcattctgcgatgccttagctgaagagagttcgagactcacctcagttgcttcaacgagcctaaattttatgagtgaagatacaactatgatgaacacacaagctagtttgtcgtcaagtggattaatcaatggccagggaatgcaaagtgtttcacattttggtccacatgggcttcgtttaatgagcatgggcacagaccaacaaagaccaaacttgtcactatggttgaaccaaggaaatcaccacattaacaacccacttgatgtggcatcatcaagttcttctggtttgcctgaggtattgcacatggcacaacctaataataatgccttaattggttcttctacaatgttctccaattttggaataacgcctgcttcttccaattcatctaatccaaacttatctctaatggggaaaaagggagaaggtggagcttcagatttggcatcaatgtattctgagagtcaaaacaagaattcaaactcagctactccaatgtcagccactgcccttttgcagaaagcagcacaaatgggctccaccagaagcaccaatccttcaattttcagtggcagttttggagtaatgagctcatcctccacgcaaagtactagtctcaatagcaattcaaaccaaagctctgaccaacttaaccacgcctttcagaattttaatgcaacaagcagcagtgcaactctgttgggaagttctactaactttagctcgttgacgcattcatcaaacggttttgaccagtttctgatggaaaacaatgtggagccgacccagttgaagctccatcctggctcaaacataatggagcaacataacttgacaagagattttcttggcgtgagtggaaatggaggtggacatcatgcatttctaccccaagagctggcaaagtttgcttccttaggctcatcaatgggattgaatcagttcactgcaggccatcaatga

SEQ ID NO: 2534 - DNA, 1053 bp, Glycine max
  Peptide Sequence Number=SeqID_119312
atgaaaaccaggttgttcctcctgaggcatcctaccttcatgttcatggacaaagatgctaattcagaaatccaactccctcctggatttagattccacccttctgatgaggagctaattgttcactatctgagaaacaaagtgacatcatcaccccttcctgcttcattcatagcagaaatagatctttacaagtataatccatgggagctcccaagcaaagctttgtttggggaggatgagtggtatttctttactcctagagacaggaagtatcccaatggagtgaggcctaatagagcagctgcttctggttattggaaagctactgggactgacaaacccattttcacttcctgtgggatgaagagcattgctgtgaagaaggcactcgtgttctacaagggtcgtccaccaaagggatcgaaaaccgactggatcatgcatgagtatagattgcatgattccacgatctccaattcaaagcaaggagggaccatgagactggatgagtgggtgctgtgccgggttcgacaaaagactatcagcccaagaagcctttgggaagactcaaatgaacccatttatgaaccaacaagctactttcaacaaatgagcgagaaatcaaatcctgaaccagtcaaaaactctctgcatagtgaatatccaatgttgccttatattctggcttctaagagtgctctgcctaattctattgacatggcctcaagctcgagctttggctgtaatgatgatgtgaaagcatatgcttcattgcatgatggcaacttaaataatataataataggagcacagttcatagcacctgtagctgaggacttgtttaatcctctgaagagaagaaacattgaagagaacgagttggacttgtatgctcccctcaataaaaaactaaacgaagaagttgatgttgggaagcaaatacttgagaaagatgtcaacaaaggctacaatttcaataactttgaccagtggacttccatcatacaaccccaagagtttaatagcttggcctttacgaaatatgcatga

SEQ ID NO: 2535 - DNA, 144 bp, Glycine max
  Peptide Sequence Number=SeqID_119313
atggctaaagagaaagggttcccctatgagagatgcagcgagacgttaatgcgcttagcacgaaattttgcgctaagcgcgtctttaagcttctttgtgggcttttttcgcgctaagcttgagctcaccgctaagcgagagtga

SEQ ID NO: 2536 - DNA, 595 bp, Glycine max
  Peptide Sequence Number=SeqID_119314
gtttagttctgttactgagcggtttttcatggaactcaacacccgtcgaattgataccagcgccactagaagtgaaacactaagtatcattaatgggatgcggtacctgaagcttggggttaaaactgagggtggattaaatgcttctgcttcttttgttgcaaaagcacaccctataaaccgtcaggctcataaacggaaaagtgagcttcaccatgctctatgcaatatgctttcaaacatcctagcacctcttgcagatggtgggaaaagccagtggccaccttctggtgtagagccagcactaacattgtggtatgaagctgttggacgtataagagttcagctcatgcattggatggataaacagagcaagcacattgcggttgggtatccattggtaactcttcttttatgtcttggtgatcctcaaatatttcacaacaacttaagtcctcacatggatcaactctacaaacttcttagggaagggtgtcaggaggcatatgtaagtgtagatgatgtgagacatagtggcatagggattaggaagttagcaaatgagactcttggtgaatcaagagctggactttaa

SEQ ID NO: 2537 - DNA, 1280 bp, Glycine max
  Peptide Sequence Number=SeqID_119315
atggctttagattgtcttcatcgagttttaagattttacttgagtgtccatgccgcaaaccaggccccaaatcggatatgggataacctagacagtgtaacttctcaacttttagcagttctaaggaaaggattgcttactcaggatgttcaacatgataaactggttgaattctgtgtaactattgctgaacataaccttgattttaccatgaaccatatgatactagaattactcaagcaagacagtcctagtgaagcaaaggttattgggcttcgtgcattgcttgccatagtcatgtcgccttcaagtaagcattttggtttggatatatttaaaggtcctgatataggccactatattccaaaagtgaaagctgcaattgagtcaatattaaggtcttgtcataaaacgtatagtcaagcacttttgacatcatcacggaccacaatagatgctgtaaccaaggaaaagtctcaagggtatctattccggtctgtgctaaagtgcatcccgaatctaatagaagaagttgggcggactgataaaattactgaaataataccacaacatggcataagtattgaccctggtgttcgtgaagaagcagcgcaagtactaaaccgtattgtgaagtacctcccccaccgtcgttttgcagtaatgaagggaatggccaacttcatattaagacttcctgatgaatttcctctgctcatccaaaactcattagggcgcctgttggaactcatgcgcttctggagatcttgtctaatagatgataggatacaacttgaagcagatgcaaaatctctagggcatgaaactgtgagattcagaaagtcttccattcaacaatcaggtgaagcaattgagtttcgcgcatcagaaattgatgcagttggcctcatattccttagttctgttgatagtcaaattcggcatacagcattagaattattgcgttgtgttcgtgcattgaggaatgatattcgggacctgaagatacatgaacaaccaaatcatactttgaaatatgaagctgaaccaatatttattattgatgttctggaagaacatggggatgagattgttcagaactgctattgggactcagggcgaccatttgatttgaaacgagaacctgatgccattcctcctgaagtgacacttcaatctataatatttgagagccctgacaagaacaggtgggctcggtgtcttagtgagctagtcaaatatgctgctgaactttctccaagctctgttcaggaagctaa

SEQ ID NO: 2538 - DNA, 360 bp, Glycine max
  Peptide Sequence Number=SeqID_119316
atgcatgaaggtactgaggtgggattttcaattttggggaaagtagggcgcggtcatttctatgggcagcgggttattaaccgggtcgcaaatccgacctgcggaaagccgaacagcactctaagaagaacggcgcagcaactcgatcatcgatcttccccggtgatcttcaacgatccggcgaaaacacgattctcaccactcgcaaactcggacagggcacagaagatcgtgaaatcgtacgatcttacgagtcagatcgcggttttgagtaccatggtcttacctcctttccatatcctcctatctctaaaatctctttctggatttgttgtgtttttcttctgtatttctgcatag

SEQ ID NO: 2539 - DNA, 381 bp, Glycine max
  Peptide Sequence Number=SeqID_119317
atgaaggcagggagtgctgccaagttgatcgtcgacgctctgcttcagcgcttcctccctctcgcacggcgtcgtatcgaaaccgcgcaagctcaggatgggcaatacctgcgaccatctgatccggcctacgagcaagtcctagattcgcttgcaatggtggcgcgccacactcctgttccgctgctggaagccttattaagatggagagagagtgaatctccgaagggtgcaaatgatgcatcaacgttccaaaggaagcttgcggtggagtgcattttttgctcagcgtgtatccgctttgtagagtgttgtccgcaagaggggcttactggtaatgctgtggtagatggtagtaggaccactgtagcgtgctcatag

SEQ ID NO: 2540 - DNA, 591 bp, Glycine max
  Peptide Sequence Number=SeqID_119318
atggcagaagcccattctatttcctctcccatggtttctagttgcaagttatccaagcatggtgctgatatttttcaagatccaactctatacagatcagtggtgggtgcactacagtatgctactttaactaaacctaaaatcagcttcaacaaagtctgtcagtttatggctaagcctcttgaatctcattgggcagtagttaaaaggattttaaggtatctcaaagaggcagtcatctttcttggtccaaatctgatatcttggtggtctggcaaacagaaggtcactgcccggtccagcactgaagctgagtaccgtagtttggctcaaaactcggctgagttgacatggattcatgccttactaacagagttgcaagtcccttttaccactcctgttctttactgtgataatcagagtgttgtgtcaattgctcataatcctgtgttccacagtcgcaccaaacatatgaagattgatgtctttttcgttagggaaaaggttctggctaagaaactcttcatcttacatattccagctctggatcagtgggcagacatgctgaccaagcctctttcttcagcttga

SEQ ID NO: 2541 - DNA, 639 bp, Glycine max
  Peptide Sequence Number=SeqID_119319
atgaagatggtaactgctttcaacggcaacatgaaggttatatggatatgcatagggtttgtgaaaagggacccgcctcccccaatgaaagctgctgctggacttagacgcattaatcttgatggtcttcgatggagggtttttgacgcaaagggccaggttcttgggaggttagcatctcaaatagctactgtagttcaaggaaaggataaaccaacttacacacctaatcgtgatgatggggatatgtgcattgttcttaatgcaaaagatatttgtgtgactgggagaaaacttacagacaaggtctactactggcatacagggcaacaaaggactctaaaggatcaaatggccaaagaccctactgaagtcattcgcaaagctgttctgcgtatgctgcctagaaacaaactacgtgatgacagggatcgaaaattaaggatctttcctggcagtgagcacccttttgttgatcgcccacttgaaccgtatgtgatgcctcctagaagcgtacgggaaatgaggccgcgagcaaggcgtgccatgattcgagcacagaagaaggcagagcagcaacaacagaaggctgatggaatgaagggcaaaaatggtgaagcacaggaagaaagtgcatga

SEQ ID NO: 2542 - DNA, 834 bp, Glycine max
  Peptide Sequence Number=SeqID_119320
atggcaaagctattcaatttcctccctctcctcttcctcaacatcttcattcaaacaatttcagcccaagtagcaccagcaccagcgggccccaccaacatcacccaagttcttgagaaagcaggccaattcacaaccttcatcaaacttctcaaggcctcacaaatagctgatagaatcaattcgcagctcaacaactcaaaccaaggcctaaccgtatttgcacccactgataatgcattctcaagcctcaaagcagggacactaaactccataaactcacaagaccaaatgcagttgatacagttccacattctccccactctctacaccatctcacagttccaaaccgcaagcaaccctttgcacacgcaagctgggaacagtgatgatggagagtaccctttaaatgtcaccacctcagggaaccaagtgaatgtaacaactggggtggttgatactacagtgtccaatactatctacagtgataaccagcttgcagtgtatcaggtagataaggtacttcttccaatgaagcttttcggcgcaacggcaccggctgcttcaccggcagaggctccggcaccgaccaagccggagaaaaatgtccgggctggggctgctgattctccttcagggtcgtcggacacgtccgctgatgcttcgagtgcagtatgcttgttctatccctcaatgctcatcatacccttgcaagacaaaatcaagctttgtatgtttaaattagagagacacaggagtaaagtggtcatgggtcctggttggtccaacgactcgaacattccgaaccaaagtgaaggaagaaactcaaattga

SEQ ID NO: 2543 - DNA, 1269 bp, Glycine max
  Peptide Sequence Number=SeqID_119321
atggagtttgatttttcaattgagtataagcaaggacattataatgtagctgctgatgccttgtcgcgagtggaactagtttcttgtcaagctctcgcggttcatcaggtggtttctgaattggtgataaagattaaagcctcttgggattcagatcctgcagttcatagggagttaatgaggaaaggaagactagttgagggtaaagatgatgctttaagacaggatattattctgcattttcatgcttctgccactactggtcactcagcgcgaaatgcaaccttacaaaggctcaaatatgtggtctattggaaagggatgagtaaagatgttagagcttttgttcaaaaatgcagtgtatgtcaaaaatgtaaatatgagaccaaggcttctcctggattgctgcaaccattgcctattccggatttgatttggcaacacattaccatggattttatagaaggcttgtctagttcctttgattctatcaccagtgacagagattcaatatttctcagtcagttttggcaggaccttatggcttttgagggtgttcaggtccagctctccacagcttatcaccctcagatggataaccaaacaaagattattagcaggtgtttcgaaacatatttgaggtctactccttatgaagtggtgtatggacaatcgcctcctgtgaatcttccttacttagcaggatcttctaagattgagttggtggatagaagccttttgaggagggaggagatgctgaaaatcattaaatttcacatgaagagggcccaggatagaatgaaacagctgacagataaacatagatatgagaggcagttcagtgtcggcgatatggtctatgttaaattgcacccttatcggcaaatttccgtagctgccagaagcaatgtgaagttgtcccccaagttttatggcccatttcagttgaagaagcatgtaggtgaagcagtaacttcttcgagtcttcacagttcagtagaagaagatcctctaatcaaagaacctgaagctattttggatcgcatgccaataaagagaaggggtcgagttgttactaaggtcctagtaaaccttgaggacaagactgaagctaaaggtggggaattgatacgtgatattcttgtaaggttgaagacttcacgtagggcaactgagtctactgaggtcacgagagtcttgttcgagtcacgtgactataatgtcacgccaacgacgacggtgtccaacaaagcaacattgtcgaagtaa

SEQ ID NO: 2544 - DNA, 1059 bp, Glycine max
  Peptide Sequence Number=SeqID_119322
atgggtcttttgaactcacttacaactcaagctattgataaagaagtccctcatactcttgccaagttattggataagttctttgatttatttcaagaacctagtgggttacctcctcgtagacctggtcatgaccatcgaattccactagttcaaggtgttggtcctataagtaagagaccatacaagtatgctaaacaacataaagatgtgattgataaactagtgcaggaatctttgtcgactggtataattcaaaatagtagtagtccttttgcaagcccagtagtcttggtgggtaataaagacagatcatggaggttgtgtgtggattatagggatcttaacaagcatacagttaagaacaagtttccaattcctttagtagatgatctattggatgaattggcaggttctagcattttctcaaaaatcgatttgaagtcagcatataatcaagtgagaatggatcctgctgatgtgtataagactgcttttaagactcatgctaggcattttgaatacttagtgatgccctttggtctcactaatgcacatgcaacatttcaagggcttatgaactcagtttttaaggagtttttgaggaagtttctgctagtgttctttgatgacattttggtttatagttgttcattggaagaccatttgctgtatttacacaaagttttggcaactatgagggcgaattccttgtttgctaagaggagtaagtgttattttggggtttctaaagtagagtaccttggccacttcatttctaaggaaggggtatcaactgatccagctaaagtgcttgtagtagaacagtggccactacctaaaaccttgaaacaacttagaagcttcctggggttagctggatattacaaaaggtttgttaagggatatggtggcattgctaaacccttaactaacatgcttaaaaaagataactttatctggttcgatgcagcaaaattggcttttcagcaattaaagaagaagcttactgagacccagttttggctttacccgactgttcaaaaatctttgtggtag

SEQ ID NO: 2545 - DNA, 399 bp, Glycine max
  Peptide Sequence Number=SeqID_119323
atggatcaatctgaaatgtttaataaatggcaagctcataggtggtgggcagagaattatgacaaggtcatggaattgtacagtgttcaaaggttcaatcagcaactagttcctcttccaaccctacctagatctgaagacgaggtgttagagtaccctacgagcggcaagtgtacaagtctttgtgaactcaagaaaaaaatcatgacatggtacacaaggggaagaattgaagccaagatggcttgctggcaaagtgaaatagctcaacctctactgaacataataaagctacctagacagatatggaaggtagacaaattggagaaaatggatgagggaaacttagttgatcccaggacttcccctgagcaagttgtggaaacaaaggcaatttag

SEQ ID NO: 2546 - DNA, 480 bp, Glycine max
  Peptide Sequence Number=SeqID_119324
atgataaccaataattgcagaacaatttctttcaaagtgaaagttcacgaaaatttgaaaaggaagaaaaatcatttacatggaacccaaaattttaacttggtagcgacaaaaaagtacacgagatctacatcgtcaatcagttcaaacttaacgcaggggaaaagaaaagaaaagaaaaaaaacaagaaaaaaatacatgtcaaaaattgccatttgaagacttacatccacaaacaagaaacaacgattgccacggtgaagataacaccttcaaatgtgtgccttttcaaactcaatgcactcgaagcatcagcagacatgccttttcaaacatgggtgatgttggtggggccctctggtgctggtgctacttgggctgaaattgtttggacgaggaggttgaggaagaggagtggaagtaacagcctgaactttttgcagaaccctaagtatgagtacatgaatcaaagaaattga

SEQ ID NO: 2547 - DNA, 291 bp, Glycine max
  Peptide Sequence Number=SeqID_119325
atgaagttcaaacctcaagttgttcatgcaaccgcttctaaacctccattggaaaatgggggagcttgccacccagctcgcccaggcgagctaggttgcttcctccagaagcaactgccttctggaggaacatcctggaaggcccaaattgtgcatttacatttccttttgacttccggcatgtcacggaaattcatgggttgtgcaacaatgctttcttttgactttcgacatgccacggaacttcacgaattgctcaacgatgggtgccaagtacctcaaagtggttaa

SEQ ID NO: 2548 - DNA, 231 bp, Glycine max
  Peptide Sequence Number=SeqID_119326
atggagggtagagctaacctagggttaaaacttggagggattgatgggaacccggtgttgagaggaacgaggataagggctacgtgggagtacgtgagctcagttgaaggtgggcaactggggatggtggatttatgtgtgatttgtggatgtggagagtcgacttgcaccatcgcccgatcgccacctagtaccacatatgacgggtaccccataatcctacaagcttga

SEQ ID NO: 2549 - DNA, 1437 bp, Glycine max
  Peptide Sequence Number=SeqID_119327
atggccactgaagcacatcactttcccaagattaatgaccaaggcacttctagttctagtagagcttataacccaattcaaaaggatgtagagccatccgaaataactgaggaactccctagtagacatacacatgggagaagtaaaagccttaccgagatacccacaagaacgctagatgaaacaagagaggaattttttagaacaagcaaacctccaactccatctcttagaagccaaataaatgagttccaagttccttcttcaaccaaaaatgaatcaactactaaaactcttattcccaagctcagttttaaatttcacaacacttgttcagatgttgaagaggcatccatcccagcacttgaaggttcacccccagaacgactgcaagatcctattatttcaagaacatcatcacctaatgggaagaaaatatcatccctacctgtcactccaattgctcagtcaaatcaggagtctgagcatggagggaacatttcctacccagcaacacatgttaaaaaaggacagcagttaccgatgcatcgttcccgttcagttcctgtgcttaccgaagatggcaacacatacgtaggtgccatgtttcgtattgttcctaccacaccacggttggcaaggagtattgccacaacatctacgaaatctccacctgacgacaccatcgaaaacgaggatggggaagatattcctgaagaagaagccgtctgcagaatttgtttgatagaattgggagaaggttctgatacccttaaaatggagtgcagctgcaaaggtgaacttgcactggcacaccaagaatgtgcagttaaatggtttagcattaaaggcaacagaacatgcgatgtgtgcaagcaggaagttcagaacctacccgtcactcttctacgagttctaaatggccagacactttacttgacaaggagtagaagccaacaatacaggcaaggagaaaccaataactttcacagggtttggcaaaatgtccccattcttgtgatcatcaacatgctggcatacttttgttttcttgagcagctacttgtttcaagtatgggatctggtgccgttgccatttctctccctttttcatgtatactaggtctacttgcaagcatgacatccacaattatgggttcaagtgaaattggactccaacaggcaatttctaagaaagttttagatttaaatcttgtggatagaaaatacgtaattgagagaaaaaatctcgctaaaagtgatcaagtaggttctttgatgaagataaaatcgcttaataaggaagccgttctatccatcctacttgctacatttactgggtttggagctgtgatgtgtggagcttatattcttattgagtttttgaagtggagaagacgatggcttggttcccaagaggtggtgctgcctcattaa

SEQ ID NO: 2550 - DNA, 210 bp, Glycine max
  Peptide Sequence Number=SeqID_119328
atggcagggaatcttttccacaataatgatagggggtttggaaggagaacaaaaggaggaggtgataggagacatgggtgtcttcaaaatcaatgtccattctataaaaaaatccttcactttaacattattagttctgtcgaaatagttaattgttttgggaagacaaaactagaagaaatatggaaacgtgaagatgaaagttcttag

SEQ ID NO: 2551 - DNA, 1689 bp, Glycine max
  Peptide Sequence Number=SeqID_119329
atgacgatgatgcgccttcacaatcacatcacagatcgcaacttcactggcttcgcatttgcggcatcgctgtgtcctttttatatcttcactagatctactacactcccaactccacacttcttcttcttcttcttcttcttcttcattgcacatggaaaaaatgggtgggggccggttcaaaccgacgcagaagaggaagagggttccaaagagggtgtggttaagcttccaaaaatcaatgggtgtcctcgtgggtggaaaccatacctcctccagttcaacatggacaccaaggcattcaaattccagatccttactagctccatcgccaggcgcgtgctccttcgcacaatcctactcgcgtgcgctgtctcgtttgtctctctgtaccgcgccctatccctcttcgatttcggaaccctcgctcccatcgccacctacttcgactgcgtctccggcttccagagcgtcaccttccgccccggttcccccttactccgaacccggttcggggtctccgccaattgcgagaaagacgccaatttgaccctcactgtggtcaccgagctaaccggtagccggttactccaccccggagctaaaagcctctgcgtcggagaaggctcctcaatggccgtcacggcaatgaaacagttaggttttttctccagcgtcagcgccgtccaaacgcaccgtttcgagcagaggaacgtcctgtacgaggataattccttcgatttcgtgttctcgagagacctagacaaggtttctgtcccggcattgctggttctcgaggttgagcgtgtccttaagccaggtggcgttggtgtcttccttgtaggcaccacaagttctcaccccaatgacatgataagagcagccacacctgtgtcctcgttattaaggtcttccaatgttgtgcatgttggttctgtcaacgaccataaccttgttgttttcaagaaacgagttgaaaacgctactttgttttaccaacatggtttacccgctgattgtcccagtgtcaccttcaccaaaccccttatagagttaatggagcctctcgtgagtgagaaacaacaacaaccaccgattgagtttcacaagaggaatattccctatttgcctaagtttgtggatgtttccactaggaagaggttggtgtatattgacattggggtaggggagcttcttgatgccaatgttagtgattgttggttcctaccatcgtaccccattgatcagaaggatttcaatgtttattttgttcactacaacacttcgattatgttgtcctatgtgaagcgacctggtattacctttgtttaccaccctggcttggctggtattgataaggtcaatgctaagcttggtagtgatgatgatgatgacatggatcctttacttggggaggaggagaagtttgatttccctgcgtggttcaaagaaactgtgcaatatgctgattttgtggtcctcaagatgaacgcaggaagtgttgagctcaagttcctctcggacatatttgagaatggagctatatgctttgttgatgagttgtttctcaagtgtcccgagaggaggggaggtgatgagaaaagtgtaaccagcaaggaaagttgcatggatatttacaaggctctccgaagcaatggtgtctatgtgcatcaatggtggggagactga

SEQ ID NO: 2552 - DNA, 573 bp, Glycine max
  Peptide Sequence Number=SeqID_119330
atgaaggaaaaccatcttgcaccggtgactgtgcatttcgagcaaggtcttggccagaagtttagacaagcagctggaactggtattgatttttcagtgtttgaggagtctgagttattgaaagtgggtgacatgaatgtctaccctctagcagtaaaggcagatgcatcagtgaaggcagatgctccccctggtaattatgacgagtcagatagatctccaacctctggtaacacaaactctcagattacgcaagtggtgtttgagaaggagaaaggagagttccgggtgaaagttgctaagcagatcttgtgggtgaatggaatgaggtatgagctgcaggagatatatggtattggaaattcaacggagagtgacttggatgagaatgaccaaggcaaagattgtgtcatttgctggtcagagcctcgagatacaattgtccatccctgccggcatatgtgtatgtgtagtggatgtgcaaaggttttgaggttccagacggatagatgcccaatttgcaggcaaccaattgagaggcttttggagataaaggttgggtctgaggagtga

SEQ ID NO: 2553 - DNA, 1893 bp, Glycine max
  Peptide Sequence Number=SeqID_119331
atgacagaggatatgaaaattgatcatattgtggaagttcctgataccccagatagaacaactgtaaggcacgattatcagaaatatttaggtaatcctgataagagggggagagcttttaatgctgctgatgaaaataataaccacagtaactatatatcattgtccccgtcagaggaatcttattcttctcaaaatgctcccatctttaggagagcccaaactgatggagctgaaaagatggagaaagggaaaagtataagctccaaggttccttctaaatcatctcaccgtggtatttctattttagatttgactgaagagaatgaacaaatccgacatccgaaaccagctttctcacatcgtggatcaagagataatgcaactgaagacaagaaagcactaaaagcaactaatggaaggtcttcgttacctgtcatttctgattcttctaatacatctagaaatgccttcattggaaagtataaactagatattaaaacacttccaggtcctaatatatctgtggaccatggcaagggtatttctctgtctaatgattctcaattacaaaatgaaaagcaagtatctttgcctcctcgtgtttccacctctccacgagggagagggcacaagagattggtacgaaatgggtgcatttcacctcataatattgcaacaatggaaaaacaattggctgaacagagcaaccacaaaaccaaagatgttgaacagagtcatggtcattcagtttctagcagtacagtgtcaccggttagtgttgatgacatagttgctggagagagaggcaatggtagagggaaaggaaaggaagtacttgcttatcgttcaccacataggctgacttttcgtactgctagcagccctgtgaccaattatgaagagatcaatggtcctagtaatgctataagaaatccacttcaatactctggggggcaaggtggtcggagaactacacataatgagaggaatgctaattggcacttgcatgatgtaaatgggcatcatttgaggataaataatgatgttggaagatttatcaatggacacaatacaaccggaatggacagaagaaacactgggaatggtcaaagcagcaatcaaatacatggttctcagtcagatcatacagctcaaccaacttctgtgatcattccagatgtggaccagtcatctggaacccatcgtactgctgacattttgactaaaaggcaaaggaaacgggaatcaccttcagggtttatgttccgtggttcaactggggattcatcaagctcatcccggaaccctgtctcggatcctgaagtgattgagttgttatccccaccaaggggttcatcaagctcatcccggacttctgtcttggatcatgaagtggttgatttgttatccacaccaaggtatgccaacagatcatctgaagatttagatgataatgacaataatagctcggaagctcgggcaaggcaagtggaagcagatgagagattggcacgtgaactccaagaacaactgtatcacgatgatccttttgaaggcagagggattgatgaagatttagcatgggacctgcagcgtgcagaggctcttatgcgtgcaactattgatagccacagcataagtcaaccgagacagcttccaagggcaatcagacagcctcgtacacggtttccagaaaatccttctagaaggagagctatggctcaagcttctttctctaatagaatgtcacagtggaggagtcgtgctacaagtcggactcgagcacctagcacatcatctagaggaagaggcccccggtttcctctggatatggacttagatatgtctctacagctactttattccatgattctgaatggtttgctttaa

SEQ ID NO: 2554 - DNA, 270 bp, Glycine max
  Peptide Sequence Number=SeqID_119332
atgtggatctcgcttcctagttatgctctagaagacttcatcaatgaacacaaagaggcagagtcaagatccaaagaagctcaggcatacaagaagtatcactgtgaaccaagtagtaaaatgggtgcttccgttttcgccactggtcattttattcatgttccagcgagagtggatatatatgttgtagaacttgttagaacaaagtttgcaattgatttttattgtggcaaaatgctgatgctgtttgcgttacgtgggatgtgttaa

SEQ ID NO: 2555 - DNA, 1674 bp, Glycine max
  Peptide Sequence Number=SeqID_119333
atggcagggcttaatgtctcagaatatggtcatagttgtgtgcacaaggctataatattgaaggatcatgttggccttaaggagatacttggagttctcccaaaactaggtaacccctttgagataaaaactgaggctgcttcaatagctgaggatgagaaagctgcagccatctcagttgtggtggataggagggatgtgccacatggtgacacccctcttcacttggctgcaaaacttggtgacattgttgcaactgaaatgctcatggatgctggggcaaatggtaggttgaagaacacggaaggatggaccgctcttagagaagctattattaacaaacaggataaaatagcaatgattatgatcaagtactattggaatgactatgacaaaaaatattatagaaggttgcctaggtatatagggactgtgagaaggatgaaggacttctacatggagattacattccattttgagagttctgtgatacctttcatctcgaggattgcgccttcggatacttacaagatttggaaaaagggtgggaatatgagggcagatatgactttggctggatttgatggtttgaagatcaagaggtctaatcagagcattcttttccttggcgatggtacttcagacgatgagcggaaattccccggatcgctgttcaaagtcttgcacaaagagaaggaggtaattgtggcttcacctcgtaaagttgcccccactgatagacaggttaagaacacattggctaggaagtctaggtctgaatcagtgagggtagggattgatgtgagtcaggcacttcttgttccccagttaacatggaggagaaaggagagaaaagaaatggtggggccatggaaagctaaggtctatgacatgcaaaatgtggttcttagtgtcaaatccagaaggatccctggagctccaccacccgaggccaagccagctcccaagcaagctaatatgaaggacaacgaaaaaattgaagacattttgacagatgaagaaaggaagcaattggaagctgcaatgaattcatcagatgataatggccacactcacaaaagtaaacatgcaaagaaagaaaagaaaggaaggtctggtggacatagagaccacaacaaggacaaaaacaccaccagtgcacaatctgctgagatttctgttaaccaaaagggtgaaagccagtttaagagagggatgatgccttctctttggctttcccaaaactttccactaaaaattgatgaattgctacctatgcttgacattcttgctgaaaaacttaaagcggttcgtcggttaagagaactccttacaacaaaacttccaaaggaatcctttccaatcaaggttgccatccctgtggtgtccactgttagagtattggtaacttttacaaagtttgaagaaatgcaacatgaaaatgcagatgagtttgaatcagccccatcaagtcctacttcaagtgaccaagagaacccagaagaggagcattcctcatcatggtttgggtggataaagaccccttctagatcaagtacaacaagtgcggaatctagtagtaaaatatttgatgaccaggacctgtttgctattccctctggttataaatgggttactattgaagataagttaaaaaagagaggactagaatag

SEQ ID NO: 2556 - DNA, 228 bp, Glycine max
  Peptide Sequence Number=SeqID_119334
atggcgtcttctggcactcctattatcttcaccgtgttgcaaatctcgatctatgtggctagatgggcgtacggatcttcactcggtgtagcagagctagagtattcctctagcgtcatcctctatagatggtcttctgccatgatgcattcttcaaggaaaggatgtggactggtcaaaggagagagagaggataattcggatgatgaaggtcctctctctccttga

SEQ ID NO: 2557 - DNA, 339 bp, Glycine max
  Peptide Sequence Number=SeqID_119335
atggaggaggttacactacatgcagttgttgaaggagattactcagagttactcatcttgagaagtgagctcaagaagacttttctttgtgagtatgtaggctcaatcacggaggatggcatcgaggtgttacttggactagggtcgcaagccatcaatgaagatgttgagctggactggctcgctaaacctgtttgtaggagtcttccagagcaacccatggaagcggatgagatttccaccttaccctcagcagtcttagactccgggaagtacttcttcggtgacttttccaccacctcgtcctatgtccgtaggctattccacttgaacaagtga

SEQ ID NO: 2558 - DNA, 570 bp, Glycine max
  Peptide Sequence Number=SeqID_119336
atgggcaacatctcaagcagcggcggcgtcggcggcggcaatccccgtcgccgacacagcggggcttcacggcggagtcaccctccgccacctcctccggtgacgccgcagcctgagatcgccgcgaatccattcgtgtaccatggtgctgcttcacagtacccgaaccctcccctgcattaccctcagtaccattaccccggttactatctttcggtgccacctcccatgcctcatcatcctcatcatcaccatcatcaacatcatcatccacacatggacccggcgtggattcaggggcgttacccttgtgggcccatgatgcctaaccctgcacctttcgttgagcatcagaaagccgttaccataaagaacgatgtcaatatcaggaaagagacccttaggctcgaacccgatgaacaaaattctggccacctcctcgtttcgttttccttcgatgccaccgtttctgggaggtttgggttattttcacgaggttatatgctcatcaagcttatcgataccgtcgacctcgagggggggcccggtaccagcttttgttccctttag

SEQ ID NO: 2559 - DNA, 2877 bp, Glycine max
  Peptide Sequence Number=SeqID_119337
atgtcaatgcccttgctcacaaacttgcaacacattgagacactcctcaatgcaccaaaccccaccgttagtgcatccattaaaagatggcactctgcattcatggccatctattgttcccgagctattatgtcacactccactctcaagaaaccaaacaaaaccaaagcaaaagcctcaccttcaccaacaccaacaccaacaccatctttcacagttgttgatttgaaccctcaccattcctttgatatagaccaaacagccctcaccgatattgtcaaagaaaaagagcttgagaaccttgatagatttggtggggttgaaggggtggctaaagcccttcaaacccacgttgagtatggtatcaaaggtggtgatgatgatgctgaagacatcacacgtagaagacaagtgtttggttccaacacttaccacaaaccaccttccaaaggcttctttcactttgtggtggaagcctttaaggatgtcactattctaatcctcatggtttgtgctgctctttcccttggctttggaatcaaggagcatggaattaaagaaggttggtacgatggtggaagcatctttgtcgcggtgttcattgttatttccttgtcagcagtgagcaacttcagacagaatagacagtttgacaagctgtctcaagtgagcaatgacatacaaattgatgtggttagaagtgggaggcgccaaaatgtttcaatcttcgaaatcgtagttggcgatgttatttgcttgaagattggagatcaagtgccagcagatgggttgttcatagaaggacattcacttaaagtcgatgaagcaagcatgacaggagagagtgatcatgttgagattagtagacaaaaccacccttttctgttctcaggtaacacaaaggatgagactgggatcaaagagttcaatggaagcaggaccaagtttgatgatatcatgaatgctgttgtggggattgttgctgatgcagttacaattgttgttgttgcaatccctgagggtcttcctctggctgtgactctaactctggcttattcaatgaagaaaatgatggctgaccaagcaatggtgagaaagctctctgcatgtgagacaatgggttctgctaccacaatttgtactgataagacaggaactctcacacttaacgagatgaaggtgactaaggtttggcttggcctagaaccggtgctagaaagtgcctacacaaaggttgctccatttgttcttcaattgatccaagaaggagtggctctaaacactactggaagtgtgcacaagtccaataaatcaggttctgaatttgagttttcaggtagtcccacagagaaagcaatcctatcttgggctgtcttggaattgaacatggagatggagaacttgacaagaagttgttccatcattcatgttgagaccttcaactcaaagaagaaaagaagtggagttttgttgagaaggaaggtagacaacacagttaatgcacattggaaaggagcagctgagatggtactaaagatgtgttcaagatactatgatgcttctggcattgtgaaagatcttgacaatgataggatgttgaagtttgagcacattattcaaggtatggcttctagtagtcttcgttgcattgcttttgcacatgtagaagtagctgaggaggagcttgtagatgaagaagggaatgcaatggcgaaagtgaaagaaaatggtttaacattgttggggcttgtgggtattaaggatccatgtcgtcaaggggtgaagaatgccgtggaagcatgccaaaatgctggtgtgaatatcaaaatgatcacaggtgacaatgttttcactgcaaaggccatagcaaccgaatgcggcatacttcggcctaatcaagacacagatggagcagtgattgaaggagaggaattccgcaactacacgcatgaagagaggttggagaaggtggaaaaaatctgtgtgatggcaagatcttctccttttgacaaacttctaatggttcaatgcctaaaacaaaaaggccatgtagttgctgtcactggggatggaacaaacgatgcaccggctctcaaagaagctgatattggactctctatgggaattcaaggtactgaagtggcgaaagagagctcagatattgttatattggatgacaattttgcatctgtggtcactgtcttaaggtggggaaggtgtgtttacaacaacatccagaagttcattcagtttcaattgacagtgaatgtggcagcacttgcaatcaactttgtggcagcagtgtcagctgggaaagtgccactaacagcagtgcaattattatgggtgaacttgatcatggacacattaggtgctttggctcttgcaacagaaaaacctacaatggaattgatgcacaaaccaccagtgggtagaacaaaacctctcatcaccaatgtcatgtggaggaacctattggctcaagctttgtaccaaatagcaattttgctgacccttcaatttaaaggtgagtctatctttggtgtgacatcaggagtaaatgacacattgattttcaacacatttgttctttgtcaagtgttcaatgaattcaatgcaaggaagatggagaagaggaatgtcttcaaaggcatacacaggagcaagttgtttttaggcattattggcataacaataatccttcaggtggtgatggttgagtttctcaagaaatttgctgacacagagaggctaaattggggacaatggggtatctgcattggtttagccgcagtttcctggccaattggttgggttgtgaagttaatacctgtcccagataaaccattcctcagttttttgagtaagaagaaatga

SEQ ID NO: 2560 - DNA, 720 bp, Glycine max
  Peptide Sequence Number=SeqID_119338
atggcaagctccgcttcctcgcgaggcattgcagctatcgtcggtgtgggccccaacctcggcctctccatcgctcgcaagttcgctcacgagggctacacggttgccatcctcgctcgtgacttggggaggttgtcaagatttgctgatgaaatagcgagggaagagaaggcgcaggtttttgctataagaatagactgttccgattcaagaagcgtgagagaggcatttgaaggagtgctctctctgggattcgtggaaattcttgtctacaatgcttaccagccactaccttggtgcccttcctccttccaagatcttcgcatcgaatcctttgaaagatcccttgccgtttcttccgtcggcgccttccactgcgctcaacagaacactgcacccaatgggggagatgagacaggctgtgggaaattcgctttgagagcactatcgcaatgtttggccaaggaatttcaacctcaaggagtgcacctagctcatgttatcattgacggtgttattggcccacccagaggaccaaccttgacgtcatcatcttcacagaggggaaattcattgggggagcaaagcagtggaggaggaggcgagggtacaatggacccagacgcactcgctcaaaccttctggcacttgcacgttcaggaccggaacgcttggaccctggagatggatcttcgttcaccctctgctagattcttctag

SEQ ID NO: 2561 - DNA, 348 bp, Glycine max
  Peptide Sequence Number=SeqID_119339
atgtgggatcggcacaggcttaaaggagcactcaaaccgggtgtatttacccccaaggcctacactctgaagagtccgtcagggcctctccctcctgattcagtaatagcggcatctctaatagattcctcaagttttttcttcgattgctctaatagggtccccaaacgtcagagagaaggaaaatggattgaagcctcaattttgtactgtcttcatgcaatctttttccctctctccatggatattattttgcaaatcccaacgatgaaggtgtgcggaattgaatcgcaaaccacatatcaaaatttcatgacaatgcaacggttaacgagtcagggatcatag

SEQ ID NO: 2562 - DNA, 2076 bp, Glycine max
  Peptide Sequence Number=SeqID_119340
atggcttcgtgcaatggtgaagactgttgcaaatggaaggggatttcatgcaataatttaactgctcgtgtgactagattggttatccaattttcatattctattccagtgccaggacctacaagttacgaaaattttgttgcattgggagagttgaaacttgcattgaatgaacttgttggtctcgttcctcatactctagcaaacctttccaatttgcaaactcttgacctcctggataattataatttgtttgcaaatgaccttgaatggctttctcacctttctaatttgagataccttgatctctcaaatgtcagtcttagtagagttgttgattggccatcatcaataagtaaaatcccttctcttatggagctttatttagatcactgtatgctacctcaagtcaatcctaaatctattacccacctgagttcttccacttctctccaaatcctcagtcttcaggaaaatgaattaaactcttcaattctgtcatgggtacttaatgttagcaaagtcctcaaatctctagatctcgcaagtaataaccttcccatacaatcctcgcagattctgtgtcaactaaaggatttagagttgttgggtctcgaccagaactcttttagtgggccatttcttgatttttctaggctttcttccttgaagagtttgacacttcagaacaacagtatttctgggccattatcatttggtcacttgccccatcttgagtttttggaccttagtttcaaccatttgaatggatcattgcttatatttgagctagggaaagacaatcttgctgctgatgccttgtcaagagtgatgcttatggcttggtcagaacctcattgtcaatttattcaagagctcaaggatgaattgcaacaaaatgagccattaatagcaataatggcaggctgcactagcaatacaaacgaggatccagatcatacaaaatttcatagttcggctattgggggacatacagggatctctagaacaaaagcaagaattgttgctcaattttattggcctaatatgcaagctaagatcagaaaaatcgtgcaagagtgttccatttgccaacaagccaaatcagtgactgctttacttgaaggtttactgcaaccattgtctattccttctcaagtttgggaggatatcgcaatggatttcgtaactggtttgcttttatcttttagatatactgtcatcatggtggtcgtggatagattatccaaatatggccattttattcctctaaaaacatattacactgccaagcaagttgctaaggctttctttgctaatgtggccaaacttcatggggtaccaaaatcaatagtgtcggatagagacaaggtgttcactagccaatttcggcaacaaccttttaagctacaagggactacattggccatgtcctcagctgaccaccctcaaacggatggccaatccgaagcccttaacaagtgtctagagatgtatctgagatgtttcaccttccaagaatccaacagttggtttaaagctctgccttgggcagaattctggtacaacacaaccttccataattcattgggtatgactccttttaaggcactctatggtagagaaccacctacattgaagcgatataatcccaatagcagtgattctactgatgatcaggcagataaaagaagatttaatgtgggagatttagtccttgtgaagctgcaaccatacaagcagaattcggtggcactaaggaaaaaccaaaagctgggaatgaagtattttgggccatttccaattttggctaaagtaggagccatagcatataaactcaaactacctaagaatgctagaatacatgttgtgttccacatttctcagctgaaactgtttaagggggatatgagtgatccttatttaccattaccaatgagtaatgcaaggaatggaaatgatgacaaggacaataagacaaaaggaagcaacaactcacacgaggacaccgggcaaaatagccagctggtcaaagatttaatggacaatgcagaaattcagggcttaaggaaatga

SEQ ID NO: 2563 - DNA, 309 bp, Glycine max
  Peptide Sequence Number=SeqID_119341
atggctaagggaatcagaaagctaagttcctggatggaggttgccccagcacctattatttacacaaagaaaccttctaatacacctactttggaaacaatcaccgaagaagaagaagaagctgccgagggattcgaaaatggaaatgggtatataaatatccatcaatcatccatgcatgaacattttgtcggtggtaccatcaagcatatatcttgggtccataatcgggggcttaattttacgtttgcaggaatggtgaagtgtagtaaagtaaatgttgcaagattttgtcccataaacatgtga

SEQ ID NO: 2564 - DNA, 210 bp, Glycine max
  Peptide Sequence Number=SeqID_119342
atggctcaccacgcagtcgaattgttgggctcgcccagcgagccagattggctaagcgagactcatccgcttagcgagaaagcctgctcgctaaacgagaacaaaatcctagagaatgttgagtcagagagcagtgcgcttagcgtgcagccagtccgcccaatgagaacgttgtctcttctcgcacttagtacatccaagctcgcttag

SEQ ID NO: 2565 - DNA, 144 bp, Glycine max
  Peptide Sequence Number=SeqID_119343
atggagagtcctaagtgggagaaagatgaatcgcacaaagcagtacaatatggaggcttcaatctcttctccgtctctctgacatttggaaactctatcggagcagtcggaggaaaaactggaaaaatctcagggaaccactag

SEQ ID NO: 2566 - DNA, 225 bp, Glycine max
  Peptide Sequence Number=SeqID_119344
atgggtattgatccaaaaactcacaagccaaggacagacttgaatgacctcatgagtctttctcagtttcttggcatgtcaaacttgagcagtgccattaacactgcttggggcaataaccttctagtggtagcgagactggccgtgagtggtagcgagaatgacaccggagctcgacacagaaagtataggacagagaggaagatgcataagtgcgagagctga

SEQ ID NO: 2567 - DNA, 722 bp, Glycine max
  Peptide Sequence Number=SeqID_119345
atgggggagaagaaaaaggaacaactgcaggaagcaactaaattcgaaagcagtgacatcgtgattgatgttccatctcccatcaaacgacatgtgaagtggaagatggtctgcaccaagaaaagtgaccaaatgacgtctgaggcatcaaatgaaattgctgagaagatcgatcaggccttagagggttcctttgtcgcccatggacgtcaggatgtattgattgttgccattgggcgactagaacaccctagtcatattcgtgttgttggagccgattctcaatttcaatcgcagatgcaatcacagggactcgcactatctcatgagcctgaggttggtccttcagttgctcgtgttagcacaaatgagtgttgtgttgatccctcagggaatgacccagacacaggtgactcaaagaaatgcggattgtacatcgaagaaaattctccctgcctggttgccctagggagactttatgaggggtcggccaccattcacaacatccctttgggcggtgatcaaatcaaggttggtgttgaggaagttcaagatgcagatgctcgcattcctgtacccactgaagagggagctatggaaccggcgaaacctgcacataggtcggattatgatgtcaatgatcccctatatctgatgacattgatcatcccacaaatttttctaaagtcgttgcaacttatgtgggaggctaccgtgtttgg

SEQ ID NO: 2568 - DNA, 144 bp, Glycine max
  Peptide Sequence Number=SeqID_119346
atgtcgatgcgtactttggaagaaagatttgttccctctccgacttgggtaatgaaagcatgggaaacaactcaagatgaaatgatgactgctggtggtttggatgctgtggctatggtgaaatggttatactataagttttaa

SEQ ID NO: 2569 - DNA, 237 bp, Glycine max
  Peptide Sequence Number=SeqID_119347
atgaattcattgcctagtgttgttcaagtatcctccaccatcgagtctggagccacgcgagttcattgcctagcgttgttggccaattctctattctccaatcttattcggagacccatgaattcattgcctagcgctgttcatgtggactccaccaacgagtctagagccccgcgaattcattgcctagcgctatttgccaattctccattctcaatcttatttggagacccatga

SEQ ID NO: 2570 - DNA, 852 bp, Glycine max
  Peptide Sequence Number=SeqID_119348
atgaaagtatctgccctggctatcgccaccgccctgttcagcaccaccgcttttgccgcgccgttgaccctgcaaacctacaacccgcaggagaacgcgatcttcgcggtgaactccacgctggcctccggcccgcacgaagcggtgctgtttgacgcccagttcagcgttaaagatggcgaaaagctggttgagatgatcaacaaaagcggtaagaagctcacgcacattgtgatcacctctggcgatccggatttctattttggcctcgagccgctggtgaaagccttcccgcaggccaaagtggtggcaaccgagcaagtggttaagcatattgaagagaccaaagcggcgaagctggcatactggggcccacagatgaaagacggcgcgccgaagcaggtctatgttccacaggtattagccgcagatagcttcaccattgacggcgagaaagtggaaattcgtcagccgcagaactacgccgcgttcgtctggatcccggcgaataaagcgattcttggcggcaccggcgtcgcctggggcatgcacgtctggaccgccgatacccaaagcgcggcgagccgtcagcagtggcgccagacccttagcgatatggccgcgctgcatccgcaacaggtgatcccgggccactatctcggcacgccgccggcgggcgacaaggctatcgtctttacccgcgactatctggagaaattcgagcaggcgctgaaagcgcataaagattccgccagcgtcatcaaagccatgaaggcgcaatatccgggtctcgctgaagaaagctcgctggagctgagcgcgaaagtgaacaccggcgaaatgaagtggtaa

SEQ ID NO: 2571 - DNA, 249 bp, Glycine max
  Peptide Sequence Number=SeqID_119349
atgctgagtttcataaaacgtgcagatggatacggatatggatcgagttatcgccgcccaggtatatatgcgcatatgcgagctgggcagtttgagcgcggcggccagggcgcttggtatgtcgcgaccgatggtgagtcgctatctggagcagatggaacactgggccggtacccggctcattcatcgttcgacgcgcaaactgaccttaaccagcgcaggcgaaaaggtattgcagaaaacgcttag

SEQ ID NO: 2572 - DNA, 2673 bp, Glycine max
  Peptide Sequence Number=SeqID_119350
atggcggaagcaactcgctctagggcttcagcagaccgtattgaggatgcaatcgcgaaactctcagcttcacaactagcaatgaatacaaagatcgacgacctcctccaacgaatgacccaactagaggctggccagcaaccaccacaatcatcggcgtcgtcttcagcaggacaaacaccgcaaatgcataacgtagtccatcgcatgaagttggacgttccaaggtttgatggttcagatccaaccggatggacattcaagataacgcaattttttgaataccacgcaacgccggatcaagagcgcctaaccatagcatcattttatatggaagggccagcattggcctggttccagtggatgcatcgtaatgcacagctttcatcttggccggcgttccttcacgcgttacactctaggtttgcatcatcaacatacgaagacccaaccggattactatgcaagctccaacaatgttcctcagttagtgagtacctctcagagttcgaatcactcgcgaatcgggtggttggtctaccagcaacattcgttctaagttgctttatctcggggttgaatccctccatttgcagagaagtgcaggttcgtgaaccagtgtcactggctcaagcagtggcgtacgcgcgtctgcaggaggagaaactcctggactcgcggcggcaacagacgcctcgatctctcgtgatcaccccaagttcgagagcagccacaggaaccacgaattcttcatacacaaatagcttatcacgaggctcgaatccttcgattccatttaaaagattgactccagaagaactcgcggtccgccaggaaaaaggattatgcttccattgcgaggagaagtactcgtggggtcataaatgcgcaccttcactcttcttactagtagcagaagatgatcaattaacacctgaagttgtttcacggtcaccctcaccaacagatgagttactcagggaaccaccgccagcccaactgagtttccatgcactatcagggcattccgcacccaagaccttgcgcttgaaaggaaccatcaatggattacatgttagtatactcatagatggaggaagtactcataatttcctccatcacagagccgtggcaacactgggcctcaccactaaggaggtagcaccattgaaggtaacagtgggaaacggagaagaaattagatatgtggtcctaggggttgaatggctcaaaacgctgggaccagtgttaacggactacacgtccttatccatgaagttcatcactgaagggaagcttgtggaattacaaggggaacgcgagcaagtaggaagaaggatgggacatgacgcttttgtgtcgactatcgggctctcaacgccatcacgatacgcgaccatttccccattccaacagtggatgaattgctcgatgaacttggaggacactgagtttcgagtgatgccttttggattgtgcaatgcaccatcctcattccaagccacaatgaatcagttgttccaaccttgtttacgcaaacacataatcgtcttcttcgacgacatattagtgtacagcaagaccattgttgatcatcttctccacctggaaaatgcctttcgtaccctagtggcaggtcagttctcgcttaaactctctaaatgtacgtttgctcagcaacaattggagtacttggggcatattgtgacggcggtaggagttataccggtgccagagaaggtacaggctattcaaacatggtctaatccacgctctcctcgggccttacgtggtttcttaggtctcgcagggttttaccgtcgatttatcatgggatacacgattctggcatcaccattaactaaccttttgagtcaaggccagtttcagtggtcgccggaagccactgaagcattccaaaagctgaaagatgccattaccggagctccagtgctagcgctaccagacttcaaagtacccttcgttgtggagaaggatgcatcgaacatgggtatgggcgcggttctatctcagggggccataatcgccgccgtcaagaaatggcggcagtatctactgggccacaaattcaccatcctaatggatcatagaagcttgagggaactcatgagtcaagccattcagactcctgaacaacatcgttatctcgtgaggttgctaggatttgattacacgatacaatatcatttacgtaaagaactcgcacatacacctgctttcaaagaattatatgaacagattcaagcagatcctacgaagtatccagatcattcagtgacttcaggcttaattctacacaaggggcgcatctggcttcctccaacatcgtcattcattaaactactcctcgaagagttccatcaaacaccagtaggaggtcacatgggggtgcaaaagacgttgcaacgtcttcaagagaactttacgtgggattcgatgagaacagacatacgcaacttcgttgcaaactgcatcacatgccagcacacaaaatatgataatcgtaagccaggagggttgttatgcctcattccgataccagcgctgccatgggaagacttatcaatggattttattgtagggttgcccgcgtacaaaggaaacacatgtatccttgttgatgcaatcctaccccccaagggcattggatag

SEQ ID NO: 2573 - DNA, 2220 bp, Glycine max
  Peptide Sequence Number=SeqID_119351
atggagcttacatcacttgtcattgtagatcgtttttcgaaagggctgcatctgggtatgcttccccctcaccatactgcgtatacagttgcaatgttgttcatggagattgccggaaagcttcatggaatgcctcgaagcataatttcagaccgtgatcccctctttacggatgggcaaatggaagttgccaaccgtattattgaacaatacctgggagcctatgtacatcagaaaccggcgacgtggggtcgttatttgatgtgggcggactggtcctacaacacatcatgccattcaacgacagggatgaccccattcgaagtaatgtatggccggaaaccaccaagttttccccagtatatcacgggcacatcacgaatagatgcagtcgatgagctactcactcaacgagaagaagtctttgccttcttacgaaaaaagctgagcaaagctcaaaatcgcatgaaggaaacagcagataaaagtcgtagggatcagaagttcaatgtgggtgactgggtcttggtcaagctcagaccccatagacaaacgtcggcggcaggagctccatattcgaagctggctaaacgatactatggtccatttcatatcatagctcgattgggcaaagtcgcgtacaaactacagctgcctgatcattcgaagatacatccagtgtttcacgtttccttgcttaaagcttacatagcggcggcagatgccaaccgtagtgcagaactaccatcagaagattgggtagggctcacaccagaggacacttcatgggaagactggtatgagtttcaagcactttatgacctcgaggacgaggtctggtttgaagggcatgggagtgatacgcagcagacgcaaggggtgccattagcaggacaagtggaagacagtagtggagggatggaaactgagttagttaggctaggaaggttcgaaggttctggaacccagttacaggtagctaggccgttaggaggatcacaagagaagccaatgatagacgttgtggatgtgctgacgtcttgttcaaatactggtgatacatcatcatttgaatactcatccttttctgatttctcatctttggatgatgtggacctaagccagtctcaacgtgaagaagggattggcaagtatgcggaggtagctactagtgagagggttattgttgaggtgtcatgtagtgacaatgttgatccctttcctcataaaaagtcccgactatgggttcaaaaggagaagttacctcctataatgctttccgaatacacttgggtggatggtgaaatgggatcttattattcttgttattctgataagctcagtgttcttcattttattaactgtgtcatcgtgtgttcatttgcgaatgaggactttagtccttttcacctctattattgtcgtaacaatgcctgcgcgaagccggattgggttttccttaggaaggatatgctgagtaccgataacccctttaagacacctcctatgcggctacgagccctatcgtcattgctccagctgttcggactccaccttctcgtccaactccataggacattgtgccgcctggggataagagcaaaaagaaaaaaggccaagagggtgaccgaggaggaagctcggccccaaaaattgaaacaaccaactcttcattggttcaacactcatccacccagctctcttgaagcccttcctttggtgttagggaagaacttttttaactctacctatcaccctcgtaacttgatgttgagtagtgccattttcaactacgacaaagacattttgcaagtgttaaagttgaaaactggtcttgatgcgatcgagagggataagaagcatgctcttgatgctaacaatcagctaactaacgacataaagaaattccttgtccaaggtggcggagtggaaaagaagagggatgttgatttccagaccttcatgtgtagtgcacacgagaagatcttggaggagcaccatattcctaccgatgctgattttgacattttgatggatgtctatgaagggaatctagtttcaatccaagatattcctaagaagactcctcaaaactccagaacgtcgtccgtggatgctttttgtcctgttacttctcctgctgacaccgtcatgactaatgttgatactgatgaggatgataataggaataaagaggcgaatgaagtgagtgataactag

SEQ ID NO: 2574 - DNA, 141 bp, Glycine max
  Peptide Sequence Number=SeqID_119352
atgaggtctacttcattccaatggcttaaggttaaaaagaggctaagtcatgaagtgctaaaagtgacagttgagctcagctcaacagttggactaaacgtgcatccaccgctaagcgcagcttcagcacgcttagcgtga

SEQ ID NO: 2575 - DNA, 372 bp, Glycine max
  Peptide Sequence Number=SeqID_119353
atgacgcaagaagcagtgtggaagtggcatgtagaaagtgctctagtgtggcaaatttactgcggtatcgccattagcatcagcgatacacttgtatcgccattggtagcagcggaacaaaagctgagtcactgcgcccatgccgctattcaaactgtcccgccattggcgcctgcggaacacgtaggggtgggggttgcagtgtgcagatgggtaagcttagggtttgcagttctgaaaagcttgcatgtgaacgttaaaaatttgaacgttggtgtgagcttgtgctttgttgtgtgcttcttgctttgtgctccttggttcaaatttggtgcgtggcttccttccttcaagtgctcttacccttacttg

SEQ ID NO: 2576 - DNA, 1890 bp, Glycine max
  Peptide Sequence Number=SeqID_119354
atgccagatattacattcacaagtgcaaacttcaaagggttagaccttgagcagaataaccctatggtgatcaccatccaagtagcaggttttcttgtgaagaaaaccctaagagatcataggagttcgaaaaatattttattccagaataccttcacgcagttggatattctggaatcgacactttatccccgtatgaccccctcttcggattttcccggggaagagtcctcaccagggctaggacaacctttggaattagatccgaggatcgaagaggatcaaagagtgaagcctaatgaagaaaccaaacccaaccccttaggacatagggaagatcagatcacatacatgggaactcaactagaagaaaatgagcagcaactcataatccaagtgttgaatctaagacaacctttggaattagatccgaggatcgaagaggatcaaagagtgaagcctaatgaagaaaccaaacccaaccccttaggacatagggaagatcagatcacatacatgggaactcaactagaagaaaatgagcagcaactcataatccaagtgttgaataggctaagccaatcacccagaaaaaagaaaggttggagaagaaagacaaataacaattcaggacaagggcattggatgctcagcttcttagatgcttactctgggtacaatccgatttgcatacatccatgggatgaagaaaaaacaaccttcataactaagtcagccaactattgttaccaggttatgcctttcgacctcaagaatgcaaaggcgacataccaacatcttatggatacaaattttaaagaccagattggaagaaacacagaggtatacgttgataacatggtcgttaagtttgatggtgcaaaaccttatgctcaagatctgcaagagatctttctacaaattcaaaaatataatatgaggctaaatccaaagaagtgtgtatttggggaccctcaaggagatacaaaaactcacgggccagataactctttaactagattcttaccttggatagctgaaaaggctaagctgataatgaatttgttgaagaaaaccaaaacgtttagatgggatcaagaatgcgatgaggtttttcaaaacttgaaactaacaccggtgacacccccaacgttggccaaactagacacacataagaagttgatcatatacttatcggtctctgaagaggttgcctccggacagataaacgaagggtatcaagttaaagaaccccaacttttgaaatattggcatgccttcatgagtttgaaagatgattttgaagaaattcaagttgagcacatcgatagagaccacaatgatggagtcgacaacgatataataaaatacttgaccaagggactagctcctaaggattcactagaagctaaggtcctaaggatgaaagcagctcggtatactgtcatagcaagtgacttatacaagaggggatttgtagtactcctcctcaagtgcctgagtcaagatcaagctaactacaccataagggagttacatgaagacgcaccatcgagtctcatatcgggccctcgtcggaaggcaggtttcgacaagattgtgtcgagattgtcaaaaaatgcatacaatgccaacatgaccgtttccaatagcaaacatccactagtcgtagttgattatttcatggagtggataaagtcctactcggctaaggatgtaccttcacaaaggtttccttctcaagtacttctactcggcaaaggatgtaccttcaaaaaggtttccctcccaagtacttctactcagctaaagaagtaccttcaaaaaggtttccttcctgagtactcttactcgactaaagatttaccttcaaacaagctttcctcctga

SEQ ID NO: 2577 - DNA, 735 bp, Glycine max
  Peptide Sequence Number=SeqID_119355
atggtttataccaagaaagtggtagtgaagaaccatacttctttctttgcaaccgagagtgaaagcttgtattctccttcaccaatgattcaaaaggacaaaggaaaaggcataattgatgtcattgaggttatttcctgttctgactcaaagaatactattttaaggactcctccacatgctaaaggtgtggcaatagggtcactaaagaagaaagtgatctcccaaaaggagaagcaagggcaacaaagaaggaggtcagattttgaagaaccccatttgcttaaagacaaagctaccaagagaaattcaaggccaactgggaaaacaaaaaaagttgtttttgggaggtttagagacttgaaagtgattaagaagtatggttgggatatcctttgctttgttaagaagcaaaaatcgacagagttcgttgattttccgagtcttaggagaaactatgtgatcaagaagttaaaagagttgaaggacaatgagctaaagtccaagtctctcaactcatttggaggattggttcactggatttgcatgcattatgtgcttccaaagataggaacatttcaagaggaagaatcctccaagagtaaggaagtattattaaaggaaaaagaatttgaggatttccatgattttgatactttatttggtaaggaagttctttctatagagaagaaggatgagggtcatcatgaagtgaaaaaaatatcgcaagaatga

SEQ ID NO: 2578 - DNA, 108 bp, Glycine max
  Peptide Sequence Number=SeqID_119356
atgggtagagttgacttgatgctgaattgtaaagtcttatcagatgtttcacacacggctacagatttcacagatcgcgagaaactaatgatcgaggttgctctctga

SEQ ID NO: 2579 - DNA, 165 bp, Glycine max
  Peptide Sequence Number=SeqID_119357
atgatgggtaaggcaattatcgcgccagctgagaacaacactatttacgaactcatgtggaagttgggacaagtttttaccccttataaagttgcgtataacaatagttatcacacgagcataggcatgacaccctatgaagcccttttatgggaggaagtgtag

SEQ ID NO: 2580 - DNA, 195 bp, Glycine max
  Peptide Sequence Number=SeqID_119358
atgatgagcccaatgaggactggttgtgtatcaaacccaaagcttcgatacatatcaactgaatttcacactagtgtatatcctccaaattgtagaagtagttacatcatcaaatgcaatggtaataagttctcagtgatgtcatgcttgatgccttcacaaagtgaaccacaaatattccattatcatgaataa

SEQ ID NO: 2581 - DNA, 129 bp, Glycine max
  Peptide Sequence Number=SeqID_119359
atggttgaagcagagaagataagtgaaggaaaacacagttggagatcgtggaggaggctacaaaaacagtttcagaattcagactcagtcgctgtcttgtttgtggaacaggataagagagagggataa

SEQ ID NO: 2582 - DNA, 552 bp, Glycine max
  Peptide Sequence Number=SeqID_119360
atgcaggaatttgcagtgagaacaggttactgtatgatggagtcaaaggagaaattgaaagaggtggagaagtgtttggattctcggctatggcatgcgtgtgcgggagggatggttcaaatgccagtggtgaatgctaaggtgttctactttcctcagggtcatgctgaacatgcatgtggacccgtggacttcagggtttatcccaaaattccacctttcattcaatgcaaagttggagctatcaaatacatggctgatcctgaaactgatgaggtttatgtaaagcttaggcttgttcctttgaccagaaacgagggtgattttgaggatgatgctgttggaggcatcaatggatctgaaaataaagataaatccccttcttttgccaaaaccttgacacagtctgatgccaacaatggtgggggcttttctgttcccagatattgtgctgagacaatttttcctcggttggactattccgcggaccctcccgttcagaacatccttgccaaggatgttcatggggcacgccgcgccggcacttgttaa

SEQ ID NO: 2583 - DNA, 204 bp, Glycine max
  Peptide Sequence Number=SeqID_119361
atgcaaaaccaccaaggagagatgttttcgtacttgaagaagggggaaattgtgcattgtgcagagagagactcactcgctccagaacaattagaaaggagttgtcatgctcggaagagtgacaagcctgatatatggaggggtatcgatgttttacatgggtataacacatatttttatttttggagtatcggagcttcataa

SEQ ID NO: 2584 - DNA, 858 bp, Glycine max
  Peptide Sequence Number=SeqID_119362
atgagtaccgcatgtcgtggtagaaaaaacaggaggaaagttgagaagagagtggcaaatgaaggaaagagaagaagcagagaagttcgagtgggaagtgatgatgatggatgcatttgggaaccctttttgaaattgaaaatcgccggagctgtttatgaattttggcctcaaattggattgattttcagtcatgttgaggagattaatggaattgttaatagtggtgttgtgaaaagattttgtgatggtatacgggttgacttgatcgaaaacctcggtcttctacttcatagccttattgttgctagtaagatatcaaagagtaaaatggaagcagagacattgagtcctaaccatcctcctagctttctttgtcagtcgcttcctgctgttgtacctatgcttctgatttcaacagtatatgttgaccctggaaagtgggtagcaactgttgaagatggtgcacggtttgggtttgatctgatggctgtcatgcttattttcaattttgctgctatcttctgtcagtacatatctgcaaggattggtgcaattactggaaaaagtctagctcaggacattgagaaggcaaaaatcctaggacagtttgttgcaggttttgtatttctttcgtttatacttggactgcttatcaatcaaccagaagttccattttccatgaatggaataccaggggagggtgcatttgtgctaatgagtcttccaggagcaaatcttgtacctcacaacttttaccttcattcctctattgtacaggagaaacttgcctcttgcaatatggtagtagcttgcatgggcagttgccttgctgctggactgctggaggtttactaa

SEQ ID NO: 2585 - DNA, 1758 bp, Glycine max
  Peptide Sequence Number=SeqID_119363
atggacccgttagcaccctttctctttaatattgttgctgaggcgttgaatggattgatgagagaggctgagaaacaaaacttattcaagggattccgagtgggctcaaataatgtggatattaacatcctccaatatgcggatgacaccattttttttggagagggttcgatggagaatgttaaggctatcaaggcaattctgcggacttttgagatggtttctggccttaaaattatctttgcaaaaagttgttttggtgcatttggaatgtcagataggtggaagagggaagcagccagttgtttgaattgtagcttgttgtccatcccgtttgtttatccaggcatatctataggggaaaaccttagacggtttcacatgtggaatcctattcttgaaaagtgtgagagagctctaaataaatggacacaaagacacctttcatttggggggagagtgactcttattcagtccgtcttaacttcgttgcctatttactttttatctttttccaagattcctaagaaagtggtggagaagctagtgtctatacaaagaagattcctatggggaggcggcacagatcaaaacaagattgcttgggtcaaatgggagacagtatgtctcccaaaagagaaagggagtctgggaatcaaggacatcgataccttcaacatcgccctgctaggcaaatggaggtggaatctatttcagcatgaaggacaattgtgggctagggttctggagtctaaatatggaggttggaggggattggatgaagcacatcgagacaatcatgagtccatttggtggagggatctaaagatggtcgttcaaaactcacaacaggggatggagctgagtaatagcatagagtggaggcttggctgtggagatagaatcaaattttgggaagataagtgggtagatggagaggaatcattggcagcaaaatatcccagactgtacctaatatcgtgccaacaaaaccaaattatccagcagatgggaggatatagggaagaagagtgggagtggaactttttgtggaggaggccattgtttgacaatgagataccaatggctgtaaatttcttacaacatgtagaaagtaaggctatccagatacaaagaagagatgactgggtgtggacaccagattcaagtgggcaatatacggcgaaaagtgcttacaggatgatgatggggggagcaacagatgggacacaggatagggattttgaggagctgtggaagatgaaggttccaaccaaatttgcagtgtttgctaggaggctacttagagacaggttgccaactaaaacaaatcttcacaggagacaagtagagatcgatgataggatctgcccattttgcagaagcgcggaggaggaagcgggacacttgttctttcattgcactaaaatcatccctatgtggtgggaatccttgtcttgggtgaacaatgtgggagtttttccgcaagatccaagacaacatttcctccaacatggatctatagtggctgatggactaaggactaatagatggaaatgctggtggttggctgtcacttggactatttggaagaaaaggaatgacataatcttctccaatgactccttcgacatcaacaaaatgatggaagaggcagctttcctcatgtggacatggcttaggaatctggagaaggactttgtaattcattttaatcaatggtctactaacctaagagaagggtttgtgtatcactag

SEQ ID NO: 2586 - DNA, 831 bp, Glycine max
  Peptide Sequence Number=SeqID_119364
atggagacacgaagtgagataaggcattcaaagttcaagaggatttgtgtgttctgtggcagtagccctggcaagaagagtagctaccaagatgctgccattcaacttggcaatgaattggtctcaaggaacatcgatctggtgtatggagggggaagcattggtctaatgggtttagtttcacaagctgttcatgatggcggtcgccatgtcattggagttattcccaagacgctcatgcctcgagagctgactggtgaaacagtgggagaagtaaaagctgttgctgatatgcaccaaaggaaggcagagatggccaagcattcagacgcctttattgccttaccaggtggatatgggactctagaggagcttcttgaagtcataacctgggcacaacttgggattcatgacaagccagtgggattagtaaatgttgatggatactttaattccttgctgtcatttattgacaaagctgtggaagagggatttatcagtccaaatgctcgccacataattgtatcagcaccaacagcaaaagagttggtgaagaaattggaggattacgttccgtgtcatgagggtgttgcttccaagttgagttggcagatagaacagcagcttgcataccctcaagattatgacatgtcaaggtataggagagtgacagaactagagacaacaaacaagagagacacagtactcggtgaccggggccaattcttgggtggaagtgcaatggagagaaaagggttgcattcctcagtttgtacatggcattgcaaagaggtattaaagtcaaacagctcacatcaaggtcacatataa

SEQ ID NO: 2587 - DNA, 273 bp, Glycine max
  Peptide Sequence Number=SeqID_119365
atgattaccagtgacactcccgggactgagatcgcggctgaaactgcagcagcaatgagatcgcagttgcaattgtggaaaatcagagaacttctcgatgcaaatagagttattaacttaaaagtttacaataacaaaatgaaactaaaccttagcccatggagaagagttaatctgctggaagtatgtgatggaaggaagagaaagaggcattatagtacctggagtgagcgagggagaatgagtgagcggcgagcgagggagactgagtga

SEQ ID NO: 2588 - DNA, 345 bp, Glycine max
  Peptide Sequence Number=SeqID_119366
atgccaaacatccttcaacacctaaccacaaggcgggctcttcccctgactagtagcaaggtcatccaatcagatggtgccacgtggtggatgaatatgcgcagtaccaaccagttaatgccttcccgcgttgtgctctatatacagatgacatctgcacgaatgataagacatgtgtcagttactgattcgtggtcataccttacatgtcgatcggacaggaaccactgtttcagattcagaataaggattcacgcggttgtgaaacccatgtcgatcattaaccaaatcaaaatagttgatgagtgggtcaatggtgttggatcagtcattggactggtttga

SEQ ID NO: 2589 - DNA, 354 bp, Glycine max
  Peptide Sequence Number=SeqID_119367
atgtctatccattctgcgcagcttaacagtgttgaggcagatgccggaacttctgctagtactgctgttcctgagttcagacagtggtacagtgtaacgagtcctgtatgtgatgagtcaactgctctggagtctcctgagactaccttgccatatatgcaaccatcggattcaaattggtggccattgcctcagagggatcctcttcttctaactgcgaccacattagaagctctgcatgaacatagttgtacacttcctttaaactataatctatgttgtcaagactcaagatcaactacaagatcctacttggtggggttgggagggggtcgcaagaccgcaaaaacttag

SEQ ID NO: 2590 - DNA, 342 bp, Glycine max
  Peptide Sequence Number=SeqID_119368
atggcaatgtctgctattccatcttttccggagaacaattcaggcagtacagtcatgcctctagatgatattttttgtcatagtagtgaggatcattgctacattcatgaggctgaagtaatattggaagcaccaaacgaccttaactcttcctttgtttcacctgtgatattgcaaccattcactagtgtgctcatgaatgaaaatacagcacatgtacctgacagcattactactcctggatttatgaacagtgattattttcaagctcactctgtgacatctgagatggcgataatagaaaacatgaatgaagaagccttcagagatccacaccaatag

SEQ ID NO: 2591 - DNA, 681 bp, Glycine max
  Peptide Sequence Number=SeqID_119369
atgagcgaccaccaccctcggttgcagcaccttcgttcagcctctcacctattgaaagaatcattttcttctttctcctcaaatttcctcatatttttgttcctttctctcttaactctttcttttcgcaccctcgtcgaaaccggcaccgcccatgtcacctcctttatcgaccgcgacccttccctccgcgccctcctctcccgcctcgacctcgccggaaactcccacaaccaccataacggccacgaccttccttctccgaacaaccaccgccaccgccgccgccccttcctccacctcacccgcgtcggaaccctagacgacgacttcttctccggcgacgacgatgacgcccgctccctcttcggctccatccccaaaccctcagccaacgccaccctcctcgccctctcccccttcaaaaccacctccgccttctcagatctcttcgccgacgacggaattagggtttcccaagtgatccgctccggcaccaccttcaacacccaaggattgtcctccttatcttcgtcgtcgtcgcggcgcgacaacgacgacgacgacgacgatagggaggagaaggaagaaccgacgaaggagaaggtggatttgcaattcttcgtgaaggggatcgaggtgggccgcccgagacgcggcggcgctgttcttccctggtga

SEQ ID NO: 2592 - DNA, 1338 bp, Glycine max
  Peptide Sequence Number=SeqID_119370
atggtgtccgaaggcactctcctgggcatgggtaaccctctcctcgacatctccgccgtcgtcgatgaagacttcttaaaaaaatatgatatcacctcgaacaatgcgattcttgcggaggacaagcacaagcctatgtatcaagaattggctgagaaatataatgtggagtacattgctggaggtgccactcagaattcaatcaaggttgctcaatggatgctccaagttcctggtgcaacaagttacatgggtggcataggaaaggataagtttggggaagagatgaagaagaactcaaagcttgctggtgtaaatgttcactattatgaagatgaaactacacctactggaacttgtgctgtttgtatagttggtggtgaaaggtctcttgtggcgaacttagcagctgccaattgctacaagtctgatcatttgaagagaccagaaaattgggcactagttgaaaaggccaagtatatttatattgccggctttttcctcactgtatcaccagattccatccagttagttgctgagcattctgctgcaaataacaagatcttctcaatgaacctttctgctccttttatctgtgagtttttcagggatgtacaggagaaagctctaccgtatacggactttgttttcggaaatgagactgaagcaagaacattttctaaagttcatggctgggagactgataatgtcgaggagatagctgtaaagatttcccaatggccaaaggcatcaggaacacacaaaaggataacagttatcacacagggtgcggatcctatttgtgttgctgaggatgggaaggtgaaaaagttccctgtgaaacttttgcctaaagagaaactagttgatacaaatggagcagaaaaaaaaaaaccagaacatgtgcacactttcgccgttgccgccgccctccgtttgtcatgtgcttgcttccgtggtgctcgcgtgcgtggtggtgccgctgctgtcgtcgcgccgctgtgtgtcatgctggagactgctgttgctattcatgctgttgctgtgcgtcgtgcaggggtctccttttgcaggtggcattcgggagatgcatttgttggaggatttctttctcaattggttcaggagaagcccattgaagaatgtgtgagagctggctgttatgcagcaaatggtgtcaagctaggtaaccacatgcaacatgcaacgagagcaccgatcattgttgaaatcgccgcagcactggaagaggttgtagatggcatcgaaggaggcagggacaaagaagttgttgtgattggcgaagacaatggagttgacgagggaggtgaggagtga

SEQ ID NO: 2593 - DNA, 357 bp, Glycine max
  Peptide Sequence Number=SeqID_119371
atgacgctgagaaaagatacttttatagaaaagacgacaacgtcaaaggataattttgatcccagcaggaggaaagtttccaaggatagtgttgatcccaagaggagaaaagtgtccaaggataatgttgatcctaactggaggaaattcacgacgaataaatttgatcccaagaggaggaaggtgcccaatgatgatgctgattctaagggcaggaaagtgtacaagaatattgttgattccaaatatcggaaaacaaggttgaagagcaagaagaatccaagtgttgttgtcaatagagcaagtaaatcaaatggtactgctgattgttttcttgccacttttatatgcccttag

SEQ ID NO: 2594 - DNA, 303 bp, Glycine max
  Peptide Sequence Number=SeqID_119372
atggagcaaaaaggaggtgtgcctatgcaacgatatgaagtggggagattattaggccaaggaacctttgcgaaagtctaccatgctaggaacatcataactggcatgagtttaagtatgaaaaataggactcagagagaaggggagtggcggatacaagccagatcttgcataatgtgggaacttgggaagactggaaaagccaaaaacggcaccacaagtgatagcgtagcaaaggaaccagttgcagaaacagaggatgagaatgcagcaagcaagcaacaaaagcaagggtgcaactag

SEQ ID NO: 2595 - DNA, 726 bp, Glycine max
  Peptide Sequence Number=SeqID_119373
atgtctctgaaattacctgtctattctgagttagttaaagctttttattcaaatttagaaattcatgaagatgttctaatgtatgaaatctatgggattaagatggtcattgaccaatccctattctatgatttaacaaaattgcctagtgaaggtgtgccttttgagggtgcactgattgatgaatggaaattcgatttctctgagcatgatgcccgccggttggtttgcaccaaccaagcggatatgaccggaagacttcttgccggttcattggcttttgaaagccgcatcctccattaccttatagtttgcattttgcttcctagatcttcaaaccttgcccaggtttctgaagaagatcttattgtcatgtgggcctttcataaagaaccttatgttccaatcaagagatcattccttataggcgcttcagtcatagcatcctttggttatattaaggagcatgatggatcatgggtaaagaagggtgctagaaatattggtgaagaaggacatgagggagaagattcatctcttcttttgaagattttggaaaggtttgatggtcttcaaacctttgttggtgagaggttcgatactttggaactgcaaggggatatgtgcttcaatgaaatggagtcaagaatgactaaggctgaagaagatgtatcttacatccggtcaagctttgatcttccaccaccgccgccaccatcatcttag

SEQ ID NO: 2596 - DNA, 225 bp, Glycine max
  Peptide Sequence Number=SeqID_119374
atgccaacctatgttccttttccacttcagcaagtgcaacttgtacggctgattctttctgctgtcatacacaagctgaactgttggaatttgaatcagtgggaacttgggaagactggaaaagccaaaaacagcaccacaagtgatagcgtagcaaaggaaccagttgcagaaacagaggatgagaatgcagcaagcaagcaacagaagcaaggctgcaattag

SEQ ID NO: 2597 - DNA, 378 bp, Glycine max
  Peptide Sequence Number=SeqID_119375
atgaagggaaagtttctaagagggtgccttaacaagtggaagaaaatgggaagtagagtgttccattgtgctgcctacggttactgctgtgaatgggaactggggtcatccatgcatgaagatgaaggagactccattcccaacgatgtgccaaagggtcacttggttgtgtacgtgggagagcaccataagagatatgtcatcaagattaccttactcaatcatccactcttcaagactctgctggatcaagctaaggatgagtatgatttcattgcagattcaaagctctatattccttgcagtgagcatcttttcctcactgtccttcgccgtgcaagcactccacacaacgaacgagtgtttgtgcgtgtctga

SEQ ID NO: 2598 - DNA, 417 bp, Glycine max
  Peptide Sequence Number=SeqID_119376
atgtccccttgggttaggggctttgagagggagatttctgggttcctttttacttggtttctggtggatacttttgtggcttttatattctctgtggatgcttgggttgccattgtagactcaaggaagagtgggagggagattgtgaaggaagggtgttatttgatatccactatgttgaatcaggctattcaggtgaagtgcttggaggctatactttgcgggtcgtttgtgaggtggggtttgagccgggtttgcgggaggtccttggccaagatgtttcagtccaccatggaggtttacttcatggtgacttggcttatgttttactttgcagcgcggtgtaaggacgccgatcttcatggtaggaggttcgggcagagggagctggagggcttggttgaaggtcacagatga

SEQ ID NO: 2599 - DNA, 348 bp, Glycine max
  Peptide Sequence Number=SeqID_119377
atgttgggtcgttcacagcacgaacttgagccactgatacaactattgaggaagagcaaagaggttgtttacaagtgttcaaaaatagggaaatacaattttgtggctaagaaattcttaccgtggaaaactaaaattaaagatcttgcagactcaattgagaggtttttcaatattgaaatgctagctcttattgcacgcgatcaacttgagatcttgcttagggttagtgaaatagaatacttcaatgatgaaaagttttccgattcggtgatcgcggcattagctatagctgctgctgttactgttgctatagttattaaatttattaaatttcttctgttctaa

SEQ ID NO: 2600 - DNA, 1338 bp, Glycine max
  Peptide Sequence Number=SeqID_119378
atggcactactaatagaagcaacagtgggagctgtgttcaacgagttgctgagaaccgagatagaacagcaaaacaacgagttgcagcttccgaaggaggaactccaatcgtttatcagaaagatggaggaggggacacagcttgttttcgattgttcaaaaatccggtggctacactttgtgactagggcttgttacaaggacatgttacacggacaaactggaccggttaggagaatacttagggttgttgagaaaacgtgcttcgaccctggggaggcaattgaaaacacgctgttaatgtttttgacgtggatttctgtctttgctgtgaagctaataagggtagcttttacgttttcttccactaaacaggagcagatttcacttgataaacaattgaagaggaaaaaaggctacttgctctctgccaggagtctcacagttttatggggagagggagacactcctaggtattgggggtgggctggggtcagtgaatttgaagatggaaggaatcaagaaagtacaagtgaagcagtgaatgcatactatgcagcagcattgctgggtctggcatatggttactcaagtcttgttgacactggatcaaccctggtggcgttggagattcttgctgcacaaacttggtggcatgtgaaagcagaagacaacttgtatgaagaagaatttgcaaaagataacagaatagtgggtgttctgtgggctaacaagagggatagtaaactatggtgggcccctgctacgtgtagagagtgtacgcttggaatccaagtgctacccttgttgcctattactgagacattgttctctgatgctgattatgtgaaggagcttgtggaatggacagtgccctttttaagtagtcaagggtggaaggggatgacctatgccttgcaaggaatttatgataagaaaacagcattgcagaatattagaaagttgacagatttggctcatccaccaacagtggtagagatcttgacatacattgtactgctcgcacaaccactgtttctgagtgagattgcagaattgactcaactgagattcaatgaacaacaagctttgagcacccacgagagtttcagcaccctagtaccaacagtgtatgtagggttctcttcgagccacacttcgaagagcagtgtagggggttctgtgggtttgagcgaggggtttccggcactattgaaaacaatgtgggacaatgtgggtgttgaaggagcggttttcggcagatttcaggcaggaggaaaaagagaagagcgatttcaggaaggaggaggacaaggttttcgagtgcgcgggttgtga

SEQ ID NO: 2601 - DNA, 297 bp, Glycine max
  Peptide Sequence Number=SeqID_119379
atggcaacaacaaatctccttctctcaaaaatcactcatggaccccccttccccaaagaaaaccctcctctttgttttcatcatttccttctcttcacctacgacacacaagtgggtttgagggccaagtgtgagagagagactgggagagaagtgagctggcgctggcacgagcagtggcacgactggcagcaccagtggtggccgatggctgggttggtggtgacctttaagaagggagaacaagaagaggcaaccatgaaagcaagggtttgcaaaaagagctcgcaactatga

SEQ ID NO: 2602 - DNA, 252 bp, Glycine max
  Peptide Sequence Number=SeqID_119380
atggcatccatggttgactcaaaagccatgtacggtgtgatcatggaatcaagcaaaccaaacactcaaagaagaacaaatctaggattgcatgttgttcaacacacaaaggtgtcacagaaagcaaagacaaatggtggagggaataacgtaaaggatcataaggggaagaatagtgcaagcacctattcaatcaacaaatcttcatccttgttcattcccgtgatgcttttgtttggttacttgttttga

SEQ ID NO: 2603 - DNA, 810 bp, Glycine max
  Peptide Sequence Number=SeqID_119381
atgcaatacacgaaaccagcgtttcgaaacgcggctttctactgccacgtcttctctcgctccttaaccttaaaccctaaccctctgctcctcgtttccccgtttcggaaacccgaaacgtttcgcctcgcttcacccgtttcgtgcttatcctcctcctcaatggcggtgcctccgtcttcgctggagaagcaattcgatgactttagggttcagctggaagaatctggaaccttgcgcgaacgaattcgaagcgtcgtttcggagattgagtcctccactaggctcatctatgccacacttcttctcgttcaccagtctcgtcccactcccgagcttttagagaaggccaagtctcatgttaatgtgttaaagaagcagtataagcaacttgctgaagttgttggaggatgccctgggcaatactataggtaccatggtgattggaagagtgagacacagtctgtagtttcaatgcttacatttatgcactggcttgaaacaggaagccttctcgagcacaaagaggctgaggaaaaacttgggtatgtggtgaatcaagtgacagctggggactatgattgtccaaggaaggtcttaaagttcttaacagatctccatgctgcattccgcatgcttaatctacgaaatgattttttgcgaaagaagtttgatggcatgaagtatgacttaagaaaagtcgaagaagtttactatgatgttaagattcggggtttgacaccgaatggtgagccagttggagacttggagatcaaggaatcgcaggacaatcttaatcttaagttgtga

SEQ ID NO: 2604 - DNA, 153 bp, Glycine max
  Peptide Sequence Number=SeqID_119382
atggaatatacaattgttccttcccttattcttctcattcttctctccgtggaggccctggtccttgaaaaccagcttctatcttcttccctatcaacaaacattgatatacttttattaccctatagagctggaacaagatcaactaattga

SEQ ID NO: 2605 - DNA, 375 bp, Glycine max
  Peptide Sequence Number=SeqID_119383
atggcagtgaaggaaagcaacacaagccaaaatattcagcagcagcagcagcaacaacaagaagcttgtgatccttgcaagtcttttggccaaaagtgcagccacattgtcaagaagcagcgtgcaaaattctacattcttcgccgctgcatcgccatgctcttgtgttggcatgagcgtgaaccatatctctatatttcatctaaccaaattatgagggtaggggtgggtccgttagaggagacagcaagaatcgtaataagaagaaaagatgagttgtgggtacgacccggtgctgtgccaagctgctccccagaccctgaccctcgtgcggccctctctgcgccgtgggctcactcctttcctaagctttag

SEQ ID NO: 2606 - DNA, 1827 bp, Glycine max
  Peptide Sequence Number=SeqID_119384
atgttttcttcgtctccaccgtttccttcgtcttcttcgccttcagttacgatgcttcatgaacaagctgctcctgcagttgcctcatggtcttctagttctgcagctcagcattttcctacttcggttcttttacaagagcagcgtgatgagtataagccctttctgcacgtgcataataaggagacaacactaaatacaaggcagatggatatgacctcagttcatgaaaaaggtaacacaagcaacgctgatcagttagtgcatgactttgtccagcagttgcatctccggtctcatttacagaacttattgacttgttctccgacaaggggaattgctgcttcttcaattctgcagcctgttgatattgattctgagtggcctgcggatggtgtgccacggaatgccgtttctcttgcacagcaagctttgtctgcctcaaagcaagcagtttcaacaactggagagatgaaattgattgaaattgatgatgatgatccacttccttctggtctggcctccacaagtttgactgactcttcactaaaaaagaataaagttgtgaggtcaacacggattatagaaagactatctaaacagagaaaatcatcaaagtcaaaatttcttgacgaagaaagttaccttgaaagaaagtctgatgtacagagaaggttacgtttagaaaagaagttaaaagaagggtatgatccaaatgaccctttgcgtttgttcctgtcgggtcctgaatcaaggcaacttttgacccgtgaagaagagtctcaattgattactcagttacaggatttatcaagattggaagaagtaaagatcaggcttcaaactcagttaaggcgggaaccaactttggctgaatgggctgatgcagtgggccatagttgttatgccctgcagacacagcttcattgtgctaacagaagcaaagaaaagttgtttcatgctaatttacgcatggtagttcacattgctaaacattatcagggacgtggtctcagccttcaggacttatttcaggagggaagtacgggccttatgaagagcattgaaaagtttaaacctgaagctggttgccggtttggtacttatgcatactggtggataaggcatgcagtaaggaaggccatatttctacattccaggacaatccgtttgccggagaatttatatacccttttgggcaaggtcatagaagcaaagaaatcatacattcaggaaggaaatcttcaccctaccaaagaagaattggcaagaaaggtaggaattaccatagaaaagatggacaatttgctgtttgcttcaagaaatccaatttcgatgcagcaaactgtgtgggcggaccaagatacaactttccagttattgcattctgttgtgcgtgatggtaatgaatcagcagcagctaaaagcttgtgtgctagtatccttacaatgcgcttccacgttgagcaagttattgtcataccgctttggtgtaaatttctgttaagctggtcttctcctaatgttggagaatgttgggagattactgcagactcagcaattgagatcccagatgtgactgtctcaaaacagctaatgaggatgcatgtgcacaaccttctaaatatcttaagcccaaaagaaaggggcataatcaggctaagatttggtattgaggatggcgaggagaaaacgttgtcagacattggcaaggtgtttggtttgaccaaggagagggtccgacagttggagagccgagcattgttgaagctcaggcagtgtcttgaaagtcaaggacttgatgcatacacagacttgcttgtatag

SEQ ID NO: 2607 - DNA, 498 bp, Glycine max
  Peptide Sequence Number=SeqID_119385
atggcactattgggaaaatgggcttggagattgttgagtgacaaggagtgcctttggagagatgttttagtgagcaagtatgagttgagagttgtggggacgggtagtgaagtgagcttttggaatgctttgtgggttggggaatttcggccaaatcataatacacaagatggatgggagtggaaatctaaggagtatatgtggttagagaagtctacacaaggtgctatcaatggtggggtgacattatgggcaaataccatagcacacttttggcaacactttgggatgatcaaaggaaggaagaaacaaatggcatggtgggtggcttgggttactgtgatttggtctatttggaagctaaagaacgatattttttcaaacagttcatgcgatctggaagagctgctggaagctatcaaatttcgatcatggagctggagcagatcatttgtcgaaggtctggatatagaggaatgcttaagacatttagcatag

SEQ ID NO: 2608 - DNA, 1404 bp, Glycine max
  Peptide Sequence Number=SeqID_119386
atgaagtgttttccattctcctatggagagaagaaagatgaaccgaaaggcttgcagttgcagtcaacatcgggtcgatcagacaattccacatgtgttgaggctgaggttagaagatctggttctgcattaaattctcaggatgtttcagacaatggcagctcagaatctctcaggaggaatgcgattcccagtttgtcccagagaccctgcaacctcagagtgtttactgtatctgaactgaaatcagccacaaagaatttcagtcgctctgttatgatcggagagggtgggtttgggtgtgtctacctgggattgataagaagtgcggaggacccctccagaagaactgaagtcgcagttaaacaacttagtaaaagaggaatgcagggccatagggaatgggtaacagaagtgaatgttctgggcattgttgagcatcccaatcttgtgaaactagtgggttactgtgctgatgatgatgagagaggaatccagcggcttctgatttatgaatacatgccaaacagaagtgtggaacaccatttatctcaccgatcagagactcctctcccatggagtaggagattaaaaatagctcgagatgcagctagtgggttaacatacctgcacgaggaaatggatttccagataattttcagagatttcaaatcttcaaatatcctattggatgaacagtggaatgctaagctatcagactttgggttagcaaggttgggaccatcagatggactgactcatgtctcaacagcggttgtaggaacaatgggatatgcagctcctgaatatgttcaaactggacgtctaacatcaaagaatgatgtatggagctacggtgtcttcctttatgaactcataactggtaggcgccctttagatcgaaatcgccccaggggtgagcagaagctgttggaatggataaggccatacctatcagatgggaagaaatttcaactaatattagatccaagacttgataagaaacaagtcttcaagtcagcccagagacttgctacgatagctaaccgatgcttggtaaaaaatccaaagaatcgtccaaagatgagtgaggtattggaaatggtgaatggaatggtagaatccatatccagttctagtccacagttgcccctgaggagtgtggcaacattggaagcttcccaggatactgaaacaaacaacaagaaacgaaccatggatcataagcctggagaaaatttaagccatcaagcctgttacttgggagcaaagcttcttcatgataagggaagagctccagcatgtttctcaatgccatgcggtcacaaacaatgtgcaacttctccatctcttctaaggatgtgtataaatctgccattacatgctacttaccaactactatag

SEQ ID NO: 2609 - DNA, 324 bp, Glycine max
  Peptide Sequence Number=SeqID_119387
atggcaatggtggggtgggacaggtacgggtattctctctccaaccccttaccccgactctctaacatatctccatactcgtacccgatacccgacggatttaagtttattgtcccatccccgtcgggtatcggagatggtccctttttgtgtgtaaaaccggttaggtcggaccggtgcaaccgggatccggtggctaactgtccgagtttggatagatcatcccgtgtcaattgcatgaccgatccaatagtgaaactagttcggttagaccaccgagtaacggttgagtcaaaccaggtttcgcaattgtgcttgcaatga

SEQ ID NO: 2610 - DNA, 1593 bp, Glycine max
  Peptide Sequence Number=SeqID_119388
atgtcaaagctggctggtgaaagtgaaagcaatctgaggaaggcatttgaggaagcagagaaaaatgcgccatccattatcttcattgatgagatagattcaatagctccaaagagggagaagactcatggtgaagtggagcggaggattgtttcccagctcttgaccctcatggatggtcttaaatcacgtgctcatgtaattgttattggagccacaaatcgccccaacagcattgaccctgctcttaggaggttcggaagatttgaccgggagatagatattggtgttcctgatgaagttgggcgtcttgaggttcttcgaattcatacaaagaacatgaaactcgctgaagatgttgatttggaaagaatatccaaggacacacatggttatgttggtgctgatctagctgctttgtgtactgaagctgcacttcaatgcatcagagagaaaatggatgtgattgacttggaagatgagacaattgatgctgaaatattgaactccatggcagtgacaaatgagcatttccagactgctcttggatcaagcaacccttctgctctccgtgaaacagttgttgaagtgcccaatgtcagctgggaagatattggtggtcttgaaaatgttaagagggaactccaagagactgttcaatatccagtggaacaccctgaaaaatttgagaagtttggaatgtcaccttcgaagggagttctcttttatggtcctcctggttgtggtaaaacacttttggcaaaagctattgccaatgaatgtcaagcaaacttcataagtgtcaaaggtcctgagctactcacaatgtggtttggagaaagtgaggctaatgtgagggaaatttttgacaaggctcgcggttctgctccatgtgtcctattctttgatgaacttgactctattgcaactcagaggggtagtagtgtcggagatgctggtggtgctgctgacagggttttgaaccaactgcttacagaaatggatggaatgtcggcgaagaaaactgtgttcatcattggggccactaatcgaccagatattattgacccagctcttctgcgtccaggtcgtctcgaccagttgatttatatccctctcccagatgaggactcccgtcatcagatatttaaagcttgcttgaggaaatccccagtctcgaaagatgttgatcttagggcgcttgccaagtacactcagggtttcagtggtgctgatataacagagatttgccagcgcgcgtgcaagtatgccattagagagaacattgagaaggacattgagagagaaaggaggaaaagagataaccctgaagcaatggaagaggatgatgttgaagatgaaatagcagaaatcaaggcagctcattttgaggaatcaatgaaatatgctcgaaggagtgttagcgatgccgacattcgcaagtaccaggcatttgcccaaacattacagcagtcaagagggtttggaagtgagttcaggtttgcagattccacctccagtggtggtgctgccaccgcatctgatccatttgcttctgctggtggagctgatgaagatgatctttacagttag

SEQ ID NO: 2611 - DNA, 1587 bp, Glycine max
  Peptide Sequence Number=SeqID_119389
atgcctaatcccgatgaatcctcttcttcctatgacaaacttgaggacgttctcagccgtttaaccaagcaacagctctatttggaggaatcagttaatgcgatgaccctcaagattgaggaacttcttcatcgtgtgtccccgattgtcccaccttctcagcccactccgactccattaccacatcctcaacctgcaactccaattcatcgtttaaaattggaggttccccgatttgatgggtcagaaccactgggatggatttataaaataaaccaatttttttactaccataataccccagaggcagataaacttaccgtggcgtcttttcacatggagggtcgggcccttgcgtggtttcagtggatgaacaccactcaccagttcccttcgtggcctgcgttcttggaggctctgcgtacacgctttgctccttcccagttcgaggacccctcgggggctttgtgcaaactcactcagacgggcaccgtagcacaatacttggctgatttcgaggacttagccaatcgaaccattggccttcccactccgttcctcctgagttgctttatctccggcctcacgtcggagattcgccgggaagtgcaagcgcaccaacctgctaccctcgtgcaagccgctggtctcgcacggttgcaggaggagaagttcgcagatatgagaaccccctcccgtcaccgccctgcaccaacccctcccctttccccacgactcaaccccactatcccttcgtcgcccatacgagttccttccccttcatccccaccacaaccttttcccttaccctcaccaaatcttccccctttactaccttcacctcgcaacccccctcaggcatggaagcgcctatcccccgaggaaattgcttctcgaagggagaaaggcctctgctttaattgtgaggaaaagttccatagagggcataagtgcgcctctaggtttttccttctaatttctgaggaagacgacccagccaaccctcttataaccggctcggacctacccaacactataacccacgacccgcctcagttacaaccccctgacccacccgatagtccgaattcttacccggcccaaatttctcttaattccctggcaggccacgttgcaccggaaactatttggctcatgggaagcatttccggtcatcctttattgttgctggtcgatgggggtagcacccacaatttcgtccagcaacaattggtgactcacttgggattaccttgtcgggaaaccgcaccactacgggtaatggtcggcaacggtcaatacctggaatgtacctctatctgtgacgccattaacattcatattcagaatcaaaccttcatcgtcgacttgcatatactgcccatctccggcgccaatgtggtattgggtgtgcaatggcttaaaacgttagggcccgtcctcaccgactatacatccttgactatgcaattcttctaccaagggaatttgatcaagttacaggtttcgccgtctatgccagacacagccctctggcctgtgctttcatatcacagtcctttcggaagaacattcgacttcatctga

SEQ ID NO: 2612 - DNA, 372 bp, Glycine max
  Peptide Sequence Number=SeqID_119390
atgggtctagctttaatcgtcggactcctcggccttctgattctatttcacgccgcttattcaactattcagtgtaccctaaaaactgtttctcatatacaccggtattttgcttttcatcgcacgtttcagcataggggccttttgaagattacggaggaagagttttcagggcctccattcgacgtggtgattgagctgtttcttggattgttgctttgtttttgggctgccctcactgcgccggggaagtttctatccatacatcctcactctgaagataacagacagttaggtggcacatgggccaatacaaatgaaaggggagaggggagtcagaatacagatcaagacagggatttctgtcaatga

SEQ ID NO: 2613 - DNA, 531 bp, Glycine max
  Peptide Sequence Number=SeqID_119391
atgaatctgattgcgcctatgtgttgtctggctttgtttgaattgttttacagtaagggcaccaagagagatttcagcaccgcgattttggagcgtaagaaggctctgaatcggcttgtggttgatgaggccgtcaacgatgacaactctgtcgtcgctcttcatcctgataccatggagaaacttcaactctttcgtggtgacaccatcttgatcaagtgtttgttagctaatataatgtgccctttacttctaacgagtatggttattagggtttgggcacaagagaaaggaaagaaaaggaaagatacagtctgtatcgcacttgccgatgagacatgtgaggaaccaaaaataagaatgaacaaggttgtgagaaacaaccttagggttaggcttggagatgttgtttcggtacatcagtgtcctgatgtcaaatatggaaagcgagtccacattcttcctgtggatgatactattgaaggagtaacaggaaacctctttgatgcctacttaaaacgaaaggcttga

SEQ ID NO: 2614 - DNA, 274 bp, Glycine max
  Peptide Sequence Number=SeqID_119392
ttgcttccctaacaattcaaaaactcacgcaagaacagatcggagaaaacatatatcaacaactagatctgagaagaaaaaaaaaccacacacatacagtggttggaagagggcggcaaaggttaatccagatctgcaagttgttgtcgaggacatagaaaccattgtagaaccagactacggcgacgccggtgaggatgagtgtgatggtgccgaggagaaggagtgtgacgatgccggcgagaagaaggaaacagatcgaaccttcgactga

SEQ ID NO: 2615 - DNA, 243 bp, Glycine max
  Peptide Sequence Number=SeqID_119393
atggctaccattgtatctaaatcgacttcattagtaatagagaaacaatttgaagagctacgtaaaaaatatgaaagtcttaagaaagaaagatccgtgctccaactgattcgcatgaatcttgaagcggagtgtcctgaaactagcaatgaagacaagaccatagaggaagagcgtggaccagaatcagcagcaaatatattgaccatgaagcgtggcacctctactctgcttaaggaatga

SEQ ID NO: 2616 - DNA, 321 bp, Glycine max
  Peptide Sequence Number=SeqID_119394
atgcttcggtcttgtctcaagcagttgcaaaagaatctatcgagttttgttcactccaatgaagatcaagtactggaagcagtaactttggtgccagaagatgttatggagggtcattttgctgttcttgccatcaagggtgaagatacaagaaggtttattgttaagttagactacttgactgatcctatgttcatggaactactgaaccaagctcgagaggagtatggtttcaaacaaaagggagcacttgcagtcccttgcaggcctcaggaattacagaacattctagatggcccaagagccaaagctgaaaggtag

SEQ ID NO: 2617 - DNA, 156 bp, Glycine max
  Peptide Sequence Number=SeqID_119395
atgggtcaacttcaatttcttcgcaatgtggtggttgggctcaatggtgccattttggtgggtgttgttgttgtcatccatggaagggtttgggtggggttagatgttagggcttataggatgggaatggcaatggttggtggtgacgggcagtag

SEQ ID NO: 2618 - DNA, 777 bp, Glycine max
  Peptide Sequence Number=SeqID_119396
atgggttacaagcaatctgcccctgacgcacatgaaacactgtcgagtccctcctacatgaactatcctatagcacggactgtccgtcagcatccttttgtcaaccacattatggaggcatacatacacttggggtggaagccactcaacctcaagcgatatgatgggacaatcgacctagacgagcatctggatgccttcttgacacaggcgaatctctacaccaacaacgatgtgatcctatgtcgtatcttccctaccccccttaaaggaacgacattgacccgatacggtgaactcctaccaaggtccataaactgctttgacaccttagtcgaacgattcagcatgcagtatgccaccagtaggtctcactgcatgaccttagccgccttggccaatctacaacaagcagacgatgagtccctcagagagttcatggacagatttcggtgcacaaccatccagatccgaaatctcaaccccaaggtagtgttgcattccattctccttgcattacggcccaacaagttcacaaacaatctgtgcaaaaaaaactaccaggtagcttggacgaactacacgaacaagccaaggcctacatccatatggaagaaatgttcaaattccagaatgaagtccaccaagctggatagaagcgtgacaagtgcaaagcaaacaccaaggccgacttgcacaagtcgaacaagaggcacaagccagacaagcactatcctttctccaaaaggcccaagtacgagtgttacacacccttga

SEQ ID NO: 2619 - DNA, 582 bp, Glycine max
  Peptide Sequence Number=SeqID_119397
atggtggtcaagtctcaaagcatacccgaacatgtggtagacctggaagaagtctttggggaactacgcatatataacatgtgcctcaaccctgaaaaatgcacttttggggtaggcggcggcaagttcctcggcttcatgatcacataccgagggattgaagccaaccccgacaaaaccattgtcgtactagagatgcgcatccccaacaacagtcatcaagtggtagtcaagatgaattaccccatcaagcaggttttgagaaagcctaaacttgcaggaaggatgatagcctgttccattgacctgttagagtttgaccttcaatacgaaccatgcagtcccataaagacacaattcatggctgactttctggtagaatttgctggaaacgacataaccaccccaaaccagtggaccctctacgttgatggtgcatccaacataaaaggaagtgggccagggataatcctcgaaggccctgacaacatcaccccagagcaagccttcaagctcaacttcagagccttaaaacaaccaaccagagtacgagacgctaattactggtctaaagctagctag

SEQ ID NO: 2620 - DNA, 315 bp, Glycine max
  Peptide Sequence Number=SeqID_119398
atgaaattccctacactgacaagggagattataactgttaaggctgatcaaaagcaaccacaccagtgctctacaaaaagcctgaagccatctgacatgctggggatccatctcgacataatttgccacaaattggatatctgcccccaggccaaacctatatcacagaagaaaaggaagatgggagaagagcgacataaagccttcaaagaagaagtcgataagcaacttcatcaaataggtcaggttttccaccaggctcatcaatgttgtgatggtaaaaaaaaccaacggccaatgtcgagtgtggactga

SEQ ID NO: 2621 - DNA, 474 bp, Glycine max
  Peptide Sequence Number=SeqID_119399
atggggaaaggcatggtcggctccaggatggaaggatatggtgctaccttcaggctttttgtagagcactgtgtagggaatttcattgttggatggggcatggagactatggcttcgagctcgttgagtgtcttcctaccgattaaggaaaagtatgatgagtttgcgccaaccaacctcgagtctctagaagttcttctagtacaggatgtcagtggaactgccttggtcgataaggaccctggacaccatgaagttcaatataatgatgaagacaaccatagggttgtcttggttgacaggattgatgcccttgaagtccctgtccataaaggcgataggagggagacttcgttgtgggttcctgttctattggaggtggtcactcgcgccgctatggctaatgtctttgatggcctcagtcttccgctcttcttttgtctgcttcttggttcatgtgctgcccctcttgat

SEQ ID NO: 2622 - DNA, 1554 bp, Glycine max
  Peptide Sequence Number=SeqID_119400
atggattctgaagtacataacatgttggccgttatcatgtccttttccctcttcatcattgtggcactgaaaatagggaggaatctcaagaaaactgagtcatctccaaacatacctccaggaccatggaagctacctatcatagggaacatacaccatcttgttacatgtacgccgcaccgaaagttaagagacttggccaaaacatatggacccttgatgcatcttcaacttggtgaggtcttcacaatcattgtttcctcaccagagtatgctaaggagataatgaaaacccatgatgtcatctttgcatcaagacctaaaattctagcttcagatatattgtgctatgaatccacaaatattgttttttcaccgtatggaaattattggagacagctacgaaaaatatgtacagtggagcttttaacccaaaggcgtgtcaattcattcaagcaaataagggaagaagagttcaccaatcttgtcaaaatgattgattcgcataaagggtcacctatcaacctcactgaagcagtctttttatcaatatatagcatcatttcaagagccgcttttggcaccaaatgcaaagaccaagaagaatttatatcagtggtaaaagaagctgtaacaattggatcaggttttaacataggagatttgtttccttctgcaaaatggcttcaacttgttactggtttgaggcctaagcttgagagattgcatgggaaaactgatcggattcttaaagagatcatcaatgaacacagagaggcaaagtcaaaagctaaagaagaccaaggtgaagcagaggaagatttggttgatgttctcctaaaatttcaggatggtgatgatagaaaccaggatattagcttaactattaacaatatcaaggctataatcctagacgtctttgctgctggaggtgagacatctgcaacaaccataaattgggcaatggcagagataataaaggatccaagagtaatgaagaaagcacaagttgaggtgagagagatattcaatatgaaaggaagggttgatgaaatttgcatcaatgaactcaaatatttgaaatcggttgtcaaagagaccctaaggttacacccaccagctcctcttttaattccaagggaatgtggacagacatgtgagattaatgggtatcatataccagtcaaaagtaaggtatttgtcaatgcttgggcaattggaagagatccaaagtactggactgagccagagaggttttatcctgagagattcattgatagctctattgactacaaaggcaataattttgagttcactccatttggttctggaagaagaatatgcccaggaataaccttgggttcagtaaacgttgagctagcccttgcatttttgttgtatcactttcattggaagcttccaaatggaatgaaaagtgaggagttggatatgactgagaaatttggagcgtctgttagaagaaaggaagacctatacttgatacctgtcatctgtcatcctctgcagggaagtggtgcaggcaaagaaggctga

SEQ ID NO: 2623 - DNA, 369 bp, Glycine max
  Peptide Sequence Number=SeqID_119401
atgggtaaaacatgtagtagtagttgttcttggggattgtggatcggagggtttggagtagtggagcctatgatgaggaaactacaaagcactttctcacgtccaaaaggggtgaagcagggccattttttggtgattgcaacacaagggtggaagccagagagattctctattgagttggagtttttggatcaccctgactttgtgaagttgttaaagcaagctgaagaagagtacggattctctcaggtaggagcacttgcaattccttgcgaaccagatgacttgaagagaatcattacaaggaaaaagaataggaacaagggtattgctattgcctgttgggttaaagggcttagagttgcatga

SEQ ID NO: 2624 - DNA, 396 bp, Glycine max
  Peptide Sequence Number=SeqID_119402
atggaggttggaaagaagaagatgctcctcaagtctttgatcacaaaggtgataaagggtcttccattattcttggcaccaaatggaggagcacgtggtacgagaagggttagttatttgagtgacattgttgaagaggagaatgagaggacaacaaaggtgccagaagatgttaaagaaggacactttgcggttgtagcaatgcatggtgaagaaaccaaaaggttcgttgttgagttggattatttaactgatcatgctttcttgaagctgttggagcaagcaagggaagagtatggctttcaacagaagggtgcacttgcagttccctgcactcctgaagaacttcagaagattatagagaatcgaagagtggacatgccactacttaattaa

SEQ ID NO: 2625 - DNA, 201 bp, Glycine max
  Peptide Sequence Number=SeqID_119403
atggattttcaaatggccaaaacatcagcatggtgcaaagaaatgtcagaggaattgtcagagacgatagttgggctggggaaatttgggagcttcctaactcatcatcaacttcatcagatgatagccattttttgggcgttaaagggaatcctgcaactggatcatggtccgctgtcacagacagagattgttgcataa

SEQ ID NO: 2626 - DNA, 345 bp, Glycine max
  Peptide Sequence Number=SeqID_119404
atggagatcaatgatggtttgtggtggctaatggtggttgtgggtgatggagaaagtgcttgggactttagaaatggctttggaagaaagaaagaagaagaaatgacgtttttcctaagctacacgaaagcaaaggctgaacttcgagcacactccagacatcttctcaaagatccaaatggtcagatcgttgacaagtgtcttgggaagctgcaaaccaaagttcgagaagatccaacagttaatgaaggctggggaacatttttaccgaggaagcttcatgtagcttcctcaagaagcttcattaagaggcttcttcaagaagcttccccatggcttctttga

SEQ ID NO: 2627 - DNA, 456 bp, Glycine max
  Peptide Sequence Number=SeqID_119405
atggcaaggattcctgacaagattaagtctattgatgggtcaagagagacgcttaagcttgctgtgagaatcaccgacctttggttcgttgggactcccaacaagtttgagcaagcggaaatggttattgttgattctgagggtgatcaaattcatgctgtttgtaaagcggaccacctaaagtcttggaaagctgatttgaaggagaattccacttatgttatgcataatttcaaagtggtcaagaatgatggtcaatttagagtgtgtgaacatgagtacaagttagcttttattggagtgactattgttagagaagttgatttgcatgaactaccttttaaggaatttagatttgttgaatttggaaatgtcgttgctgggaattttgtggttggcctgttggttggtgctttttcagcatgtttcatcaaaaaataccagggttgtttttag

SEQ ID NO: 2628 - DNA, 504 bp, Glycine max
  Peptide Sequence Number=SeqID_119406
atggctataacatggcaagttaaacagaagccatccctcacatgctcctgcaataacatcaaactattagaagcagctcagtccatgtcccagaaaaggtccaatggaggcctcccccaaaatttctacctacaattcctagcaccatccttgctacacccagacctccaacatcgttttataccgaaattgcaaattaggtcacaatgtgaaaataggaaaaaagaagaagaaaaacctaatattgtgattgtggaaggagccaacaaggatgacgaggagggagagaaaggtgagattggaggggcaaggctggctgctaaaggcggtgttggcgagggcaacaaagagaggggtaagggatgggaagacgatgcaagtgtcaacattggcgtggcggaggagattggtgttgatgaagatggtgaggtagaagatgagtgtggcagggaagaattttttggcaatggggagggtgaaggggtcgtggtggagaaaccctaa

SEQ ID NO: 2629 - DNA, 1664 bp, Glycine max
  Peptide Sequence Number=SeqID_119407
gttcatgctctaattttttaactgcctatgaggattgccaatctccaactaatcggcctataatcaacactgaaggatattccgatcttggtgatcaattcatgcaatgtagatattgtaatgcacaaatgttgtatgatgaaagaatatcaaaagataaaaattgtgggagtccaagtcaatattctggaattcagggccatattgtttcaagtttaactcacatgctggatcaacacaattatcatgctaaaagttttagaatggccaaggatagattgatagatgatcaagccgataatatcaaattgcaactgatagctgctcggggaaaagatggctgtgtatataatatgcctaatgttcccaaaatcgttgcacttattgttggcgattttcatcaaggctcaaaaagagatattattgttgaaattcaaaatggagaattacaaagaatccatgaactgcaccctagttatctaccactacagtaccctctactctttccttatggagaagatggatatagagctgacatacttcactgttctacttcatccagcaaaaaaagaaagcgaaaccgtttgacaatgagagagtggtttgcttatagacttcagtccaggtcaaatgaagcacagactttattgcattctcgaaaattatttcaacaattcattgttgaaggttataccatggttgaatctaaaagacttagctacatcagaaacaaccaaaagaaatttagagttgacaagtattgtagcttacaaaattcattggatactggaacagctaaaggcttaaccaaagggaaaagagtcatcttaccttcaacgtttgttgggagcccacgttatatggctcaactttactttgatggtatggcaatatgcagtcatgttggtttcccaaatctttttattactctaacctgtaatccaaattggccagaaattcgtatttcacctttgaatctcaaaccaacagacagaccagacattgtatcacgaattttcagattgaaatatgaacaaatgctctcagacttaacaaagggtcaattacttggaaaagtagttgcatatatgcatactatagaatttcaaaagcgaggatttcctctcgtccatttattgttatttctacacccagacaataaatatccatcttcaactgacattgaccagataatatcagcagaaataccatcccatgaagatgactcagaactctacagattggtggaaaaccatatgatacatggcccatgtggaattttacaacctaactctccatgtatgaaagaaggcaaatgcagtcgtttttatcctaaacaatttcagcctcagactcttttggattcaaacggttacccagtctatcgcagaagaaataatggtcattcaatttcaaagaatggctatgatatagtgattgctgttatggtttctaatagcaatgagacaactcaaaatgttaacattcaaaatgacgaacttaaagaatatctagattgcagctgcaaaggacctacttcatttgaggatattagaactgttgcaaatatccaatatgcaacatatagagaaacatgttttgccatggggtttttacaagatgatagagaatatgttgaagcaatcaaagaggctaaggactag

SEQ ID NO: 2630 - DNA, 2922 bp, Glycine max
  Peptide Sequence Number=SeqID_119408
atggcaacctctgaaaaatttgtgcaaccatctattcctaagtttaatggccattatgatttttggtcaatgaacatggagaattttcttagaagcaaggagctgtggagtgtggtggaagaaggcattcccgcaccagtaattggatcaggaccaggcagtgaggctcagaagaaagccatggaggaggccaaactcaaggatttgaaggtcaagaattttctattccaggcaattgatagggggattctggaaacaattcttgacaaaggtacatcaaaggctatttggacttcaatgaaacagaaatatcaaggatccatgagagtcaagagagcacaactccaagctttacgaagagagtttgaattgcttaccatgaaagaaggtgaaaaagtagatagttttttgggggcgaacttgactgtggtcaccaaaatgaaatccaatggagaaactatggcagagagtacagtgatcacactcgccaaaacacttaagaggattggcccatcagaggccggggtcgaggaggacgtggcagagggagagttacaaccagcacgtctagaagaacgatggtattttgattcagggtgcagcaaccacatgacaggaaataaggcatggtttttagatttggaggatgaacactgcagaacagtaaagcttgggaataacatgcacatgactgtggtagcaaagggcagcctcaggatgcaaattaatggtataactcaggtactgtctgatgtttactatattcctgaacttaagaataatttgctaagtttagggcagctgcaagagaaagatttagccattctggtttcaaatagctcctgcaaagtattcaatcccaggaaaggattaattatacaaactgatatgagcgggaatagaatcttctatgtgacagcctctatgcatccaaaacagtccttttgtttgcaaacaaaaactgtctcagccaaagaagcatacatatggcactgccgttttagacacctgaattacaagggtctgaacatgctgtcttgcaaggaaatggtggttggtttaccagcattggagcatccacagaaaacatgtcttacatgtttaactgggaagcaaacccgaaagagttttccaaacaatagctcatggaaagcatctagacaacttcagcttgtacattcagatatatgtggtcctatccagccaacttcaaacagtagtaaaaggtatttcctaagcttcattgatgactttgctcgaaaaacttgggtgtattttttacatgaaaaatcagaagcattggcggtgttcaagaaattcaaagcacgtgttgagaaggagacaggaacatccatcacttgcctcagaacagatagaggaggagaatttctctcaagagaatttgaagtattttgtcaaacacagggcataagaaggcagctgactacctcctacactcctaagcaaaatggcgtggctgaaagaaagaatagaacgatcatgaatgttaatcggtgtccgacagcagcagtagagaacaagactccagaagaagcctggagtggtacaaagccagcggtggagtatttcagaatttttggatgcttagcacatgcacatgtactggatcaaaagaggactaaagttgatgataagagcagaaaatgtgtctttataggagtcagtgatgaatctaaggcatggaggctatttgatccaatctcaaaaactatcattatcagtcgagacttagtgtttgaagaagacgaaagttgggattggagcaacactgagttgaaaatccagcaagatgaactaagttgtgacgatgaaggcgacgttgaaggagagaataaccacaacggtggtgaagatgcagacgatggaagtgaaggtgaagatgaagatgacggtggtcatagtacctcacttgattcatctcaaggaaggggtgaacgagcaaggagagcaccaagatggatggccgattatgcaataggggaaggtttttctgaggaagaaaatctgaataaaagaaccacacctggaagctcagagtattaccagatggagtctaaccaattggagttaattgggcatggaattgactacactgaagtctttgccccagttgcaagacttgataccatatgggtaatattggctatagctgctcaattcagctgggaggtgttccaacttgatgtgaagagtgcttttctccatggggaactcaaagaagacgtatttgtactgcagccggagggatttataaagaaaggagaggaagagaaagtttatcggctaaagaaggcattatatggccttaaacaggcaccacgagcctggtacaataagattgaagcctattttgcccaagaaaagttttacaagtgtcctagtgaacacacattgttcacaaaatcaccggaatcaagcaatgtgcaaatggaatatttatttgtcaaagaagacaaaggaggaaggagtgctgatgaaacattatttaaacaattagttggaagcctgatgtatctaactgttactaggcctgatctgatgtatacagtaagtttaataagcagatttatgaccaatcctaccacggcacactggcctgcagcaaagagagtcttacggtatgtgaaaggcacaactaatcttggaatcttgtataagaaaggagcaggcaacccaaaattagtagcctttacagatagtgattatgctgttgacttggatgggaaaagtacatctgcatttgtgtttatgatgggaacaggagcagtttatcggaaaactgaatattcctgtccaaacccgtattctaagaattacaaacaagagtacagctatacactattaaagctagatatggcgaatgctactgcatgcttcactgtgaagaggataatagtgtaa

SEQ ID NO: 2631 - DNA, 1491 bp, Glycine max
  Peptide Sequence Number=SeqID_119409
atgagaaacctaatctttgaagagcctgaagtcagggttccaggagacacttcaagcagtctgcgctatgcctgggaatcaatacgagccccagtgataataccagtcctaaaactagctgtcatactatgctcaattatgtcaatcatgctatttgttgaaagggtagcaatggcaattgtaattttagttgtcaaagtgctggggaaaaaaagatacaccaagtacaacttggaagccatgaaacagaagcttgagagaaacaaaagattccccatggttctgatccaaatacccatgtataatgagaaagaggtctacaagctttcaattggagcagtatgtgggctgtcatggccagctgacagatttatagttcaggttcttgatgactcaacaaatcaatccttaagggaatgtgtccaaatagagtgtcagagatggatgcagaaaggtgtgaatgtcaaatatgaaacaagaacaaatcgcaatggttacaaggcaggtgccatgaaggagggtttggagaaggaatatgttgaggattgcgagtttgtagcaatatttgatgcagatttccagccagatgcagattttctttggaatacaattccttatctgcttgagaacccaaaattgggattggttcaagcaagatggaaatttgtgaattccaaggaatgtatgatgacacggcttcaagagatgtcactcgattatcactttagtgttgaacaggaagtgggctcttcaacatactcattctttggtttcaatgggacagcaggaatttggcggattcaagcaataaaagatgctggaggatggaaagaccgaacaacagtggaagatatggaccttgcagttagggcaagcctgcaaggttgggaatttgtttttgtgggtgacataaaagtaaaaaatgaactgccaagtacatttaaagcataccgatatcagcagcacaggtggtcatgtggtccagctaatctctttaagaaaatgaccatggaatcctctattgccatgtatagggtaccgcttctcaagagacttcatcttgtctatgctttcttctttgtgaggaaaatagttgcacattgggtcacattcttcttttactgcatagttataccagcttgtgtgatagttcctgaagtcagtctcaaaaagcagattgccatatacatcccagcaaccattacaattctaaatgcagtctccaccccaagatccatgcatctactagtactctggatactctttgagaatgtcatgtccctccatcgaactaaagcagcaattattggactcttggaagcaaatcgtgtcaatgaatgggttgtgactgagaagcttggaaatgccatgaaacagagaaagaatgctcggccatcaagaacttcatggttccgaattatagacaggcaggagctttctttacaatgggatttgggcaagtgggaacaattgtaccctactaaagcttaa

SEQ ID NO: 2632 - DNA, 1995 bp, Glycine max
  Peptide Sequence Number=SeqID_119410
atgtacctaaaagacggttattccctgttattaaaacaccgcaaaccatcttcactccccctcgtgctcgccacgcgccccctcaacccaccaccctcctccgcctccctcctccacgagtcccacgtggcacacgcgcttcgccgcgaacccaacgtcctatacgcgctccaacacttccagtatctaaccaacaccctcgccttcaagcacacgcctttaacctaccacgtcatgatcgagaagctcggaagaaactccgaactcgacgcgcttcactacattctccaccagatgaaaatcgaacgaatcccatgttcacaagattcattcatttgcgttttaaactcttacaaaaattctgggttgggtgatcgtgctttgaagatgttctataggatcaaggagtttgggtgtaaacccacagtgaaaatttataatcacttgcttgatgcattgcttggtgaaagtggaaacaagtttcatatgattggtgctgtgtatgagaacatgaggggtgaaggaatggagcctaatgtgtttacttacaatgttttattgaaggcgttgtgtaagaacgggaagctagatggtgcctgcaagctgcttgttgaaatgtcgaagagagggtgtgtgccggatggggttagttacacgacggttgtggcggcgatgtgtgaggatgggagagtggaggaggcgagggaggtggcgcggaggtttggggcggagggtgtggtgtcggtttgcaatgctttgatttgtgggctgtgtagggaggggagagttggggaggtgtttggcttaatggatgagatggtggggaacggggttgatcctaatgttgttagctattcgagtgttattagttggctttcagatgttggggaggttgagttggcgcttgcggttttggggaagatgattaggagagggtgcaggcctaatgttcacacgtttagttcgttgatgaaagggtatttcttgggagggagagtgggggagggggttgggctgtggagggttatggttttggagggagttcggccgaatgttgtcgtgtacaacacactcttgaatggtttgtgctgcagtgggaatctggctgaggctgtggatgtttgtggtcggatggagaaggattgtttttgccggccgaatgtgactacgtacagcactcttgttcacgggtttgtgaaggctggggatttgcagggtgcttctgaggtgtggaacaagatggtgaattgtggggttcggcctaatgttgtggtgtacacctccatggtggatgtgctttgcaagaattctatgtttgatcaggcttatcgacttattgataatatggctactgatggttgtcctccgactgttgttacgttcaacacgtttatcaagggcttgtgttgcggtggaagagtactatgggcaatgcgtgtggttgatcagatgcagagatatgggtgtttgcctgataccagaacgtacaatgagttgttggatggcctgtttagtgtgaatgagcttaaagaagcttgtgagcttataagggagttggaagaaaggaaggtggagctaaatttggtcacttacaacactgttatgtatggattttccagtcatggaaaggaggaatgggttttgcaggttttggggagaatgttggtaaatggagtgaagccagatgccattactgttaatgtagttatttatgcgtactctaagttgggtaaggttagaactgccatccagtttttggatagaattacagcaggaaaggaattgtgtcctgacataatagctcataccagccttttgtggggtatctgtaattcgttaggcattgaagaggcaattgtgtatctaaataaaatgttaaataaaggaatctttcccaatattgccacttgggatgtgttagttcgaggcttctttaagaaattgggtcatatgggaccaatccgcatcttggatgatatcttgggaaaaggataa

SEQ ID NO: 2633 - DNA, 246 bp, Glycine max
  Peptide Sequence Number=SeqID_119411
atggagggtggaacacccactatgttgttatcagtgcagggtttggcggcgcgaggtcgctacgaggatgacattggcacgaaggagtctcaagaacacaaacgaagaaaggatgaagatgatggggaatatcacaaaaagaaagaatggggaacgaaaaagaagtgggagaggaagataggagagggaaacatgagagtgagtgatggaatgaagggttatctggagactcctttcttgatttaa

SEQ ID NO: 2634 - DNA, 2273 bp, Glycine max
  Peptide Sequence Number=SeqID_119412
atgttagtgtcatggaatattcgggggcttaataaagctggcaaattaagggagattagctcccatctccttaacctccaaccaagtattgttgttttgattgagactagagtgaaggaagctaatgcacataaaattcgtggtaagctgggtttgaagggaaaatacttagataactatagtcatcatgggaatggaagattatggattttttgggatgattctaaacttgagttaagatatgttaggagcagttgccagcttattcattgtagtgttcatgatgtggctggtaaattcaagttctggttaactacaatttatgcacataaccaacttgacaacaggaaaaagttatggcttgagctggatgacatttataagaatcagcagggtccctggtgtgctgttggagattataataatgtgcttaatagtatggataaaattggagggcagctagttactgaagctgaatttaaagatttgcgtgcaatgatggagaatataggtttatgtgaaatggatagctcgagtgaattttttacgtggtctaataaacaagcttttgctcctatttactcaaggattgacaggattcttgcaaatgtggagtggcttcaggatcacgtgggtgcttcacttgatatcattcctgctcatatttctgaccatgccttactgcatcttcactttcctgatagcgttaagaagcacaagctgttcagattccacaatgggtggaccaatgtcttaggttttcaggatattgtggacaaaagttggtctaaggatgtgaagggcctgcctatgcagagattgtggaaaagattgatgagactaaaaaatgagttactaactcttaacagaaaatttgatattcaaaagaaagtgcaatctgccagaattgatcttgctgaagcttttgtggagttgaggactaatcaaacggaagcctctagaatcaataaagtaaaggagaagactgagagcttgatttattggaatgaaatggaggaaagggatcttatgcaaagggcaaaaatagattggattagtcttggtgatggtaatacaaaattctttcatgcctacttgaagacaaagcaaaaatctaccactatgaagatgcttcagaagttggatggatcagttatcaccaatcatgctaatattgctcaggaagttattgagtattatagtagcttaatgggtcataatagtcctcatctcaatcatatagatatcaaagctctaagagaggggaagcaattcagtttggatgtttgggagattgaattggctcttcaaggtattggagatttgaaatcccccgatttggatggatacaatgcaaaaaattttaaatcttgttggggtatcgtgaaaaatgatgtcattgatgctgtcaaggaattctttgagaatgatagattatttcttcctttcaatagaactcttgtcactttgatccctaaaagtgaagatgcaaaatcagtgagagattatagaccaattgctggttgctccaccttctacaaaatcatatccaaaatcttgactgcaaggttggggagtatgatgcctagtgtgatcagcaaggcccatgctgcttttgttccaggtcagaacatccataatcacatactacaggcatacgaactaatcaaaggctactctaggcgaggaggaacccctagaataatgatgcaattggaccttcaaaaagcatatgacatggttgattggactgctttggaaactatcatgaaagaattagatttgccgggtaaattcatcacttggattatgaacattgtaactactgtcagttatgtgtttaacataaatggtgaaatctcaaatgatatgtttgctaggagagggatcagacaaggagatcctatctcccctctgctgtttgtgtttatcatggaatatttcaatagacttatggagcagttgcagctaaaccctaacttcaaccatcatgcgaaatatgagaaattgggtatcactcatcttacatttgttgttgatgttctgttattctgcaggggagatactgtttctatggaaatgatgattaaaacaatcacggagttctctaacacgacgggtttagtgattaaccctaccaaatgcagaatttattttggtggaattaatagcgttgataaagctagttttcagtctgtggcaccgttttgtgaaggtcaattaccttttcgatatcttggtgtgcctcttacggacaagaagctggatataaa

SEQ ID NO: 2635 - DNA, 327 bp, Glycine max
  Peptide Sequence Number=SeqID_119413
atgaattcattggctagcgctgttcatgtgtccgcccccaacgagtctggagccccgcgaattcattgcctagcgctgttcgccaattctccattctccactcttattcagagacccatgaattcattggctagcgctgttcatgtgtcctccaccatcgagtctggagcttcgcgaatttattgcctagcgctgtttgccaattctccattctcaatctttaggagacccatgaattcattgcctagcgctattcatgtgtcctccgttatcaagcgcggagcctccgagaaagaagaaggagagacgagagtcgttatagactaa

SEQ ID NO: 2636 - DNA, 540 bp, Glycine max
  Peptide Sequence Number=SeqID_119414
gcagagttttctgcctttgccctgttttgcttgagaaacgaggatatgggctatgtgggagtacgtgggctcagttggaggtgggcaataggggatggtgggtttatgcgcgatttgtggatgtggaaaacttgttgtgcaccatcacccgaccgccacctagtaccacatgtgatggagtggtacctggagatatgtcgtgggggtcaggagaccttggggacgtcaggcgagctcctggcagtcaacagataaaaggaactaagacccacaaagcaaggaggcttgtgtggtggctggccagctgtgaaactttgattgatataagggatatggcctctggtaatcgattaccaagggtgggtaaatcgattacaaggcttaaaaatgaagaccaggaggctaagatggtctctggtaatcgattaccaagggagtgtaatcgattaccaggcttgaaaacgaggcagcatgttgtggaggcctctggtaatcgattaccaggctgtgtaatcgattacacagaggaacatgccactg

SEQ ID NO: 2637 - DNA, 314 bp, Glycine max
  Peptide Sequence Number=SeqID_119415
gatttacatgcgattctcctcaaatttcagccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaaatagatatgggagcaaggattgcctttgtggataactgggcggtgggtaaggagaaggtttattattggctgagtaatgacattgttgggttggtgggaaacttggctgtatag

SEQ ID NO: 2638 - DNA, 297 bp, Glycine max
  Peptide Sequence Number=SeqID_119416
atgacacaagatcacgagaaacttgattcagatttaattgccacttgtatagtaggcatgatcagagaagacccatcaataaaaatttctttgattcaagagaggattaacagtgaatttgcgtacaaggtgtcgtacaaaaaagcttggttggcgaaacagaaagccattgcaattgaatatggcgattgggatgagtcatatgcgaaactttcgtcgtggctaagacacatgcaaaatcattctcctggatcatattttcaagtactacatgacgattttatcgttgggaatacg

SEQ ID NO: 2639 - DNA, 309 bp, Glycine max
  Peptide Sequence Number=SeqID_119417
atggaagctctcaagatattcaaatggtcattatttttcactccgatgtccgattcaggcacatcacatatcgagatgctcaaaattgaacaattgaagctctcgaaatattcaaatggtcttgacttttcacacggaggttcgattcaggcgcatagtacatcgagatgctcgaaattgaactacggaagctctcaagaaattcaaatggtcgaaagttttcactcaaatgtccaattcaggcgcatcgcatatcgagacgctcgaaatagaacaacggaagctctggagatattcaaatggtcataa

SEQ ID NO: 2640 - DNA, 384 bp, Glycine max
  Peptide Sequence Number=SeqID_119418
atgaagttattgtcgtttgaattagctcagaggttctacattcaatttcgagcgtctcgatatgtttcaggacttggtacgaaaattgaccaagaggagttgagaatctacacaagtgacattcaaagggaagttaatagcgtggagcctgactcaatcagacatccgagtaaaaagttattgtcattgaattggctcagagattccacattcaatttcgagcatctcgatatattacgggactcaatcagacatccaagtaaaaagttattgtcgtttgaattggctcagagcttcaacagtcaatttcgagcgtctcgatatgttacgggactcaatcagacatccgagaaaaaagttattgtcgtttgtattggctcatag

SEQ ID NO: 2641 - DNA, 678 bp, Glycine max
  Peptide Sequence Number=SeqID_119419
atgaaagctattgtagtcgccctgcctgtcgtgatgatcccggctaccgttctggcggcaaatacggaagaagggtattacggttcggcaaaatatctgcagattgaacagcgggccaaagagatggataccagctcccgtccgggtgtcgggcagtttgtgggcggtaaagagaaagagcattttggcggcgcggcgattgccgcaggttaccagttcggtaacggctggcgtaccgaaggtgaatacacctttaaacaaaaaacggagtacaccagcggctccagcacattcgcaaacaactttaaccacctgcagaccaaaacagaacgtctgatgctgaatgtctaccgcgattatgaactcggctacggtgtctctgtttacggaaccgcagggcttggcgtgagcaagatcaaagcgggcggctggcagggtaacgccggacgtgaatatgcctcgacaacacaaagcaacctgacttatgcgttaggggcgggagtaagctacacgccggttgaacgtctgtatgtcgatctgggctatcgttatatcgatatgggtaagattgaaagcggatataacaattttactaacgcgcgtggcttaaaagatgagcagatgaaggcgcacatcgtctctaacgaatttacgctgggcatgcgttacgtgttttaa

SEQ ID NO: 2642 - DNA, 225 bp, Glycine max
  Peptide Sequence Number=SeqID_119420
atgccgatctcccctacggaagtattagttggtctgtgccgtcccgacataggtagggttcgcacccacaaagacatccagtggacccggagaagtccaacagggccctggggtttccagctctggttacaggcctctgttagtcctacagggtgcccgttccccccagcaaggtcatgccatcgtgacataggtaagtacgcacgtggcttaactgatttctga

SEQ ID NO: 2643 - DNA, 498 bp, Glycine max
  Peptide Sequence Number=SeqID_119421
atggatcaggttcaatgtcaatcttttagcaaggtatatggaaagatttgggatctagcaatgatagaagtgtcagttgaagtcattgcagctcttacccaatactatgaccaaccgctcagatgcttcactttttgggactttcaattggcaccaaccatagaggagttcgaggggatcttaggatgcccgataggaggaaggaagccataccttttttttgggtactacccttctgtggcaaaagtggcaagagtagtcaaaatctcggaacgagagttagatcgagtcaagcagagtaggaatggagtagtcggtataccgaggaagttcttggaggagaagacggaaaccctgacaagccaaggagagttggaatcattcatggatgtattagcactactagtgtttggggtggtactacttctgaatgtagatggacttgtagatctagcaacgattcatgcctttcttgcttatcaccacaacaaggtgtag

SEQ ID NO: 2644 - DNA, 675 bp, Glycine max
  Peptide Sequence Number=SeqID_119422
atgcccgctgccattcaacgcaaccccgggactcacatgcttgtcgaaatcaacaaggacggaatgctcatccatgcgcgcgtcaggaacgcacgcagccccgccatcgagagaggaaagcggaccgccgccatcaccggcatcgtcgtgcaccagaccgatgccaacacggcccagtcttcgctcaacagctacaggaacccgaaggccaatggggcgcacttcctgatcgacaaggacggcaccatctaccagactgctgccatctatcagcgtgccaaccatgtgggcccgctgaaggcgagatgcctgcttgtggggaaatgcaaggccagggactatgaaggactgaaggcaaaagaggtacaccgcatcgagatgctgaaggctcctggtgaacgctatccgagcaatatggaggccataggtatcgagatggtcggccgagcagagctgccgaagggattcacaccgccacccagaccaaggggctggactaccgaagagttacgcggatggtttggtatctatcccacgccgactgaggcacagaaccgagctctgacatggcttgttggagcgcttcaagattccatgcagctatcgcccagcgagctcttcaagcatccggacgtgagccgaaaaaacctgaccgaagcgggtgggatcctctag

SEQ ID NO: 2645 - DNA, 489 bp, Glycine max
  Peptide Sequence Number=SeqID_119423
atgacttctgctggacctgccttctctttttccggaactccgactatcacgactgcgaaactaaactggaagaactatttgtcctggtctgcttcggaaaaaggtattgatattgttccaagtgacagaaaatctgagtgggagaagctggattatcagctatgtgctgtcttgtggcaatcggtcaaggcagatgttttggagatccttagatcgttcaaaacatgttgttctttttggaagaaggcccgagaaatctttgccaatgatattcagagtttgtttgatgctactatgaaggtcacagccctcaaacaaaccagtcacgacatgattgcacacataggtaaagctcgggctgcagtgaaagagttaaagaggtttcttgtggctgattcgctggaagaagtgaataagaagctggataagttttatatggttcttatcttgaggagtcttcatgcagattgtgatcacatgcgtgaccaa

SEQ ID NO: 2646 - DNA, 2634 bp, Glycine max
  Peptide Sequence Number=SeqID_119424
atggatatagcaaaggaaattgcagtgcctttggctgctgagcatttgcttccgcgcttgaagaaagcactgaatgcggtcatgaacgtccctaaagatgttgctgacatgaaaaacaaacttgataggattcaatccatcattcatgataaagagaagaaggcagcagatgaagaaggcaacaaggcaaaggtgaaacagctggtgcaaacatcctttcacatggaagatattattgatgaatgcgccattgttgaggaaaggcagcttcgtgatgatgctggatgtgtagctctaccttgcaaggccgttgatttcgtcaaaactaaggcctcttgccttcattttgcgtatatgaatgagggagttgaatcagaaattgctgcaacgaaggacaaaaatgagagcgagtttggctcccaaatgcatcctcctggaggaaaccaaaactccatgttccgtaaccttcgagatgctcctctttacatcaaggatgatgaagttgtgggctttgatgtcgcgagaaatgaattgattggttggttagttagtgatagatcagagcgcacagtcatctctgtggtaggaataggaggtctaggaaaaacaactcttgccaagaaagtttttgacaaggtggctgagaagttcaaacgccatgcatggatcacagtgtctcagtcctacacagaggtaggactgttgagggacttgttgcaggagttgcgcaaagaaaacaaggagaatcatccacaaaatctttctacaatggatcagaagtcactgagagatgaagtcataaaccatttgcgcgacaagaggtatgttattgtgtttgatgacgtgtggaatacaagtttttgggatgacatggaatttgctttaatagatgataaaataggaagtagggtctttatcacaaccagaaacaaggagtgtggaggtttgccactggcaattgtggccattggtggtcttttatctcgcatagaaagagatgcaacctgctggaaaaagtttagtgaaaatctaagcaaagaactagaggatggtctatctcctgtgacgaaaattctgagtttcagttatcatgatttgcctgacaatctcaaaccatgcttcttgtattttggagtatatccagaagattatgaagttgaaaatgtaagattgattcgacaatgggtagctgagggattcatcaaatttgaagctgataaaactttagaggaagttgcagaacaatatttaagagagttgattcagagaagtttggttcaagtatcctcatttactggtgatggaaaacctaaattttgtcgtgttcatgatttagtaggagacatgatccttaaaattgctgtagatttaagtttttgtcattttgccagagagaatgagaatctgttagagagtgggattatccgtcggctaacaatagcatctggttccatcgatttgatgaaaagtgttgaaagctctagcattcgatctctacatatttttagagatgaattatcagaatcctatgtgagtagtatccttatgaagaagtacaggtttctaaaggtacttgattttgaaaaagctgcattgtttaattgtgttccagaacatttgggggatttattccttttgaggtacttaagcttcagaaacacaaagctaaacgatcttccaacatcaattggtatgctccacaacctagagaccttggatctaaggcaaactatggtgtgcaagatgccaagagagattaacaagcttaaaaaactaagacaccttctagcttatgatatgtctaaaggggttgggtatgggcttcaaatggagaatggaattggagacctagaatctctacaaacactacgtgaagtggaaacaaatcatggtggagaagaagtatttaaagagttggaaagacttacacaagtaagggttcttggcttgaccaatgttcagcaaggattcagaaatgttctatactccttgataaacaagttgcagcacatggagaagctatacattgctgcaatagatgaacatgaagtcattgatttgaattttattgtatctgagcttgtacttcagaatagtcaattacagaaggttcgtcttgtagggaggttaaatgggttcccaaactgggttgccaagctacaaaatcttgttatgttgtccttgtcacactccaagttaactgatgatccattgggattacttaaagatctaccaaatttgttgtgcctcagtatcctttactgtgcatatgaagggagctgtttgcattttccaaacggggggtttccaaagctagaacaaataataatcagacgcttgtataagttgaattccatcagaattgaaaatggagcattgccttctctcaaaaagttgaagttagttagtatctcccaactgacggaggtgccttctggtgtctgcagcttaccaaagcttgaggttttccatgcaattaatatgtcaaatgaatttgaagaaaactttcatagcaaccgaggacaacgtgctcaatggataatagagcaggtgccatttgccctgggatttaactttcacggacttctaattctccatgtggactttgacaacaacagcgttgaatcatcatga

SEQ ID NO: 2647 - DNA, 1014 bp, Glycine max
  Peptide Sequence Number=SeqID_119425
atggcaaaggtggccttcatatctttctatgcaattcttctacagaagcctggggaaggcaaagcttcaaaacttgcaaaaagggtgattgcttgtctcgatgtgagaacaaatgataagggggaccttgttgtaaccaaaggagaccagtatgatgtaagagaacatacaaaagagaatgaggtaagaaatcttggcaagccagttgatcttgctggacagtactataaagatggagctgatgaggtcagctttctaaatattactggatttcgcgacttccctcttggtgatttaccgatgctgcaggtattgcgatacacatcagaaaatgtttttgtacccttaacagttgggggaggaattagagatttcacagattcaactgggaggtactattctagtttggaagttgcttctgaatactttaggtctggggctgataagatttccattggaagtgatgcagtttatgctgcagaagaatatttaaaaaccggagtaaagactgggaagaccagcttggagcagatatcaagagtttatgggaatcaggcagtggttgttagtatcgatccccgtagagtgtatgtaaaggatcctaatgatgtgcaattgaagaccataagggtttcaagtccaggttcaaatggagaggaatatgcatggtatcaatgtacagttaatgggggacgagagggccggccaattggtgcttatgaactagcaaaagcagttgaagagcttggtgctggtgaaatactacttaattgcattgattgcgacggtcaagggaaaggatttgatgtagatttaattaagttgatatcagatgctgtaagtatccctgttatcgcaagtagcggtgctggtgctcctgaacacttctctgaggtgttctataaaacaaatgcatcagcagcacttgctgctggcatttttcacaggaaagaggtgcctattcagtcggtaaaagagcatttgttgaaggaaggcatagaagttcgaatatga

SEQ ID NO: 2648 - DNA, 300 bp, Glycine max
  Peptide Sequence Number=SeqID_119426
atgacgtggaccaccagtgaggagaagctagagaaaatgagaggaggaagaactacttggggttgccgtatcgatgacttcatcaacgtcgtcacaggcggtgatggagaggatgaggaagttgagttgtcaaagaagagatctcgaggcgcttctttaaaagatccacgcttgtgcatcaaaaccacctccttcatcagtctcatcgtcccggacaaggaagcgccaccgcgttctccgatgatatctccacctctagaatctagcttttgtgggctttcttggtgcgggaaatcgtga

SEQ ID NO: 2649 - DNA, 195 bp, Glycine max
  Peptide Sequence Number=SeqID_119427
atggttgaagatccaaccgtggccaaattagaggcctgccaaggcatagatataaatgaacctattcatccattcaacacaggagagcatcaacacgagaagcgctctaggcgcaattccaacccgagagggaactgtcctgagtgcgaattgtcgtgcttagcgccaaaaatggactcttgcttagtgatatga

SEQ ID NO: 2650 - DNA, 435 bp, Glycine max
  Peptide Sequence Number=SeqID_119428
atgatctctaaggtacctacatacgacgctaaagatgtggaaaatcatgtgcaaactgtgcatcgtgatgaatccgagttgaaacataagttggattctcctgacagaagaccaaatttccctcatcgagagcacgaggtaatacatgtcatagcaggagggttcgtggatgctactttgggtcgaaacctggaagtctatgtagatgacttgataatcaaaagaaacaacatgtgtccatggcaaaagaaacctttgctcaactacgaaagaagcagggcaattttacaaggtatcctcgctcaaacaaggtataagccactcaagccaactcaaattaaggagaagatgaaatattacataagatatctcccttcagtgaggagcgcaccagatagtgcgtctagaaactcaattagttggaaacagagataa

SEQ ID NO: 2651 - DNA, 609 bp, Glycine max
  Peptide Sequence Number=SeqID_119429
ggactagcactggctcttgagcttgagataagtccttcagttgctcgtgtcagcacaaataagagttgtgttgatccctcagggaacaacccaaacacgagtgacttagagaaatgcgggttgtacgtcgaaaaaaatccggcccggctagttgccctaggaagactttatgagaggtcgacaatcgttcacaacatccatttatgcaatgatcaagtcaaggttagtgttgaggaagttagagatgcaaatgctctcattcttgtacccactcaagagggaactgtgggaccggcgaaacttgcagataggccggatcatgatgtcaatgatcccctctattttatgacattgaccatcccacaaatttttctaaagttgttgcagatgcagaattcaaagaggaatgtgtacctaggagcctacttgaatggtactttgaaaggatttgacgatactccacaaagtaaatccacgactgttgttaggtggattgttgttaaatatttcaatgctgctagaccattggaaccagagatattgaaggcattccacattcagtgggcaagctactatttgaaagttaaaaatgaaacaattagtgtttaa

SEQ ID NO: 2652 - DNA, 309 bp, Glycine max
  Peptide Sequence Number=SeqID_119430
atggctacaccacccaactcccctactcctcctcctcctactgattcaacatcacattcaccttctaccatgaagaggacaagaaaattcaagtctaatttgacgtcaaaatgggcacttacagccaacaaggatggtgtctatgacactgtttgcgaaaagtacgacattagcaaggagaagtggacgcaattttgtcagagccgcagagacctttcgtgggaggagaagaaaaagaaacaaatggaggaagctgctacatccgaaagcactaacaccgtcattgatcctccatctcccatcagatga

SEQ ID NO: 2653 - DNA, 1251 bp, Glycine max
  Peptide Sequence Number=SeqID_119431
atggactacgccagcgaagtggatgcggacgcggaaaaggtcatcgtcaaggaactcaagcgcgcctacccggactacggcatcttcggtgaggaaggtggcgtgcagggcgagcgccgccagatgtgggtcatcgacccgctggacggcaccagcaactacctgcgcggcgtgccgcactactgcgtgtcgatcgccctggtcgaaaacggcgagccgaccgatgcggtcatcttcgacccgctgcgcaatgaactgttcaccgccagccgtggcgcgggtgccgtgctgaacgaccgccgcatccgcgtggccgaccgcaaggatctggaaggcacgatgatccacaccggcttcgccccgcgcgagcgttcccgcgccagcgcccagctcaaggcagtcgacgccctgctggtgcacggcgaggacatccgccgtaccggttcggcggcactggacctggcctacgtggcctgcggccgcgccgacgcctacttcgaagccggggtgaaggcatgggacatcgctgccggcctgctgctggtccgcgaggcgggcggcaaggtctgcgacttcaagggcgcgaccctgggccgcatggacaaccgtggcccggagacccaccagatcgtggccggcaacctgaaggtggccgagtcgctgcagaaggtgctggtgaacaccgcgatccatggagacggcacctgcgaaggtgccgttttcgtatccgcggtgatcgtgcttgtcactttctttgcgcgcaaagaaggtaaccaaagaaacgctccgccggccgcgagccgacgcgctgcgcacgccggtgccctgcgctcctcggcccgccgagggacggtgcgggaactcgctgcgctcagacacccacacctcttcgccctcgccggacctgcggtgctcggctcgcttgaaggcggactggaagctgtagcatttgaccttgggtccgccttgagcgagccgagcatcgcaggggaatcaggggcgaaggggcgccgatgtttgagcgaagcgagttcggcgccgccccctgattcgccgagaagcgcagggtaccgtcgcgtagcgacggctcgcgccccggcggcgtgtttctttggttactttctttgcacgagcaaagaaactgacacctccccgcaggcgcggaaacgatccgccaggcacgacccggcatcagcaatgcatccccacaaacaaaaacgcccggcgcgaggccaagcgttcctgcactag

SEQ ID NO: 2654 - DNA, 367 bp, Glycine max
  Peptide Sequence Number=SeqID_119432
atggtcattctgcgccctttgtcattcagtagcagcaagtcgagtgataaacgcgcagagataaattatggtcattctgcgcctttgtcattcaggagcaacaaattatggtcattccgcacaccttttcgccatccagaggcgatcgtgtccgatggtgcgcagagacaaattatggtcatttgcgcctttccatccagtcccgatcgtgtccgatggcacgcagagacaaattatggtcattctgtgccttgtgtcaacaaagaggagcgaattcggcagtatcaggatgatgttggtcgttcggtgctgatcattttcaaaatttttgcaggttctactggcggggagatttaccggccgaatg

SEQ ID NO: 2655 - DNA, 279 bp, Glycine max
  Peptide Sequence Number=SeqID_119433
atggcgcttgggatgtctgaaggaagagagaagcaaaaggtcatccctgaccatgtcattcactacattttcactagcatgcctattgaaacatatgtcaaattggctgatgataacttaaaaatttggacactacattggggttcatcaatggtggcttattgtcaacttggacaaggtcgaaaatactttattagattatttccaattaacaaaaatgatgtggttaaattcatacgtgttgttgttaacaaattagatgttgcttggatatcataa

SEQ ID NO: 2656 - DNA, 213 bp, Glycine max
  Peptide Sequence Number=SeqID_119434
atgttctgtcatggaaacttatatagaggtagttgtcatcctagaagtagttattgtggtggttattgtagcgattatcgtagtgggagtgtggttattatagtggaagtgcgtggttattgtagcagttatcgtagttggagtgcggttattatagtgggattgcggttattatacatatttgatagacctttaaatatcaagaggcactaa

SEQ ID NO: 2657 - DNA, 132 bp, Glycine max
  Peptide Sequence Number=SeqID_119435
atggctgcagttcctcagattccttcaaatggtcctttctgcatttgtcaaaatcttgtaatggaaacacaaagggcctggctaaataagaaagcatggtttttctgggatttcaaaaacttagggttataa

SEQ ID NO: 2658 - DNA, 114 bp, Glycine max
  Peptide Sequence Number=SeqID_119436
atggagagggttgtctgggtaccatgtagtggaagtttggattgtagcgaggttggccatggtggtctcaagacgatccacacaggcggtggaaagttcggtgtccaccattga

SEQ ID NO: 2659 - DNA, 876 bp, Glycine max
  Peptide Sequence Number=SeqID_119437
atggcttcccgtaagagaaaagccacaacttcagtgtcccatgccggatatgacaaatcaagacttgtatcacaggaggcctgggaccgttactcagataatgtgcttgccaggaacattctgccagagagaaatgtcaagttgtatatcactgaatttgatgattttagaagagaactaattagaagaaactggcatagacagcagaccaatttggctgagggaagcattgatgtggcaattgtgaaggaattttatgcaaacctatttgtccatgatgacacgtctcccaagcaagtcagggttcgagggcaccttataaaatttgatgttgattccctcaacaccttttttgagacttcaatggtagtggagcaaggggagagcttaccttcttactccaggggatttgtacttaatgttgagggtctgccgtggaagctcttgaggaaagatcttaccactctggcccaaacctggagtgttctatcttattctaacttggccctaacatcccatacttctgatcttaatctggatagggctaagttagtttatggacttgtaatgaagatgaacatgaacttgggatcacttatttctgggacccagaaatccaaggctagaagatctgaggccccatctacttttgctccccctgcgtctactccctctacttctgctcttccttcaccgccagcagctccagtttttccaagtccctctgctcagagcttagagtctcttatgtctatgctgcagagcctgcatcagggccaactcctgatcatgcagagtttgcaggatgtggcccagcaacgaccagttatgagcctggagaagtttgttgagaaggtggcatggccaggagtttag

SEQ ID NO: 2660 - DNA, 504 bp, Glycine max
  Peptide Sequence Number=SeqID_119438
atgattgaaaacattgttctaacccgtcgatatgttaaatggcttcacctgctatacaacaacttcactgcattttctggagaccaagaacatttaatctcgttcagtgaaagaaatgagattattgcagcagattatgtagaagcttctgatcaacagaggataacgacactggtaactcaatatggcatcgtctacatcttagagcttgtcaaatactatgacaacaactctcaagcacacatcaatgaggatcttgtgaatttggtaaaagggttaaattttgtacctacatttatgttagaaaaagatgcatcatacgaagagttcttaaacagagttcatgttgccgagctagttcttaggccaaaaggactttcgaaaattcctcatccttggttgaacatctgggttccaagatctcgaatctcatatttcaatgatggtgtcttcaaggacattattcttaagcaaaatattgctgtcggaatctctttagtctaa

SEQ ID NO: 2661 - DNA, 297 bp, Glycine max
  Peptide Sequence Number=SeqID_119439
atggcgagtaatttagcattttccattgctattgctgttgtatggctatctagcatactagtgttcacacaagcacaatttcaattccaacctcaaccgattatgaccccattggcagtttttgagccatcttcagttagtgacatctcaagtttgataaaattctcaaactctcttgcaacccctttcaccatagcacgagatgcggtggtgttaaatataactaatctcaatgattttcgaaatgggttagggattttggtggctgattgtgatcatgatgggaagagtagttaa

SEQ ID NO: 2662 - DNA, 615 bp, Glycine max
  Peptide Sequence Number=SeqID_119440
atggagtgtcctttcctactccaacctcaccctcacctctcacatgtccgatctgaatatggacagggcgagatctcacagatggcccagtccaactcctctcggctaggattccctgcacttattacaacactatgcatcgccagaggagtggtccttgactcacttacttttgagtccttgagccctgccattaatttggcatacatcaggaagaattgttggaactcggatgatcccatgatcacatttatggggactcgcaaggctcgggctcgagtacctactgacgcttctactccccctgctctaactccagtaccagcaccctccagcccctccactcagagcacagacattcttgtgtcgatgctgcagagcctccaccatggcttatgcctggtgatgcagagcatccatgacttggctcagcatcggcccattatgagcatggaggatttcattgctcaggtggcctggccaggagtccatccttctcctttgggggaagagctcctaggatccctggcccactccaacaccgaatacatctctgccagcccatatgctccctcctcacctcaggataagcctacaccggcacaggagagctga

SEQ ID NO: 2663 - DNA, 1845 bp, Glycine max
  Peptide Sequence Number=SeqID_119441
atggagaagttgcaggaaattgcagcatccttggctgttgattatttgcttccacccttgatgaaagctgtgacctcagtcatggaggttccaaaagatgttgcagagatgaaagacaaacttgatgggattcaagccatcattcatgatgtagataagatggcagaagctgaagaaggcaactcacatgatggtctcaaagcaaaggtgaagcagcttgtggaaacatcttttcgcatggaagatatcgttgatgaatacaccatccatgaggaaaagcagcttggtgatgatcctggatgtgcagctttaccttgtaaggctattgatttcgtcaaaactacggcttctcttcttcagtttgcatacatgaatgaggatgttaaatcagaattttgtacgatcaacgagaggaatggaaatgaggatagctccccaatgaaatcttttggaggaaaccaaaacatcacgtttgacaaccttcgaatggctcctctgtatcttaaggaggctgaggttgtgggctttgacggccctagagatacattggaaaaatggttgaaagaggggcgaaaaaagcgcactgtaatctctgtggtaggaatgggaggactcggaaaaactactcttgccaagaaagtttttgacaaagtccgaacacatttcactctccatgcatggatcacagtgtctcaatcctacaccatagaaggactgttgagggatatgttgctcaagtttgtagaagaagaaaaaagagtggatcattctcagaatgattattctacaatggataaaaaatcattgatagatcaagtgagaaatcagttgcgccacaagaggtatgttgttgtgtttgatgacgtctggaataactgtttttggcaacaaatggagtttgctttaattgataatgaaaatggaagtaggatactgatcacaaccagaaatcaggatgttgttaattcctgtaagagatctgctgttattcaagtgcatgagctgcaacctttaacacttgaaaaatcattggaattgttttacaccaaggcatttggatctgaatttgatggacattgtccaagcaatcttaaggacatatccactgaaattgttaaaaagtgtcaaggtttaccactagcaattgtggtcattggtggtcttttattcgatgaaaaaaaagaaatacttaaatggcagaggttttatcagaatctaagttctgaactagggaaaaatcccagtttatctcctgtcaaaaagattttgaatttcagttatcatgatttgccttacaatctcaaaccatgcttcttgtatttcggaatatatccagaagattacgaagttgaacgtgggagactgattcctcaatggatagctgagggattcgtcaaatctgaagcaacaaaaactttagtggaagtggcagaaaaatatttaaatgagttaatcaaaagaagtttggttcaagtatcttcatttaccaaggttggaaaaattaaaggctgtcgtgttcatgacctactacatgaaattatccgtgagaaaaatgaagatttaaggttttgccattctgccagtgaccgtgagaacttgccaagaagaggaatgattcgtcgcctaacaatagcatccggttccaacaatttgatgggaagtgttgtaaactcaaacattcgatcacttcatgtttttagtgatgaagaattatcagaatcctcggtgaagagaatgcctacaaagtacaggttattaagggtacttcattttgaaggcgattcactgtataattatgttccgctcacagaaaattttcaggatttatcccttttgacgtactaa

SEQ ID NO: 2664 - DNA, 231 bp, Glycine max
  Peptide Sequence Number=SeqID_119442
atggctaagaaggcttctctcttggctctgtttttcaactcctcctctagtttccggcaacttcagtgttttaaaggctacttggacgtttcagcttctgaaggctcgcttagcgagattggctcgctaagcgagaggtttcccaacacgctaagcgagctgcatgcctcacttagcggatgtcactcgctaagcgcatatgcctcgcttagcgagacatcaactgcttga

SEQ ID NO: 2665 - DNA, 2721 bp, Glycine max
  Peptide Sequence Number=SeqID_119443
atggataaattaaaggaaattgcagcgtccttggctgttgattatttgcttccacccttgaagaaagctgtgaactcagtcatggaggttccaaaagatgttgcagacatgaaagacaaacttgatgggattcaagccatcattcatgatgcagataagatggcagcagctgaagacagcaaatcacgtgacgaaatcaaagcaaaggtgaagcagcttgtggaaacatcttttcgcatggaagatatcattgatgaatacaccatccatgaggaaaagcagcttggtgatgatcctggatgtgcagctttaccttgtaaggctattgattttgtcaaaactacggcctctcgtcttcaatttgcatacatgaacgaggacgtgaaatccgaatttggtggaatcaaggagaggaatggaagtgaagatagctcccaaatccaatcttctggaggaaaccaaaacgtcccgttcgataaccttcgaatggctcctctgtatcttaaggaggctgaggttgtgggctttgacggccctagagatacattggaaaaatggttgaaagaggggcaagaaaagcgcactgtcatctctgtggtaggaatgggaggactcggaaaaactactcttgccaagaaagtttttgaccaagtccgaacacatttcactctccatgcatggatcacagtgtctcaatcctacaccatagaaggactgttgaggaatatgttgctcaagtttgtagaagaagaaaaaagagtagtggaacattctcagagtgttcctacaatggatcaaataaataaaatggataaatggtcattgacagatgaagtgagaaatcacttgcgccacaagaggtatgttgttgtgtttgatgacgtgtggaatactcttttttggcaagaaatggagtttgctttaattgatgatgaaaatggaagtaggatattaatgacaaccagaaatcaggatgttgttaattcctgtaagagatctgctgttattcaagtgcatgagctgcaacctttaactcttgaaaaatcattggaattgttttatacaaaggcatttggatctgactttaatggacgttgtccaagcaatcttaaggacatatccactgaaattgttaaaaagtgtcaaggcttaccactagcaattgtggtcattggttgtcttttattcgacgaaaaaagagaaatacttaaatggcagaggttttatcaaaatctaagttgtgaactaggaaaaaatcccagtttatctcccgtgaaaaggattttgggtttcagttatcatgatttgccttacaatctcaaaccatgcttcttgtattttggaatatatccagaagattacaaagttgaacgcgggagattgattctacaatggatagctgaggggtttgttaaatctgaagcaacaaaaactttagaggaagtggcagaaaaatatttaaatgagttgatccaaagaagtttggttcaagtatcttcatttactaagggtggccaaattaaaagctgtggtgttcatgacctagtacatgaaattatccgtgagaaaaatgaagatttaagcttttgccattctgcgagtgagcgtgagaacttgtcaagaagtgggatgattcgtcgcctaacaatagcatccggttccaacaatttggtgggaagtgttgtaaactcaaacattcgatcacttcatgtttttagtgatgaagaattatcagaatcctcggtgaagagaatgcctacaaactacaggttattaagggtacttcattttgaaggcgattcactgtataattatgttccgctcacggaaaattttggggatttatcccttttgacgtacttaagcttcagaaattcaaagatagtaaatcttccaaaatcaatagacgtgttgcacaacctagaaacattggatctaagagaatctcatgtgcttatgatgccaagagagttctacaagcttaaaaagttaagacaccttttagggtttcggcttccaatagagggtagcattggagatttaacgtccctagaaacactgtgtgaagtggaagcaaaccatgatacagaagaagtaatgaaagggttggaaagacttacacaattaagggtgttgggcttgacccttgttccgccacatcacaaaagttctctgtgctccttgataaacaagatgcaacgcctggacaagttatacattactactccattggcattatttatgcgcattgatttgcaatttgatgtatgtgcacctgtgcttcagaaggttcgcattgtaggggggttgaaggagttcccaaactgggttgccaagctccaaaatcttgttacgttgtccttgagacgcacctatttgactgttgatccattgcctctacttaaggagctaccatatttgtcatccctctttattaatcgtagtgcatacgagggtaaagttttgcagttcccaaacagggggtttcagaacctaaagcaaatactactgggaagcctttttattttgaaatccatcgttattgaagatggagcattgccttctctcgaaaagttcaagttagtcggaattcccgaactgaaggaggtgccttctggtctctacaagttaccaaagcttgaggttttccatgctatcaatatgtcagatgaatttcaagaaaactttaatctcaacagaggacaaggccctgggatttaa

SEQ ID NO: 2666 - DNA, 714 bp, Glycine max
  Peptide Sequence Number=SeqID_119444
atggagggtggcattggagttctaacgtccctacaaacactacgtgacatggatgcagaccatgatgcagaagaagtaatgaaagagttggaaagacttacacaattaagggtgttgggcttgaccaatgttcgtgaagaattcacaagttctctgtgctccttgataaacaagttgcaacacctggagaagctatacattaatgcaaaatatatacttggggtcaatgatttgcaatttgatgtatgtgcacctgtacttcagaaggttcgcattgtaggggggttaaaggagttcccaaactgggttgccaagctccaaaatcttgttacgttgtccttgttgcatacccgtttgactgttgatccattgccactacttaaagatctaccaaatttgtcgtccctctgtctcctcaagttttcatacattggtgaaattttacagttcccaaacaggggatttcaaaacctaaatcaaatactactgaatcgcttgattggtttgaaatccatcgttattgaagatggagcattgccttctctcgaaaagttaaagttagttgatattccccgactgaagaaggtgccttctggtctcagcaagttaccaaagctcgaggttttccatgttattgatatgtcagatgaatttaaggaaaactttcatctcaacagaggacaacgtcaatggagaataggccatgggatttaa

SEQ ID NO: 2667 - DNA, 462 bp, Glycine max
  Peptide Sequence Number=SeqID_119445
atgtactctactctgtctttcactccgccatcggtgcacaatggggtgaaggttgctaaattgaagccagacttagtggcgaaagaggcggatagatggaagaatgctctcttaggttgcgtctacggtctggagcctagattcaagaagattgaacgcttcgctctgaatagatggaaagatcaaggtatgctttctgtgcacatgattaaggagaacctattcctctttttgtttgactctgaggatagcaaactgcaagtattggagggaggcccagtatcttttgatagaaggcctttgatttttaaggaatggggagagagaatggagatgaaaatagatgcttctttcaagaccccaatatggatcaatctccctctatttccatgggaattatggggtgttgatagccctagtgctatagcaagcaagtcttttgggcatacctctatttactga

SEQ ID NO: 2668 - DNA, 724 bp, Glycine max
  Peptide Sequence Number=SeqID_119446
atggtctcaaattgccgcacgtctccctggtcgcacagacaatgagatcaagaatttctggaactccacactgaagaaaaggttgaaaatgaacaacaataactccactttatcaccaaacaatagtgactcatcagggcctaaagatgtcaatgtcatgggtggaatcatgtccatgaacgagcatgacctcatgaccatgtgcatggactcctcctcatcaacatcatcatcatcatgcatgcaatccatgcatgccaccaacatggtactaactaacccctttcccttgttgcccaacaaccgttatgacatgatgaccggtgcaaccggtttccttgacaacatggctgctgcatgcttaacccaagttggcatggtagatcatgatcatggggttgttcatgggacattggagcctaataaaacgcgtttaggaagcgacttttcccttcctccactagaaagtagaagcattgaggacaatagtagtaccccaattgatcatgtgaaaagccataacaacaacaaccacttcaagaatagttgcttcaataacactgatcattaccatcatattcaaagctccaacaacgtagttgtagaggatttgtttgggtttggaaatcatgggcaaggggaaaactttagaatgggagaatgggaccttgagggcttgatgcaagacatttcctattttccttcccttgatttccaagtttaa

SEQ ID NO: 2669 - DNA, 1314 bp, Glycine max
  Peptide Sequence Number=SeqID_119447
atgaatcctaaccgggatgggataaaaggacctctgattgtagagccagaagccaaccatggggaatcagtgacaccaagcaatgatgctcaaatcgctccgctgcaacgactctcatttcagatgagcattcttctcaagttggcgaaggtgtccgatctactagctctactccaaccaatccggagactacaagaccttcatctcaatctccaccggttcccacggaaagcaaagcattacctaaggtggatcatttatctatcaaaactccttccagtttgccataaaccttcttggctaactgttgacatcatcttcaatctcagactattgggattggagcaagagtggaagaaagaaagttgtctttatcttctcctccaaccggtacctcctcccgacatgaaggaatgcccgataatcgggggctacgtatcttcccttgcatgcggatctgaaagtcgtggatctcctgatggccgctgtcgagatgcctgcctttcctgggggaacccttccttgcattctattattgtattcgcttcaatcgctcccgaatcggcagatcaaagatcggaataccagcctttaactgctagaggtggattggttgagaggccaaatgctatttgcttgcttctcctgttcgctctagttcacctggtttacaacgcggaaagacttttaataattccacctactagtgatctcatgaaagggaagacttttaaacaagactttctttctcttgcaccacgccggaacgtatggacactgcctaaagttaagaagactaagaacagggtttacgaacaggggcctggaccagaaagctttaatggcgggggcagaaacggaagcaatcttttagtaatccacagattaggaaccgagtggggaatctcaaagtctctggtctctcaaagtggtgctgctgagtttgccaaaagatttcgagttaagaatataacttatgatttatctccagtgtcgattcgaaacttgctcaactctcatcacttgcctggtacggtgttgcttttgaatacctatggtatcaaacgattctcgacgctagcaaggttgcatttttccttcatgccattgtcggggaagctcttacagttttcgaataaatggaaaaaatcctcggtttcctttaagaggaggaatgccagtactgattctctgaacttgaagctcgctcttcgacccgtaccgtaccctgtacactcggctattctcccgattataagtaaggccgatttcgctacttcatataggctactctatgagagaagacctgcataa

SEQ ID NO: 2670 - DNA, 585 bp, Glycine max
  Peptide Sequence Number=SeqID_119448
atggatctgggaaacaatttaaacagaaggttgagtatgaatggaggcctaaacctactgttcagaaaattcaagaggaagaaaaggggggtacatagggagaggcacaagtccagcagagctacaattactcaggaatggaggccaaaggaagaagaaaatgtggttattggggacaaattagctgtgattgagaaagtagacaagactaatgaggaactggacagtaagaagtcagaaagcgttaaaggcaaagccattcaacagactcctactatggtgaagaagcctttggttataatcactactgagcgagaacaggtgagaattcaaggagaaggatcatcaccccctgtgataggggtaaatgatcgcaagctggaatatcgtagcttagaagggaatccatcaagcaaggtttttgcttctttccattctttcttatactctggtaggtcagtgatcgagagattatgtattgaagaaataaccgatgctctttccgctcttggtggaataactgcagttggtgctttatgctttagtaggggcattatcttctgtttcagaaagaactctgagtga

SEQ ID NO: 2671 - DNA, 339 bp, Glycine max
  Peptide Sequence Number=SeqID_119449
atgaggaaacctgatatgatgggaaaagacaaaatcaacaacaacattaagagcaagctaaggaagggtttgtggtcacctgaggaagatgagaagctcctaaggtatatgatcactaagggacaagggtgttggagtgacattgctaggaatgctggtcttcaaaggtgcggcaaaagttgccgtcttcgttggattaactacttgagacctgatctcaaacgtggtgcattttcacctcaagaggaagaagtcatcattcacttgcactccattcttggcaacagcctaaaagcatgtcaggggttttgccttaactatcatggtctagctttctga

SEQ ID NO: 2672 - DNA, 285 bp, Glycine max
  Peptide Sequence Number=SeqID_119450
atgattacctcagagaaatttgttcaaccatccattccaaggtttgatggacactatgatttctggtccatgattatggaaaatttcctacgtagcaaagaattatggcaactcgtggaagatggaataccaatgcttggtgcaacacccactgaggggcagaagaggagtgtagctgaggcacaactaaaggatctgaagaagcacgtcacaagcaatctggagatccatgcaacagaaatatcagggatcaacgagggtgttgaaattgctacaaatttctag

SEQ ID NO: 2673 - DNA, 306 bp, Glycine max
  Peptide Sequence Number=SeqID_119451
atgactaatgcaaactgtccgcaagagtcaatgcattcagtctcaaacgggaatctaaggtttgacactgcacaaactcttgtatcaaggttccttcaggtttcttcttttttcgaggacgagggtgagagccccgtcgagtcttatgaaacaaaagtccaaacttggagcagccaacattacaggaacaaacctgtggttgttgttgctgctccacgattgcaaaagtattctagttttgatgaccatagtggggagaagcctctacttttgcctattcgaagcttcaaaatctcgcttatctga

SEQ ID NO: 2674 - DNA, 246 bp, Glycine max
  Peptide Sequence Number=SeqID_119452
atgaataaaacagaagacgaagaggacgaggatgtgggactttccccggagttagaaaggatagtcgcccaggaggaccaagaaatggggcctcatcaagaagagacagaactggtagacttgggaactggcagtggaaaaagggaagtaaagataggcacggaactacgtaggtctgatttccttatcgcaattaaggaatacgtaggagcaagggaaataccctcgtcgaccgcaaaaagataa

SEQ ID NO: 2675 - DNA, 417 bp, Glycine max
  Peptide Sequence Number=SeqID_119453
atgtattttggagtagtgggtgatggcagcaaagggccaccagatggcaggggtggcgataaacaacgtgttctattcaaagatatgatcatggggaataaggagattgctccaccacgtcaaaaggttgatttgatatggcaaaaaccagcaacaatagtgtacaaggatgacaatcgtgtgaagccaatggtgcacatagttgactttgtttttgaagttttgtgtgcgccatgggaagatgctttggtcgccaagcttcttggaaagtgtattggttacaatgtaatgaaagacaggttaacatgcctgtggagattaattgtagggttcgatatccttgatattgacaacaatttctatatggtgaaatttgatatggagatggacataaccaaggtcatgaaggaagggtga

SEQ ID NO: 2676 - DNA, 1206 bp, Glycine max
  Peptide Sequence Number=SeqID_119454
atggcttcccctctcacttctatgctatgccgcaacaatttcctttggtcctcacaggctcaactttcttttgacaacttaaagcaagcaatgacgaaggcgccagtgctcacagcccctgatttctctttgcctttcgttgtggaaactgatgcatccgatacacctctcggcggccatttcagggtaaccaaaacagctcatcgcattaaagccaatttcacctgggatactttgctttccgatgtcaaggctgttacagccattgcccatcccttctggcatctgggaagatttatcactggatttcgttacccatctaccataatcccatatatggtggtggtcgaccgcttttctaaaggtgcacactttggtgtagtgccccgacaattcttggcttataaggtggctaatctattcttggatactgtttgcaagcttcatggatttccccaaagcttagtctccgacagagagcccttattgatcaacaatttttggagagaattattccggattagtggcacctcatttaggatgagtaccgcttaccatccccagtccgacggccagacagaggccactataaaatgctatgcagatgctaaacgccgtcatcaggatttccaggaggaacaatgggtttatgtcaagctccaacccttttgccaaacgacggtctcgagaacagcccaccataaactcaccaagcgctatttcgaaccttttgaaatactagaactcattggcaatgtggcgtattgccttcgcttgctagcaaattcccacatccatccagtatttcacagctctttgttatgcccccactatggtccccttgttctcgacaccaatccattacctccacatgtggttcacaaccaccctattctcgaaccactcgtaaaacttgattctaagtttgactcttccactaccctacccacacgaatggtacttatccaatggcaaggttttccccctaaggaagccacttgggaaaagtggtccacggtgtctgatgtgttgcacctggaggacaaggtgcatttgtcaagagatgttattgatagcaatcagggtcacaacccttcacctcttgaggaattggaagttggagtccaccaagaggagataccagcccaagaaggtaggcccaaaaggaacaacatcagacctggatatctgaaggatttcgtgtag

SEQ ID NO: 2677 - DNA, 1158 bp, Glycine max
  Peptide Sequence Number=SeqID_119455
atggcagcgatcttagacgattctggttcaatactgttgcctgagattatgtggcctagatactcgagttggcgttgggcgaataagcacttggaacgtttgaggaaaagtttagcattcaacaggggaatcactatagataaggatatcatcaaagaagatgaccgtgaatttcctcaaggcgcgttgcataaactgaacaacatcacgcagtattcacaatggccatggaggcgtgaccaaggtcatccaacaattcgtcgatcgttggcatgggtaaacgatcacgaacagtcacagcgattaaagcacggagaaatggctttggctaacacggttgaggccagattcgaggaggaggttgatgtggtgggtaatctgacgtggagggggaagggtagttggtttgaggaagatgggggtaaattgggaaatgatgacttggatagcaggtatgggttggggaggttcaggagggttgggttgtgggccattggcaacatcaacatgaatggtaaagaaattgcccatatgttcaaactgcatggagagggtgggataagcgtgattccttgtgttcgaggccaagagtttatcaggtctgatgctgttccttttgggcctaccttcatgggccggtatctcctcttggtggacttcagcttccagttcctcaggagcattcttcttgctttggccgcggctattggcactccaatacgagtggattctacaatgttggacgtaaggcgtggaagtgtttgtgtgaaaatcgatttggataaaccagtgatagagaaggtttggctcgaagaatgttgctccggcggcggcggcaccaatggtgatgcgaagggcaagcaagttgttgttgcatctatgaggcaggatgcggggtccacttcatcaaacattccaattggaaacttcaatacaaataatgggaatattaatggcgaagacaagtcaattactgccaatgatgagctgcatgtccccatgcaagctatttcacccaacagatttgttgtactacaaggaaatgaggatgatcaaatgcaacctatggagataggaaaatcaactgaccaaccaatggtgggccagcaggatatggtacttgagacatccttgggtgaccataatgcgacaacttag

SEQ ID NO: 2678 - DNA, 795 bp, Glycine max
  Peptide Sequence Number=SeqID_119456
atgttggggaagaggccccagccgcggattggaaaaatctccgaattattggtctccggcgactgcaccaccaagctttttgatgccctcggaagaagccctagaagcccgtttgacatgatgaacttgaagatgcaatcaccaaagggtcttaaaagctatgaccttggtggtgtaggtctaggaattgtggtggcccttgataaaaaatcatcatccgaggaacaaggccatgacgttgtgcccaaacacgccgttatttgcacgtcaaattcaaaccgatccgtaccaatcccagttaaaaaccatcaagggtttcaaaagggtgtgaatgaaattcccgttggaagctccgaggattacacgtttgtgacataccatgtacctaacaacaagaccatcactaaggtttattatgatggcggtgaacgtggaattctaacacatggctgctataatattaacaacaacaacaacaacaacgttggtgttggtggtgttagaagaatcccaccaacgcaaactttaaatattgaagaagatgaaccgtcatatcccacctcggattttctcagctcgtgtcacttgtgccgaaagaatctccatggcaaagacatttacatgtacagaggagaaaaagcattttgtagcaacgagtgtcgttcaaggcaaatatcaatggacgatgaacgcaaggaacggtgtagatcagaagcttcaaggtctgtggagatgtcaagttcaccatatacagcaagggaccaaatgttttcaactgggattgtggccctttag

SEQ ID NO: 2679 - DNA, 2520 bp, Glycine max
  Peptide Sequence Number=SeqID_119457
atgaccacaagcgctctagaaattccacgtccttctttttcaactccaccggttcccccctcggctgtgttggcatcagggtctccttcttcctcttcccaccccaatgtctccttagataaaatctacagttctcgtgatgtcgattcactatgggagactgagattgccaagtggagggccactactcaaaatgtttggagagtggagcatcctaaggtggccaatgccattgtagccttagttgaggtcgtgagttcaaaccatcgactattattcaaggttggtaatgttcttgtcaagctgctgcgcaccagattggatggtgatgagttgcttaggcgctgcaagggcttgcaaagggagaaaaatgacttgacagacaaagtggagagcactgcgatagagaaggatgagcttgccaaggtggttgctgacctccaggcccaattgaaggagtcagagtccaggctggaggagtttgagttgagggcatcaaaagagagggaggccagcaaaaagcttgaagaagagttgttggtgtataagaaagaggttatggagaagcatgaaaagggctttcataaggccgttaggcaggacgtgaaggatgatgttctgcttgaggaaagagagatagttgttgaggaggaggatgccggcgaggaacagggcattgggatgacacgagataatctcgtgtttgatttcgacctgcttaaaggtcttgtcactcatcttggtgatgcttcctttttctttgcaaagcttttccctttatgcttgagtgatcttaccaagggtgtgccttatatttttttaagagtgtgtaccaaaggtgcaccttgggtttcttgcattcctatagagataaaatttaagaatatgaaagcttgtgaaggggacgcattcgtgttgggttttggagaggcgaaccttgggtttgtccagcctttggagaagcgagactcaccaagggtgtaccttgggtttgacaagcctttagagaagcgagactcaccaagggtggaccttgggttttatgagcctttggagaagcgagactcatcaagggaaaaccttggggcagaccttgggtttgatgagcctttggagaaacaagactcacaaagggccgaccttgggtttgacgagcatgcgaagatgcgaccaggaatgccttcgtcctgggttttgttagggctcaccaaggacttgagaagggaaaagagtacaacacccggtcttccagcttgctatgaccctgaatgggccttcccagttgggaccaagctttcctgctcggggatcttttctggcttcaccttggactcgccatacaagggctttaaggatgactctgttggttgcctccgcttgaccgttggtctaggggtgtttgatagagtttacaaggccatacttgcatatgaggtgttttcaggtgaacttctctacctcgatggctggaatttctttatttccatcccctatatggcgaaaggccaaggggaaatcatgctatggatgttgtcggggggtgtgcatggaacatttgcgaattcttggcattttttgcacctccttgtgaagtcaaaggtgtcggccttaagtgttggccaattgtgcctgacgaacttgagcaagggtgttgttaacccttttttgaatagttcgccatcaaggatgacatatctggccttctcctcctttcctgccatgacctccttggtgtctatggttggtgcttggaaggtctcctggatgatggtcttgaggagcaagggtacttcaggctttgatcgactcaagatcggtggtgttgtgatagttttcttaaaggctaagaaggcttgctcgcaagcttcatcccacgggaatggctcggtttctggagtagcttgtagaatggcctttccttctctgcaagcctcgggaggaacctggacaaagatgctatatcatcgtgcacttgtcagggttggcttcatatccccggtgaataatcatgaagcctataaattttccactgcaaaccccaaaagtgcaattttcaggattgaggcacatgtcgtacttgcggatctctctaaatacctcttccaaatctaccatgtggtgggtcacgctataagacttgatgaccatgtggtccacatagactttggcattcaggaatatttgtcatcggtccatgagcctttggaatgtggctcctaccttcttcagttcgaagggcatgaccctgtaacaaaaattggcgtcttcggtgatgaaggcggttttttcctcatcgggagggtgcatcctaatctggtaggtgtagtcagtgcacatatgccatttgccattggccttttctaccatgacaatgacttctgctacatgtttgtacttgtcgctaatgaagtccttgctgagctaagtacactacccagttgcttcgtagacggccagggtccttattggagatttttcgcccacgctcatgacttgactgtcgctaccaccaaatgtggg

SEQ ID NO: 2680 - DNA, 459 bp, Glycine max
  Peptide Sequence Number=SeqID_119458
atgtcgtcttctcctagtctagagcgtgcatttggatctagttgtatccagagtacgcgtccaggatgcttagaacttggaacccaaatgctccatcgactagcctatggattttgggcagagggtatgtatccttggggcagcccctgttcagatcagtgtagtcaatgtacattcgccatttgtcattggccttttgaccatgacgatgttggcgagccaggtgggatatctaacttctcttatgaagttggctttgagaagcttgtccactacttcttagaccgctttgtgtcgttcttctatcatgttcctcttcttctatggctgccaagcgaacaggtccctattgagctacatacactgcctgggtttgggttcgagctgcagcttgacgagttcttcgataggctttgggcctctatcaaaagtgttgttgtgtggatctacattgaatag

SEQ ID NO: 2681 - DNA, 429 bp, Glycine max
  Peptide Sequence Number=SeqID_119459
atggccaaactgcgacctcacaggcaactcttagctattggaacatcatacttagagcttgccaagtgttattatgaaccatttcaaatactggaacgaattggcaaagtagcttacagctctaccgccatagatgttgataacaaacccgtcatcaccccctttgctattctcaacaccaatttgaatcactctactgctgaaccacgattgatggtgcttatgcaatggacaggcctccatcctaatgatacctcatgggaagaatgggccaatgtgaagggtacctatcaccttggggacaaggtgttattcgatgggttaagggatgataggcaaaggactatggtccaacaggacactagagtcggcagtgaaaggctaaaaaggaaaattaatccacccaagcacttagaggattacgtttga

SEQ ID NO: 2682 - DNA, 1086 bp, Glycine max
  Peptide Sequence Number=SeqID_119460
atgagagaacttggtacttatagtgtggagaggaagttgcgggtccttgttgatagaggttgttacggtgacgtaacagccctggcagataattatcggcttgtagataaaagccaggccctaaggatgactctgttggctgcctctctatctgactgttggtctggggatgttcaacaaagctttgaattaggtgccattgttggtgataatggtgtacgtgaggccatacttccatatgacgtgtttctaggtgaacttctctacctcattagctgtgatttctcaaagtggtcttgcctcgatccacttgggccaaagggagctcagattgtggagattgtcaggaagaggggtcatccaatttggttcctctttttctccgaccataacttcctcagtgtctatgctgggagtttggagtgtctcctggatgatagtcttgaagtgttcgatctttttggtgttgcccaacttagaaagcaagtttgctttggtgttgctctccctagcactgtttccttggtctggtatctgttggcaacctgcccttggacaagctttgaagttgagcttgagggcttgctctatagtgacattattaggtccttcgaggatgattcctaccccgctccctttcacgttggacacaccgtcaacatagaggctccaccagtctcaagtgatcaaactctaaaggttctacggaccatgccaccatcctccctgctagttcatgcttcgcaaaacctgtttgatggggtagttcgtcttgactaccacttgatgactctagaaatagggcctgagacgtcaggccgagtgcttcttggtgtcatggggtatacggatggtgaagtagatagagagctagtgcttcccttcctcttgactggcgatgtggcaatggtcttcttgaaggctaagaaggcttcttttggaggaacctggataggaatactagtctaccatttagcttatggacttcctggaccccaggaacttgcctctgttgaccttgaaagtacattttttcgggttgaggcgcatgtcctatttgcggagctcttcgaagacctcttctag

SEQ ID NO: 2683 - DNA, 210 bp, Glycine max
  Peptide Sequence Number=SeqID_119461
atggctttgtaccctggtgctaccaatctcttagcaaaatacaatggctttgaataccaacactttgatggtcacaacttggattgggcaaaatcagaagataaggcttatggtggccgaaatcaacctccgtggtggcgaagcagagagattgagggagcgaggtcgagcaaaggccccaaagtaagagtgcggagggacctcgattag

SEQ ID NO: 2684 - DNA, 615 bp, Glycine max
  Peptide Sequence Number=SeqID_119462
atgatcaagaaagccaaagagctagcaatcctctgtgctacacaagttggccttgttatattctccagcacgagaaagctttatgaatatgccagcaccaactttacaaagtgtataattgctaaatgttgctcttgtattccattttttttcagaggcctgtgctccttcttcaccgacgactctagggttttgcctcacaactccaggatctctcttgctttcacattacttcttcttctcgttggtttagtctcccttttcaccatcttcaataatctcgttagtcctcatctctttggctgcattttcagattcactactaaatcactaatgcattgcatccttcttcgcctttcgaatgcgccttacttgtgtaaaaacgatgggattgttcttcactgcccgtatgttaaagaatcaccatcactttgggaaaatcctttctcttccacaacatcttggaagccctgtgctgagcgccaggatggtgttttaccaggtgtcataccttctttgttttattcagaggaaaatagtggttcacgacttccttcagcacaatcctattgtagagagaaacattctcactcacaccaaaagcctatgccttga

SEQ ID NO: 2685 - DNA, 405 bp, Glycine max
  Peptide Sequence Number=SeqID_119463
atggcgaggattcctaacaagattaggtctattgatggatcaaaagagacgcttaagcttgctgttagaatcaccgatctttggttcgttgggactcccaacaagtctgagcaagaggaaatgatttttgttgattctgagggtgatcaaattcatgctatttgtaaatcggaccacctcaagtcttggaaagctgatttgaaagagaattgcacttatgttatgcataatttcaaagttgtcaagaatgatggtcaatttagagtgtgcgaacatgagtacaagttattttttattggagtgacggttgttagagaagctgatttgcatgaactgccttttaagttagatttgttgaatttgcaaatgtcgttgctggcaattttgtggctggcctgttggttg

SEQ ID NO: 2686 - DNA, 297 bp, Glycine max
  Peptide Sequence Number=SeqID_119464
atgccactgatcaccatagaggaaaatgctacataccacttcctattcgagcgtacccctcaacatgagattaaccatattgtttcctactatgcttactttggatttgtgtggtcggacaaccctttgcaattctcgcagcaattctttgggtatgatggcaatgggaggcctattagatctaccttccatcgggatacaaccattgaagtcaacgaggatgtgggagatttcagcgacgatggggatctcacactatccgagatcactttctaccaggatgtctacggtgaatag

SEQ ID NO: 2687 - DNA, 359 bp, Glycine max
  Peptide Sequence Number=SeqID_119465
atggttgtaacaacatgtcctgatgttgtggttgtagagattgagtccttaaagttaaaccatatgacgcaatctaaaacccttgactcactgatcagtttggaggccctcttggtagctttcgatccgtgtttggttccaccccagcatcatgtccaggatggggatggcctttcttttctttgcttggttgctcctttgttgttgtctcgcgtggtggtatacgtttatgaggtggtagcaagggaagttgcaaccaaaaccaatgctaccaacaacactataatgtatttgggagacattttgattgaattagctctcacggttttggacaatattggtgcagaaaatagagcagg

SEQ ID NO: 2688 - DNA, 228 bp, Glycine max
  Peptide Sequence Number=SeqID_119466
atggcaaaaagtgattttggcatgctaagaagtttggccgccataggactgtcatatgatgctgattgtggccaagttgatataccaattggttttgcaactgttgagaaggatcttcctgggggcttgacacctatgcttggtgatcgaaaggtagagcattttctgggaattaagaggaaagctgaaccatcaagctcggataccccaaaaaagcctaaatcataa

SEQ ID NO: 2689 - DNA, 2226 bp, Glycine max
  Peptide Sequence Number=SeqID_119467
atggagaaattgcaggaaattgcagcgtccttggctgttgattatttgcttccacccttgaagaaagctgtgaactcagtcatggaggttccaaaagatgttgcagacatgaaagacaaacttgatgggattcaagccatcattcatgatgtagataagatggcagcagctgaagaaggcaagtcacgtgacgaaatcaaagcaaaggtgaagcagcttgtgaaaacatcttttcgcatggaagatatcattgatgaatacaccatccatgaggaaaaggagcttggtgaggatcctggatgtgcagctttaccttgtaaggctattgatttcgtcaaaactacggcttctcttcttcagtttgcatacatgaatgaggatgttaaatcagaatttcgtaggatcaacgagaggaatggaaatgaggatacctcacaaatgaaatcttttggaggaaaccaaaacacgtttgacaaccttcgaatggctcctctgtatcttaaggaggctaaggttgtgggctttgacggccctagagatacattggaaaaatggttgaaagaggggcgaaaaaagcgcactgtaatctctgtggtaggaatgggagaactcggaaaaactactcttgccaagaaagtttttggcaaagtcaggacacatttcaccctccatgcatggatcacagtgtctcaatcctacaccatagaaggacagttgagggatttgttgctcaagtttgtagaagaagaaaaaagagtggatcattctcagagtgattattctacaatggataaaaaatcattgatagatcaagtgagaaatcggttgcgccacaagaggtatgttgttgtgtttgatgacgtctggaataactgtttttggcaacaaatggagtttgctttaattgataatgaaaatggaagtacgatattgatcacaaccagaaatcaggatgttgttaattcctgtaagagatctgctgttattcaagtgcatgagctgcaacctttaacacttgaaaaatcattggaattgttttacacaaaggcatttggatctgaatttgatggacattatccaagcaatcttaaggacatatacactgaaattgttaaaaagtgtcatggtttaccactagcaattgtgaggttttatcagaatctaagttctgaactagggaaaaatcccagtttatctcctgtcaaaaagattttgaatttcagttatcatgatttgccttacaatctcaaaccatgcttcttgtatttcggaatatatccagaagattacgaagttgaacgtgggagactgattcctcaatggatagctgagggattcgtcaaatctgaagcaacaaaaactttagaggaagtggcagaaaaatatttaaatgagttaatccaaagaagtttggttcaagtatcttcatttaccaagggtggaaaaatcaaaggctgtcgcgttcatgacctactacatgaaattatccgtgagaaaaatgaagatttaaggttttgccattctgcgagtgagcgtgagaacttgccaagaagtggaatgattcgtcgcctaacaatagcatccggttccaacaatttgatgggaagtgttgtaaactcaagcattcgatcacttcatgtttttagtgatgaagaattatcagaatccttggtgaagagaatgcctacaaactacaggttattaagggtacttcattttgaaggcgattcactgtataagtatgttccgctcacagaaaatttttgggatttatcccttttgacgtacttaagtttgaagaattcaaagatagaaaatcttccaaaatcaataggcttgttgcacaacctagaaacattggatctaagacagtttgttgtgcgtatgatgccaagagagttctacaagcttaaaaagtcaaggcatcttctagctcatgataggttgtttgggttatttggtgggcttcaaatggagggtggcattggagttctaatgtccctacaaacactacgtgacatggatgcagaagaagtaatgaaagagttggaaagacttacacaattaagggtgttgggcttgaccaatgttcgtgaagaattcacaagttctctatgctccttgataaacaagttgcaacacctggagaagctatacattaatgcaaaatatatacttggggtcaatgatttgcaatttgatgtatgtgcacctgtacttcagaag

SEQ ID NO: 2690 - DNA, 252 bp, Glycine max
  Peptide Sequence Number=SeqID_119468
atgaagcacattgttcttacattctatttgaattttattctcccatgggatatcaagccacagaacattagtttgtttgaagagtctcatatattcaacatcattgatcttggagctgctacagatctccgagtcggcatcaactgcattcctaaggagtttcttttggatccaaggtctccttatgtggtgactcatggtccagaagatgtgactgatgcagctgtaattgcagtcacaatgccattgtga

SEQ ID NO: 2691 - DNA, 204 bp, Glycine max
  Peptide Sequence Number=SeqID_119469
atgaggcatattttattcttatttgcattggatggtcttcggtctactggtattgtgcatagggatataaagtcacagaacattactttgtttgaagagactcgtacattcaaaatcattgatcttgaagctactacagatctccgagttggcatcaactacattcctaaggagtttcttttggatccaaggtatcttcgttga

SEQ ID NO: 2692 - DNA, 318 bp, Glycine max
  Peptide Sequence Number=SeqID_119470
ttcccaaacaggggatttcaaaacctaaagcaaatactactgaatcgcttgattagtttgaaatccatcgtaattgaagatggagcattgccttctcttgaaaagttaaagttagttgatattccccgactgaagaaggtgccttccggtctcagcaagttaccaaagcttgaggttttccatgttattgatatgtcagatgaatttaaagaaaactttcatctcaacagaggacaacatcaatggagaataggccatgggattttagtgtcatggacttcaaattctccatgtggactttcacaacaatggcactga

SEQ ID NO: 2693 - DNA, 1467 bp, Glycine max
  Peptide Sequence Number=SeqID_119471
atggagttcaaagataaaagaatgaaggcaacgtctgagattctgaacagtataagaattctaaaactgcaagcatgggagatgaagttcctatcaaagattattcagcttaggaagactgaggagacatggctaaagaaatttctagttggtacagcaattgttagatttctcttctataacgccccaacttttattgctgtggatacatttggtgcatgtgctcttatcggaatcccacttgaatcaggaaaggtcttatcagcacttgcaacattcagaattcttcaaatgcccatatacagttttcctgacaccatttcaatgattgcacaaactaaggtttcccttgaaaggattgcatcatttcttcgtctagatgagtggaagactgatgtagtagagaagcttccacagggtagttctgataaggcaattgaattagtagatggaaatttctcttgggatttatcttccccttatccaacattgaaaaacgtaaatctcacagtttttcatggtatgagggttgctgtatgtggtaatgttgggtcaggcaagtccagtttactttcttgtataataggggaagtaccaaagatatctgggaccctgaagatatgtggtacaaaggcttatgtttctgaatcaccatggatacagagtggcaagatagaagacaacatattatttggtaaagagatggatagggaaaagtatgatgaggtgctagaagcatgttccttgacaaaagaccttgaggttctaccatttggtgatcagaccactatcgaagagaagggaatcaatttgagtggtggacagaagcaaagagtgcaaatagcccgtgctctataccaagattctgatatatacctgtatgatgatcccttcagtgcattggatgctcatacaggatcccatctctttaaggtcatgagagaaggaagaataactcaatcaggaaaatacaatgacattctcaggtcaggcactgattttatggaacttgtagatgacatagttaaacccaaaggacaactagttcaagaagaagaacgggaaaagggtagagtagggtttaatgtctactggaaatacatcacaacagcttatggaggagctcttgtacccatcatattactttcaacgatactcactgtggcttttcagattgctagcaattattggatgattttggctactcctatctctgcaactgcagaacctgatattggaagctttaaacctatggttgtctatgttgctttgtcaattggaagttccattttcacctttgccaaagcatttcttgctgtgatagctggatacaagacaaccactgtgatctttaataaaatgcatttgtgcatttttcgagcaccaatatcatattttgatgccaccccgagtgggcgaatccttaatagagtatgtcatactatgttgacaattttcatggtttaa

SEQ ID NO: 2694 - DNA, 222 bp, Glycine max
  Peptide Sequence Number=SeqID_119472
atgatcgtcgtaaacgttgtcggaatacaacgacacctgaagcaatgtcggtgcttagcccgacgtagagcttccattttaaccgatgtagatgctctattttgtagtagtgccagtgatgggagttcaaaaggaggtggttatttgtcaactgaagattctcaaggttctgctgaaacaatatttttggaagaaggttttcttgattttttgaacaagtaa

SEQ ID NO: 2695 - DNA, 1290 bp, Glycine max
  Peptide Sequence Number=SeqID_119473
atggctgtcttccctggctgccataccagctcttcttctcctttccacacagccacccactcgcacccatttccgcagcacccttcaccttcgttgccgcacaacccctcttggtctgcgatgcttcccttcaccgtccatggctgccactcaccatacaaagcttccatggctgcctacaaccaccaacactactcatcgtccgccaccgaggaccgccttgaggttgccttagccaaacttaccctcagccaacacaaactcgccgtttcgatcgacaccttagctaccaccatcgacaaccttcttcatcgactgccttgcaattccactccacatttctcatcttcctttctgccgccgccgcctccaccgcagactccgccgccccctccgctgctcaagccaactccatcacccacgtgcaccgcatccataactataccacctccgccagccacgacgcctccgccgccacctccaccagccacgacacctccgccgccaccagttccgcctgtggttcccatacagccgcgacccacaacttggccagacccgcttcctaggcctgttcttcatctgtccgatcacattcgccccaccatgcccttcaccaagctcttcagcagagttcctccgcatgggactgccatggccgtgtacacgcttccagcaatggccgttgcattctgcacaactgctaaactatgtgcaattccccgaaataaaccgtgggatcccgggagtaaagggcttgcaggaagcaaaaagcatgagacccatgcagctggtataatcgtgaaggaagatatcatcgtgctttctagaagatatgtagatgaattaagcgcttttgatatcggaaaatataacaacaagttctcccttagtctctctcttcctcttcttttatggaggttcctagccctcgaagctaggtggttcacattctcaagcttggttcctaacacaaaatttgtagtaattagaatttacactaccactaagagcacatatcatcatatccctacagaccaacctttgaaagtccattcacaattagaattctattccacattcctggtaaagatgcaaagcttagagaacctgtataaaacagccatagagatcttcaaaggatctatcattgagaagaacaaatgcaggcatcatggatgcatgtctgtaccagaagcctggggtgctttgctacaatttgggctatctcttcaagtaatttcttcgactagacacatcctgtggggttacacagtgaacaaagaataa

SEQ ID NO: 2696 - DNA, 912 bp, Glycine max
  Peptide Sequence Number=SeqID_119474
atgaagcatttagaaatgttcaacatggtaagtactcctcatgcaaccactggttctaaatatttgaagttgaaatggaggaaatttggtcacttggctggtcaagttggtggagcaaaaagtttattttgcaggttgtttgggcatgaagctgaaaacaccttttggttgggtagttcatccacagagaagcgtctttgtctcgtgggcaggggcattttcgaactcatctacgatggtgtcttagtagagaccgtcgttgacctagtaacctacaaagacggtgtaacatatccaccgttcgtttgccgacctccaaacgtcgttttcgacccaccaccgccacgttgccgaagtcgtgcccctttgactgccacttgcaactgttcgtcaaggcctgctctcgcttcttctgttggttgcacttctcgggaccggtgccaatacgggttttgtgtctcccactgtatgtgttccctgaatttgtctatggactttgtttctttgcatccaacgctgaagatagctgaggaaacaaccactgcagttggatatgtggtagagcgtttgtatacggaacgagagcatgctgcagctccttattttcgcataaagagagtggagatagaggatcaattgtatgacatgacaagtcctttaactcaaacattaaatcagttatcaatgtctgaaattttaagaaagccgattaataggaagagtcatggtgctagggtcactcttgcctgtcacaagatacccaaatctttgtctgataagccagacatgcttgcagcatggcagccagcatcacaaagcttattgactgtcgttgaacatgagcccaacaacgacagcctaaccttgtcgcacgacgttgttctcatgaatacaatgacggccttaggttga

SEQ ID NO: 2697 - DNA, 475 bp, Glycine max
  Peptide Sequence Number=SeqID_119475
atgatgtttactacttgcaaaggagctacttcatttgaggatattagaacagttgaaaatgttctataccctacatatagagaagcatgcttcacaatgggttttttgcaagatgacagagaatttgtggaagcaatcaaagaagataaggactggggtgtcattactaaacctgaagaagtttggagtcagacatggaattggttagctgaagatattgcatatcattataaaaaaacaactctgaacacagaattacacattgatgatgagcaacttaaaaatttaacattactggaaattgaaaaacttctgcttgcaaacgaaaaatcactcagagactatcctacaatgtcatatcctaagggtgcaaatcctgcatcgtgtctagagaatagcttgatattgtctgaacttaattacaacaatgatgaggctagatcagaattcgaaaatctttttctatccatgacag

SEQ ID NO: 2698 - DNA, 177 bp, Glycine max
  Peptide Sequence Number=SeqID_119476
atgtaccgtgatgcaatccttcctaggaagggaccagtcaccagagccatgaacaagagtctccaagaggattggactagagttgctaaagaaggtcctagggttctcatgaacctcagggtttatagggtaccctacaaattaaggatagggtaccctagtagtatagaattttaa

SEQ ID NO: 2699 - DNA, 243 bp, Glycine max
  Peptide Sequence Number=SeqID_119477
atggctaagaatgaaaaaagcggaattcgaagtaagcacatcgacattaagtacttagccattagagaaagagtaaaagacaagaaaacggtcattaagaatataaacattgagttgatgatcgctgatcctttgactaagggcatgcctacgtttaaattcaaggatcatagagagactgagagcttgaaagaaccaaaacaaggtagctctttcatggcaatggctggaggtacattttga

SEQ ID NO: 2700 - DNA, 201 bp, Glycine max
  Peptide Sequence Number=SeqID_119478
atggttgtcgaggatgacaatgtagatcttgcagtcagtggcaacatcaaaggcactggtgttggtgatataacggtagtttcaaaatcattgttctctaccaatgatgtttcagccagtgacacgatagtctttgttgaagaggtcaaacgttcagtgctagtggtgacggggaggccaaagatcaaattgacctcatga

SEQ ID NO: 2701 - DNA, 273 bp, Glycine max
  Peptide Sequence Number=SeqID_119479
atggatttggatgggatgacaccagaaattgtgtcacttcatcccaaagttgacaatcatgtctacaaagagtttgaaagattgcaaggtatatttggaaaagatcatgcaaatggtcatggggttgagagtgcaacagatgtagtggaaaatgaaattggtgataatcaagttgatggtgaagactggctacaacatgataattcacttctatctaatggaaatacttcggcaaggagtgaacatttttctaccaggcaacctcttaaatga

SEQ ID NO: 2702 - DNA, 438 bp, Glycine max
  Peptide Sequence Number=SeqID_119480
atggatgaaaaccctcgatcattaaaaagaccaatacatatgctaacaagtttctttgaggattggaagcggactagtaaattgttattgaacttgatgagattgaccgtggctacaaatgttaagccatgtatgcccaaaagaggtaatgtattgaagttcataaaattggccagggattattcacattctaacattactgacaaggcactgtgggatacctatcaagaaattaatgccatgttaattcaagaggaagggagattaaagaaaatgaaggataacttagttcatctcataactcatgatggagccagtactagtaaaagcaatttggttaaaaaggaaggagtccgcaaagagaagaaatactacttttgcaagccgaatggtgactttaagaaggtttgtctaaaaagaaagaaatggattgaatag

SEQ ID NO: 2703 - DNA, 341 bp, Glycine max
  Peptide Sequence Number=SeqID_119481
gtctgggaggaggtactggaggtagttatatgggtatctctacattgaagtcttcttcgatgatggtggctcgattagctatcagcgtactgggagctgaaacattcgacaagggtgtcaaagctgatgtcgatgagtcgtccttccctcatagcgatgagagtatgaggcatcatggtcatcctaggtatggatggcttgtcgggggtgtaattccccttgagtacgttcttcctcctcatggtgtggctctatctccacaacatgtgtttagagttgttggagggtgttgtttgtctgtcatggttgttggtggaggattggaggtgtctcgcgtttga

SEQ ID NO: 2704 - DNA, 591 bp, Glycine max
  Peptide Sequence Number=SeqID_119482
atggacctctctcaccctcagtctaacttgtccctcggattttcttcctcccacgcctcgccacctcctcgctccaacccgccagtgtcactgcagctcatggaaccgcagacggagaatggcaacttagatgttgaatcggacgacgatgaggacaaagaagtcgaggaatttcgcattctaggccactcaatatgcctcaagaggcgaagagattgtgactcctcatcctcctcctttgccaccaagagggtttccgtcgagcccgatcttgacacgcataatgtcgttgtgcgcgcgtggggttgccaacccctctacattggaattgttgatgacgatcatgccatgcctatggacatggtcattgggggtgatgagagaggctcttttgactttgtacacaaaagtgggaatgattctagaatcatttgtagtaaaaagggaaacatagaagatgttgctcttgtatttgctcaggacaaggacaggtctctgggtacatcttgttatctttttggtagcccttgcaacctgatgcatgacattcatgtaactactatagtgcatattaccctatttcattgttga

SEQ ID NO: 2705 - DNA, 489 bp, Glycine max
  Peptide Sequence Number=SeqID_119483
gacctcattgaagttcaaagatccagcctccatagaagctccacaagcaagcttccaccaaatcccctaacacctttagacctcattcctctcccacttgacacttcttttatacataaagaaggggaatctaggaaggatagattccctactaaaaggaaatccaagcttagccctagaggggatggaccttttcaggtcttgaagaggatcaataaaaatgcctataggtcggacctcccagaagagtctggagtcagcaccacttttaatatttctgatttaattccttttgctggtggagctgatattgaggaggagaaaccaacaaatttgaggtcaaatccttttcaagggggaggggatgatgcaatccttcctaggaagggaccagttaccagagccatgagcaagaggctccaagaggattgggctagagctgctgaagaaggccctagggttttcatgaacctcaagataaatttttga

SEQ ID NO: 2706 - DNA, 425 bp, Glycine max
  Peptide Sequence Number=SeqID_119484
ggatcgcgcccacaagacacctagtggacccggagacatccaatagggccctggggtttccagctctgtttacgggcctctatcagtcctacagggtgcccgtacccccccgacaagggatcgcgcccacaagacacctagtggacccggagacatccaacagggtcctggggtttccagctctaattacgggcctctgtcagttctacggagtgcctgtcacccccagcaaggtcatcaggcctcctactaatcgagctttcatcaagaggtactgtgcccccaggcaggcgcaaggcaaaacaccacaacagcttggggatggccagcaacaggcaaaaaatgcaccgttgccacctccagagtccctcagctcaaccacaaaaaggttagagtattgcctacgacccatggccgaccaatag

SEQ ID NO: 2707 - DNA, 1312 bp, Glycine max
  Peptide Sequence Number=SeqID_119485
catgccgaccatttccagcccgctgatgcgcggcatctggatatcgagaaacaccacgtccggctgcagccggtggatctggctgatggcttcaatggcgttggcgcattcgccgataatcgcgatccccgcttcagcttccagcaggttcatcgtcaacaatcagtgcgtttaacatcaggcggccctctccatgggaacattgagcgtaatgcgggtgtaggcgtccggtcggcaatccacctgcacgccatagccttcgccgtagcgcacgcgaatgcgtttatccaccaggttcatccccagcccgctgcagttcggcttcggctggaacagcccggcgttgtccgtcacctgcagcagcagatgctccccttcgcagcaggcgccgatttcgatgcggcccacgcccagcagatgcgaggtgccatgcttgatggcgttctcgacgatcggctgcagcgagaacgccggcagccgcaccgccaacagcgcctccggcagcgataccgcgatctccagccgatcggcgaagcgcgctttctcgatctgcaggtaggcgttcacgtgttcaatctcgtccgccaggctgacttcgtcatcggaacgtttgaggtttttacgaaagaaggtcgagagagactgcaccagatcgcaggcgcgctcgccatcgcggcggatcaccgccaccagagtattcaaggcattgaacaggaaatgcggattgacctgcgcatgcagcagcttgatctccgactgcgccagcagctgcttgtggcgctcgtactgtccggccatgatctgcgccgacagcaggctggcgatgccttcgcccagcgtacggttgatggtgctgaacagctggcttttcggctcatacagcttgatggtgccgatcacccgctgattttcgccgcgcagcgggatcaccagcgtcgatcccagcttgcaggcaggattgatcgagcagcagtaagagagctgattaccgtcggcgtacaccacctcgttgttgtcgatggcgcgatgcgaatgcaccgaggcgatcggcgtgcccggcaggtggtggtcgtcgccgatgccgataaacgccagcagcttgtcgcgatcggtgatcgccaccgcgccgatgcccagctcctgatagatcacccgggcgaccttcatgctgttttcctgatcgaagccctgccgcaggatgccctcggtgcgctcggcgatcttcagcgccttggaagagaatgcgctggtgtatttttcgaacatcgcgcgcctatccagcaggatttgcatgaacatcgccgcgccgacg

SEQ ID NO: 2708 - DNA, 2301 bp, Glycine max
  Peptide Sequence Number=SeqID_119486
atgaaggctcctcccagtggttacttgcctaattctggcgaaggggaaaggaagaccatcaattcagagttatggcatgcttgtgctggaccactggtttctttacctcctgttggaagtcttgtggtttacttccctcaaggacacagtgagcaagttgcagcatccatgcaaaaggaggctgacttcatacccagttatcctaaccttccatccaagttgatttgcatgcttcacaatgttgccctgcacgctgatcctgaaactgatgaagtctatgcacagatgacccttcaacctgtaaataaatatgacaaggaagcaatattggcatcagacatgggtctcaaacaaaaccaacaacctactgagttcttttgcaaaactcttacagctagtgacacaagcacccatggtggattttctgtgcctcgtagagcagctgagaaaatattccctcctctggatttttctatgcaacctccagctcaggagattgtagccaaagatttgcatgacaatacatggacatttagacatatttatcgcggacaaccaaagaggcatctactgacgactggttggagtgtctttgttagcactaaaaggctgtttgctggagattcagttctttttattagagatgaaaaacaacaacttcttttaggtataaagagggctaatagacagcagccagcactatcttcatcagtaatatccagtgacagtatgcatattggcattcttgctgctgcagctcatgcagcttcaaataacagcccatttactatattttataatccaagggccagcccttctgaatttgtaatcccatcggccaagtataataaggccttgtacaatcacgcttcccttggaatgagattcagaatgatgtttgagactgaggagtcaggggtacgcagatatatgggtacaatcactggtatcactgatgtggatcctgtccgatggaagaattcacagtggcgcaatcttcaggttggatgggatgaatcgacagctggtgagcgcccgagcagggtttcaatttgggatattgaaccagtggtgactcctttctatatttgtcctcctccatttttcaggcccaagttccccaaggagccaggaatgccagatgatgagtctgatatagaaaatgctttcaagagagcaatgccttggcttggagatgaccttggcatgaaggatgcctctagttcagtcttccctggttttagtttgatgcaatggatgagcatgcagcagaataatcagttctctgctgcccaatctggatttatacccccatccatgctttcatccaatgcactgcatggtaaccttaccactgatgatccatccaaattattgagctttcaagctcctgtcctctcttcaccaaatcttcaatttaacaaacctaatttagcaaaccaagtcaaccaattgcaacaatccccaacgtcatggcctccgcagcagcagcagcaacagcagaagctgcagtcaatgttgcaaacacccttaaacccactccagcagcagcagcaacagaggcaacagcagctgcctgtaccacaaaacctgtcacaaccacagcagcaacagccccaaatgcctcaacagagagcacaacagccacaacaacagcaacagcagtcgtgtcaacagaccatcatgagtaacgggacagttgcttctaaccagattccaaatcagtgtgtacaacaaccagtaacatactcacaacttcagcaacaacaattactctcaggaagtatcccaccccaacaaagttttcaatcacccaataagaatgcattgttgatgacatccttaccacaagactcacagtttcagcaacaaatagaccagcaagctagtctcttacagaggcagcagcagcagcagacacagttgcaatcatctccgttgcagttattgcaacaaagcttgtcacagagggcatcacagcaaccacaaatgactcaaatgtgtcagcaaaacagctcagagcaacaaccacagttgcagttgctacaaaaattgcagcaacagcagcagcagcagcaacaacaacaacagcaacaactcctttccacttctagcccacttttgcagtctcagcttctacatcaacaaaatactcatcaacaaaaccagcaattgccgcagctgcctctatcacagggtcatcagcctcaacagcttggaaacaatgctttctcaatggagaagcttctcaatggaaacaactactctacttcatctctgatgcaaacacagcagctttct

SEQ ID NO: 2709 - DNA, 630 bp, Glycine max
  Peptide Sequence Number=SeqID_119487
atggctccaagaaagctttccgcaaagagatccaggaaggacgccacggctgaagggaccagtgcccctcccgagttcgacagccatcgtttcaggagcgctgagcaccagcagcatttcgaagccatcaagggatggtccttccaccgagagagacgcgtccagctcagggacgatgagtacagagatttccaggaggagatagctcaccggcgttggacgtcgctggtcactcccatgcccaagtttgatccggatatagttctcgagttttatgccaatgcttgccccacggaggagggctggattccttttgatgcagacgccctcagccagttcctgggatacccgctagtgttggaggagggccaggagtgcgagtatagtcaaagaaggaaccgggccgatggatttgacgagaaggccattgcccagctactatgcataccaggtcaggattttgcccggaccgctgccgggagacgggtgcgaatcatgcacaccaacatgactaccttgacccagacatggatgacgttgctgctcaataacatcctgcccagcgatcataactccgacctccctctgccgaagtgtcagctggtatgccgcctactaggcaccctttag

SEQ ID NO: 2710 - DNA, 405 bp, Glycine max
  Peptide Sequence Number=SeqID_119488
atggagccaactaagaaggtagctgattatttcacaagaattctcagcattaccaatttgatgaagggctgtggagagaagcttgatgatcagatggttgtggagaaaatcttgaggtcactctcacctcggtttgattacattgtgtttgtcatagaagaatccaagaatcttgaggatttgaagatagagaagctgcaaggttcattggaggcacacgagcaaaggctgaatgatagagacacaaaaagatccacgcaagatttacaagctcattcctcaaaaggcaaaggaagagggaattggaacactgataaaggaaagggaagtcacaaaactcatagcaagaactctgaagaaactcaatcagaaattggagaatcttcaggacaacataagaatgga

SEQ ID NO: 2711 - DNA, 624 bp, Glycine max
  Peptide Sequence Number=SeqID_119489
tgttatccagcttgcattcaatgtcatagaaaaactgacatccaaacaggaccattcacatgcggatgtggcaaagataatgatcagcctgttctaaggtatagagttgaagtaatggttagccaaaacaatgacagtagcaagtttttgctctgggaccgcgaatgtgctgaattgattggtgaaatagctgatgaagtgaatagggtcaagattgaagatggtgatgttgatttgaatgcttctcctcaagcacttgataggttgttgggttatgtgcttgcttttaaggtcaggattcaatcaaaattcaggaatgtcattgttcttagatactcaaatgaattagatttgatcaatgttgtgctcgacatgctggctgatactgaggtatgttccaaaatagatgcttcgaatgttgattgcaataatgctatgcatcctgaatgtcaatctctgtttgtgacagcagaccatgatccagttgcaggattccctttaatgcccaaaaaatgcctatcatctgatgaagttgatgatgagttaggaagctcccagatttccccagcccaactatcgtctaacaaattaacaagacattctgataagagtgaatttagctga

SEQ ID NO: 2712 - DNA, 294 bp, Glycine max
  Peptide Sequence Number=SeqID_119490
atggcaacaccctctgaaaaagctgcattgccccatctgttgctcatcagctacgttctacacctaccagcctgcatgcacaccacgtccaagcctattttgccaatgatgctggctaaacccgtacgccacgtatttcgccaacgccaatggcgaaacacctcctcaatgctccacgtcagccgctatctcgccaatgccaatggcggctcagctgtatcaccagcatgcatggtggaatgcatgaaaaaagagaccccctgcataaatactttcaaaagagaacctatttga

SEQ ID NO: 2713 - DNA, 543 bp, Glycine max
  Peptide Sequence Number=SeqID_119491
atgcaattgacgcgcctgattgaagtttcaaatttcaaaattatcatcttcgaaccaaaaattactcgtcatcacagctttttggcctctacaaaagagtttccatgttattgtcattcacacagacaagttagttcaatctcagttttaacagaacaaccttgcatcatgaattctgtttttgactttttgagggatgtatctccggtgaaacaaacatggaggtttaaggtccgagtcctttggctctgggagatgtctcctttgtcagaatccaccaaagctttcgctattgaaatggttctcatggattctgaagttcaaatgaattttggaagagtgggagatgttgaaacaaacttggaggttgaaagtgagggtgatccgtctatggaaaaatgtatcggatcagtcaaccagacaaggaaatcacaacaatctttgggaagtagtattgttccagccggatataactactgtcttctcccgtgtctattttcgtttctattttattattctctatttctcattggtcattcatga

SEQ ID NO: 2714 - DNA, 198 bp, Glycine max
  Peptide Sequence Number=SeqID_119492
atgccggtgaagaggcatgcgggggtggaggggcagcggcgagtgggggcgcgtgatgtggggtgggaagtgtgggaagtgtgggaagtgtgggttgttgcggtgattctcggggtggtgggtgttaaggtcagagagggtgaaattgtcattttggcaatgttgtgttgtgttggaacactcttctcggtgaagtag

SEQ ID NO: 2715 - DNA, 246 bp, Glycine max
  Peptide Sequence Number=SeqID_119493
atggagcggtatttacagcacttggttcgccaggaggcggccaaccacagggggcaggtgcagatacatgagtgtctctaccagctcagcctcagtcagcagagccagggtttcactccttttgcgtgccctactccagatcagttcagggctgaggttgcatggcccggagattggcctaaggcccaggcaggggaggcgccccgcagaggctcccggcgatgcagaggaggcccgcatggatga

SEQ ID NO: 2716 - DNA, 1013 bp, Glycine max
  Peptide Sequence Number=SeqID_119494
gaggactacacctcctcgcctttagaggactgcacctcctcatcttcagagggctgcacgacctcacctttagagggctacacgccctcgcctttagaggacttgacgtcctcgccttcagaggactagatgtcctcgtgatcggagggctgcatgccctcaccttcagcggactaaaggtcctcatctttagaggactgcaagtcctcgccatcagagggcggcacgccctcaccttaaaaggagtacacatcctcggcatcagagggctgcgcgccctcagcatcagaggactacacatcctcgcctttagaagacttctcgtcttcagagggctgcacgccctcaccttcagagggctacacgccctcccttttagaggactagacgtcctcgactgtagaggaatagacgtcctcaccttaagaggactagaagtcctcgccatcagagtgctgcacgccctcgccttcaaaggactacacatcctcctctttagaggactgcacgtcctcgtcttcagagggctgcatgccctcactttcagaggactacacatcctcgccatcagagggttgcatgccctcaccatcagaggactactcgtcctcgcctttagaggactacacgtcctcgtcttcagagggctgcacgccctcacctgcagagggctacacgccctcccctttagaggacttgacttcctcgcctgtagaggaatagacgtccttaccttaagaggactagaagtcctcgccattagagtgctgcacgccctcgccttcagaggactacacggcctcgtctttagaggactgcacgtccttgtcttcagagggctgcatgccctcaccttcagaggactacacgtcctcgccatcagagggctgcatgccatcaccttcagaggactacacgtcctcgactttagagtactgcacgtcctctacttcagagggctgcacgccctcaccttcagagggctacacgccctcgcctttagaggactacat

SEQ ID NO: 2717 - DNA, 741 bp, Glycine max
  Peptide Sequence Number=SeqID_119495
atggagaattcaagactaaatacaatgactaatgcaatatgtctgcaagagtcattacattcagtctcaaatgggaatctaaggtttgacactgcacaaactcttgtgtcaaggttccttcaggttttttcttttttcgaggacgagggtgagagccccgtcgagtctgatgaaacaaaagtccaaacttggagcagccaacattataggaacgaacctgtggttgttgttgctgctccacgattgcaaaaatattctacttttgatgaccagagtggggagaagcctctgcttttgcccattcgaagcttgaaatctcgcttatctgaagaagatattgatgttcaatctctgaacatgtcaatgagttctaaaagattttcaagctattcgaatagaaaagcagaagttaaagctgttgatgctgatgatgtcgatgctgaagttcagtctcaaaagaggtcaacatcttccaaaagattttcaagcaattcaaatagaaacacaaaagttgaaggttctagagctgagaacaagaagaaagagagtgtggtgcttccttctcccattccatggcgttcaagatcaggaagattggaacataagcaagaagaatttgatgaagcctctaacatgatgtttccttcttcaaaggaggaatctcaccctgtgaagtctcaaccttcttgcgcttcttcacgagacaattccgtgtctttttctccttcttgtggaatttga

SEQ ID NO: 2718 - DNA, 387 bp, Glycine max
  Peptide Sequence Number=SeqID_119496
cttgttactctatttcttcatcattttgaaattcctcttgattctgaatcttatattccaatcaagagatcctttttaattggtgctgctgcaattgcttcttttggttaccgcaaagagcgtgatggctcttgggtcaaaaagggcactcaacccgctgatgaagaaggcaacctcccaaatgaagataattccactcttcttcgcaggcttatggacaagtttgatggacttcagacttttgttggtgacaagtttgatgccatggaattacaagttgacatgaggttcgatgctatggaatcaaggatcaccagagttgaagaagatgtctccttcatccgaacttgttttgatccaccacctccgcctccttcatcctcttag

SEQ ID NO: 2719 - DNA, 516 bp, Glycine max
  Peptide Sequence Number=SeqID_119497
atggtgggagcaggtttgaaaaaggatcttagagtgtctagggttgtgccaggagggtctcttaatgccttcctttttcttctcatcggagttaatttcacaaagacttgccatggtaaagaagaagggggaacaagcacacttggagagcgcagtgcgatgatttacttcacgggcgaggtctctgctcagttggtagagctccgctcttgcaattgggtcgttgcgattacgggttggatgtctaattgtccaggcggtaatgatagtatcttgtacctgaaccgacgggctgtcaagaacgtagaggagggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 2720 - DNA, 237 bp, Glycine max
  Peptide Sequence Number=SeqID_119498
atgtgtgtatatgatctttgggtagcaggaatacttcaagaaatggctccgaaaaagctttccacgaagaggtctaggagagacgccgcgacggaagggtccagtgccgccctcgagtttgatagccaccgtttctggagcgccaaccaccagcagtgcttcgaggccatcaaaggatggtcgtttcacagagagaggcacgtccagatcagggaggatgagtatacggatttttag

SEQ ID NO: 2721 - DNA, 828 bp, Glycine max
  Peptide Sequence Number=SeqID_119499
ccacgccttcgctcgccgcaaaagggcatgttgcgacagcgctgtttgccaattctccattctcaatcttattcggagacccatgaattcattgcctagcgctgttcatgtgtcctccaccatcgagtctgaagccccgcgaattcattgcctagcgctgttcgccaattctccattctccacttttattcggagacccatgaattcattgcctagcgctgttcatgtgtcctccaccatcgagtttggagccccgcgaattcattgcctagcgctccccgcgaattcattgcgtagcgctgttcgccaattctccattctcaatcttattcggagacccatgaattcattgcctagcgctgttcatgtgtcctccaccatcgagtctggagccccgcgaattcattgcctagcgctgtttgccaattctccattctccacttttattcgaagaccaatgaattcattgcctagcgctattcatgtgtccgccaccatcgagtctggagccccgcgaattcattgcctagcgctgttcgccaattctccattctccacttttattcggagacccaggaattcattacctagcgctgttcatgtgtcctccgttatcaagcgcggagcctctgaaaaaaaagaaggagtagagacgagactcatcatcacggaaagggcaggacggacgaaatcagtgtcttatctttgctttcctcttatctccgatgagagatacttggcaccctttgttgcacaatatgtgaagtcccgagacgtgccgaaaatcgaaaggaagcaggcttacgcgatccgtgaaaattccgtaat

SEQ ID NO: 2722 - DNA, 273 bp, Glycine max
  Peptide Sequence Number=SeqID_119500
atggctccgaaaaagctttccgcgaagagatctaggagggacgccgcggctgaagggaccagtgccgaccccgagtttgatagccaccgtttcaggagtgccgagcaccagcaacgcttcgaggccatcaaaggatggtcgttccacagagagagacgcgtccagctcagggacgatgagtacatagattttcaggaggagatagctcaccaacattggacgtcgttggtcactcccatggctcagtttgaccctggtatagtcctggagtaa

SEQ ID NO: 2723 - DNA, 288 bp, Glycine max
  Peptide Sequence Number=SeqID_119501
atggttccccgcatgtcatcgggcccgccgcctctggatgacaaaagtgcagatgaccataattgtctctgcgtgccattgaacacgactgtgtctgaatgtcaaaaggtgagcggaatgaccataatttgtctccgcatgtcatcgggcccgccgcctctagatgacaaaagggcgcagaatgaccataatttgtctccgcatgtcacagggcctcagggtcagtatgacagagattgtggggcggccgacaaaagcgaggctcttgctcctacgtatcctcaatga

SEQ ID NO: 2724 - DNA, 180 bp, Glycine max
  Peptide Sequence Number=SeqID_119502
gctgaggtaaccatcacgaagcttaatgaggagaggcgcaggaacactcaagaaaaagatttacagcagcagcaagaagaactggacaatttgttgttcaaaatttcccaaatttctccattgggtgttcattcaaggcttttggaagatgcaataagcaataaatatttacttatctga

SEQ ID NO: 2725 - DNA, 348 bp, Glycine max
  Peptide Sequence Number=SeqID_119503
atggcgtcaaccagaaaagattggtcaatcaaattggaagatgcactatgggcttacagaacttcatgcaagaccccaattggcttatctccttttcaactgctgaaatccaaatggtctggacctttcgtcatcaagaaagttcagccttatggtgcaatagagttgtatgatccacaatctcaggaccctgacagaacatgggtggtgaatggtcaaaggttgaaattgtaccatggtggagagtttgaaaagatgccttacaacaagaaacccgcttgggagttccactatcttgtaaatcctttacaacttctgaaacacacaaggacatcccttcctttgtga

SEQ ID NO: 2726 - DNA, 402 bp, Glycine max
  Peptide Sequence Number=SeqID_119504
atggtgtccctgtgtggttcagactttgtaaaagactttttacaagatagtggaaatctcaagcgggttgcttggggattggatgtaggcatagggtgtggccgaaccatggtatcagagcttcattcttgtataaagtttagaaacttcaagaataaaggcctcatcaataggcctcctatttttaatggcataggttaccattattggaaaacccgcatgcaaatttttacagaggctatagatatgaatatctggtgtcgcaacctacccttcggcgagagggtcacgcgagactcacgggagcgtcttccaagaaaggaaaatgcgcagagtcgccaccaacgtttatttgaggagaacgtcggaaaaaccagaaaaggtgcggtctacgaactttaa

SEQ ID NO: 2727 - DNA, 394 bp, Glycine max
  Peptide Sequence Number=SeqID_119505
atggcagatgatatcacattcaatcatagaaaacaaggtatccaccttactgaaaaggaaacaattcatttatgcttgactgagattgagaatatgctacaagccaatagaaggagcttgcgagattttccatccatgccatacccaataggatatgcacccaaccaacatcataataaactgatccataatgaaatggcatatgacaaagaaatgctagcagcagaattcaacacagcataccatttgctcacagatgagcaaaaaactattgtcgatatcattatgcgtgtagttaacactcaatcagctgcagtttacttcctctatggatatggtggaactggcaaaacatttgtttggacaaccttatcatctgctatatgctccaatg

SEQ ID NO: 2728 - DNA, 590 bp, Glycine max
  Peptide Sequence Number=SeqID_119506
atgggatcaagtcaaacaccttcgcttaaaaagaggttctatcaagtcaaggtcaagagcctaggaatcaccagtttaaaagagctagggcagttgatggtcagctccaacggcaagctttttgcaaagattacgcaattgacgcttttcttgcctatcatagccacaaggaaagcccggtacgaccgaagatgtgagaaaagcagtacgaggattgtttgttgtactccagctctttatgtatggttggtttcacacctttttcgccaagaggtgaggcatgcttgcccgcaagaaggtcaccgttcatgcacagagaaaggaggcacaaattgggaccaactcttagcaaacaaagaaagagcgtctatcaactggttccctcgatggaaagaaggaagaaccggagttcttatttcatgcggaggatatccgaatgttcccttgatggggacgaagggttgcattagttacaatcccgttcttgctataagacaacttggctaccctatgagaggggcaccgctagaggaagagatcgcacctgtcctttcacgtagagacgcttcagaagtccgcaaggcatggga

SEQ ID NO: 2729 - DNA, 222 bp, Glycine max
  Peptide Sequence Number=SeqID_119507
atgcatatccaaggtagcaagataccttggatatgcatgtatatggcaaaaacacctcacaaaaatatacatatgtttagggtgaatgctgtgaaaattttcccgaacacaatgatgaagaggatgagcttcaagagaatgattcagagttcttacaaggtggaaccatgcagtaccagacacgagatagatattccaaagaacaaggcttttttcgaataa

SEQ ID NO: 2730 - DNA, 333 bp, Glycine max
  Peptide Sequence Number=SeqID_119508
atggaggagattcttaaagaccatggggatttgatattgggattcaacaattttttgccaaagggatatgaaatcttacttctagatgagggtgaggatgggtttggaaatgcttcgaaatatttgaagaagattcaggatcgatttgaaaacaaagatcatgtttacaagtcatttcttaatatacttcttaagttcaaaaataatggagtcactcttcatgatacataccatgaatcatatatattcaacttctctaaactgctacactttttgagggtcaccatgatcttgttcgtgacttcactaagtttctgtcatctgtacatctaa

SEQ ID NO: 2731 - DNA, 141 bp, Glycine max
  Peptide Sequence Number=SeqID_119509
atggagaaaggtacaagtcttcctatggagaaaggtttcaagatcctgttgtttcctatcattgatagtctaggaaatcccttaagaattttttcacaaatacggttcgaagtcgaccttaacggaagaaacttacactaa

SEQ ID NO: 2732 - DNA, 222 bp, Glycine max
  Peptide Sequence Number=SeqID_119510
atgagggaggaaggtgattcaagtgatgatgttggtgctagtgtttttgttcataaagatggtgacatagctaacaaccaatgtgtacatgttgaattaattgaagtattttatgattacttcaacttaaaggaaaacttaaacctaccaagtgaagtacagagtgatgcacatttcaggccggtggacaagctggtggtggtaagaaggctactagtggag

SEQ ID NO: 2733 - DNA, 687 bp, Glycine max
  Peptide Sequence Number=SeqID_119511
atggatagttgctactcgtgcgtatctcctacacttgagtgggagctatgcctggggagctgccgcgctagtgcatattgttggatatatgagcattttcccagtgttcatgatagtgtgactgatgatggctatgccgagatgtcaccacgtgcctaccggtggcttactatgaaggcttatatgaagggattaacagcatcgacgtaccggacacgtatagatgcactgaagatcactgacatggggtcccattgtggtcacacttcgaccagagagggtggtgcgatagtttcgcttcaaaccatccctccaccgcctattagtgcctccttgtcatatgaggatatcgacgacaggtggatgcattactcggaccatctagcagctgcgggacatatttgtcttgttcctgggaagtgttcaagagattacatggagtggttctttgagatatctcatccgttcatcacacccacacaggcagctgatcaacccagacatccacctgtcccacaacatgaggcatacgtggagccaaatatcacggagatcccagtggcaacaggagctagaccgtcactggcagctgatccccccagacatgcaatggatgcttgtgaagcgattatagaaaggttggggcgtgtgctcaacctaaggatggtcactgaaggcacaaagtaa

SEQ ID NO: 2734 - DNA, 216 bp, Glycine max
  Peptide Sequence Number=SeqID_119512
atggtggcgaagaaggccagcatcagcggatccttcagcgacatgtcaaaactgatttcccagttgacgagctttttcagggctaacagcaggagggccaccagcaaaccgccggcgacgggagcgggaatggtatattttcgcagcagaggaatggttctgacgcacttgcccccgaggagcaaaaccagcgtcgccgcgactaacgtgccataa

SEQ ID NO: 2735 - DNA, 866 bp, Glycine max
  Peptide Sequence Number=SeqID_119513
gcgatcaaaacacggatggcaagaccattgtctccgacggcaaaacctcaggtcgatacagataccgggagcttcaaatgaaaaaaacgcttgttcttcccgcgatcgccctggttgccatcgccgcactgtcaggctgcacacgcaccagctacgccatccatacccacgacggtcgaacgctcatcagtgacggcaagccgaaagaaacttctgccgggttgctcggttataccgacgccaatggcgttaaacagcaaatcaacaagacggaagtcaaagagccagctaacaccaagggagccaatggctccctttctactctaaacccggcgtacttgcctgcatttaacgataacgtcgaacacctgacatttcagcgccaacgttcccgggtcatcccacatgtcaacgcgctcgctaggctcgaagactcccacgtccatttcctggcggtgatcccgtcacgcgccacctacgccgctttcggctttgccgccaccgcggcgatagaaaccaaagacgaaatcattgcggtagcgaccgaagggttggcgaaagcggccaaagaattcagcgtgcctgaagatagagtgaccacgcacgtggccgtcggcgatcctaaagatcagatcctggaactcgctgatgcgcttaacgcggagattattgtgatgggttccaaccgcccttctgcgatcacttacctcctcggctccaatgccaccgccgtcgtgcgccacgccaattgcccggtgctggtggcgttcgaagtcataggttacggtcttggcggcgatggcgccttccatgcctttaacgatcaggtcagccgcttcgaaccagcccatgtggcgcagcattag

SEQ ID NO: 2736 - DNA, 261 bp, Glycine max
  Peptide Sequence Number=SeqID_119514
atggcgccaaaaacttgttgtctccttggcaagcataccaagttgcacaagaaacaaatgtttcctttcctttttatatgctttccccaactgattggccaatcagaactctcttttgtggatgagcggttgctcgtggtgagaatcctgaaactggccaaatacaggctaaaggcccaagtggagaaggacgaaggcctaagtggagaaggacaaagcccccgagtggagaaggatgaaggcccaagtggagaaggatga

SEQ ID NO: 2737 - DNA, 678 bp, Glycine max
  Peptide Sequence Number=SeqID_119515
atgtatctcaacttaagtaaggcttctgaggcaagccttgttccactaaacccggaaatcaaggcaacttgtaggaagaacaacgccttaaggaggaggagagagcagctagaaaagcagataaatcaaggagataaaggaatctcatcctctacaacatcctcatcatttccacttgatttagatgagccaactacatccactcctttttctatttctgcagataactcaatggcaagagacaagccacagagatttaccttggaggactatttcagctcctcaacaccacggtatttcacaagtattgtgcggccagagctaatacagggcaacctattccaaggattgccaaatgaagatccttacgcccatttggccacttacatagagatatgtaatacagtcaagatagttggtgttccgaaaggtgctattcgcctcaacctattctcctttttccgcgaagctctagatcgcttctgcaatttactccgtcggactgcaatgcatggattcaatgagccaatacaactgaatatatttactaatggcttacgacctcactcaaagaaacttctagacacttccattggtggtaagataaatttaaaaacacctgatgaagctatggagctaattgaaaacatggcagcaagtgaccatccagttctttag

SEQ ID NO: 2738 - DNA, 525 bp, Glycine max
  Peptide Sequence Number=SeqID_119516
atggatagagatacactagggcatagtgggaaaagaggttcgaaaaacctagggaaattagcgagaggtgacaaccgacatttggtgctctcatttgacacgaataactcacaggagtggaagacccacccttgcaaccaccaatttcaaggggaggtcatggagcatccacggaggatacaagccctagatgccaccgatcaccatagagacacacgctatatatcacatccttttcgagcataccccttaatgcgacatcaatcatgttatttcctactatgcttactttggattcgagcggttgggcaacccattgtgattctagcagcaattcttcagcttgatgctaatgggtgggccactagatctaccttctgtcaagatacaaccatcaaagtctacgaggatgtgggagattatagcaacgatgaggatctcacgccatccaagatcactttctacctgggtgtctgtggtgaagagatatctaagggagaggttgttttgtttgacgaggaatag

SEQ ID NO: 2739 - DNA, 591 bp, Glycine max
  Peptide Sequence Number=SeqID_119517
aacggggtcgaacagctggacaggctcgcgacgtactctctgcccggacagatcgtccccgcagtcgtgtggtttcccgcacaggcgcagtcagatggctcagtacgcttgcgtggcgacgcgcgcctgagccttccagacacgtcagcttccttcttagtggcaaaagcgctacaaggcacgcggtgctccgtagatttggccgcaaacttcagctccctggcctggcgcaaactgatgcagaacgcggtggctggactcatggcgctcacgcaccgccgctcgggcatgttcgcccgcgctgacatcgccaggcttacgctggcttatttacaggaatgtctgtccgtggcacgggcagaaggagcagaactcggcgacgaagtgccgcaggagatcctcgacaagttccgggcggctcccgcagacatgagcacttccatccttacggatcgagaagcaggccgaccgctcgaatgggatatccgcaacggtgtcattgcgcgtcgcggccgggttcacagcattccaacgcctgtcagcgacatcctggtgccgcttcttgcggctgctagcgatggcccaggttga

SEQ ID NO: 2740 - DNA, 508 bp, Glycine max
  Peptide Sequence Number=SeqID_119518
atggtggcgaagatgctggcgaaggttggcgaggagagccgcaacgatatgcagcagtgctggcgccattttgatgcgcaggactggccggcgctggcctcatcgctgcaccggctgggcggatcggcgcagatcatttatgccggcgagatcgatgatctgtgcggacagatcgagcgcgcctgccaaagcgctgaagatcaggaggtcatccgcgaagggcttctgctgctggaagagaagctggatacgctgaaccagtcgtgcagaaatcgcatccgcaatgaatcatgcatgatggcgcgatttctcgcgcagatattccttccatgtgatgccgctgataaccgcacaggtggtagcggcgcaatttattgtgcattccgccacggtgcgatatcccttccatgtgatgccgcagataactgcacgggtggtagcggcgcaatttattgcgctttccgccgcggtgcggtaattgaaatgcgcgatgaatcacgccgctacg

SEQ ID NO: 2741 - DNA, 348 bp, Glycine max
  Peptide Sequence Number=SeqID_119519
atgttaaaaatcaaattcctgctgccgctgctgctgattatcagtgcgctgatctggtggctgatgccgcattacagcgatgaggacaaggcttactacatcgcgaccttttgtacgctgacccatgacgggcgcgataacagcgcacaggcgatgcagcagattattgaaggcggtaattcggattatgcgctgcagaagattcatttccagtccgggctggcggagcatctgcaaacggtatggcaggatttgtcgccgcaacagcagcagcaggcgcggcaggatgcgtttgtctgccgccagttgatgtcagataagctgctgccgggccagccggtgcgctga

SEQ ID NO: 2742 - DNA, 892 bp, Glycine max
  Peptide Sequence Number=SeqID_119520
atgaacatcatgaaaaaaagccagctggcgctgctgattagtaccttgtgccttagcggttcaccctatgccgggattatgcgtcatgacattgacgtgcaggaataccgcgattttgccgaaaaccggggcaaatatgctatcggtgccaccgatattcccctctatcgcaaagacggcagctttgaaggctatgtactggacgtgccgatgccggactttagcatggtcagcgacgagggtttcagctcatttatcgcgccatcttttgtcacaggtgccaaacatgttcgatatgttctgtcgctgaatttaggcaaaaaagccaaattttcgccgacttaccgtggcattaactacaataatgatcccacgcgagactttcatttaccgcgggttaataaggtggtcgtcgaaagcgcgccttcgccttacatcggcggtgaagaattattagcgaatcgcagtcgctataccgtatttgcccgcctgggtgcgggttatcagcaaatcgacgatccagaaagcggtaaattgatacctatcgatggcgcctacgtctataacaccggtggaacctttaaacccggcgccattacgaatttttataaggactacattaagtggagaattttttcacctgatcacccctcattttccctgttaagtattggtacccgtggaggtgatagcggtagcccggtgtttgcctgggacagtgtagaaaaacgctgggtacagttcgctgtccattctggtggctatggggggactacctacaattattcctttgccagtgaattaattaatggaaagcatgtgcaggaggtactggattccgtcagggatgctgatgttgaagacagcggcggcactaccctcgaatggcgcg

SEQ ID NO: 2743 - DNA, 891 bp, Glycine max
  Peptide Sequence Number=SeqID_119521
atgcccgcgcagcggctatctgcgcggctgccttttctgatacttggcggcgtacatacgtgcgtcgctgctttccagcagctgctccagcgattgcggctgctgcggatcaaattccacgatgcccgacgaaaactgcagcgtgtaacgccgctccagatcctgcatctgtttatgcagatagtgggcgaagcgcgccagcgtcgcttccgcctcgtcctgacgaatgccgttcagcagcaccacaaactcatcgccgccgagccgggcaaagatatcggcatggcgaaaactcaccttcatggcatcggcaaagtccatcagcgcgcggtcgccctcgcggtggccatgccggtcattgatggccttaaaaccgtcgagatcgagaaacgtcaggctggcgggcagctgtttcagctgacactcattcagcgccatctgacccagcgtcataaagccgcgccggttggtgatttgcgtcagctcatcggacgtcgcggtctgaaacgctaccagctcggcttcggccatggccgccagatcgcgcagcgcgtgcagatcctccgcgttgaactggcgcgcatggttatcgatgatacacagcgtaccgactttggcgccggacggcgtgcgcagcggatagcccgcgtagaaacgcaccggattgtctgcatcggtaaccagcggattatcgctgaagcgcgtgtcggccagcgcgtcctcaaccaccatcacctcatcctgcaggatggtgtggccgcaaaaagagatgttacgcgcggtggttggccgatcaaaaccgtcgctggatttaaaccattgatagtcattctccagcagactgaccatcgcgaccggaacgtcaaacagacgtcgggcaaggcgggttaa

SEQ ID NO: 2744 - DNA, 1491 bp, Glycine max
  Peptide Sequence Number=SeqID_119522
gccggtgccgacttcatcgcgccgtcagcagcaatggatggccaggtgaaagcgattcgccaggcgctggacgcggccggttttaccgataccgctatcatgtcctactccaccaaattcgcctcgtcgttctacggtccgttccgtgaagccgcgggcaccgcgctgaaaggcgaccgcaaaacctatcagatgaacccgatgaaccgtcgtgaagcgattcgcgagtcgctgattgatgaagcggaaggtgcagattcgctgatggtcaaaccggcaggcgcttacctcgatatcctgcgtgatatccgcgagcgcaccacgctgccgctggcggcttaccaggtgagcggtgagtacgcgatgatcaaatttgccgctcaggcgggcgccattgatgaacgtaatgtggtgctggagagcttaggtgccattaagcgtgccgtgctctctgcccctgcgcgggcacgacatccggtttgctgtaacacatccatcattaacaagagttacgcgatgaaagcacctgcactgcctgcggacgaatcacagcgtctgacccagttacgtgcgctcaacattctgcacacacccacagaagagcgttttgaccgtttaacccgccttgcccgacgtctgtttgacgttccggtcgcgatggtcagtctgctggagaatgactatcaatggtttaaatccagcgacggttttgatcggccaaccaccgcgcgtaacatctctttttgcggccacaccatcctgcaggatgaggtgatggtggttgaggacgcgctggccgacacgcgcttcagcgataatccgctggttaccgatgcagacaatccggtgcgtttctacgcgggctatccgctgcgcacgccgtccggcgccaaagtcggtacgctgtgtatcatcgataaccatgcgcgccagttcaacgcggaggatctgcacgcgctgcgcgatctggcggccatggccgaagccgagctggtagcgtttcagaccgcgacgtccgatgagctgacgcaaatcaccaaccggcgcggctttatgacgctgggtcagatggcgctgaatgagtgtcagctgaaacagctgcccgccagcctgacgtttctcgatctcgacggttttaaggccatcaatgaccggcatggccaccgcgagggcgaccgcgcgctgatggactttgccgatgccatgaaggtgagttttcgccatgccgatatctttgcccggctcggcggcgatgagtttgtggtgctgctgaacggcattcgtcaggacgaggcggaagcgacgctggcgcgcttcgcccactatctgcataaacagatgcaggatctggagcggcgttacacgctgcagttttcgtcgggcatcgtggaatttgatccgcagcagccgcaatcgctggagcagctgctggaaagcagcgacgcacgtatgtacgccgccaagtatcagaaaaggcagccgcgcagatag

SEQ ID NO: 2745 - DNA, 144 bp, Glycine max
  Peptide Sequence Number=SeqID_119523
atgaaagcacctgcactgcccgcggacgaatcacagcgtctggcccagttacgtgcgctcaacattctgcacacacccacagaagagcgttttgaccgtttaacccgccttgcccgacgtctgtttgacgttccggtcgcgatg

SEQ ID NO: 2746 - DNA, 438 bp, Glycine max
  Peptide Sequence Number=SeqID_119524
atgaaggattgtgtgcggtgcaggccgggcgttgttgccggtcggcatgaatgccgaccctacagcgcacccggcaaccgccgaatcccaacccgccgttacccgcagggcacgcattcatgcgcaccaggccaccgcagaatcatcacccgcagcacacccgcagggcacgcattgatgcacatcaggaatcagcagaatcccaacccgcaacatacccgtagggtgcgcattgatgcgcacctggaagcctcaccgcagcacatacattctcacgcactggccaccgcagaaacaaaactcccgccaggtggcgggagtggaagggcagattactcgttgatgtccgggtgctgctgcaccaggtttttccgcttcgcctcaaggcgggcgatctcttcatcaatatcttcaatcttctgctcgatgttgtcgtga

SEQ ID NO: 2747 - DNA, 1194 bp, Glycine max
  Peptide Sequence Number=SeqID_119525
atggcacgctttgttttatttgcaaaaagtctctgttttgacgttgaccagcaggtcctctttccggtgcagtcgcccgcgcaccgcgtggcgctgacgccgctgcaaaccgccattctgcggcgcgtgattgatgcggatggcaaactggtgcgcaaccagaccctgcatgcgctgttccagcgcgtccccagcgacacaccgttcgccgagcgcctgacggccaccattgccgccatcaatcagcaggcgcagctggcacacgcgccgggaccgctggtgcatcaggtgccgctgattggctgcgtgctggccgatcaggtcgatgtggcgccgctgagcgatgagccggtggctgcgccagcggcagcggtggtcagtccgcaacctgcgcccgcgccggccagcgtaaagaaaaagcggcctgtgctgcgctgggtaatcgttgcgctgctgctggtgaatgtcgcgctggcgctgctggcacgccagatgtttgcgcctgtgcagcacgatgcgctggatttccggccgctgctgcgcattcagaacagccaggtgtttatccccagccacctgaaagccgattcgtgggtggtgcaggacgcgctgcgccgctatcggcagtggcagccgcgcctgccggatggctcagcgccgccgatggtgtacatcaacccggtgcgcacccgactcttttccagcaccttcctgagatacccgatgcgtaaagcgataatcaccacggcggtggtgctggcctttgtgctgccgtgggcgctggcgctgctgctgcggccggcagaaccggtgccggagtggtgtgaggtaccgtatcgtattgatcatgaaggcgcgccggctggcgcgattgatgccaccattcgcacgcgctttaaggcggacggcagcggcagctcaacgctgaccggcaccgtcacggtacgcgagcgccactatcgcctgcatcgcgtatccgataccacctggcgccgccagggcgatttcatgctcagcaccacgcgcaacgtacgtatcctggcagacgacaccgtaccgcccgcgctggcggcgcagatcgtgttttcgccagcgcgcgagggcaataacgattattaccagatgtaccagctgcccaatggcgaccagatgattaattatgccgggctgccgcggctgtactgccacagctaa

SEQ ID NO: 2748 - DNA, 1177 bp, Glycine max
  Peptide Sequence Number=SeqID_119526
gactggagatcgaaaccccggtgctggatgccatcatcaatctgtgccacaagctgcagctcgaggtattgggggcgccaaccgcttcccgttgaggaccatcatgagcctgaactgcatcattcttgatgattatcaaaatgttgccctgtcgctggccgactgggcatcgctgcaaccgcaggtacaaactaccgcgctgcaccgccactacgccaacgaagatgaactggtcgctcacatcgcgcacgccgacattctggtggtgatgcgcgaacgcacgccgctcagcgcccggctgataggccgcctgcccaatctgaagctgattgtcacctccggtatgcgcaatgcctcaattgatctgcacgcctgtgccgaacggctgattgcggtgtgcggcaccgccagtagcagcgcggcgccgctggaactgagctgggggctgctgctcggtctggcacgccacatcccggcggagagccaggcgttgcgcagcaacggtgcgtggcagcatacgctgggcatggcgctgcacggcaaaaccctcggcctgcttgggctgggcaagattggcggtgagatggctaacgtggcgcgcgcttttggcatgcgcgtgtgcgcctggagccagaacctgagcgaagcacgcgcagcggcgtgcggcgcagagaagatggcttcgctgccggcgctgctcggggcgagcgatgtggtatcgattcatctggtgctgagtgagcgcacccgtcatctgctggacggcgcggcactggcgcacatgaagccaggcgcgctgctgattaacacctcgcgcgccgggattgtcgatcagcaggcgatgatcagcgcgctgcagtctggccagctggcgggcgccgggctggatgtctttgaacaggagccgctcccggccgatcatccgctgcgtcagttgccgaacgtgctggcgacgccgcatctgggctatgtcgccgacaccaattaccgcacctacttcagcgaggcgccgcggcagcccggcataattaatcatctggtcgccattgggcagctggatacgtacgttgcgcgtggtgctgagcatgaaatcgccctggcggcgccaggtggtatcggatacgcgatgcaggcgatagtggcgctcgcgtaccgtgacggtgccggtcagcgttga

SEQ ID NO: 2749 - DNA, 169 bp, Glycine max
  Peptide Sequence Number=SeqID_119527
tgcgacgaacacaatgctcgaccttagacaaaatgatggtcagatggagaacatacagcttcaaggtatggtggcgaaggagaagaagcagagacttgtgacgatgctcgagtgcgacgaacacgatgctcagatgcacacagggacggtttcgctagacggagattag

SEQ ID NO: 2750 - DNA, 684 bp, Glycine max
  Peptide Sequence Number=SeqID_119528
agtctggaccctaaagtgattgccacaaataaacttgttgcagaagaagacaagggcagatacctcacccaatgtgtcccacttcacaaagcatcactcaaaggtgactggaaagaagctagaaaactattggatcaagatgggtcacttctcaaaacggccataacaaagggggggtgggccacactcctccacatagccgtgggagcaaaccgtgttcactttgtggaggagctgctaaagttgatgcaaccagaagaattggaattgcaagaccacaagggcaacactgcattctgctttgctgcagcagttgggaatgtgcaaattgctgagatgatggagagaataaatgcatcgttgccaaccataaggggtggaggaggactcacccctcttcacttggctgttttacaaggaagaaaagaaatggcatggcatctgttccctaaaactaaggaaatctttgaagaggtggactggactatacttttcattaattgtataaagtctggactatatgatttagccctggaaatgctaaatgagaaggacatgctagcctatgctcggggtgaggagaatcagacagggttgcatgtcttggctcgaactccaggttgtggttgccaactacgatgtcgaaaacacctcctacatttctgtaagtggctatacaattaa

SEQ ID NO: 2751 - DNA, 1110 bp, Glycine max
  Peptide Sequence Number=SeqID_119529
atgtttgtacctagaaacattgaggaagcactagatgatcccaattggaatttagcagtcttagaagagttgaatgcattaaaaaagactgggacttgggaacttgttgacctaccacgtgacaaaaaacaggtgggctgtaagtgggtctttaccattaagtgcaaggctgatgggagtgtagaaaggtacaaggcgagattagtagcaaagggattcacccaaacttacggagtagactatcaggagacttttgctccagtcgctaaacttaactctgttcgaattcttctatcccttgctgcaaattacaactggcctttacatcaattggatgtaaagaatgctttcttgaatggggaactagaggaagaagtgtttatgagccttcccccgggatttgaagaagaacttggaagaaataaggtgtgtagactaaagaagtcattatatgggctaaaacaatctccaagagcatggtttgaaagatttggaacagtgataaaagggcttggatatatccaaagccaagctgatcacacattgttctataaacattcaacaaataataagattgtcatcttgattgtttatgttgatgatattattctgacaggtgatgatagtttggaactcaaaaatttgagggagaaacttgctaaagttttttatatcaaggaacttggcccattgaaatacttccttggaattgaatttgcaagatcaaaggaaggtatctttatgaaccagcgaaagtatattctggatcttttaaaagaaacaggattacttggatgcaaggctgcagaaacacccatggagcccaacttaaaactacaaccagctgaaacagaaaatatggtggacaaaggaagatatcaacgactagtggggaggctaatatatctatctcacacgtgtctagatatagcctttgctgtaagcatgggatcacctggaaggggacttctttataaaaaccatggacatcttcaggtagaaggctacactgatgcggactgggttgggagtgtgacagaccaaagatcaacatcaggctattgcacctttgttggaggaaacttagttagttggagaagcaaaaaatag

SEQ ID NO: 2752 - DNA, 722 bp, Glycine max
  Peptide Sequence Number=SeqID_119530
atggactttatgcgcgccatcggcgagtcgaaccgttatcagatgagcctgcgcttcaacggcggcagccccatcgccagcggtccggacgaccagccagagctgctgtacctcagcagtgcaaattatcaggcggagtccagccgctatccaatcagcgtcagcgtgacggtacccgctgccgagctgatcaaagcctggcgtcaggcgctgcttattttcctgccgatggccgccatcttttcgatattgctgatggtgctgaccgccaactggctgcgccgccgcctctcatgggcggatgaaattcgccgggcgatacgcaaccgtgagttcacggtgcactatcagccggtgtacagcaccgggattcagcgctgcaccggtgcggaagcgctgatgcgctggcagcggcccaacggcgaaatgatccgcccggatatcttcatcagccatgccgaagcggaaggcatgatcgtgccgctgacccagcatctgctggcgatgatggcggaagatatccagagctggcaggttgaaccgggcttccacattggctttaacctcgcagctgagcatctgcaacaccccgattttgtgcaggacatgatgcgttttgcccgcaacatccgtgacaaacagatgctgatcacgctggagcttaccgagcgcagcctgatcgaggacggcgacgcggtgtcgcgcaagctgcgctatctgca

SEQ ID NO: 2753 - DNA, 324 bp, Glycine max
  Peptide Sequence Number=SeqID_119531
atgatgcgagatgaagttaatcaatctataattataagtagttactgttatacgtatcttctattcaacaacattgcaaatttttttaaagaacttccacagtttgttgttaaagctggtccaactttaagtaatctatatggcacagattgggaaaactggcttgagacaaatgatgatgcctgcagcatggagtgcaaaagtgaacttctgaaaattctcaaactcatcaatgagggatcctcccacaaccaagttagagatatctcctcatctggaatgagttatgttgtactagttatagtttatggtgatgatacctga

SEQ ID NO: 2754 - DNA, 144 bp, Glycine max
  Peptide Sequence Number=SeqID_119532
atgagattgggggtgatgattaacaaggaggtggaggatgacaagtggaaacatgtccacctcattaaggagggccccggactaactcattttctttgcagatggtgtccttttgtttgcaaaagaaaaggattcaaggtttaa

SEQ ID NO: 2755 - DNA, 1389 bp, Glycine max
  Peptide Sequence Number=SeqID_119533
atggccgacgctgagaacggtgagggcagttcgcatctttttggggtcaccactttggtgaattcaagtggccgccaaaggctcaggctgcattcaagcaactcaaacagaccctatctcaggcgcctgtccttgccctatcggattttgatcatccccttcactgttgaaatagatgcttcagggattggtatgggtgcagtgctttcccaacacaaccacccaatccccttcttcagtaagccttttccaccaaaacttctcagtgcctcggcttatgttcgtgagttgttcgcgattacagcgacggatgtgatagagttcatatcgcaatgccttgattgtcagcatgttaagtatgaaactaagcgaaccgctggcttgctatgtcccttaccagtcccttatcgaccttggaaagacttgtccttggattttatcacaggattgtccctatttcgtggcaatttagtcatattcgtagtggtcgtcgccctgttcatggacatagtagggaaaatccacgggctgcctcgcagcttggtctctgatcgagacccattgttcttgaaacagtgcttgtgcgccttcatccatggtcgaccaaaggagtggggtaaattcctcctatgggtagagtggtcccataacacatcttggagcgcagccaccgacaccacccctttcgaaatcacctttggccgcaagccctttaattttccagaatatatcaagggagcttcgaccttggatgtcgtggatgaaatgctcactaatagggaggaaacatttcaggtgattcgaaagaaactccttcgtgctcaagagcgtatgaagatggccgccgataccaaaagaagagaggtgcactaccagccaggggactgggtcatgctcaagttgcgtccatatcgacaagtatcagcaaagggcgcacacgccactcgtggcaagctagcaaagagattctatgtcccctttcagattttggagcgcataggacccatggcctatcacttgaaactgccggaggaagcctgtatccactctgttttccattgttcaatgttgaaacccttcaaggatccccatatgagaacctcggagcacgcaccattggaagtgttggtgcaatgggagggtctctttcctgatgatacttcatgggaactttgggagaaattgtgtgaagatttccaccttgaggacaaggtgaatctccatgggccaacagatgatatgaagcaaggagaaacagaaggcagaagcacacaagcagaggtgcagaacacacaatcaagggtgcagaagcagaaccaagaggcacagatagcagctaggactaagaggaccctcacaagcccctcttatcttagtgactatgtctaa

SEQ ID NO: 2756 - DNA, 474 bp, Glycine max
  Peptide Sequence Number=SeqID_119534
atgcatgacattcttggtggcagcaacccaacgacacgcccagtgacagggttgctaagtagcatatgttccttttgccacccaataggattcaacaccccacaaggtggaattcccatccctaatgccaatggtgccattcccacagtcaatgttgtcattggcattccattaggcattggcttggctggcatcacctttgcaccaaacaacaacaacaacaaccaaagcaatgcacaactacatctaggacctgatgggttaggacttgggatgtatgtggcaagttctttcgatgggactaggcagatgatggcattcaccatgcttttcaaggaaggcaagtatgggggcactgaaaagttcaagaatgcaaaagggtttgctgagctaagacttcttttcccaacagggcaagtctctattgatggtgctgagacactgctcaagatcactgtccatttgagctattga

SEQ ID NO: 2757 - DNA, 792 bp, Glycine max
  Peptide Sequence Number=SeqID_119535
atggcatctacatctgaaacactaggaaacaagatggctatgggaatgggatcattaactgcagcttccctggcaatgttgcttgcttttgcgaatttggcaacgactatagcaacagttgaccccattgcagccacagggaaagaacatgttattgagctatacatgcatgacattctagggggcagcaacccgacggctcgacctgtaactggcttgctggggagcatatacagtggtcaagtaccctttgcaatgccagtaggattcaacacccaagggactcccatccccaatgccaatggtgctaaccccaccgtcaatggagtttttggtacccctttaggtactggattggctggtacttcatttgcaccaaactcaggtaataacaatcaaaacaatgcccagctgcagttaggacctgatggactgggactaggctttggtacaatcactgctattgatgacatattgacctctcaacctgagttggggtcccaaatagttgggaaggctcaaggggtgtatgtggcaagttcagcagatgggacaagacagatgatggcatttacagccctctttgaaggaggggaatatggtgatagcttgaacttttatggcttgtacaggataggaagcaccatgtcacaaatatctgtgatggggggcacagggaagttcaagaatgcaagggggtttgctgaactgagagctcttatcccaccaggacagattgccactgatggtgcagagacactgctgaggatcactatctatttgaaatactga

SEQ ID NO: 2758 - DNA, 204 bp, Glycine max
  Peptide Sequence Number=SeqID_119536
atgattccttggaggagcaggcctcacagggaagcttttgttgcccatggacgtcaagatgtattgactgctgccgttgggaaactagagcaccttggttgtgcccatgttgctagagctggtgtgatgatcaaatactactttggatcggcttcaaggggctcccgcaccttttcctccatggctactgaagacctagagtag

SEQ ID NO: 2759 - DNA, 651 bp, Glycine max
  Peptide Sequence Number=SeqID_119537
atgctccagtgtggggtatcacggtacaaagtgaaggatgatattgagcataacaatgatgaaagcacaaagaaaggtcccccagcgaagatgggagaaactgcgatggaatgctctgccatccggctgattcctcctaatggaagaagattaatcttttgtatccggatttcgacaaagcggcaagaaatcttaggtttggacttcccactgatggatgaatctctatggcagtttaagcacttagcacaatttgtggtctattttgctagtaattacaacttggctctttggttagtcatgaagcgaaaatacatgatgttgtccatgatgatatcgagcccaagacaaccaagaaatgacattgatgtttatctgagtcccataattgaagtcttgacaaaggtgtgggatgaggaggatgttagaaagaaggctcagaccatccagaaactaaacactacccctcagggactcgtaccacctcctgagcctgaggttggtccttctgctgcctgtgacagtacaaagggaagttgtatcaatcccttggggcaggacccagacacgggcatatcagacaagcgtgggttgtcggtgttgaggaggtttcgagatgttgatgctcgcatccctgtacccactcaagag

SEQ ID NO: 2760 - DNA, 314 bp, Glycine max
  Peptide Sequence Number=SeqID_119538
caataaaagacgcttgggatcttccatcagatgtggttaagggtgataacagcagtcctgaacttgatgaacttgccgaagcagaggagcttgtaaaagaaaaggaatggggagatcgctctatgcttgcgacaattgcacttggggctgctcagtctccttggggtgtggcaagtggagccattgctggacacctactcgcaactactattgccattcttggaggagcattccttgctaactacatttctgaaaaactggtacaagtcaacctgatagagcattcaatgcttgaatttttaaatatccaatga

SEQ ID NO: 2761 - DNA, 207 bp, Glycine max
  Peptide Sequence Number=SeqID_119539
atggcaaacgcagcggaaatggtgccatttcgatcaacgaaatatgcaatgacgatggcgttgttacgattgtcgtcaaaaccccaaaacaatcatccatcgatgaagaagacactagccgacgacggctgtggaagtgtaggagatgaagcacagtttgaaaatgaagaagttttgggaaggaagctttggaagtgtgggagatga

SEQ ID NO: 2762 - DNA, 1065 bp, Glycine max
  Peptide Sequence Number=SeqID_119540
atgaattgcattcccatacctagatcttctccacaattccttcgaatttatatatgcttagatgcatgcaagaaaggattcaaggctaactgcaaaccttttattggtcttgatggttgtttcgtaaaagggtactatggcggtcatttgcttgcagcagtgggacaagatgcaaacaatgccttttttgtgattgcatatgcggcagtaaatattgaagataaagataactggaagtggttcctcactttgttacatgaagacataggagactacaagcaatatggctggaatttcatgtcagacatccaaaaggaagttatgccaggtgtgaaacataagtattgtgttttgcacttatggaagaatttctcaaagcaatggaaagaaaaagagttaagaggcttagtctggaagtgtacacaatctactactgaagcagactttaagtggtcccgtgaatcatggaccaaagcttactttagtgaaaattgcaaagttgacaacataaccaacaacaattatataaggacgtatataatgcgcaagatgacaagtgcaaaaccaaaaattgctgcaagattaagcccattggtacctatgcaacagtcaaggctggaaaaagagaaagttgaatccaacaagtggattgcaaaatggggtggtgatcctgatggaactagatttgaggtttgccatcatgaaacaagaattaatgtagatctacaaaaccagtcattcacatgtaggcaacttacagaggactacaatgatggtatgttgaccattggatcttacaatgcaacctatgaaaattacatacgccctaccaggagtcaacaatattggaaaactacaccgtttgataggtcgacaccactccatattaaaaagagacctagtcgacccaaaaaatgtagaagaaaagatcagaatgagggccaagtcagtaacagtagactgaaaagatcctacaaagaggttacttgtactagatgcggtctcaatggtcataacagtggaggatgcattaatggtggtgtttcaccaagaccaaaaaagtga

SEQ ID NO: 2763 - DNA, 321 bp, Glycine max
  Peptide Sequence Number=SeqID_119541
atgaaagggttaggtcctcatgcccctttggtttcaaggggaaagcttcctccttcgttggcagtagtggatgccttgccaacatgctcttcttatttctctagaaccaccgtcctatacccattgagtgacattatgcctgaattatatatagtaagatgcagacaaaaatcaaggttgagcttggcccgtggcacaattcgagcccaagcatccaatattagtggtgttgaacctggagattatggaagcaatactgagaaagatggtcagaatgtatttgaagggaatgttatcgaaggcagttcttctaatgtgtga

SEQ ID NO: 2764 - DNA, 174 bp, Glycine max
  Peptide Sequence Number=SeqID_119542
atgcaggggtactgtatggttatccgcacctttcctcaaccaggggaaaatgagcctgttgacgtgccgagactaacattgtcttctgcaccttttgtcatccagacccgtgaagtcaggggcaaagcagagactaacatcgtcttctgcaccttttgtcatcccgacccgtga

SEQ ID NO: 2765 - DNA, 429 bp, Glycine max
  Peptide Sequence Number=SeqID_119543
atgcctaaatatgaccttgaaattgtcatggggttttatgcaaatgtctggcctactaaggaaggtgttatggataagcactccaaagtgcggggccaatggattccttatgatgcagatgccatcaaccaatttttagggaatccactaatcttagaggaggggcaacaatatgaatatactgcaagaagaagtcagactacaggttttgatgaagaggctatagagggtacatctacttgtgttgctgtaactgagaacaagagagggtacatctcttgtggattagttcaagtggagggtacatccacttggttgttcaaagagaacaaggaagggtacatcccttgtggatctttgcttgtaaaggattttacaaggttgaaaagaaatctcaagaaccggtggttgcttggggactggatgtag

SEQ ID NO: 2766 - DNA, 261 bp, Glycine max
  Peptide Sequence Number=SeqID_119544
atggagctccatatgcacacatacatgcatcatttggctgaccagcagataacaaatcataggggccaggaccctagcccttacccttggcatattctagaacagtttagagccatttttgcatggcttggagacaggcctatttttcagaagaaggcgggatctgcagatgctccaggagatgcccaaggagatggaggaagaactgaggataatgaagacatggtagatttagttgattatttcattggaggagactga

SEQ ID NO: 2767 - DNA, 192 bp, Glycine max
  Peptide Sequence Number=SeqID_119545
atgtctttctttccagggatggaaaccattggttctgtggatgacctcttggatttttcatcagacataggcgaggaagatgattacgatgacaaacctaggaaagcctgtccttcacttaactcaaaatgcgccggcccatcgttgtttaacccattggtccaggttgatccaaaccattcattttcttaa

SEQ ID NO: 2768 - DNA, 180 bp, Glycine max
  Peptide Sequence Number=SeqID_119546
atgcaagcccccatgacggttccatccccatctagtgttgtaaccaagacaatgagacaaaaagattacatgcagccaccaattagtcaaggcttgattaatacaaattttgttgcatacatcttgagctccttagaaggaggatcaaataataaagaacatacctgtctctacatctaa

SEQ ID NO: 2769 - DNA, 357 bp, Glycine max
  Peptide Sequence Number=SeqID_119547
atgatggcacatcactggacatatcagatgagggagcctcctagacatccacccacggtgcataatcctacatcagttatgccacatccacctatgttgcctgttgatacaatagctgtgccacatccacctgcaccaacacatgttgatgctaacatgcctcgacatgcagtggataacataaagcttgcaacacatgttagatatgaggatggtcactgctacactaatgcatacattataacgaagcactgtttaacattagccagaggtgtcatggagcaaggcaatgtttatgttcgttcaagacaaaggagagatacacaggggagaaatggtggtggacgaggatcatga

SEQ ID NO: 2770 - DNA, 180 bp, Glycine max
  Peptide Sequence Number=SeqID_119548
atggtactcagagcggcgaaagagaagacgcttgggaaggagaagaagagactcacggaggaagcatggattgaaaaccacatgaggaggaggagagactcgtggaggaagagaagagatgagcaaatgaaatggaagaagaatggctggtgcaggaacaaaatcactaagatattttaa

SEQ ID NO: 2771 - DNA, 126 bp, Glycine max
  Peptide Sequence Number=SeqID_119549
atggttaaaaatgtgaagggagaatgcccaacatgttacatttgcaggataacattaatgattggaggaggcaacgatcaaacacctgaccacttgatcaaagaggcttcaaaccatgtcaaatga

SEQ ID NO: 2772 - DNA, 249 bp, Glycine max
  Peptide Sequence Number=SeqID_119550
atgatgattactaggccagaggcagctggaaactatacaggccacgacggagtgaaggggaatccgctatctattgagaccttgggagtgtcgaacgacgatggagcttgcagcacactatcaaggtcacaacggagggaacgaggtgacaacggagcttatggcactgtgcaggtcttggtgaaaatgcagacgtacgttcaacaaggcatagtagtcatgttcaacaaggtgcaccttcgaaagtga

SEQ ID NO: 2773 - DNA, 339 bp, Glycine max
  Peptide Sequence Number=SeqID_119551
atgggggggggggggagttgcctgtgcacggcggggtggcctcgacaattactgcctagttttttcctaagtgggagtgttgtgtggacacacttaggctatttccttgaggaaggtaccatattgcatctgagagttgaggtcaggtgcatgcattatactgagcatgattgtttggaacgatggactgatgatgattgttgttggggagtgatggctggatggaatgattgtgcgataatgggtgctcttcaacccttagctcaggctatagggaattcaaatagtggagaagttgttggagctgttgagtaccaaggattggaccactttcaatga

SEQ ID NO: 2774 - DNA, 1310 bp, Glycine max
  Peptide Sequence Number=SeqID_119552
atggccataaaaaacaagaacggcgcagggcgtacgttcacatcagccaaacgcattaccggaaagcgcgtcgctatcgggataggatgcgcactatcgggcatgctcacctccgcgatggcggcacccggtgcgtcggcatcaccctcggcggtcgaacagcccgctatcctttccttcgccattcccgccggtgatctggcgcccgccttgcagacggcggccgctaaggccggcgtgatagtgattttcacgcccgaacagacgcgtggaaaaagcaccgcgggcctgcagggacattatcgcctcaccgacgcgttcaatacgctgttggcgggcagcggattgcgcgctcaacaaaccgcacagggatatcggttggtcgacgccgggccggttcagccgttgacgataccggagctgtcggtggtcggcggtttgtccgacagcgtcgccgccggccgttcggtgctggataaagaagatatcgaacgcgtgcaggcagacaatatcgccagtttgcttgatcgcttgcccggcgtagggatggcgggatcgccgcgcccgggtggccaaagcctgaatatctggggcatgggcgacatggaagatgtgaaggtggtgctggacggggcgccgaagggatttgagaaatatcggcagggttcggtattcattgaacccgaattgctgaaaaaggttgaggtcgataaggggccgcacaatctgttgaacggcaatggcggctttggcggaaccattacgctggagaccaaagatgccggagatatgctgctgccgggcgaagattttggcggcttgctgaaatacagctaccacaccaacgatcgccagggcatttacagcggtgcgttgtacggccgtacgccggaaggattcgccgacggtttgatctacatgagcaagcgtgacggcggcaacctgaagcggccggacggcacgcgctttgcctattccgccaacgatcaggcttcctacctgttaaaaaccaatatttatctgagcgaggcgcaaacgctgacgctgtcggcgatgcgctccgattccgatggctggcagccttttgccgccaagcgggacgatatcgccgcgcccagccaggcggatatcgataaatatggccgggaagaagcgtggcgccgcattctggtgtatcgcgaccagacggacaccaattactcggtgaaatggaatctggcgccggaagcgcagccgttgctgaatctgacgctgtcttatgcctattcgaagacagagcagcatgacaagcggccggattccgcttcaaa

SEQ ID NO: 2775 - DNA, 637 bp, Glycine max
  Peptide Sequence Number=SeqID_119553
ttcgtagatcacgtcttttccggtttttccgacgttttcctcaaataaatgttggtggccactccgcgcatatttctttcgtggaacacgcatcccgcgagtctcgcgtcgccctctcgccgaaggatctttcttcatctgttcttgtgcatccacccattctcactcatttgcatgtttattttcttgttgcgcttaaacggtgcagatccgatgatgagtcccgcaaagagctagagaggataattgctcaggaagatcgagagatgaagccataccaagaagagacagagctcgtagacttaggtaccggcagtgaaaggaaagaagtaaagttaggcatgggtatggctccacccatttgtgaggaattagtggccctactgagggactaccaagacgtctttgcttggtcgtaccaagacatgcctgatgtaagccacgacattatgcaacataggttacctttgaactctagttgttcttcggtgaaacaaaagctaaggagaatgaaacccgaaatgtcattgaagatgaaggaggaggtgaaaaagcagttcaacgctgatttcttggcagtagctcgataccccgagtgggtggccaacattgtgccggtccctaagaaagatgggaa

SEQ ID NO: 2776 - DNA, 195 bp, Glycine max
  Peptide Sequence Number=SeqID_119554
atgtgggtgcaagcctttggtttgtttgctcaagcgacctgtgctcctgagttttggacatccaagaccgttcaatcagaaattactcgtgctacatattcgtttcttccttgctacaaggtcatgacaaaagacaaggttgatacctcaaagccctacactggggcaatgaggggcaccgtgcatgagccttaa

SEQ ID NO: 2777 - DNA, 585 bp, Glycine max
  Peptide Sequence Number=SeqID_119555
gtccttgcctttagagggttgcacgtcctcgcccttagaggactacatgtcctcgactttagagggctacacgtcctcaccttaagagggttgcacgtcctcgccttcagagggctgcacgccctcgccttcagaggactgcacgtccttgccttcagagggctacacgtcctcgccttcagagggctacacatcctcacctttagagggcttcacatcctcagcttcagaggattgcacgtcctcgccttcagaggactacacgtcctcgactttagagggctacccgccctcgccttcagaggactgcatgtcctcgccttcagagggctgtacgtccttgccttaagagggctgcacgtcctcgccctcaaaggactacacgtcctcgactttagagggctacacatcctcgccttaagagggttgcacgtcctcgcctttcgaggcttgcactactggttcctgggccaccctcctgatcttggaggagggccaaatatgcgagcaaagccagaggagaaggctattgcccagctactatgcatatctgatgcaatcctacccctcaagggcattggatag

SEQ ID NO: 2778 - DNA, 714 bp, Glycine max
  Peptide Sequence Number=SeqID_119556
gtcgactctagaggatcccaccaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacgatgtgccgccccagccaaactcccccacctgacaatgtcttccgccccggatcgaccggccgaagcccgaccttgggtccaaaaagaggggcagtgccccgcttcccgattcacggaataaggtcttctttccccgctgattccgccaagcccgttcccttggctgtggtttcgctggatagtagacagggacagtgggaatctcgttaa

SEQ ID NO: 2779 - DNA, 415 bp, Glycine max
  Peptide Sequence Number=SeqID_119557
cctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 2780 - DNA, 690 bp, Glycine max
  Peptide Sequence Number=SeqID_119558
atggcctctggtaatcgattaccaaggctgtgtaatcgattaccaggcttaaagatgggatcaggaagtcgagatggcttctggttatcgattaccaaggggtgtaatcgattaccaggcttagaaatggagacagtaggtggtgaaggctctggtaatcgattaccaggttgtctgtgtaattcgtgtttggcctctggtaatcgattaccaaggctgtgtaatcgattaccagagatgaaaagccttgagatcgtgatggcggcgcaagtaatccatgatcgagtggagatggagtgcctagagggagcttgggagaccctcgaaggcaatgcgaggtgccgatttcggggcacgattcgattcatggctacttcattggtgcatccagaggaactcgcgcgcacgcttcagcgcactgtggagtggatactacccacgcccacaccatatcgtctagtggagccagtccaagtgatcgaggtgatgtcatctgaggaagaccctgaggaagaccaagaggagctacctcctgagcctgctgtggatgctcttgacttcctagagggtgatgaggacccactccttgaggtggattctcccgaggtcgtcatgtcggtatctgaggcagactctacggaggagagcggccctggagagatggcgactagtggaggctattcatcatag

SEQ ID NO: 2781 - DNA, 567 bp, Glycine max
  Peptide Sequence Number=SeqID_119559
atggaagaatcatcgaagaagagaaagggaacgtcctccaccaccgctactgttggccatcgctgccacggaccctctgaaacacccacagcaccaattcatccttccttatcatctccaagatcatctactctattttcttcagatgatcaatgtctacggtacaactctcaattttcttctaggatcatcttagaccctaagtacctagacacaaatttctttaatgatgagacatttgactgttatcaagtgtttcaaaactctggattggttaattttatgtctttaaaattgccttactaccctgaacttgttaaagtcttttacaacaatttaaaaattcaggatggtattatttcttctgaggtgcatggtatttctatgatcattgatcaatctctgttcttttcattgactaaattacccagtcaaggtgcaccttttaagggcaccattgttgatgactggaaattcgattattctagtcatgatgctcgccgtatggtttgtaatgaccaggctgaaatgaccggtagattgttggcccggatcattaacctttga

SEQ ID NO: 2782 - DNA, 195 bp, Glycine max
  Peptide Sequence Number=SeqID_119560
atggctgcaaaagattttaatgtccaggcatgtcttttcaatggttattgggaagatattgggactataaaatctttctttgatgcgaacttggctcttatggaccagcggcccaagtttcagttgtatgaccagtccaagcctatttttacttgtcctcggttcctaccaccaactaaaatggagaagtgtgag

SEQ ID NO: 2783 - DNA, 870 bp, Glycine max
  Peptide Sequence Number=SeqID_119561
atgatggtggcaagtgagctacaaggattttccatgtccctgggttcaaagaagccatccttttaccgtgacatgaatctgtcttcctcattcactggtagcagagtgaacttacttcattcaaagaacgtagcatctggttttcctcaaggaaaattctttagtgttacgcagagaaatacaaccagaagatttttggctacttctactcttgcagatgttgcaaatgactttatggcccttcaatcaccaatacttacaggaagagaagccagcccaaagactgttgcatcgatcatattaggtggtggagctggaactcgtctattcccccttactcaaagaagggctaaacctgctgtgccatttggaggatgctataggctggtggacataccaatgagtaattgtattaacagtggaattaacaaaatctacgtccttacacaatttaattctcagtccctaaatcgccacattgctcaaacatataatttgggaggctgcatcaactttggaggtggttttgttgaggtattggcagcaactcagacacctggggaatcaggaaagaagtggtttcagggtacagcggatgctgtgagacaatttctttggttgtttgaggatgctgatcataaaaatatagaaaacattctgatattgtgtggtgatcagctatatcgaatggattacatggaaattgtacagaagcacattaattcatgtgctgatatatcagtatcttgtctcccagtggatggcagtgaaaatgtagaggttgtaaataagatgacagaaacttggaagttccaaaagttcggaggtaataggcaaggcaaggaggcagtccaacctttccctccttaa

SEQ ID NO: 2784 - DNA, 2427 bp, Glycine max
  Peptide Sequence Number=SeqID_119562
atgaccaatgttgctgatcatttgcctaactcagaagaggcaattcgcagaggagagtatgcagtcataagaagcttgattcgggtgttagagggtggtgttgaggggaaaagacaagttgacaaagtcattgacaaatgtgcttcaatgcagaatctgcgtgaagcaattgccacctatcgcaatagcattttgcgacagcctgatgagatgaaaagggaggcatcactatctttttttgtggagtacctggagagatactactttttaatatgttttgctgtgtacattcattcagaaagggctgcactccgttctaatactgctgatcactgtagttttgctgactggatgagagcaaggccggaactctacagcattattcgcaggagagatccaatgggtgcacttggatattcaagtttgaaaccatctttaaagaagatagctgaatctactgatggccgcccttctgagatgggtgtggttgctgccttgagaaagggtgaggttcttggtagtcaaactgttctcaaaagtgatcactgtcccggatgtcaaaacccaagtttacctgagagagtggatggtgctcctaatttccgagaagttcctggatttccagtttatggagtggcaaatccaaccattgatggtattcgatctgtcattcgaaggattggtagctccaaaggtggacgcccaatactttggcataatatgagagaagagcctgttatttacatcaatgggaaaccatttgttcttcgtgaagttgaaaggccatacaaaaacatgctggaatacacaggcattggccgtgacagagtggagaaaatggaagctcgattaaaagaggatatcctgcgggaagctaaacagtatggtggtgccataatggttattcatgaaacggatgataagcatatatttgatgcttgggaggatgttacctctgatgtgattcaaaccccacttgaagttttcaaaagtctggaagctgaggggttccccattaagtatgcacgtatgcccatcactgatggaaaagctcctaaaagctctgattttgacactttggcaaataatattgcttctgctgcaaaggacactgcttttgttttcaattgtcagatgggtaggggcaggacaagcactggtactgtcatagcttgccttgtgaaacttcgaattgattatggtaggcccattaaaatactgggtggtgatgtgacccatgaagaatcagactgtggttcttcaagtggagatgaaactgggggttatgtcaatacattatcctccaatacattgcaaagaaagacagacgatgaacaaaatcgtgcttttggtataaatgacatccttctgttatggaagataacaacattatttgataatggtgttgaatgccgagaagccttagatgctattattgatagatgttctgcacttcaaaacattcgtcaagcagtcttacagtatagaaaagtattcaatcaacagcatgtcgagccaagggtaaggagggtggcgttaaatcgtggtgctgagtacttggagcggtactttcgtctaattgcttttgcagcatatcttggaagtgaagcatttgatggattttgtggacaaggagaatccagaatgacgtttaaggtttggttgcatcagaggccagaggtgcaggctatgaaatggagtatcagattaagaccagggcgatttttcactgtccctgaagacttgagagaaccacaagagtctcagcatggtgatgcagtgatggagaccattgtcaaggccagaaacggttctgttttggggaaaggctccatactgaaaatgtatttctttcctggtcagagaacttccagtcacatacaaatacatggtgcacctcatgtttacaaggttgatgaataccctgtgtattgcatggcaactccaaccatctctggtgccaaggagatgctagactatttgggtgctaagcctaaaccttccctcactgctcaaaaagctatattgaccgatctgagagaagaagcagttgtttatatcaattatactccctttgtcctgagggagttaaataaaccagttaatacactcaagtatgtaggaattactggtcctgtggtggaacacatggaagcacggctaaaagaagatatactagctgagattaggcagtctggtgggcgaatgctattacaccgtgaagaatataacccctcaacaaatgagtcaggtgtggttggatactgggaaaatattcgagcagatgacgtgaagacacctgcagaagtttattctgctcttaaagatgatggatatgatattgtctaccagaggatacctttaacaagagagagacatgctttggcctctgacattgatgcaatacagtattgtcaagatgagtaa

SEQ ID NO: 2785 - DNA, 549 bp, Glycine max
  Peptide Sequence Number=SeqID_119563
atgagccgcaacatgaacaattttacacatttgcttgggccatggcaaacagattttagatccaatgatggccacactttcaatcatcgtgaatccaatgaggtgcctgtgttttacagatctcactctactcatgtcactgatgacagaagttcaggtgtattagctcgacaacggttttcggacttcagaaatcctttaggattccacagtataccaaattttccagcaccaccacctagaagacaacaaattcatgtgcacaatgaggatatgagaaggcttagagagattttccttcagccacctcaaagatccacattccaaataaacacacaagctcccccaccggtagaaatttccaaatcaacggctttgagcaagcttaagaaagtagtccatgaccctccaccaaagaggtatgctaggagggtgagcttatattacagaaacaatgttgcaaagccttggaaagagaaggagaaagaaaaggatgaagatggcaagagttgtgctatttgcttggaagattttgagcccagtgaggag

SEQ ID NO: 2786 - DNA, 360 bp, Glycine max
  Peptide Sequence Number=SeqID_119564
atgcccatgattagtaataatcaaaagggtagctttaacatgaatccgttatttaggagtgattcttttgggcattactaccctgaggctgaacacagttacactatgatggagaagaggcaattgttcctcagaagctatcagttctgtagaaagaagagcctcaaagagagagtcaaagggtctttggttcgtgtcaagaaggttctgtggctgaggctaagatctgctaagaaactcagaaggttgtttttttccagaatcagaatcaaatgcggcttctattaccggaggagaaggttttcacgccttctcagtgcccataaccgcaaaatagactcttcctcttgtttatggtag

SEQ ID NO: 2787 - DNA, 2118 bp, Glycine max
  Peptide Sequence Number=SeqID_119565
atgtctccagctggtacaggaggaggcactgtcagtggagagcatgaaccaaagtctgatagagcagcaacaactgcttacctccatcagatgcagaaaggcaagcttattcagccatttgggtgcttgttggtcttagatgagaaaacatataaggtcatcgcttacagtgagaatgcacctgaaatgctcaccatggctagtcatgctgtccccagtgttgatgaccaccctgctcttgacattggcacttacataaggactattttcactgccccaagtattgcttctattcacaaggtacttggatttggggatctttcacttcataacaccattctagtccattgcaagacctttgggaatcccttttacgcaattatccatcttgttaccggtagcacaatcatcgattttgagtcggtccagcctcctgaagttcccatgactgcatccggttccctgcaatcctactacaagcttgcagcaaaagcaacaactagattgcaatccttggctactgtgaacatggaaacactatgtaacacaatggttcaagaggtttttgagctcacaggttatgacagagtgatggcttataaattccatgacgatgatcatggggaagtgattgctgaggtgaaaaggccaggcctagagccatatctggggttgcactacccagccactgatattccccatgcgacgcgcttttctttatggagaacaagggctgctcatagttgccacttgcaattcatggtgaacatgaattctagtgcttccttggtattggcagttgtgatcaatgacaatgatgaagatgggaatagttctgatgatgctgctgttcagcagccacacaagagtagtacgagtctatggggtttagtagtttgccatcacactactcccaagtttgttcctcaggggcggttcaaggacttgagaggcctaaagcaaatttattttttgagtatttgtcatccacgtgtgggcaaagagctagagattgagtatcagattgttgagaagaacatcctgcgaactcaaacacacttgtttgatgtgctgacgcgagatgagcccctagccattgtttcacagagtcctaatatgatggatcttgtcaagtgtgatggagcgaccctgttatataaaaacaaggtgtggagattaggggtaacgccaagtgaatctcagataagagagatagctttgtggctctctcagtgccatagggattccacaggcttccctggggctgctgctcttggtgatattgcatgtggaatgacatctgccagaataacttccaaagatatagttttctggttttggtctcacacggctgcagaaatccgatgcgacggaggatgcatccaagatccatcattcaaggctttccttgaagttgtcaagaacaggagcttactctggaaggtctatgaaacggatgccattcattcattgcatttaatactgagagatgcgttcaaagagacagagagcatgaagatagccacatatgctcccaattcaaggcttggttgtttgaacattgaagaaacgcaaggactggaggcagtgacaaatgagatggtaaggttaattgaaacagcaacagtgccagttttggcagttgatgttaatgggatggtcaatggatggaacaccaaaattgctgagttgacaggtcttccaagtgatgaagctatgggaaagcattttctcacacttgtagaggatttttcagtagatagagtcaagaagatgttgcacatggcattgcagggtgaggaagaggaagagagaaatgtccaatttgagatcaacacatatgatttcaagattgattctggtcctgccagcttggtagttaatgcttgtgcaagcagggatcttcaagataatattgtgggagtttgttttgtggcacaaggtataactgctcagaaaacaatgatggaaaaattcccccgaattgaaggtgactacaaggcaattgtacagaacccaaacccatcgatccctccattatttagcacagatgaatttggttggtgttgtgaatggaattcagctatggcaaaattaaccggatggaagcgagaggag

SEQ ID NO: 2788 - DNA, 351 bp, Glycine max
  Peptide Sequence Number=SeqID_119566
atgctgaagatgggttggcaatatttggctaccaaacgcattagatgtggctatgagaagctaccaagttcgagtcaaaagatgatgagggatggaagaagctgttgggtgaagtctttgaatggaagattgcgtggccttaggttgtcacgttctaggaaactttccttaggagttgtggtgttgtcaagcagaattgtaagactatacaatgaggttgtcaaccaaatgatgaacatggaaaacatatatcctgctattgttctctccactcaatggggtcttcccgttctgtctcattcctcacacgtgtgcagatcaaggagggtcatccctcttgacagaaattaa

SEQ ID NO: 2789 - DNA, 855 bp, Glycine max
  Peptide Sequence Number=SeqID_119567
atggctgaccatgatgcaaaagaagaacaaaggcccctcaaccaatggagaagaagcaaagggggattcatggcttccatgttcatttttgtcttgtcagcattggacaacatgggctttgtggcaaacatggtaagcatagtcctatacttttatggagtgatgcactttgatctagccagttcagccaacacactcacaaacttcatgggctcaacctacttgctttcccttgttggtggcttcatctcagatacttacttgaacagattcaccacatgcttgcttttcggatcactcgaggttctggctttggcaatgctcacagtccaagctgcttcaaaacatttacaccctgaagcatgtggcaagtcaagctgtgtgaaaggtggcatagcagtgatgttctacacatcactgtgcttgttggcattgggaatgggaggggtgagaggatccatgactgcatttggagctgaccaatttgatgagaaggatccaactgaggcaaaagcccttgcaagttttttcaattggcttttgctcagttcaactgtgggagcaatcacaggagtcactggtgttgtgtgggttagcacacaaaaggcatggcattggggttttttcatcataaccatagcttcctccgttggctttgtgacccttgctcttggtaaacaattctaccgcatcaaaactccaggagatagccccactttgagaattgctcaggttattgttgtgtcttttaagaaccgaaagttgtcattgccggagtcacatggagaactatatgaaatcagtgataaagatgctacagctgagaagattgctcacaccaaccagatgaggtga

SEQ ID NO: 2790 - DNA, 153 bp, Glycine max
  Peptide Sequence Number=SeqID_119568
atggggcacatggtacagctcatatggtgtcctcaatgtcctttaagagctacgttgtgtggtgtggttagaactggtattgctattgctattgctattgctatcatcccttccctaaaggaaggacctttcacagtttcaccttacaagtga

SEQ ID NO: 2791 - DNA, 477 bp, Glycine max
  Peptide Sequence Number=SeqID_119569
atgtcttctttctgtggtgcagtcactggtgtcttctgcttcttgcaactagctagtccagagctgcaacaggcattacacattcagctcctatctgagcaaactgcaatgaaaagactgaaagatttaaattatttgaaaaggcaaatccggaatcctttatatgggattatgttctcccggaaattgttagagggtactgagttgggagctgaacaaaaacaatttctgcaaatgagcacgcagtgtcaacaccagcttagcaaaattctggatgactcagatcttgacagcatcattgatggcattacgcatgatggttttggggttccagaaacattgctgaaccagatgtttggacgtgatggacatgaatctgaggagggtattagcatgctgattagcagaaagctcatgaagggagacgtacgttacataagggaagcagggaaaatcatctttcatcttatctgttga

SEQ ID NO: 2792 - DNA, 1266 bp, Glycine max
  Peptide Sequence Number=SeqID_119570
atggagagagttttgtgggttgacattgctataggacttgttgttttcagcaactgggtcgatgggttcgtaggatatgaacatcacttcaatgaaacagagttgtctttattagaggctcatgaagcttccttgtcctacgccgggaccgagaggaataatcttctgctggtaggactcacccttattcaaaatgctgctgctaaaggagcagtctgcttggacggaacattacctggttatcatttgcatcggggatatggatcaggagcaaatagctggcttattaatttagagggtggtggatggtgtaataatattagaacatgtgtttatcgcaagaaaacccggcgtggatcatcagatttcatggaaaaggagataccttttactggtatattaagtaataaggctgaagaaaacccagattttttcaattggaatagagtaaagcttcgttattgtgatggtgcctcatttactggggatagtgaagatgagactgcagaactgcaattcagaggacagcgtatttgggcagctgcaatggaagatttgatgtcaaagggaatgcgttttgccagtcaggctattctttcgggatgctctgcgggtggcctggctactattattcattgtgatgaatttcgtggtctctttccaaggaccaccaaagtgaaatgtcttagtgatgctgggttgtttcttgatgcgattgatgtatctggtgggcatacccttaggaatttatacagtggagttgtaggattgcagggagcacagaagaatctgccacagatttgtactaatcaccttgatcccatctcgtgcttctttcctcaaaacttgattgccagtgttaagactccgctattcattcttaatgctgcttatgattcatggcagatccagtccagcttagctcctccatctgcagatccccatggctattggcatgaatgtagattaaaccatgctaaatgtactggaccacaaatccaatttctgcaaggattcagaaatcacatgctgaatgctattaaatacttctcaagatcaaagcagaatggcttgtttattaattcttgtttttctcactgccaaactgagaggcaggatacatggtttgctgacaattctcctgttatcaggaacaaggcaattgctctggctgttggagactggtatttcgatcgagcaggtgttaaggccattgattgtccttacccttgtgataatacatgccatcatctgattttcagatga

SEQ ID NO: 2793 - DNA, 888 bp, Glycine max
  Peptide Sequence Number=SeqID_119571
atggcaaagttcctagacaaagctgccatcatacaagaaagctcaaaaccccaggcatggaaaatttgcactgtgacacaagttgaagaagtgaagatcctaacaagaatgttacccatagtagctagcaccatcatactgaacacatgtatggcacaactccaaacattctcagttcaacaagggaatgtgatggacctaaaacttggctctctaacagtgccagcaccatccattcctgttatcccacttgtttttataagtgtcctagttcccttgtatgaactattttttgtgccatttgcaagaaaaatcactaaccacccttcaggcataacacaactacaaagggtgggtgtagggttagtactctcggcaatatcaatggcagtggcagggattgtggaagtgaaaagaagggaccaagggagaaaagacccttctaagcctataagcctattttggctttcattccaatatggcatatttggaattgcagatatgttcacccttgtgggactattggagtttttctatagggaatcacctgctagcatgaaatcactttcaacctctctcacgtggttgtcaacatctcttggttacttcttgagcacagtctttgtcaatgttatcaatgctgttaccaaaaggatcacacgaagcaaacaagggtggttgcatgggttcgacttgaaccaaaataaccttaacttgttctattggttcctagccacccttagttgccttaacttctttaactacctttattgggcctcaaggtaccaatacaaacgtgaagactcaggcccaggttttaagcctttaggtgaaatgcctctcaaaagggttgagagaaaacaagattgtgaagttagccgagagtga

SEQ ID NO: 2794 - DNA, 2896 bp, Glycine max
  Peptide Sequence Number=SeqID_119572
cattgttaaacgtggtttggtggggttggtttatgtcaagaactcgctggtggacgtgtattgcaaatgcgggctgtttgaggatgcaaccaagttgttctgtggtggtggagatagaaatgttgtaacgtggaatgtaatgatcatgggatgctttcattgccgaaattttgaacaagcttgcacctatttccaagctatgataagggaaggcgtagaacccgacggggcttcatacacttctctttttcatgcttctgcaagtattgcagcattaacacaggggaccatgatccatagtcatgttttaaaaaccgggcatgtgaaagactctcatatttcaagttcgttggtgactatgtatgggaaatgtggaagcatgttagacgcttatcaagtttttcgagaaactaaggaacattatgtggtttgttggacggctatgataacagttttccatctacatggttgcgcaaatgaggcgattgaattgtttgaggagatgctcaatgaaggggttgtgcctgaatacattacttttatttccatcttgtcggtttgcagccatacggggaagattgatgatggttttaagtacttcaattccatggctaatgttcataacattaaacccgggcttgatcattatgcttgcatggttgacttgcttggtcgtgttggtcgattggaggaagcatgtaggttcattgaatccatgccattcgagcctgactcgttggtttggggggctttgcttggggcatgtggaaaacatgccaatgttgaaatgggaagagaggccgcagagagacttttcaagttggaaccggataatccaagaaactatatgctgcttttgaatatctatttaagacacgggatgttggaagaagctgatgaggtgagaagattgatggggatcaatggggtgaggaaagagagtgggtgtagctggattgatgttaataacaggacctttgttttctttgcgaatgataggtcactttcaaggacacaagagatttatggaatgctgcaaaagttgcacggttttcccttgatctcaaccttgaatcagtctcactgtggtgtgttataccgtgtggctaaagggaaacttgatgatccaatagagatgaacaacaacaccacatgtgcagttgatcaatcttctgtacccaacaatgatttgtttgagttgatttgggaaaagggccagatttcagtgcagggtcagtccagtagagctagagtgagcccaaattgtaaaactttgccatctcacactccaataggatatgctaataatgctattactaccaatacaaggatggggaagtgtgggaatttaggtgctgaattgaatgaaattagaaggctagtcccatcaggtgaagtggatttgagtgaagaagaggaagacatggtgatgccttggttcagttatggaagggatgatgactctttgcaacatggatatagtactgattttttccatgaaccatctggggtcatgaatgagctttcagcatcaaataatttttctttgctagatagaagaaataattgtagtaagatatttagggacactcataaacactctccatttgcatccgttagatccagggtagcagatatagctgaaaacaatgcaaataacgttccacctggatcaagtggtttttctagcttaaagatggagaagcaaggtccagttatgtgtagcaataatagttccaccatgatgaatttttcccattttgcaaaacctgctgctattgtcaaagctaaccttgagaacattggcttggcatcaagatcaggaagtgtcggaataaagataaaaagtgctgatgaatcaacaaaagttgaattaagtcgtggagagcgtccaaagaaaccagccatacacaatcaagatcaggatgttactgtttctacaaagggtgacccttcttgcaacgacgtgtccaaggttgatcaaaatcaaacttcaaatatagttgttggtgaaagtgggaataaaggacacgaagctgttgaaaaaggagtggagccagctgtggatgttgaggaagaatcagttggtgtcaaaaaggaagttcatgcacgaggatttggagccacgagaggccgttcagcagaagtgcataatctatctgaaaggagacgaagagacaggatcgatgagaagatgcgtgcgttacaagaactcataccaaattgcaataaggcggataaagcttcaatgttggatgaggcgatagagtatctcgaaacacttcaactccagcttcaaattatgtcaatgggaagtggtttatatgtgcctgcaatgatgttacctccgggaatgcaacacatgcatgcaccacatatgggtcctttttcacctataggtgttgggatgcaaatgaggttaggaatgggcatgcttgatgctaatgttattgagtcctctagatttattcaagtgccccaaatgcaaggaactcaacttcccattacacatacacctggatcctctgttttacatgggatggcaagaccaaatgctcaagtgtttgggcatcatcctagtcaggttcaccccatgccaatgccacatgctcccatcttttcttttccaggagaaccttttatcaacccatcatcaactttaggactgatggaaactgtggataaggcttcttcagcctttggcttaaaggatcagattccacaacttgtacaaaacaccaacaacggttgtaattcaacaaatcagatgtcaacacagtgtgaagcaaccattggtggatttgaacactcaactttggtacttaatagtggtcatgccacttcggcaaatgacagaggagctagtaatcccagtaaagaagataaacacttgtga

SEQ ID NO: 2795 - DNA, 1808 bp, Glycine max
  Peptide Sequence Number=SeqID_119573
atgattattatgaaacttgtcttgcagttgcagctattcacaagctaccaaagtggtgttccaaaattccaccaattctcctcagttcccgacctcaagcatctcctcaacaacgccgcaaagttgaagagccttaaacacgcgacccaaatccactcccaactcgtaacaaccaataatcacgcgtccctcgccaacatcaacaccctcctcctcttgtatgcaaaatgcggctccatccaccacacgctcctcttgttcaacacataccctcatccctcaaccaacgtcgtcacgtggaccacactcataaaccaactctcccgttccaacaaacccttccaagccttgacatttttcaaccgcatgagaaccactggcatatacccaaaccacttcaccttctcagcgatcttacccgcgtgcgcgcacgcagcgctcctttcagagggccaacaaatccacgcattgatacacaaacactgcttcctaaatgacccttttgttgccaccgcgttgttagacatgtacgctaagtgtggctccatgttgttggcggagaacgtgttcgacgaaatgccccatagaaacctcgtttcatggaactccatgattgtcgggtttgttaagaacaagttgtacggtcgtgccattggggttttcagggaggttctttcacttggccccgaccaagttagtatctcgagcgtattgagtgcttgtgctggattggttgagttagattttgggaaacaagtccatgggagcattgttaagcgtggtttggtggggttggtttatgtcaagaactcgctggtggacatgtattgcaaatgcgggctgtttgaggatgcaaccaagttgttctgtggtggtggagatagagatgttgtaacgtggaatgtaatgatcatgggatgctttcgttgccgaaattttgaacaagcttgcacctatttccaagctatgataagggaaggcgtagaacccgacgaggcttcatactcttctctttttcatgcttctgcaagtattgcagcattaacacaggggaccatgatccatagtcatgttttaaaaaccgggcatgtgaaaaactctcgtatttcaagttcgttggtgactatgtatgggaaatgtggaagcatgttagacgcttatcaagtttttcgagaaactaaggaacataatgtggtttgttggacggctatgataacagttttccatcaacatggttgcgcaaatgaggcgattaaattgtttgaggagatgctcaatgaaggggttgtgccggaatacattacttttgtttccgtgttgtcggcttgcagccatacggggaagattgatgatggttttaagtacttcaattccatggctaatgttcataacattaaacccgggcttgagcattatgcttgcatggttgacttgcttggtcgtgttggtcgattggaggaagcatgtaggttcattgaatccatgccattcgagcctgactcgttggtttggggggctttgcttggggcatgtggaaaacatgccaatgttgaaatgggaagagaggtcgcagagagacttttcaagttggaaccggataatccaggaaactatatgctgctttcgaatatctatataagacacgggatgttggaagaagctgatgaggtgagaagattgatggggatcaatggggtgaggaaagagagtgggtgtagctggattgatgttaagaacaggacctttgttttcaatgcgaatgataggtcacattcaaggacacaagagatttatggaatgctgcaaaa

SEQ ID NO: 2796 - DNA, 429 bp, Glycine max
  Peptide Sequence Number=SeqID_119574
atgagcgaggttccaccggcgaagcatatacccgtgtggctattggtcttgaaaatttggccctgctattggcttgttacttcttgcacctccaagtctcttcctgcattctttttggaatgtttttcttacgcgaggttaaaaaaagggtatattccagaatgtaatattacattccgccaaaaggggttccgaaataaaattggagatgcaggaagcaacagccatgctattggtaatgcagagataatcaaattagaagcaagcccaagggatggtgacgtgaggtccacggatcataatacattgcttttgtcggccgtctttgtccgtttgcgccttgcacaatatccggccaccacgatagttgttggttcacattggtatttgatagtgacggctcgcaacacagaagaaataacaaaatga

SEQ ID NO: 2797 - DNA, 489 bp, Glycine max
  Peptide Sequence Number=SeqID_119575
atgtgggcttttcttaccgatcgtcagatcaactgggcccacttggttaagtatcgtatgcataaggcattacggaccaatgcacctctttcgtatcctcagttagtcactctttttcttcgtcactttcaaattcctctcgatgatgaaccctttgttcaagtcaagatatcttttgccattggtgctggagcgataacttcttttaggtaccataaggatattgatggacaatggattaggaaacaagatttaccaccactgattcctgatgagcgtactccatctcctctgccacatagagatgcctcctctactcttatgcatgaagtcctttctgaactacgtggccttcgagggttcgttggtgaccgtttggattccatggatgctcattttgaaggcatggatacatggattactcagcttgaagacgacatgggtttcattcgctgttgcttccaccggctgccccatagttctttctag

SEQ ID NO: 2798 - DNA, 254 bp, Glycine max
  Peptide Sequence Number=SeqID_119576
acttcgtaaaaggattttacaaagagagtggaaactctcaagcgggttgcttggggactggacgtaggcacaggaattctgcatggtcatttgccttacaagttcttcgagggaaggttgtggaggggcctcaactgttggctgtttctagggctattgttgttgttggattggtggaggaatgtatggtctgcttgggccaacagcattttggaaggaaagagcaggctgctgttgttgttgctgagggctag

SEQ ID NO: 2799 - DNA, 750 bp, Glycine max
  Peptide Sequence Number=SeqID_119577
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtgatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 2800 - DNA, 276 bp, Glycine max
  Peptide Sequence Number=SeqID_119578
atgacgaaggaagtgatccatggtcacaactctacagtgcctcggctccacttttcctcttcttcttcttcttcttctgcattttctctggtatttgaaggctgctggatgccttctcttctcaacaatgcatggctatttatagaagatagccaaggggtgcagggaaattcgcccaggcgagctgcagctcgcctcggcaaattcaggcataatggtgaaggcatccactcgcccaggcgagttgcttgcttagggctgatgttacatctttag

SEQ ID NO: 2801 - DNA, 367 bp, Glycine max
  Peptide Sequence Number=SeqID_119579
gaacatgcgatggaactccaacgccttaatcaaaatgaagaaactgacaaaaagtagagaaaaatttcagaaatttatcaagaaaagaagaattgacaggcgtcagaacttcaacaatggaagaaaatcacaagaagattctcaagtccttagatgttacaaatgcaatcaaattggtcacatcaaagccaattgtccttcaaatgaagattggcctgagaaaagtgataagaaaaggtatgatgaaagaaggaccaagaaggcctacattgcatgggatgacaatgattcatccgatggttcagaaaaggagattaatcttctaaccaaggattatgaaagtgatgagaacatttctcaagaatga

SEQ ID NO: 2802 - DNA, 183 bp, Glycine max
  Peptide Sequence Number=SeqID_119580
atggcgataagtggatgtttgctggccatgagcagtataatggatgaacaattgaggatactaaaagtcattgttgtgcaaggcaaaaaattagtgatccgggattcaagagcagtgacccttatgttgttgtcaagctggggaatcagacagcaaagaccagggtcattcattgttgcttga

SEQ ID NO: 2803 - DNA, 246 bp, Glycine max
  Peptide Sequence Number=SeqID_119581
atgcggggttactttatggttactcgcacctttcgtcaaccagggtcaaacgagcccgttgacgcaaggagactaacattatcttctgcaccttctgtcatcctgacccgtgaatcaattgacatgcggggttacccaatggttacctgcaccatacgtcaaccaagggcaaacgagaccattgtggcgcggagactgacatcgtcttctgagccttttgtcgtcctgacccgtggagtcaggtga

SEQ ID NO: 2804 - DNA, 882 bp, Glycine max
  Peptide Sequence Number=SeqID_119582
atgtcctcgcctttagagggctgcacgtcctgcccttcagaggactacatgccctcaccttcagagggctacacatcctcgccttcagaaggctacacatcctcccattcagaggactacacgtccccgcaatcagagggctgcatgtcctcgcctttagagggctacacgttctacccttcagaggactacattactacacgccctcgccgtcagcggactacatgtcttctgcttcagaagactacacgccctcgccttcagagagctacacgccctcacgccctcaaattcagagggcttcacaccctcgccgttagaggactacatgcccttaccttccgaggactacacgtcctcgcctttagagggctacacgccctcaccttcagagggcttgacgcccttgccttcagaggactacacgtcctcgccttcagaggggtacacgtcctcgccttcagagggctaaacgttctcgcccttacaaggctacacgccctcaccttcggaaggcttcactcccttgccttcagaggactacatgtcctcgccttcagaggactacatgtcttcgccttcagagggttatacgtgctcaccttcagagggctacatgaaatccccttcagaggactacacgtcctcgccatcagagggctacatgtcctggcctttagaggactacacaccctgcccttcagacgactacacttcctcaccttcagaggactacccgtcctcaccttcagaggactacgcatcctcaccttcagagggctccacgccctcaccttcagaatgcttcacgtcctcgccttcagagagctacacggcctcgccgttagaggactacacgtcctcgccttcagaggactacac

SEQ ID NO: 2805 - DNA, 444 bp, Glycine max
  Peptide Sequence Number=SeqID_119583
atgctgcttgccttacgacctgacaagttcatggatagtctgtgcaaaaaacctctcaacagcatgaacaagttgcgcgaacgagccaagggctacatccaaatggaggagatgtctaggttaaaaaataaggtccgacaagacgaatcaaagcgtgacaggagagaaggaggtagaaagactgactcacacaagtcagacaaaaggcataagttggacaagctccaaccactaccgaaagaacccagattctcctatggaagtgatgtagctctatgtggaacttgtaagccttggatcttcttcatcaatgaagtcctttgcttcttaaagttggatggcagcggaatggagaaggagaaggatgattggagacgccccttcaaggagaagatgagtctagaagaagctcaccaccataggaagccatggataagaacttga

SEQ ID NO: 2806 - DNA, 289 bp, Glycine max
  Peptide Sequence Number=SeqID_119584
atgggccttggaggaagtcctccataccaagttaatgctgcccatttgagagacgttggaaagacacgacataggattgaatcgtcattgggatatgtcagcttccatgatatgatcgacaaagggacgttgataggtagtctgctcttcttggtggtgggtgtgattccccttgagtgcactcatgcattgtgtgggcggaatgctcgttgccctgggggcattgtacatgagcctccaactagtcgtggggtcttgagtctgaggccagaccgtgtgctaaccatgg

SEQ ID NO: 2807 - DNA, 252 bp, Glycine max
  Peptide Sequence Number=SeqID_119585
atgcaacaaggacaagcatacatccccgtagttaggttccatgaccctaactatggtatcaaaaatggaagtgtcaaaacatccaataatggttcccaagtcagaagaaatgcaaaggcaagcaaaggcggctcgtggtggtcatcgatggtcagtggtggtggtggaggaggagcttggggtgttgggggaaggtttaggggaagagaaggaggaagaaaatggttgttttatgctgctggacgtatttga

SEQ ID NO: 2808 - DNA, 559 bp, Glycine max
  Peptide Sequence Number=SeqID_119586
atgactcactaccgcaaaccacccctgtcgattcaggagcagttggatctcctccagcagcgcgggctggccatcggcgacgccgccaatgccaaacgctatctgcagcgtgttggctactaccgcctcatgggctatctctacacacagcgtgtgcccggtagcgacagcttccgagctcaagcgacattcgaagaagcggtcagtctctatgaattcgatagggcccttcgagacctggtaatggaggccgttggccatatcgaggtcgcaacgcggaccgtgctcacgtgccactttgcccatgcctatggcgccttcggccacttggagccgcgcaatctggcattcaccgggcaggagtatgcggattggctcggcggcgtcgaaagcgaagtgacgcgctccagggaagcgtttattcggcactacaaggacaagtacgcctcacccgcattccccagagtaccgatctggatggcgacagaagtcatgtcgctcggctcgctttctcgcttctacaaagcgctgcactccagagaacagaaggctgttgcgg

SEQ ID NO: 2809 - DNA, 708 bp, Glycine max
  Peptide Sequence Number=SeqID_119587
atggagggggcagcggtcaccctcgggatcttcacgctggcgaccctcgccatcggcgtcccgatgctcgcccggaaccgcccccagcccttccgctggcgccgcctgccgtggactgcggccggctacaccgcattcgctctgctctccatcgcctggtcgcagtggcgcgaggcgaccgtgatcacctggatcctgctggccgctgtgaccgtcaacggtctcttcatcgcgcacgtgctgacctggcacgagatcgtgcgcgcactgtcgtccgccttcaaatgggtcctcggcctctcgctcgctatcgagctgtgggtctccctggtgctgcacgggccgctgctcccgaacttcgtgaccctgccggacggcgagatcgacccgcagtggtactgggtcagggacaacctgttcgacggcggccggctccagggcatcgtcggcaacgcgaaccttctcgcgatcatctcgctgttcgcgctcatcaccttcggcgtcctcttcgccgcgcgcgcccgctggcgcaccacgctcgcgctgtggatgctactggccgcctacttcctgttgcgcacctcctccgccaccgcactggtgtgcgcggcggcggtggccgtcgtcctgctcgtcgcgctgctgatgagacgagcgcgtacgccgggcgcacgaacgcgcatctacgtgatcgccatcggcggtacg

SEQ ID NO: 2810 - DNA, 213 bp, Glycine max
  Peptide Sequence Number=SeqID_119588
atggggctccgaataagatttgatggtggaggatccacgaatagtgcttggcaatcaattcgtggggctcctaataagatggtggaggatgcacgaaaagcgataggcaataaattggtggggctccgaataagatttgatgatgaaggatgcacgaacagcgcttggaaatcaattcgtggggctccagactcagtggttgaggatgcatga

SEQ ID NO: 2811 - DNA, 237 bp, Glycine max
  Peptide Sequence Number=SeqID_119589
atggaggatgcacgaacagcgctaggatttcaattcgtcgggctccgaactcaatggtggaggatgcatttatggcaatcaattcatggggctccaaataagatggtggaggatgcacgaaaagcgctaggcaatcatttcgtggtgctccgaataagatttgatgatagaggatgcgtgaacagcgctaggaaatcaattcgtggggctccagactcaatggtggaggatgcatga

SEQ ID NO: 2812 - DNA, 225 bp, Glycine max
  Peptide Sequence Number=SeqID_119590
aataagtccattggatttaatgatgaaatatgtgcaatttcaggtgaaaatgaggctaagtcatggagtgctaaaaaagaatctggaagggcatcatcattaaggtcgcgcgctaagcgcgagatcagtgcgttaagcgcgagggtgctaagctcaaatccacttactcgcgctaagcgcgagggtggcgctaagtacaacgtcgcgaattcaaagcctatttaa

SEQ ID NO: 2813 - DNA, 150 bp, Glycine max
  Peptide Sequence Number=SeqID_119591
atgttggctactgaccttgtgacggtgagtgttttggcacgctggagaagtacacttctagtgaacgtggtgttgcgagagtgcaagagtcagagcgagagtgtgagtgtgcgagagtgcgcaagcagtccagttttggttttaaattaa

SEQ ID NO: 2814 - DNA, 282 bp, Glycine max
  Peptide Sequence Number=SeqID_119592
atggtggagataaggtgcagggatttggaaaaggataggtttgtttctcgtttaccatcatgtgtgacggtaacgacaacaattgagatgacgatggaggtggttgcgttgaagcccaatgttgagggtctgatgagggaggacgatggctggttggatgtgttgtatgatggcggaagggagagacatgtgtggatggccatggaggtgacaatgacaattgtgacagtgtcgatgtctgcgattatggctagtgaaatgatagggaatggtgatgcttag

SEQ ID NO: 2815 - DNA, 258 bp, Glycine max
  Peptide Sequence Number=SeqID_119593
atggccatcattttgcctaaggaaaatcttgttgtctggttttgttccttgcataataggccagacaactaccttaaaggaataattaacagtgctttgaaaggacttgacgatactttacaacttaaatccaaggctggtgctaggtggattgttgttaaatattttaatgatgttagaccattggaagcagagagattgaaggcgctttgcatccaatgggcaaagtattatctcaaagttagaaatcaaacttag

SEQ ID NO: 2816 - DNA, 645 bp, Glycine max
  Peptide Sequence Number=SeqID_119594
atgaagaataaggaggaaaacaatgagatcatctgctttgaatgtagaaagcctggacacatgaaggacaatgagaagagtagtagttcaggcgatgaacaagccaacatttgtctcatggaagatacatacgataaggtcgagactgatgaaacttcaacctttgaaaaactaagggaagaagtagcatgtctaactaatgactttgggaagttcttagaaagttcaaagactctcaccactcttttaaaattccatcaacatccctatgacaagtctggcttaggctttgaaaagggaacaacatcctccaagttacagtctgttgtagacaaatgtgatttctatgtgggtgctcacgaacatgatggggaaaggtctatgttcctagacctaaagacacatgaaggaggagaagttacatttggaggcataggtaagggaaagatctctggtataggcaaaattggtattccctttctagccttcataggcaacatcttatatgttgaaggagtcaagactagattaccattcaaagatcttgcttcatgtgctcttgtggttgaaatagaacccaagaccttagaagaagctttgacagatgatgacttgattattgccatggaagaagagcttcactag

SEQ ID NO: 2817 - DNA, 288 bp, Glycine max
  Peptide Sequence Number=SeqID_119595
atgaccaaaggtcaacttccaactatctttatgatggaaggaggagctatctcttggaaaattgttaagcggattcttacaagtacctctgccatagaggcagagtatgttgcttgttttgaggccactcatcaggccatgtggcttaaaaatttgatttctagctttcacattattgaaagcattttcaggccacttgtgatatattgcgacaatactgttgtcgtggatttctatcgaaataacaagacctcttctcatacaaagcactttgatattaagtattag

SEQ ID NO: 2818 - DNA, 561 bp, Glycine max
  Peptide Sequence Number=SeqID_119596
atgatgaagctggatactgttcagaaccgcattgacatggggatccgtatagagcgggagccaaacccgaattttatcgtcaggcccattacgctggttcatcacgcgctgatgacatcacccgggctcattgagaagctgggcgcgccgaaaaatttcgacgatctgcgccagcgctaccctttcagtggcctgctgaatcctgaaaccggcaaagtattcgaatatatgctcgatggcgttgatacttttgtaccgcgccacctggagttttttaccaccgactcccagtcggagatacaggctgcgttagccggtaaagctgtcattcagtcgagtaatctggcctgcagggaataccttgaagacggcaggctggtgaatgtcctgcccgaactgaaactggaaacctggcagctttatctttaccggccctatcagaccctgcctttctccgggaagtcgctgctccgggatggtcttacccgcagaaacaaagtatgccgctctttcaggggccctgaatactggcgacatttaatgtgcaacggggagctgtga

SEQ ID NO: 2819 - DNA, 219 bp, Glycine max
  Peptide Sequence Number=SeqID_119597
atggataccttagagccctacactggggcaatgaaaggcaccatgcataaacctcaagcgaacctaaggcagattagaagttctcacccaatgggttcccagctacacgtcatgacgaaagataaaatgggtacctcaaagccttacactggggcaatgagggcatcgtgcatgagcctcaactccattgtcgtcactccaaaatggtcaagtgactaa

SEQ ID NO: 2820 - DNA, 249 bp, Glycine max
  Peptide Sequence Number=SeqID_119598
atggcttctatggatatctctgctatggtcaactctaagatctttccatgcaatctagcaatgcgggggtccgaggaatttgtccccttcttagatacaacgtctaggggtagcaaagtgcccccacgtacgttttttaagaaggcgacacggaccctccgttggttttgtttacagaaggggatcaagacagaacccatatgggatgcatatgcaaaagacgcaattgcgggaatgtacatagtatga

SEQ ID NO: 2821 - DNA, 686 bp, Glycine max
  Peptide Sequence Number=SeqID_119599
gctttggcggtctgcaaaagctgttgttccgcgtgggggactcaccggtttttctcggcgcctcgcaattctatgcgcacaccgatgtaaccgcggacaatcagctgatcaacaaggtgtggcagcgggtgttgggggaaaacagcacctcttcggccttgggcgtggtggcggaatatgacaccactgataattttttctaccctaagaaagggttatcactgcagggcgagtaccgtttttaccgcgctcttctcggcggcgactatcattacaatcagttgtcgctggatggtaaatactttatcccgctggcgccgaccttaaccctggcgctggcggcaaattatcagtcgctgactcatcatgacaagcatctaacgccaatggcccggccttacatcgaactgcgcggcatctcgcgttttcgctatcagggcgattatgtcgctgtcgcccagacgcaactggcctggcaatttgcgccgcgctggatcctgcaaggttttgtcggtatcggcagtgcgagcgatgaggcggggtcgctgtggcagcaaaccgaagtggcgtggggcaccggttttcgttatctggtcgcccgtcagtatggtttatttaccggcgtcgatgtcgcatttagcgaacacgaacaggcggtctattttaacgtgggttccggactgtaa

SEQ ID NO: 2822 - DNA, 354 bp, Glycine max
  Peptide Sequence Number=SeqID_119600
atggctactgtttcactcaagcacaagtgtttaagctattcgttgataacaactaacatgaggtccaatctttgcatttcatctcattccatcaagtcagaaatgtataaacagaatcagaaggactttctcaggcttgtagtgaggttgtggctacaaaaattcattggtttttctaggattcaaagtacaggagtagctacaggtaaggtgttcaaagacaggactggggtggttcgaacttcaggcgttgaaggatctgatgcctactgtggagaagtggtatctgccattggtgctagaggctttggagtggcctcaggagacttttcaggagtggttgcggcttcctga

SEQ ID NO: 2823 - DNA, 1377 bp, Glycine max
  Peptide Sequence Number=SeqID_119601
atgtccagtaatcgccccagggctcttgtgggtgctcgtgtctcagtgctttctggcccccagaaggtctctcacgaggcgcagatcgacacggctactaagtgggcaaaggcccacgactacccggtagtgggggctttcgaagacctcggggtgtccgcgtcggtacccccagacgagcgtccggacctcgggccgtggatacgagaacgtagccacgagtgggaggtgattatctggtcgaaactggaccgtgcgttccgctcgatgcggcattgttcggacttcatcaaatgggccgagacgaacagaaaggtcgtcgtcttcgccgaagacagcatgacgctcaactacctgaacccgtcgacaggtatcgattcaatacttggtgagctgttcgtccagatcgcagccgcgtttgctcaaatcgaactgaatcgcttcaagtcgcgcgccgaggacatgcaccgggccatcagaccgacaacccgatgggcggctggactgccgccgctgggatatcaggtagtcgaccacccttcggggaggggtaagggactggccatcgactctgacgcggccaatttggtccgtgagatggcagacaaactcgttgacgggtggtcgttcgttcggatcaccgaatggctcaacgaatccggcaagctgacctcacaaggccgatcgcgggaagctaggggattggagcctaagggccgatggactactaccaacgtgatcgagatcctgaccggataccggacgttaggtatcaaaacccataagggacagccggttctagatgatgacggcgagccggtacggctagcgccgccgttgtttacacctgagaggtgggatgaggttcaacgcgcggcacagcttcggaaaggaaaaccgcgcactccgtctgagaccgctaacccgatgcttgaggtcgggttctgcgcagtctgtggctcgtcgctggctcagcagttcgccaaatctaggccgaggaagtctgacgggcacgtgatccactaccggtactaccggtgttcccgcacccctatcaactgcaaagccgtgtttgtcgtagccgacgatctggatgagctgttgtcggagcagttccttttggagcgtggcgaccgcagggtcactgagagggtgtttatccccggtgaggacaactcgtacgagctggacttcatcaaggaccgaatcgaacggctccgagaggaccgggtggccgggttgttcccgtctggcgaggacgaattggtgtttcgaaaccagatgaaacagctgcttgcacgtagagaggagctagagagcgtccccgtgcgccagcctggatacgagaacgtcgagctggagaagacctaccgcgag

SEQ ID NO: 2824 - DNA, 742 bp, Glycine max
  Peptide Sequence Number=SeqID_119602
aggattacacgtcctcaccttcaaagggctacacgccttcaccttcagtggactacacgtcctcggcttcagaggactgcatgtcctcgccttcagagggctacacaccttcacttttagaggaccacacatcctcgcatttagaggattgcatgtcctcacctttagagggctacacaccctcatcttcataggactacacgtcctcaccttcagaggactgcacgtcctcacctttagaggactacacatcctcgccttcagaggactgcacgtcctcacctttagaggattacacgtcctcgctttcagaggactgcatatccttgccttcagagggttacacgccctcgcctttagaggactacacgccctcgcgtttagaggatcgcatgccctcgccttgagagggccacacgccctcaccttcagaggactacacgtcctcgacttcaaaggagtgcatgtcctcacctttagagggctacacgccctcgtcaggactgcacgtccccaccttcagaaggctgaacgtcctcgccttcagaggattacacgtcctcaccttgagaggcctacacatcctcgccttcgaaggactatatgccctcaccttcaaagggctacaggtcctcgccttcagggaactcaaggtcctttacctttaatgcttaaccgaggcttgcactcctggttgaggggccagtggtttccttttatcagttcctgggccaccatctga

SEQ ID NO: 2825 - DNA, 945 bp, Glycine max
  Peptide Sequence Number=SeqID_119603
atgtcgaaaggcaagggcaacaagattatctcgattccgtccgcggatgccgccgcgggcgtggacaaggtgcagtggctgctgattctgccgccgggcagttccattactatctatgtcggcaagcgtaagctgatcatgcgtgatgaagatctgcagaaagtgcgtgctgagcgcggccgtcgcggtagcgtatcgcgcggactgcaacggatcgatagcgtggaagtgaatgcgccagcgcggccaaaaagtgacgcgaatagcgaagacatctggtgtctgttttcaccgcgtaatccgcgccacgtggcgacctttggtcacatgtttggtcgtctgtcgacggtgtttggcgtcaaagtcgaactgcgtaaaccggcggatgccgaaagctacggtaacgcgatttacatcgctaaccatcagaacaactacgacatgattaccgctgccaatatcgtgcagccgaccacggtcacggtgggcaagaaaagcctgctgtggatcccgttcttcggccagctctactggctgaccggtaacctgctgatcgaccgcgataaccgcgccaaagcgcacggcaccatcggcgagctggtggcgcaatttaaaaagaagaaaatttccttctggatgttcccggaagggacgcgcagccgcggacgcggtctgctgccgttcaagaccggcgcgttccatgcggcggtggcggcgggcgtgccgatcatcccggtggtggtctctaacacccacggcaaaatcaaactgaatcgctggaacaatggcttagtgatcgtggaaatgctgccgccagtggataccacgcagtttgaaaccacgtcggtacgtaagctggcgacccactgccgtgaattaatgtctgctaagctggaagagttgaacgctgaagtcgccgaacgcgaaaaaaacggtaaaatctag

SEQ ID NO: 2826 - DNA, 462 bp, Glycine max
  Peptide Sequence Number=SeqID_119604
atgatagacgcgagctgggttcgaggcccagaacctcctaagaagaaaggaacgcagagaacagagaaggaaaagattacaagcataacgaaaatggtattgctgccccctgaggctcgacaacaatctcagcagattctctattctctattccagctcagcttggtcacgcataatctttcagtgaaggatagtattggaggcatgacatctctacaaaagatatcttcactgataatggatgatgaaggagtggtgatcagagagttaggaaagctaaagcagggaatcatttatacgaacttggaagaattcattatcaacttctctcaactccaacagcttactaagtcttacccttgcatatgcaaagaggctgtttccggattcgaacccatgaccaacaagtcaccaaggcacaactttaccgctgcaccagggctcgccctcatactaaggtga

SEQ ID NO: 2827 - DNA, 3804 bp, Glycine max
  Peptide Sequence Number=SeqID_119605
atgtctgattcctcccatacccttggttctgcagtcaccctcgaagccgccattctcaaacttccccaacaccaaatgtccctcagtgaatccgtccacaacatgacccagaaatttgatgaactcctccttcgcttaccactctccccgattcaaccgcaacccacttctgctcctaccctcacctcccctgttcctgcaacacagcatcgtatgaaacttgacatacccaggttcgatggcactgacccttgcgagtgggtgttcaaaatcaaccaatactttcaataccacgctaccccagaacatgaacgtcttaccattgttgccttctacatggagggtcgagcactggcgtggttccagtggatgaccagcaatggtcaactgacatcgtggccccctttcctccacgccttgcagactcgattcgccgccaccacgtacgaggaccctacgggctccctcttcaagttgacgcagaccggcacggtggctcaatatttgtccgacttcgaggacttagccaacagaatcgttggtctccctgcgcaattcctcttgagttgcttcatttcgggcctcatgcccgaaatacgccgtgaggttcaggcgttgcagcctatgacccttgtgcaagccgcgggtctcgctcgcctccaagaagacaagcttctggatacacgctcctccttccgtcaccgtgcaccgccgactttgacgataccggtttctcgcccagctcccactacgaccctcttaccctctccaccttctcgcgtgcccacccctcgctcacccacaccgcgacctccacccactctgaaaaggctctcaccggaggagatgatctcccgcagggaacgcgggctgtgctttaattgtgacgagaagtaccatagaggtcacagatgtgcctctagggttttcttcttggttgctgaagaagacccagctgctgaggttaatatagaggaactggacccaggacccgaaccacccgcgacccatgacccccccggaaacgctctgactgttagggatgctctccggccaccaggttatcatcctcgtggacggggtccccacccacgtcttcaatatttaattgatcgtttccttgccttatttcagcccccttcttcgctgccacaagctgcgccggtcaacgttgaatcaatgctccagaaaggactcattcgcccaagtaacagtcccttctcctcccatgtgcttctggttcgcaaacaggatgggtcatggcgcttttgcgtggactacagagctttaaatgcaatcacggtgcgtgatcggttcctgatacccaccattgacgagctcttagacgaattgggcaaagcttgttggttctccaaacttgacctgctccaggggtatcatcagatcagaatgaactccgacgacattgccaagactgcattccgtacgcaccacgggcattatgaattcaaagtcatgcccttcggcctctacaatgcgccgtcgtcatttcgggcgaccatgaacatgattttccggccattccttcacagattcgtgatcgtctttttcgatgacatcttgatttatagtgtgacatttgatgatcatcttgttcatctggaacaagccttccaagtcttagctgagaatcaattcgtcctcaaattgaccaaatgctctttcggtcaacctcaggtggagtacctgggacatatggtttcttcgaagggcgttgagcctgtggcttccaaggtcagcgccatacaccattggcccgttccaaagtcaactcgtgctctacggagttttcttggacttgcgggattttacagacgcttcataagggggtatgcttccatcgcgacacctctggtgcgagtcaccacggtggaacccttccaatggaccactgaagctcagggagcatttagcatgttgaagaaggctttgtcggaggctccagttctcgcgcttcccgatttccaggttcccttcactatggaaacggatgcttttagggtagggatgggtgccattctctctcagcgaggccatcctatagcttattttagcaagccattccccccgaaactccaccatgcctctacttatgtcagggaattattcgcagtgaccaccgcagtccggaaatggagacaatatatccttgggcaccgttttacaatcattacagatcatcggagtttgaaggaactcctcacccaagtcatacaaactcccgaacagcacatgtacttggcacgactgatggggtttgattatcagatacaatttcgttccggcgcaagcaaccaggcagcagatgccttatcgcggctcccagagcacaccacttccttgttcttgacactatcagtaccctgcctgacattcatggacgaattacgagctcagttgacagcgagttctgaattccaggacatggtcaaagccattcaaacatcaccctcagtgtatcctgattacactattgtcaatgatttggtactcagaaaagggcaaatttggctcccttccaaacttgctctcattcctacattgttgaccgaattccacgcaacacccactgggggacacttgggaactgccaagacagtagcacgcataatggagaacttccactggactggcttaaggaaagacgttgctgactttgtagctcaatgcatggattgtcagagtgtgaaatacgagacaaaacgagtagccggactgctttgccccttacccattcctcaccggccatgggaagacctctcccttgacttcattgttggccttcccccgtatcatggtcacactgttattcttgttgttgtggatcgattttccaaagggatccatttgggcatgttgcccacagtccatacagcccattttgtagcttgtctgttcatggatatcgtcggaaagattcatggtatgccccggagcttggtatcggaccgtgaccctcttttcgtaagtcgtttttggcaggaattgttccggcttagcggtactcagctccgcatgagctctgcctaccatccacagagtgatggtcaaacagaggtgttgaacagagttattgagcagtgcctccgttcgttcatacatcgccggccgagctcattgggtaaatttctcctctgggttgaatggtctcacaacaagtcgtggaacgcggccactgggtccacgccatatgaagtcacctttggccggaaacccttcaacttcccggaatacattactggttcatccaatgtggacgcggtggaagagatgctgaccaatcgtgaggagactttcctatctattcgaaagaaactccttaaggcacaagctcagatgaagcattatgcagatgcaaggcggaggaacgtggaatatcacccgggagattggatattgcaacgtgttggacaggtcgcgtataagctgcagttacctgagggtgctagaattcacccgatattccactgctctgttttgaaaccttttaaaggttcaccggagacgatggagccagtagccctgccgtctcgctttgatcagaatcaaccactcattgcacccttaacgattctagactatcgccagcgtacggataagaagtgggaagttttggttcagtgggagggcttatctcccgacgagacgacatgggaggagctagaccagcttcgccgtgattaccaccttgaggacaaggtgtttctgcaagggccatggaatgatatgaatagtggaagagaggtgcaggaagtaactcagggtctagacagcaatgagggg

SEQ ID NO: 2828 - DNA, 243 bp, Glycine max
  Peptide Sequence Number=SeqID_119606
atgtcacgaaaatttacggattacgcaagcatcccctctttgacttccagaatgttacgaaactttacggattgtgcaataatatttcctttcgactcccgacatgtcacaaaacttcacggattgactaacaatgggtgtcaagttcctcgaagcggtcatgcgaaggtcgcatcccaccaaccagatggtccccggacgaaattagggtatgacaaggtgcaatgtggggaagaaggttga

SEQ ID NO: 2829 - DNA, 442 bp, Glycine max
  Peptide Sequence Number=SeqID_119607
aagcataaagcaaagacggtggagagtgtcaatgctgatgcagaagcctttggtgatcactggaaaacaggagattcaactgtgctgaagataggagattcggctgaagttgtgataaaacaagacatgaagggaagaaagcataaatatgggtttaacaacaataaacatgagaagccagagaacataagggtggtggatgatgaaactggtgacaaacatcagttggatgaagtcctaaggatgccatctacatatcatgggttctccacctgcctcccctcctcctcctcctcctcctcctgctccttcggacgcatcggcttcgccgtctaccgtgaagcggacatgcaagcctcacgtctacgatcgttgtctactagaccacctggtgctgacccaccagtggtccatgttgatcctgctactggcaaggccaacg

SEQ ID NO: 2830 - DNA, 848 bp, Glycine max
  Peptide Sequence Number=SeqID_119608
gaaaaaaacgtgctttacggtgcccttaccgaacacgtgccaaagctagagtgatgagtgaaatagaggaggtgcaagagcagatgaaggtcgacatggaggccatgaaagagcaaatgaccacaatgatggaagccataatgagtataaggaaaatgatggaggttaacacagctatagtcattgccgcaagtaccgccactgaggtggacccaactcacccatctggcatcaatcaagtaaatcgtccagtctcagatatggtaggtcagggaggcgaagcattgggaagtatgggcgactcctattttgtgcaggttcagaacaagcattccttcccaccatatggcctccttcccaactatataccacccaatgttgtacacgctcccgatgagaatgtcgataactctacacccatacccattgagagccaacaaccccaatctgatcatgcacaagtctctcaacccatgggggagacacatgaagcaccccgagaccacaatctagctgacttcgagcctcacctcggatatgccgttgaagggcaggcagtccttcctgctatgggggaaagggagagatttgatcatataaaggagaggctgagggctattgaaggaggcagagattatgcctttgctgacattgcagaattgtgcctagtgcccgacgtcattatccctccaaagttcaaggtgtcggatttcgataaatacaaggggactacttgccccaagaatcacctgaaaatgtacaacaggaaaatgggggcatacttgaaaaatgaaaaattgttgatgcatttcttccaggaaagtcttactagggcagccatcacctga

SEQ ID NO: 2831 - DNA, 312 bp, Glycine max
  Peptide Sequence Number=SeqID_119609
atgcgaaaaataccaaaaaagaggggcaaaagggtcttttcattgagtttcctagaccctagcttgcctaggctagcctctggctcgcctgggcccccaaattactctagggtgaaggaaccaactcgcctgggcgagccaattacttcaggagtaagcattagctcgcctggtgatcgaggcctaggatcttcttcatcaatggattcctttgcttcttggaagataaatggcagcggaatggagaaggaagagagagaggagacgccacttcaaggagaagatgagtctagaagaagctcaccaccatag

SEQ ID NO: 2832 - DNA, 240 bp, Glycine max
  Peptide Sequence Number=SeqID_119610
atgcacgaaacacaatgtggaccactacgggtacatagaatgaatcgaaaagcttggttcgaggggaggtggttgccgcccagctcgcccaggcgagctcagctcgcccaggcgagcagggttgcttcctccagaagcaaccgccttctggaggaatcttctggagggcccaaatgggcctgggtgctatttgcacccccatttttactaagtacacccccctctgctgttttttggtga

SEQ ID NO: 2833 - DNA, 534 bp, Glycine max
  Peptide Sequence Number=SeqID_119611
acctctcaaccttcatccaaactgacttcaccccctttgagcaaaaaagaagttgttgccttgaaaaagactgagaagaagtctttgtctaaaacaagaaagaaggccaagttggataaatccttggagaaaaaggaggccttcgagctagatgaggttcttttggcttctgtgctaactctatctacggaagagcacaagaggaagctagaagaggatgcaagcttggtttacttagctgggaaggttactgagaaggccaccatgatggatatagatgctcacttagaagatgaagtaagaaaagttgagattgaaagggtgcaatctgccacaaagcatagagctaaaatcatgtttgtatatgattctgaaagacaagcagagatggaagttgccatggttcctaaatatagggatcctgaagggaaggatgctcttgaagaggttgtgcataaatttttcactaaagcatctctaggagataaagatgatcttcttcatcaatggattcctttgcttcttggaagatga

SEQ ID NO: 2834 - DNA, 465 bp, Glycine max
  Peptide Sequence Number=SeqID_119612
atgttttccaagaaggagggaatgatgaaaatcctgaaactggtcaaatacaggctaaaggcccaagtggagaaggatgaaggcctaagtggagaaggacaaagccctcgagtggagaaggatgaaggcccaagtggaaaaggtttctctctgagttccttgttgaaccaatctcagacttatcaaggtaatccttgtggcatctaccctgacttatcttccttcactggaagtagcgtctaccctgacttatcttccttcaccggaagtggcatctaccctgacttatcttccttcactagaagtggcgtctaccctgacttatcttccctctttggaagtggcgtcatccaaaaatctttgttacctgtatcaagcgatccaccccgtaaggttcacatcactctcccttcattcatctccttcttcctccaagctcttatccatggcctcctatggtcgtga

SEQ ID NO: 2835 - DNA, 342 bp, Glycine max
  Peptide Sequence Number=SeqID_119613
atgcagagcttgcagaatgtggtccaccagcggccgataatgagcattgaagaatttattcaacaggtggcctggtcaggagttcagccttctcctttgggagggggtgaggcctccgcaactcaggagcctcaatgggatcaacaggaggacattccaaaggccgcagagcctacacctcctaaggcattcactttagagtctgatccagttgttgtacaggctgatccagctatatcccctcatcctgatccatctgcaccagtgtcggacctacctctttctcaggatccatcatctgcaccagcactggacctgaatgagcatgcacaagatcattga

SEQ ID NO: 2836 - DNA, 329 bp, Glycine max
  Peptide Sequence Number=SeqID_119614
tactaaagttgatgtctcgctaagcgagctcaatgcgcttagtgagtgtcatccgctaagtgaggcatcaacgtgcttagtggataggaggaatttggaaggaaatctgtcacgcaggcacgtgctcagagcgtcaccagcttgctcggcaagtcatttttcaccttccaggcttagcgcgaatttggcgttgagcgaaaattcacttactcgcgctaagcacgagaatggcgctaagaacgacgtcaaggaagctgtaaacagagcactgaatagtcgtcagagcttgaagagtgaaatacacagaggcaaagaacagagcaaagaag

SEQ ID NO: 2837 - DNA, 737 bp, Glycine max
  Peptide Sequence Number=SeqID_119615
atgcggctggtgcccgccgatcaggtgccgcgcgcgctgtcgattgtgttcagcgttcttcaccctgccgtcgatgccgccggagaacaaagcgcgcagcggcggcgtgctggacctgctgcgtcagagcgtgatgcgctggggcatgctggcggtgatcatgatgtttaccggccattttgccttctttacctatctgcgcccgttcctggaaaccagcgcgcagctgaatgtgaatcagctgtcgctggtgctgctggcgttcggcgtggcgaacttcttcggcacctcgctggccgcgtggctggtgacgcgcagcgtgtcgctgacgctgaccggcatggcgctggtgatgagcgtgacggcggtgctgctggtgagctttggccacgtctcctggctggtggcgagcggcgtcgcgctgtgggggctggcgtttggttcaatgccgactggctggtcaacctggctgtcgcgcgcggtgccggacgacgccgaatcgggcggcgggctgctggtggccactattcagctggcgatcaccgccggtgcggcagccggtggctggatgttcgatctgcagggcgcgggcggcgtattccttgccagcggcgtgctgatgctgctggccgccatcaccatctttacccgcgtgcggcatcacggttaaaaccgtttaccgccatcaggcgcgccgcgacacgcttcagggtgtgtcgcggtgccgcttttgccgc

SEQ ID NO: 2838 - DNA, 255 bp, Glycine max
  Peptide Sequence Number=SeqID_119616
atgtctaacaaatcagcaccatttcatcaaaccaagggtcttgggccatatgtattctatgatatcattgatggccaggagattcagggaaaaaactctggtgtaatgtcgctttgtaatgaacaggaagcagatgctgcagttgaagtactaaggtttttcaagaaaaggtacccagctgaatttgttggtggaagaattggtattattactccatacaagcgtcaactctcttctgcattctcgttttcttaa

SEQ ID NO: 2839 - DNA, 331 bp, Glycine max
  Peptide Sequence Number=SeqID_119617
acttatcaaggtaatccttgtggcgtctaccctgacttgcgtctacccggacttatcttccttcactagaagtggcgtctaccttgacttatcttccttcattggaagtggcgtcatccaaaactctaaagcctgtatcaagcgatccgctcatagtcagtggcaccctaacttatcttccttcactggaagtggcatctaccctgacttatcttccttcactggaagtggcgtctaccttgacttatcttccttcactggaagtggcgtcatccaaaactctaaagcctgtatcaagcgatccgctcctagtcaggttcacatcagttag

SEQ ID NO: 2840 - DNA, 189 bp, Glycine max
  Peptide Sequence Number=SeqID_119618
atggcatcggtagcgtcacccctgtctgttgaatggggcatcaacagtaagaaacaagggacggaaagaagtagatcagtaggaatactagggcctgctttagagctagccacaccaagcctagttctcttgcccgcttcgcttgtcgggcttaaagcggaactgagcttctcactaagagaatcgtaa

SEQ ID NO: 2841 - DNA, 371 bp, Glycine max
  Peptide Sequence Number=SeqID_119619
atggggcaatttgaaggccctctcgatgagtcaatctgttgctttctcataagggtggacccttgggtgctagtacctattgcctttagaggactacacgtcctcgactttagagggctacacatcctcgccttcagaggactgcagggatacacgccctcacctttagatgactacatgtcctcgcctaccaagggctacacaccctcaccttcagaggactacacgttcttgccttcaaaggactgtgcatcctcgccttcaaagggctacacgccatcacctttagaaggcgacacaccctcaccttcagaggactacacgtccttgccttcagaggactgcacgtcctcgccttcagaggactgcag

SEQ ID NO: 2842 - DNA, 706 bp, Glycine max
  Peptide Sequence Number=SeqID_119620
cttcagaggactgcacgtcctcacctttagaggactacacatcctcgccttcagaggactgcacgtcctcacctttagaggattacacgtcctcgctttcagaggactgcatatccttgccttcagagggttacacgccctcgcctttagaggactacacgccctcgcgtttagaggatcgcatgccctcgccttgagagggccacacgccctcaccttcagaggactacacgtcctcgacttcaaaggagtgcatgtcctcacctttagagggctacacgccctcgtcaggactgcacgtccccaccttcagaaggctgaacgtcctcgccttcagaggattacacgtcctcaccttgagaggcctacacatcctcgccttcgaaggactatatgccctcaccttcaaagggctacaggtcctcgccttcagggaactcaagttcctgggccaccatctgatattggagggccaccaactgtgcaagcacaaccagaggatggggcagggatcgcgcctgcaagacacccaatggacacaaagaagttcaacagggtcctggggtttccagctctgattacgagcctctgtcagttctatggagtgtccgtcgctcccagcagggtcatcaggccccttactaatcgagctttcatcaagaagtactatgcccctaggcaggcgcagggcgaggcaccacaatga

SEQ ID NO: 2843 - DNA, 563 bp, Glycine max
  Peptide Sequence Number=SeqID_119621
atggagacacccgatggttatttgcctacacacttatgctatccagtgacccgagagtctggtagcatgcggagacgccttatggttatctgcacctcgtcattcagagaccgcaagcatcaggttgcaggcggatatacccaagtgattatctgtacaaagataacatctgataatcctgacccgtgcgtcaggcgtctggtggcaggaggatatacaacaatgattatccgtacaaagacaacatctactgatccggaccctggcatcaggaccaatgcgccaggtggcaggcagatatacccaagtgattatccgtgtcaggttgcaggcggatatacccaagtgattatctgtacaaagataacatctgataatcctgacccgcgtcaggtggcaagcggatatacaacaatgattatccgtacaaagacaacatctactgatccggacccaggcatcaggaccaatgcgccaggtggcaggcagatatacccaagcaaatttacccaagtgactattcgcacaaagacaacatttgctgatcctgacctaggcgtcag

SEQ ID NO: 2844 - DNA, 597 bp, Glycine max
  Peptide Sequence Number=SeqID_119622
gtggcgctgacggatattaccgcgcgcaagaaagccgaagcctacctcgaatatctcggcaagcacgatgtgctgaccaagctgcacaaccgcgccttctattccgacgagctgaacaggctggagcgcagcgcgttgcggcccgtatcggcgatcgtgatcgatctcaacggcttgaaggacgcgaatgacaagctggggcacgatgccggcgacgccctgttgcgacgcatgggcgaggtgctgaacggcgtggtgaccgcgccgaaccatgcagcccgcatcggcggcgacgaattcgccattcttcttcccggcgccgacaagcaggtggccgccgccatggtcgaaaccgtttatgagctgctgaagatcaacaaccagttctattccagcgcaccgctcagcctgtcgttgggtgtggcgaccagcgaggcaggcgagacgatggaatcgttggtgcgccgcgccgatatgaatatgtacgagcagaaaaatgcctattacgcggcgctgcgtaacagatctgccgacaataacgacaagaccaatgccggcccccagccggaagccagctcgctgaagcgtttgtcctga

SEQ ID NO: 2845 - DNA, 162 bp, Glycine max
  Peptide Sequence Number=SeqID_119623
atgttgtatgctcagattgatgctgtctacgccaccatcaatgagaatttgaagcctggtcctgtttctgagagaaactatggcctttattacctgatggctttgtccaccaattttctcatctacatatttacatgtttgttgttcacttgggagctttga

SEQ ID NO: 2846 - DNA, 102 bp, Glycine max
  Peptide Sequence Number=SeqID_119624
atgacggacaacatagggaattcaaataggcgcccaaatgcaatcccaagcttaggaacccaagcttttagcttcaatgcaaggaaatatacttatggctaa

SEQ ID NO: 2847 - DNA, 255 bp, Glycine max
  Peptide Sequence Number=SeqID_119625
atggattctgtgccctttatcattcaggagcagcgagttgagtggaacaacaagttgggtggtaaacgcgcagagacagattatgcgccctttatcattcaagagcagcaagctgagtggataaacgcgcatagacgaattttctgccctttatcattcaggaacaacaagttgggtggtaaacacgcagagacatattctgcgccctttatcattcaagagcagcaagctgagtggataaacgtgcatagatga

SEQ ID NO: 2848 - DNA, 481 bp, Glycine max
  Peptide Sequence Number=SeqID_119626
agacccatgaactcattgcctagctctgttcatgtgtcctccaccatcgagtctggagccccgcgaattcattgcctagcattgttcaccaattcctcattctcagtcttattacggagacccatgaattcattgcctagcgctgttcatgtgtcctccaccaacgagtctggagccccgcgaattcattgcctagcgctccccgcgaattcgttgcctagcgctgttcgcaatttctccattctcaattttattcggagacccatgaattcattgcctagcgctgttcatgtgtcctccaccagtgagtctggagccccgcgaattcattgcctagcgctgttggcaaattctctattctccaattttattcagagacccatgaaatcattgcctagcgctgttcatgtgtcctccaccatcgagtctggacacccgcgaattcattgtctagcgctgttcatgggtcctccaccaacga

SEQ ID NO: 2849 - DNA, 804 bp, Glycine max
  Peptide Sequence Number=SeqID_119627
atggctacaaagaagcgtctcaccaaaagggcaaggaaggacaccgcaggggagggatccagcgcagccccacaagaagaaattgagtttgatggacaccatttccaggaggaggttgctaggaggcaatggactcaactgacagagcctatggctaagtatgacccaaagatagtcatagagttctatgcaaatgcctggcccatcgaggaaggagtgtggggccaatggatcccctatgatgaggatgccatcaaccagttcttggggcatccgttggtcctagaggaggggcaacgttgtgagttcaatgagagaagaagtcgggtctcaggatttgataaggaggccataggccacctactgtgctccccaggacaggactttgcgcgaagcgtgacaggaaggcgggtgcggatcatgcgcactagcatgaccatgtatcatgcctccaagacacccagtggaccagaaaagtccaacagagcactgggattttcggccttgatcgcaagtctctgccagttctatggggttccagttacgcccacaaggctcatccggcttctcattaacaggtcattcattgagaagtactgcatgccaagggtggagctctacatgcaacatttggctgaccacccttacccatggcctactccagagcaatttagggccactgttgcatggcctagggacaagcctaattttcaggcggaagctggccatacagaggccctaagggatgaggacggagttgaggaagatggtgacatggcagatgtgacagatttcttcctctaa

SEQ ID NO: 2850 - DNA, 243 bp, Glycine max
  Peptide Sequence Number=SeqID_119628
atgcaattatcatttaggggggggtcagttgtttctgcagctggtgaatcaggaggagcagctgtttcatctgatgatgcatcagagatgaaaatcagaggaggagatgggggaactgcttcaagttcaggcaaaaaaggtggattcaccactggagattgtgggttagctggctctgaattgacctgcacaggtgtgggctcaggcagagcaacctcgttgggtctcaccaatggaagttga

SEQ ID NO: 2851 - DNA, 183 bp, Glycine max
  Peptide Sequence Number=SeqID_119629
atggagattgcttcggagagatctggtgatggatctagcggactcaaggaagaaaatagtgttggtgatgatgatggtcgtcataaacaagagattattgtcgaggaaccactcgtggctaataccgaaagatccatactagaggctggacctagcacatccccaaacaaaaaggaagacgag

SEQ ID NO: 2852 - DNA, 399 bp, Glycine max
  Peptide Sequence Number=SeqID_119630
atgggaggcttgagcattttaagtgcccttccaaatttaactgccatcacagaggcaactgctgctgtcactcgccttttcgaaatgattgatcgagtgccgactatagattctgaagataagaaaggaaaggccttatcatatgtgaggggagaaattgaatttcaagacgtctacttctgttacccatctaggccagacacaccagtcttgcagggattcaatctcactgtcccagcaggcaagagtgtaggccttgtgggagggagtggttcaggtaaatccactgtcatacaactgtttgaaaggttttatgaccctgttgagggagtaatactcttggatggtcacaagactaataggcttcagctcaagtggttgagatctcaaattggccta

SEQ ID NO: 2853 - DNA, 1530 bp, Glycine max
  Peptide Sequence Number=SeqID_119631
atgaatatcggacaccagagatgcaattttcaagatatactaaagcaacaagggacaaaaaagaacgttgataaaggaaaggctgatagccatgaagaaatattagaggaatcggatcttgtttccctctgccttggaagagttcctaccattaatgcaagaagtgatgagaaaatcaaagtttctaataagccattgaaggatgatgaagggtttaataacgaagagttgactcttggactagagtgcaaatttgaaacatcaaagtcaggaagcacgactgaagctttgcctaataatattccaagcccagaaaatagttgtgaagtaccaaaggaagaaggtggggagagtaaggaggcactcaagactatgagagacagtacagaggatgaagttgctcagcaaaatcctacaaagaaacctcgagtttgtgttagagcaagatgtgacactccaacaatgaatgacggatgccaatggaggaaatatggacaaaagatttcaaaggggaatccttgccctcgagcttactatcgttgcacaattgcaccgtcatgcccagttagaaaacaggtgcaaagatgtgctgatgacaagtcgattttaatcaccacctacgaagggacccacaaccactctcttccaccaacagccactgccatggcatccacaacttccgcagctgcctccatgctcttgtctggttcatcaacctctaactctaactccgcctcaataccttcagcaacccccacaaatctccacggcctcaacttctatctctctgaaggttcaaagccaagacaactatacctatccaaccctgcactatcgtcttcaccttcacatccaaccataactctagacctcactacttcacaccctgcagcatcttcctcctcatcatcaccctttttcagattcaattcaaactacaacaacaacaaccaacccagatacccttcttcctcatcaagcctaagcttcagtagtaataattcctcccaaattgccaatgctatatcttggagcaacggcttcttaaaccacaataatagggacatccttagtagtgtgaactttggaagacaacaacaaatggagaacgtgtaccaatcctacatgcaaaagaacaacagcaacaacaacaacaacaacacaagccttgttcctcaagctgatactatctctgcagcaacgaaagtgatcacagcggaccccacttttcagtcagctttggcagcagcactttcttcgtttattggtggcggtggtgttggaaacacgcgaggaagtcaaggttgtaatttcggagaaagtttgagtttgggtcagaaaatgaaatggggtgaggtgtttccagtgtcggagaaaggttgtgcatcgagcttcgtgaacaaaacgccggtagcgaatacacagacggaaagtttgatgtttctgccgccgtcgtctttgccgttttcttctaccaccaaaagtgcatctgcatctcctgctgataatagcaacaccaccatcaattga

SEQ ID NO: 2854 - DNA, 165 bp, Glycine max
  Peptide Sequence Number=SeqID_119632
atggaggaagaaattgagtcaccccacccgttatgtgtgtatggcttcggaatgaggcagtttaaggaaaacgcaagagcattcgaaggatggagggttgtgggtgtgggatcgaaaccagtggcggcagaggaaaaaaggttattttcattccttaaagtgtaa

SEQ ID NO: 2855 - DNA, 489 bp, Glycine max
  Peptide Sequence Number=SeqID_119633
atgtcgactcctgctaggaagaggctcatgagagatttcaagaggctgcaacaagaccctcctgcaggaatcagtggcgcccctcaggataacaacatcatgctgtggaatgctgtcatatttggtcctgatgatactccatgggatggaggcacgtttaagttgattcttcaatttactgaggattatccaaacaagccaccaactgtacgatttgtctctcgaatgtttcacccaaacactactaatgccatttttctactctgggaagtttatgcggatggaagtatttgtttggatatattacaaaaccagtggagtcctatatatgatgtagctgctatactcacttctatccagtcattgctttgtgatcccaacccaaattctcctgcaaactcagaagcagctcgaatgtttagtgagaacaagcgggagtacaatcgaagagttagagaaattgtggagcaaagttggacagctgactaa

SEQ ID NO: 2856 - DNA, 294 bp, Glycine max
  Peptide Sequence Number=SeqID_119634
atggcggtgagctgcaaccgtggaggattaggggcagtttctaaggacatatttgttctggcaggacagagcaacatggctggaccaggtggcgttttcggggggaaatgggaaggtaatgccccagcggagtgcaggcccagcccatgggttttgaggcggagcgcgggcctggagtgggaggaggcacgtgagcctctgcatgaggacaacgatgtggccaagacatgtggcgttgggcccggcatggcgttcgcgaacgaggttgtcaaagcccgtggtggatgcgtctaa

SEQ ID NO: 2857 - DNA, 195 bp, Glycine max
  Peptide Sequence Number=SeqID_119635
atggctatgcttactgctttccaatggcctaagaatataaatacgctacacaacaacatctcctttgaacttgactgcaaagttgtcactgatagttttagcaaagttacctcaattcaatctgagtttgatgctattattcttcaggcaaagcttttacacctcctgttatgcagcaaaaacacaatttcgtag

SEQ ID NO: 2858 - DNA, 1254 bp, Glycine max
  Peptide Sequence Number=SeqID_119636
atgtcatcttcctcctatgaactcatcctcacaaattctcctgatggccctatcacggtctacgagaccaccactggcaccgtcgtggcccgattctccggcagtcgatccccatgtcgcggcctaaccgtggtgggtcgaagactattcgcggcctcgcacgtgtcctccgaaacgggtgcaggctcgatcaacatttacaactggtttaattctactgcgttccacaacttccctgtgcctgaacccgttgcacctctcattgctacccatgatggaacatttctctttgggggtggcatctcagggagtcttttttctatctcaactcattctggggatgtgatcagatcaattgctgcacactcaagatcagtttctagtcttcatctgagtgatgatgggtcacttgttatttcagggagtgatgatggcacaattgttgttgtccctacctttaagattgttattattagggcttccttggatgaggacatggaagacttgatcttgcacaaatggaaggcacattctgattccgtgactgctttcaagtctgtgatgggtactttgctttcttgctcactagattgcacatgcaagttttggaatctgggagataatggggttctcttaaggattgtggcattcccatgtgccatttttgggattgccttggattcaaaagggttaggattctatgttgctggtgcagatggtttggtttataagggggcaatgaaggctgggagtagaaaattattaagtagagtttgtgaattgagcacttggtctaagagccatggtaggtcaattgtgtcattggctttggtgaatgaagggaggaatttggtgtctgctgcagaagatgggagtgtgtggatgtgggatgttgacaaaggagaagtcgttatggatatggggaatgaggtggtaatggtaaacattagtgatatggttgtggccaggggaaatggtgagtttggagtcagaaaaggaaataatgttgcaattgaggaaggtaatgggtcattcacttcttatgggttgtgtgatgaagagatgatcaagactcttgagcaaatcacaaagcttggggaggttaggggtgaggtggaacaacacaagaagaaggtcattggcatgttggaatctacaattgaaatgtatgagaggtttttgaagcttatccttaaggaagctaccaaagccattgaagaggggggagtggaagatgataaagatgaagaataa

SEQ ID NO: 2859 - DNA, 255 bp, Glycine max
  Peptide Sequence Number=SeqID_119637
atgggagtgtctttcatgaaggctcggagagcatttagggccctaaaaggcattataaggttgcaagcactcatccgtgggcacttggttaggagacaagctgttgcaacattatgctctatgtatggtattgtcaagtttcaagcacttgttcgtggaggaatagttagacattctaacgttggatctgaaatccaagagaagtgcaacatattgaaccctctgaagaagctggtgcattatacaggctgttag

SEQ ID NO: 2860 - DNA, 1269 bp, Glycine max
  Peptide Sequence Number=SeqID_119638
atggtgctgcagctgcaatatgttcctggtgatccaaattctgtcctaagttggttggagcgctggtcagcatctcatttttggaaaccagttccccagcctaagaaaattcgggatactaagtctcatagaaagcatggcaatatttcagttggagatactcatatgagcaagtcaaaacgaaccaacaggaagcttcctactgcaagttttgactcagtcccagtgcaagcacatcctgaatttgaaaaaccaaaacggaacatgaggaaaattccaagccaatcctcagatcctcctgtgcaggaaaatccacaaagtgagcttgaaaagattaaacgtaacctgaggaaagttcataacccagttgttgagaatgctgttccgtcagaagttgaatcggagacgccaaaggatcatttggaaaaggcaacagttacctcatgccttgctgtttcagaacaagaggtcattagttctaatgagaagatcaagaaggaagcaacattaattgtttctagtgtgccagatatagaaactactccaagactttcagttagtaaggaggtgttagactcaccaagcagttatcaagtgactgtggaatcaaaaccattgactgagattacaactaaagataaaaacattcatgtttctgatgaagtaaaaaacgagcccatagatttaccagagcctatttgtaaagatgaaaattctcacttaacaaatggagatttgagtcacaaggaagatcaaataggcagtgaaaaccagaaaccaaacggaaaagcctcaattgtagcaaagcaggaacgtgcagagaatggtatacagaatagtccagcactaccaagttacatggcagcaactgaatctgcaaaggcaaagttgaaggcacaaggatccccgagatttggacaagatggaagtgaaaaaaacaaccatactcggcgacattctctgccatcctcaactaactgcaaaattagttcgcattcacctaggacactgagacaagttcaatcaggaggcaaaggtggccacagaagtgacagaactgtatcatcttctagagatgggaatggaaaggtaattcaagcagagtggaggcgcacgtaccttggtaggcaaattgatcttagagggtttcttttagaaactaatccccaaccagggtctgatttgaaacattttgcgatgagtgttttgttgaggggaatggcgaaagacatatttcgccaagaggaacagcgaaatagaggtgtatga

SEQ ID NO: 2861 - DNA, 495 bp, Glycine max
  Peptide Sequence Number=SeqID_119639
atggtggcttctatattttcaaatgttaagactgctacagtaactgcatatattggtgtctttggaaccgggttattagctgtctttcttttccaattctttgttcaaaatacatcatttccaagagggtggataattgttatggagttttatcctgggtttgctttatatcgtgggttgtatgagttagcacaattttcctttcaagggagtagttcggggtcaggtggtatgaaatggcagaatctgagtgaaagcaccaatggcatgaaagaggtcttaattatcatgtttgttgagtggatagtgatgctttttgctgccttctacgttgaccaagtattgttgtcaggaagtaggaaaagtccgcttttttacttgaaaggatttcagaaaaggcctcctttccaaaagcttgatgcccaaatgcaggggtcaaaagtattctctcaaacggagaaaccagatgtcatccaagaggtgagtattacttaa

SEQ ID NO: 2862 - DNA, 1029 bp, Glycine max
  Peptide Sequence Number=SeqID_119640
atggcaaatcctgttcccgcgagcttctggactcaagcaaacgcgcttcttcgcaagaatctaaccttccacaaacggaacgtgaaaacgaacgctcagctggtactgttcccgctgatcctcttcttgctgcttttcgcgctccaacgcctcatcgatacgcaattcggtggctccatcttcaaatgcggctgcgtctgcgccaacaacacaacaacaaccacccaagaacaacactctcgctgccctgactcagaaaaagtttgtgggatccactattccgattccattcaagctgccttctgcgccattcccaaccccatcgagtggccaccgctcctgcagcttccggctccgcccaaccgcgccgcgcgaaccccttctctcccccttccggattttcccgatgcctcgtgccggagaaccgactcgtgtcctcttactctgctcttcaccgcactcaatcactcctttgcggaaactgtgtctgctaatatgtttgggagtgccttgaacgtaagtgatttcggtagtgatttcttggctagtttggccatgaatgtactgggatctgaatcaacgcctgggagtaacaattttattgaacctgctttctcttctggtctccccatttattatctacaaacaaagtgcacagacacagagaaatctggactctcctttccctcgctgccggcagcagacaatgagatcaagtgtgatcaggctctaaatttatggcgtaatagttcttctgagatcaacagtgaactatataaaggttatcaaagaggtaactcagatggacaagtcaatgagatagtttcagcttttgattttctaaattcgaacgggaatggatataatgtctgtatatggtacaactcaacctatgagcgacacacaggatttggtcctagtagtgtgttattgcggattcctcgctctataaatctggtatatacatctaaaacttgtttcaattgttgcatcctctttgctgttatcctaaccatggatacaacataa

SEQ ID NO: 2863 - DNA, 298 bp, Glycine max
  Peptide Sequence Number=SeqID_119641
atgtctaaggcacataaacatcataagaaaattgggttttatgaactgaagagaggagatcttaggttgaatttgacaaattacggtgctacaattatctcagtcataacacctgataaacatgggaaattagccgatattgttcttggctacgattccattgattcttataagaatgatacagtttacttcggtgcccttattggacgtgtggcaaataggattagaggagctaaattcactttggatggcaaaacctacaaattgcccgctaatgatcacgggaacacacttcacg

SEQ ID NO: 2864 - DNA, 372 bp, Glycine max
  Peptide Sequence Number=SeqID_119642
atgtttgaaataagagaaaagctttttactctggtccttcaacttggcatcagagcgggttgtcgccgtccgccgttcgccgccgcaccgtcgccggctgccgtcatctccggggttcagatcgcctcgaaaagtgcgacccaaccctgcaacttacgccgccatagtccgccgcatgcgcctccatgcactgcttcttcctccgcgacttccggcgcgtgcagcgcacgcgctgccgtgccggcgtcggaagctacctcttccggtcccagcagcttcgtcgtcgcctcctgggtctatttcaggcttcacctcccacttccggcaagccgtttggtcaactcttgtgtgttttcctctcttatgtgttag

SEQ ID NO: 2865 - DNA, 546 bp, Glycine max
  Peptide Sequence Number=SeqID_119643
atgatagcaaagccagtggacaaagccacaccagtgaatctagcacagcatacttactggaaccttaggggccacaacagtggtgacattctttctcacactgttcagatctttggctcacacatcacaccagtggacaggcttctcatccccaccggcgaaatcatatctgttaagggcaccccttatgatttccttgaaccaaaaaaagttggaagccagattcaggaaggtctatatgacatgaactatgtgctagacaaaagtttcaaaaagcacttaagtaaggttgttgtggtgacagaccctgtctctgggaggaaattggagctttggtcaaaccaacttggtctgcagttctatactagtggccagttgaatgctaccaaaggcaaggatggagccgtataccgcaagcatgccggcattgccttggagacacagggtttcccagattctgtgaattacccttactttccatcccagattgtgaggcctggggagatttataagcacaccatgctttacagattcacaactagctaa

SEQ ID NO: 2866 - DNA, 1227 bp, Glycine max
  Peptide Sequence Number=SeqID_119644
atgggtactttagaacgcttttcaactgaagaagatgaaagacctagaaagttttcgaaactttcagatgatcctgaggaggaggatgctatgcagattgatatgggttctcttttagcttcccaagaccaaggcaatgatcatccgaagcatgcacccaagaagacgggaaaggtggtgcgtgacccaaaatggcttgttaacgaggatgtctcaaccggtgttctccttcacctgtcaaggtatgagtatggctcaattgcctcactgaacaggaatttcttgtctctgattagatcaggagaactctaccgggtcaggcggaaattgggagttgtagaacactgggtttacttctcttgcaacatccttgaatgggaggtgtttgatccaatcaatggccattggatgcacttgcctagaatgccttgcaatccgtatgactgcttcgtgttttctgataaggagtctttggctgttggcacagaacttcttgtgtttggaagggcaatagaggcttgtattgtttatgaatatagcctcttgaccaacaaatggtcacatggtattcagatgagtgttcctagatgcttgtttgcatccgcgagccacggtgaaaaggccatagttgctggtgggagtgcagagggcaagatcttgagtgtggctgagctttataactcagacaccaagacatgggaggttcttccaaacatgaacaaggcaagaaaaatgtgttctggcgtgttcatggatgggaaattttatgccatcggtggaatgggggaagatggtaataggctgacatgtggtgaggagtatgatttggatacaaaagaatggcgtgtgattcctaacatggtgcctccgcgaatccagggaccagatggccctgaggcacctcctttggttgcggttgtgaacaatgtgctgtatgctgcagattatgcacagatggtgatgaggaagtatgtgaaagagaggaacaattgggtctacgttggaggtcttcctgagggagcatcctctgtgaatggttggggatatgcatttcgtgcatgtggagatcgaattgttgttattggtggggaaaggactatgggtggtgaaagtatggttgaaatcaattcttggatccctgctcaaggtgcaccacagtggaacttgcttgccagaaggtgcattggtgggaactttgtgtataattgcgcagtcatgggatgctga

SEQ ID NO: 2867 - DNA, 342 bp, Glycine max
  Peptide Sequence Number=SeqID_119645
atgggtttatacacgagcgtgatggaagagataagtttttacacagggctatctcccgctgcgtttttcaccattttggctatgatggtcgtcgtttacagaaccgtgagcggcatgtttgtgtcccccgaagactacaacaagccccccgtcgtttcggcccgagccaattcccggttagacgagtccgagccgccgcgcgaaccggtccaattgggcgaaataacggaccgggaattgcgagcctacgatggctccgaccccagcaaacccctcctgatggcaatcaaaggccagatctatgacgtgtccaatggcagttggagcaggctcattgcttga

SEQ ID NO: 2868 - DNA, 330 bp, Glycine max
  Peptide Sequence Number=SeqID_119646
atggatgaattaaagatcctaaacatcccctcagagatgtttaaactctttaaccactctattttcccccaccagggacatctgataagggtttttcaaaggaagtttaaaacaccctattacagtacccaacacataagagatactaagagtgatagaaggaagagagagaggagacgccacttcaaggagaagatgagtctagaagaagctcaccaccataggaggccatggataagagcttggaggaagaaggagatgaatggagggagagggagggaagagcacgaaattttgtgctctaaaagagctctgaaatctgaagtttaa

SEQ ID NO: 2869 - DNA, 165 bp, Glycine max
  Peptide Sequence Number=SeqID_119647
atggaagacgtacccgtgagccccacttcgcccttccaccgaaggtcaactatagaatcacacatagagattctctttgtttctaggtgttgggtaattgattatcctaagatacaaatcctttcttcttccaaaactggcttaggcattcgattaccaagttag

SEQ ID NO: 2870 - DNA, 213 bp, Glycine max
  Peptide Sequence Number=SeqID_119648
atggattacgcaccgttaatggtctcattttcttcctccatcaatttctcaataagaagtgacgatccatctgacaaggagggttgctgcgagcgcgcggtgtcagcttatagcggcatgatccttgcggttctgaggatttcaatgtccccgtggcgtgagcttgtaacagtcattacggcggagcatggtggtggccgggctcggagctaa

SEQ ID NO: 2871 - DNA, 627 bp, Glycine max
  Peptide Sequence Number=SeqID_119649
atgcgccaccgccgcctgtagaggaggtaccatcgctgaggtccatctccgatcacctgtggaggatagaactcctgatgcagaactgagggacaaggagtatgctgagttccaagaggaaatagcccggaggcaatgggctcagctcgtatcacccatggctaagttcgatctggagatagtcatggagttttatgctaatgtttggcctacagaagaaggagtcaaagataagtgcccctgggctagcattgcgagtttagccagaggaggagtcaggcctttggcttcgatgaggaggctatcagccatttgttgtgtgtttcggggcaagactttgcccaaagcggattacgcctctgagacacccagtggacccggagaagtccaacagggccctaggatttcctactctgatcacaagccttttctagttctatggagtggtcaggcaacccagcaaccagatgaggaccaacagcagccagctgcaaatgcaccaccaccgcatctagaggaggcgattaatcacagtggacaggtgcagttgaacaagacatgctaccattacaacatgcaccagcagagtcaggaccccaatcctttcccttggactacccccgaaca

SEQ ID NO: 2872 - DNA, 492 bp, Glycine max
  Peptide Sequence Number=SeqID_119650
atggcgtcgagtataggcatgatggacagtgcctactttgtcggcaggaaccagattctgacctggatcaacaacaggctccacctcaatctctcacgcattgaggaggctgcatctggggctgtgcaatgccagatgatggatatgacgtttccaggggttgttccaatgcacaaggtgaactttgatgcaaagactgagtatgatatgatccagaattacaaaattctgcaggacgtgttcaataagctgaaaattgacaaacatgttgaagttagcaggcttgttaaaggccgacctttggacaacttggagttcctccagtggctgaaacgttactgtgattccgtgaatggtggcattatgaatgagaactataatcccgtggagcgaagggcaacactctcagtccgtacagaacctctggttagctacttggtgtggttcaattctgattctaagttcagcatttcgtctgatggatttgcctag

SEQ ID NO: 2873 - DNA, 333 bp, Glycine max
  Peptide Sequence Number=SeqID_119651
atgactttagtcaagattgcttttgcagctatagttcttgctgtcatagcttgcaatgggtttggattcacgagtatatcaagaatgtcaggtcctaatgaatgtcacagaagtaatgaatgcaccttgattttaccttattgtaacggagaagctatttgtcgcaatggtttttgcatgtgtgaccagactaaggagactaaagaagaatgctcgacaccagattgtaaaaacatggttaaatgtgcaacgcttatgtgttttccaccatgtgatactccatatcttaacatggaaactggagaatgcaaatgcttgtgtccgaacgactga

SEQ ID NO: 2874 - DNA, 465 bp, Glycine max
  Peptide Sequence Number=SeqID_119652
atggagaaaaatgagctgaaggaggagaattgtagcctagaaacccaaattgagaaacttcaaggtcagatacaggcaagactggctcaatgtaaacctgacctgaatgtacctccccatttggaacttgagccactggagcagacaaattttcctggacagaatctccaattgcataccatagaacctaacttgcagcaaggatctgcgattttggttgtcccctgtaatcctgatcttccaccttcttttccagctcctaatgttaccggggtcatgccgaaatctacatctgttgtcagtaaaccacatgccagtattggtttaacatgccaactagctttcccgatagcaaagcctctttggagctttcatgccttaaagccattagttacttgtagaaatgtttttgcggtgcttttccatggcaccatatccgatgtttacttggcacttagtttttaa

SEQ ID NO: 2875 - DNA, 255 bp, Glycine max
  Peptide Sequence Number=SeqID_119653
atgggatcagagagtgcggctccaatggttgagacatcaaaaaacaggtcttcttctgataaaatgaaccaagggaaagtccccaggaaaattcacaaggctgaaagggagaaaatgaagcgtgagcatttgaacgatctctttcttgatcttgccagtgcacttggtaaccgcttgtgccatcatcatgttgctaaaagacttgctcagtcagatcgagtccctcaagaaagagaatgtcactctgttgtctga

SEQ ID NO: 2876 - DNA, 1242 bp, Glycine max
  Peptide Sequence Number=SeqID_119654
atggagggaggcgacgatctccagcaccaccatcgtcagaacaacttcccattccagctacttgagaagaaagaagaccaagaaaccgcgtcatgctccacctcctccccttacccttccctagcaatctccgcggaaccgagcatgtccaattccacccgatccaaccagctctcggcggccgaggcttcggcggaggcggcgaacagcaaaaagcctccgccgaagcgcacctcgacgaaggaccggcacacgaaggtggacgggcgcgggcggcgcatccgaatgcctgccctctgcgccgcccgcgtcttccagctgacccgcgagctgggccacaagtcggacggcgaaaccatcgagtggctcctccagcaggcggagcccgcggtgatcgccgccactggcaccggcaccatccccgccaacttcacctccctgaacatctccctccgcagctccggctcctccatgtccgtcccctcccagctccggtcctcctacttcaaccccaacttctccctccaacaacaacaacgtagaaccttcttccccggcatagccctttcctccgaacacaacaccaccaccaacaacacatcaacacttgtcaatttccaacaatccaacaacctcaccaccaccatgctgcagcagcaggccaagccggagcttcgcgacggcctaccatcttccttagacatttcagacacaagaacaaacacagaagacccaagccgcaaaagaagaccaactacagaacaacaagacctatcccccaccacgcagcagcagcaccaccaaatgggaagctatctccttcaatctagtgcaggcgctattccagcgagccacgccgccaacatatggatggtggcgaattcaaactcgaatcaggtcatgagtggcgatcccatgtggaccttcccaccggttaacaacagtgctttgtatcggggcaccatgtccagcggcttgcatttcatgaattttccaacgcccatggcgttgttgccgagtcagcaactaggttctgctgggaatattggtgctgttcatggaggaagcagtaataataataatcacaataataatatgaatgaagcacatttgagtatgcttgcagggcttagtccttatcgacctgttattggcgtttcggaatctcagccgagtggctcgcaatcgcatcgaggaggtgccgatgatcgacatgataatagctccagtcaccactcctag

SEQ ID NO: 2877 - DNA, 678 bp, Glycine max
  Peptide Sequence Number=SeqID_119655
atggagaatgtgatgaacactgattcacatggtgcactagagttagaacatgagcgaacacccgcaccaccctcttcttcttctgctgctgtttgtgcttccaagaaaagcaggaggggtagtttgaccataaccctaacagcaggccttggactcttatccataggagctggtggctttaggccatgcaacattgcttttggtgctgaccaatttgacaccaacacagagaaaggaaggggacaacttgagagcctcttctattggtggtacttcactttccccattgtacttgttgtagccctcactgttgttgtctatatccaaaccaacataagctggaccttaggatttgcaattccaactgcttgtgttgccttctcaatcaccatcttcctattcggccgccacacttacatttgcaaggagcctcaagggagcatcttcacagacatggctaaagttattgtggccgcgtttcaaaaacacaacattcaggcttctggtagagccatttacaatcctgctcctgcttctacattggagaatgataggattgttcagacggatgggttcaagctccttgacaaggctgctataatatctgatcctaatgagttgaatgaccaaggaatggctaggaatgtttggaggctttgtagtttgcaacaagtgtaa

SEQ ID NO: 2878 - DNA, 219 bp, Glycine max
  Peptide Sequence Number=SeqID_119656
atgagaggaaaaagagcatgtatagggggtcatgacttgaatctcaataggcttgacctctactattatttcattgccgcactaggagttttgaattttatctacttcaatttctttgcaacccgttatataattagtgatgaggaggatgagatcacagaggtgcagccagaaaattcaattgctgtgggagaatcatctgaaccaaatgatgagaag

SEQ ID NO: 2879 - DNA, 180 bp, Glycine max
  Peptide Sequence Number=SeqID_119657
atgtacgtgttgtgtcctgtccacgagggttttgcagacctgcgttggaagcagagaagtggaccagcttaccctccacaaaatcaacatatattttgtaataatgtagcatggaagcttgcgagttacaacagtatcaaactcaaaggtcaatgcatgtttggtcccactcgggcttga

SEQ ID NO: 2880 - DNA, 141 bp, Glycine max
  Peptide Sequence Number=SeqID_119658
atgaccacagatcaacctccactccctatggctcacatatgcccgggtatagggcccaacatcaaaaggcttaactctctaacaactccccagtggagtcgccatctgtcgcaacctaccctacgacgggggtgcgggtga

SEQ ID NO: 2881 - DNA, 399 bp, Glycine max
  Peptide Sequence Number=SeqID_119659
atggtgtcggcgaacaaggagatggtcgtgtactgcttcgacaccctcctcgctcactacaacagcacggaagctccttcccctgccttcgatcaggctcaacatccattgtttgttacatggaagaaagtggtgaatggtggagatcctcgtcttcggggttgcatcggaactctggaagcacgcagcttgatcaatgggctcaaagattatgcactgaccagtgccctcagggaccggagatttccacccatacaggctaatgagctgccgcttttggagtgtacagtgtctcttcttactgactatgaagctgctaaccattaccttgactgggaggtatgtgctgatttacttgttttagtttctgggatattgctggcagaacttaagtgttga

SEQ ID NO: 2882 - DNA, 657 bp, Glycine max
  Peptide Sequence Number=SeqID_119660
atgctgcctacggcaacaagttccttcggtagaggaggaaggtctagcaaaggaacagtactggctccaccagagccaaacaccaaaaaggcatcctcaacatcttctgggtcatctacccaggctgggtcatctacccagaaatcaaaacttgaagggtcattaacccaactaacaatcaaacctgagtcatcaactcaggagtccccaaaaccaatcaccaccaaacagaccatggcagattatgcctgccaaaaagacctcgcagaaatggcttccgaatcagatgatgattctaaaacagaactccgaaaacaaatccaaattgtcaagcaaaccaagacgatggagccggagtattgggagaagaatccctttaaggcgactgcaaaagctttcccggagggattccattacaaaccgacgaccctcaacaaaactagaaaattctatgagttcatcttagtggatacaaattcagtatccattaaacacttcaaagaccccaaagatccaaacctgaatacccattcaaccattcaaattctaaaagtaatgcaacctcggcattacagatcaaacctaaaccaacccaagaaattttctgcttcgtttgacccagcaggagatacttattgggattacattgatgcctga

SEQ ID NO: 2883 - DNA, 273 bp, Glycine max
  Peptide Sequence Number=SeqID_119661
atggcaaggttctcatcgactggttatgcctcgcatttgttgggattgccaagttggcattgtggaaagcacaaccacaaactcaatgccatatccccaagaaacaacaagtcaacgagtatatctgaggtaccactctgtacaaaatcattgaaaggtgaaccaagtctaagaatcatctggactgaacatcacaacaatacagatcccatcaacacctcatggtggaaaccgtcaatcgatcatcatctagtgacctctcacaacttctag

SEQ ID NO: 2884 - DNA, 723 bp, Glycine max
  Peptide Sequence Number=SeqID_119662
atgggaatattcaaaagacaccatgcatgtcctatctgtgagaaagagacaagttgcatccaattgaaacatggaaaaaagacagtagatacgaggtatcgaagatttttgaaaccttatcacccttatcggcaattgaagaaagcatttaatggaagccaggagattgaaagtgtaccaaaacccttagttggacaccaaattgttgatcaggccaactacatcataactatctttgggaagacacaaaagaaggatgcttctgagaagaacattcggaagaaaagatgtatgacattgtatagaaataatgcatgtcgagaaaaatgtgttgaaggttatacgaagaaccaatacctaccagatgcaagcattgttgaaaggtacattgctgaagaagctattgagttttgttcagagtatatagaaaccgctacacctgttgggcttcctcaaagttttcatgactgcacatgggaaggtaggggtacacgaggattaaatgttgtaacaatggatcaccgggacgtctcacaagtgcatctgtatgtattaactaacacaccaaaggttattccatacatagatgctcacaaacaaaatgtcacagttactcacccaaaaatgaacatgatgagggtgttatataagaacacaatagaacattcatcaactagtttagaaaaacaatcttcgctaatgacaatgcttccaaaacattaa

SEQ ID NO: 2885 - DNA, 429 bp, Glycine max
  Peptide Sequence Number=SeqID_119663
atgagagatgatgagaaaagaaaagtgcaagatgatcaaaaaggaaaaaatattctaacttatggtttatcgtctgctgaattctttcgtactgcaaggtacaaaagtgcaaaagaaatatggaacatgcttgaagtcaatcacaaaggcacaacggataacttgggagccaaagattacaactatcaaggaatccaagaatcttgctacaatgacaatggaagctctcttcggaagtcaaatgacagaaaattctctaaatcctccaagaaagttgacaactccaacaacaacaggtacacatgttttgagtgtggacgtggtaagcaaggccatattaaatctgagcatcctatctatcttgagaaacatggtggtgaaaagaaagctaagaaggataggaaacaaaagaaagcctacaatacatag

SEQ ID NO: 2886 - DNA, 255 bp, Glycine max
  Peptide Sequence Number=SeqID_119664
atgaagatggatgaagccaatctaatctcttctccaatggttggtagctgcaagttaactaagtcaagatatgattctttccctgatctcactctctatagggaaaaagttatggccaagcaacttcaagttatccatgttccagccattgaccaaagagtagatattctaaccaaggttttcactcctttaaattttactacatataagtctaagctcatagtggttaaaaggcattttgccaatccctcatga

SEQ ID NO: 2887 - DNA, 492 bp, Glycine max
  Peptide Sequence Number=SeqID_119665
atgggtgttaagcctcccaaagtgttcaacaacggtccccagatgaaattagggtgtaacagtctatttacacacccccactttgctaaatacactcccgttttcgtgttcttggccggtttcactccaaaacatccaggagctttacggattccatggcgatgggtgttaaaaattttgaagtggtcaaacgaaattcgcatgccgacaaaaaatggtccctcgatgaaattagggtatgacatgtacaaagataaggtcaaggaaaaccccaatggcaccatcagcaagtacaaggccatacttgtggccaaaggttttcgtcaacaacttggttatgattacaatgagaacttatcccctttaattaaaccagttactgttagaatccttctctcccttgctattactcacaaatggggccttcaacaattggatgtcaacaatgccttccttaatgacattcttgaagaagatatctacatgagttag

SEQ ID NO: 2888 - DNA, 321 bp, Glycine max
  Peptide Sequence Number=SeqID_119666
atgctagtggtgtggtctatacaatcatacgacaaagaattgtttgaagatagaggaagattcatagggacgaaagataatgcttatgtagctggtggggacgcaagcgagggcctaatgacattgcaaatgctacccgtaactctcatggggctaataagaaaaagagaaaccgcatgggagaatcaaggcaacactgtttcaaatttggttgtttgtgttatcgtgctgcatttcggatttagttttcctttgtcgttgtgtctcatttcaaatctggcttcagatctcaagcaagaaggtgatggaaatgcgttttag

SEQ ID NO: 2889 - DNA, 345 bp, Glycine max
  Peptide Sequence Number=SeqID_119667
atggaaaaatctcttttgattgtagaagaagcaaacttatcatccagatctttttctggaagagttagtgatgataaagctaacagaagtggaaggaagggtatggttcttccttttcaacctctatttctcacatttgatgagatcaaatattctttagacatggcacaggaaatgaaaaagcaaggagtttttgaggaacgtcgagaacttttgaagggtgttagtggtgtctttaggccaagagtactaacagctctgatgggtgctattcaaggagttcctaagatcaagaaggttataatcctgcaacctggatgttggaagttacatcagcaggcatag

SEQ ID NO: 2890 - DNA, 663 bp, Glycine max
  Peptide Sequence Number=SeqID_119668
atggttggcgacaacacgaagaagttgaaagtcgccgagaatttggaggatagcatcgacggcgaactcgtcctctccatcgagaagctgcaagaagtccaagacgagctcgataagatcaatgaagaggcgagtgataaggtcctcgaagtagagcagaagtacaatgagataaggaagccagtttacaataaacgaaatgatgtcgtcaaatctattcctgatttctggttcactgcttttatgagtcatcctgccctttatgaacttctgaatgtagaggatcaaaagatatttatgtatttgggttctcttgatgttgaagataataaagatgtcaaatcaggctactcaatcacctttaatttcaatcccaatccctattttgagaatataaagcttacaaagacttttaccttccttgaagaaggaacaacaaagataactgctacccccataaaatggaaagagggcaagggattacccaatggacttgatcatgacaagaatgggaacaagcgggtcgtattgatatcagttgatgaaagtcatggtcatgctgcattaggtttccttctatttgacatagttgatgtgccattgtcttgtcttctgccctcatgtttgctttgtggtatgtggttcatgagggatgggcattga

SEQ ID NO: 2891 - DNA, 2322 bp, Glycine max
  Peptide Sequence Number=SeqID_119669
atgagtcgtacgttgcttccaaagcacgttgccgcggtggtgaagatccaaacggaccctctgaaagcgctcgagatgttcaactcggctaaaagcgaggacggcttcaagcacacggcatcgacgtacaaatgcatagtccagaagctcggccaccacggcgagttcgaggagatggagaagctgctttcggagatgagagagaacgtcaacaacgcgcttctggaaggcgcgtacatcgaagccatgaaaaactacggcagaaaagggaaggttcaggaagcagtggacacgttcgaacgcatggacttctacaactgcgacccctctgttcactcccacaacgccatcatgaacattctcgtcgagttcgggtaccacaaccaagcacacaaagtgtacatgagaatgagagacagaggggtgcaatctgatgtatacacctacaccataaggatcaagtccttctgtaaaaccgcgaggccttatgctgctctcagactccttcgcaacatgcccgaactcgggtgtgattccaatgctgtggcctattgcactgtggttgctgggctgtacgactccggtgagcatgatcatgcacgcgagctgttcgatgaaatgctcgcgcggtgtttgtgtcccgatgttgtcgcgtttaataagctcgtgcacgtgctttgcaagaagggtcttgttttcgagagtgagaggcttctcggcaaggttttgaagaggggggtttgtccgaatttgtttacctttaatatcttcgttcaagggctttgtagggagggtgctcttgatagggctgttaggttgttggctagtgtgtcgagggagggactgagtcttgatgttgtcacgtataatatacttatatgtgggctgtgtaggaattcacgggttgtggaggctgaggagtacttgcggaaaatggtgaatggtggatttgagcctgatgatttaacctacaatagtattattgatggatactgcaagaaggggatggtacaagatgcaaatcgggtgctgaaggatgcagtttttaagggttttaagcctgatgagtttacttattgttccttaattaacgggttttgtaaggatggtgaccctgatcgagcaatggcggtctttaaggatggactgggaaaaggtttgaggccaagcattgttctttacaataccttgattaaagggttgtctcagcagggtcttattttgccagccttgcaattgatgaatgagatggcagaaaatggttgtcttcccaatatatggacttataatttagttataaatggcttgtgcaagatgggttgtgtttctgatgctagtcatcttgtagatgatgctattgccaaagggtgtccaccggacatatttacctataacactttgattgatggctattgtaaacagttgaagttagacagtgcaactgagatggtaaatagaatgtggagtcagggcatgactcctgatgttatcacatacaacactttgttgaatgggctctgcaaggctggaaagtctgaagaagtaatggagattttcaaggcaatggaggagaagggatgcactccaaacataattacatacaacattattgtagacagcctttgcaaagctaagaaagtaaatgaagctgtagatttgcttggggaaatgaaaagcaagggtttgaaacctgatgttgttagttttggcacattgttcactggcttctgtaagattggggatattgatggtgcataccagttatttagaaggatggaaaaacaatacgatgtctgtcatacaacagcaacatacaacatcatagtcagtgcattttctgaacagctcaacatgaatatggccatgaagctcttttctgtgatgaagaacagtggctgtgacccagacaactatacttatcgggttgtgatagatggcttttgcaaaatgggaaatattactcaaggatacaaatttcttttggaaaatatggaaaagaggtttataccatcactgacgacatttggacgggttttaaattgtctttgtgtaaaggacaaggttcatgaagcagttggtatcatccaccttatgttacaaaagggtatcgtgccagagactgtaaatacaatttttgaagctgataaaaaggttgtagcggcacctaagattcttgtagaagatttgttgaaaaagggccatatagcttattacacttatgaactactatatgatggtattagagataaaaagatacttaaaaaaagactcccaactgtgaattctcttcatcgaggggccagttcgtcagctgttgattag

SEQ ID NO: 2892 - DNA, 1365 bp, Glycine max
  Peptide Sequence Number=SeqID_119670
atggaatcggcgggggagtggctggagaaggcgttggtggagttgtgctccaagattgaaactggcttgggtttaggtttggaccaagacatcatcaaaggcctcgtctcttactgtgaccttgccgagccacgagatgccaaagagtaccttgactttattctgcaagtgatcaaagtttcagacctttccactagctgcaaatcttggaccttagggtttaataatataatcggtcaggatgcagggaaaactgtgattgaagaatatttacgacggagaggttactcagaatccagcatcggctcaaatgttccaactaccaaattacatgcgtatgtcaaaccgccttcagttgagacatctgctagtggaactaagaaatcatttaaaacaccgaaagtggcaggccgcggtaatcatgcagaaccgaacaagaatgcgagtagcagtaatcaggaaaatcagactccaactgtagttagtgaatcaaaaacatcgcaaaaggggaaccaattgaattccaagaagaagaaagccgggaaagttgtctcacttgctgaggctgccaaaggatccattgtgttccagcagggaagaccatgctcctgtcaagcacgtcgtcacgggctggtcagcaactgcttatcttgtggcaaaatagtctgtgaacaagaaggagaggggccttgccatttttgtggtgcacttgtgttaagagagggcagctcgtatgctggtctggaagaaagtttgcctcccttgtcagagtctgaggctgttgctgaagcttatgcaaagagactggttgaatatgaccgaaactctgcagctcgtacaacagttattgatgaccaaagtgactactatgagattgatggaaacagttggttgtcaaaggaggagaaagaactgttgaagaagaaacaagaggagatggaagaagctgagaaagccaaacgtaatagagttgttgtgacttttgatctagttggccgcaaggtccttgtaaataaagatgaagcttcagaattacagtttgaaaatagaatattgcgtcctccggatgcaagggaagtgaaccgtatcaaaccaaatccaactctaacgtttcaacctgtttttgtggacctgggctttggtaggaaatccactaaagataagcaatcacataaaggcataagcaagggcttgtgcttggagattacagggcgagtgcagcatgatagaaatgaccagaagtatgttatgatggaaaaccaattggcaacagcttcaaatgaaaatgtttggcaagtatcttcaggaaatggaatgcacatcatggaagatgatggtcaatgtttactgaactatgataagtaa

SEQ ID NO: 2893 - DNA, 360 bp, Glycine max
  Peptide Sequence Number=SeqID_119671
atggatgccatggaactatgctcactaaaccgttgcaatgaaattttccatcatcttctcattgaacatgtttctaccacaactaggatccgcctctacaatcatagaccacttcatttcgcagctgctactacaacaactgcaacctcttccggaccaactacttctgcaagagaagccagtgatgatggaccaatggcattgtcctccgtaatgatgtccacgttgttgattcaatcaaaccttggtttagaggcgggtgcactggaacaaggagcaagggatcactatggtgatcatcatcaccatgaagaatcaaaggatatttgggaggccttaagcagctcatccatcaactaa

SEQ ID NO: 2894 - DNA, 1260 bp, Glycine max
  Peptide Sequence Number=SeqID_119672
atgactgtgattttaccaaccccgaccaaaaatctcataaatttcgcgctttcaccacaaccctttgaagctctgcatcctctaatggctctctccacaacatttatgcccccttcatccccaaaattgaacctttactccaaaattcgaagacccttttaccctcactctgtcagattccttaaccccctaaagattcgggcttcaactactctggattattccaacgtctctacgaacgacaaatccccccctttgaagactagcaattggcaatggaaattcaaggacaaccttataaacatttattatgaggagcatgtaaaggagagtccggagccttcccaaaatatcttgatgatgccaaccatttctgatgttagcactgttgaggaatggagactagtggctggagacattgctcaacgtaatggcaacaccaattggcgggcaactattgttgattggcctggcctgggttattctgatcggccaaagatggactacaacgctgatgtcttagaaaagtttctggttgatttcatcaattcacccaatggtccaatgaaacaaccaggacatgctgcatctatagtagcccgtgctgcaaaaaagggtctggtgaagcccaaagctatagctgctgttgcaccaacttgggctggtccactccctatcgtgtttggtcgagactctagcatggaaacaagccatgtatgtgacgatcaccttaccttgtttcacagcataaataactggcattttttctccctttctcgtaaacctgacagatatggtcttctaagaggcacattaaaggcccctgcagttggctggatgatgtataacatgcttgttagcaacgagaatgctatccaatcacagtacaaatcccatgtatatgccaaccctgacaatgtgactccaggaattgtggaaagcagatatgcattgaccaaacgaaaaggagcacgttacttgcctgctgcgttcctgaccggtcaattagatcctgtaacatctcgtgaggagtttctcgaactcttcacagctttggagggaaagacaccagtgctggttgtatcaaccaaaggatctcccaagaggtctaaggctgagatggaagctctcaagggagccaaaggggtgaccaagtttgtggaagtgccaggtgctcttcttccccaagaggagtatcctgctttggtggcagaagagctttatcagttcttgcaagaatattttggcactgttgcttag

SEQ ID NO: 2895 - DNA, 1485 bp, Glycine max
  Peptide Sequence Number=SeqID_119673
atgtatgcagaatgtggtgactccggttctgcgcgacgggtgttcgatgaaatgtctgaaccaaatgtggtcacgtggaatgctgttcttaccgcagctttcaggtgtggcgacgtggaaggcgcgcaggatgtgtttgggtgcatgcccgttcggaatttgacctcgtggaatggcatgcttgctggttatgccaaggcaggtgagcttggattggcaaggagagttttttatgaaatgcctctgagagatgaggtttcttggagcactatgattgttgggtttgctcataatggttgttttgacgaggcttttgggtttttcagggagttgctgcgcgaggaaattcggacaaatgaggtgagcctcaccggggtgctgtctgcttgtgcacaggctggggcgtttgagtttgggaagattttacatgggtttgtggagaaagctgggtttctttatgttggttctgtgaataatgctctcatagatacctactccaagtgtgggaatgtggctatggctaggttggtctttcagaatatgccagtggcgagaagcattgtttcttggacatcaataatagcgggacttgcgatgcatggttgtggagaagaggcaatacagctttttcatgagatggaagagtctggagttaggcctgatggtattacttttatatcactactgtatgcttgtagccatagtggcttggttgaggaagggtgtggtttattttctaagatgaagaatttgtatggtattgaacctgccattgagcattatggttgcatggttgatctgtatggtcgagctgctaggttgcagaaggcctatgagtttatatgtgaaatgccagtttctcctaatgcaatcatttggaggactctcctcggggcttgtagcattcatggtaatattgaaatggcagagcttgtgaaagcaaggcttgctgaaatggatccagacaactctggtgatcatgtactgctctcaaatgtttatgccgttgcagggaaatggaaggatgtttccagcataagaagaacgatgactgaacatagcatgaaaaaaactcctggttggagcatgattgaaattgacaaggtcatttatggttttgttgctggtgaaaagcctaatgaggttacggaggaggctcatgaaaaactgagggaaataatgttgagactcagaacagaagcaggttatgcaccacagctaaggagtgtcctgcatgatattgaagaggaagaaaaagaagattcagtttctaagcacagtgagaagcttgctgctgcttttggaatagcaaaacttcccaagggaaggattttaagaattgtgaagaacctgagggtttgtggggactgccatactgtgatgaagctgatttctaaagtttatcaagtagaaatcattgtgagagatagaagccgcttccactcgttcaaagatggattttgttcttgcagagattactggtga

SEQ ID NO: 2896 - DNA, 183 bp, Glycine max
  Peptide Sequence Number=SeqID_119674
atggttgaaggagaagagtgcggtggtggttgttctagtgcctctaccacgatgaaaaattcaagatgcacgttcagaatccaatccacgtttcaatttggtagatgcaaaaacacggaacttcctactcgatacgaaattaccaaaaaaggaaggaaagaagatgaagcagctcgaagctga

SEQ ID NO: 2897 - DNA, 1623 bp, Glycine max
  Peptide Sequence Number=SeqID_119675
atggcaattttgggtctcgcacttgtcataatcctttcattcctctggactcgtttgttatcaaagaaggaacgagcagcaaagagatacactgaagtcaagaaacaagctgatccaaaagcaagcacaaaacttattaccttccatggtgatctgccatacacatcatctgagatcatagagaagctagagtctcttgatgaagaggatatagtaggatcaggaggatttggtacagtttaccggatggtgatgaatgattgtggtacatttgctgttaaacagattgatcgaagttgtgaagggtctgatcaagtgtttgaaagggaactagaaatcttggggagcatcaatcacataaatctagtaaatctgcgtggttactgcaggctcccttcttcgaggctccttatctatgactatttggccataggcagcttagatgatctcttgcatgaaaatactcgacaaaggcaactactgaattggagtgatcgcctaaagatagctcttggttctgcccagggtttggcatacctgcaccatgaatgcagcccaaaagttgttcattgtaacataaaatccagcaacatcctccttgatgaaaacatggagcctcatatatctgattttggtcttgcaaagcttttggttgatgaagaggcccatgttaccactgtggttgctggcacatttggttatttggcaccagagtatctacaaagtgggagagcaactgagaagtcggatgtatatagctttggagttctattgctggaacttgtaactggaaagaggccaacagatccttcctttgtaaaaagagggttaaatgtggttggttggatgaacacattactgagagaaaaccgattagaggatgtggttgacaaaagatgcaccgatgcagatgcaggaactcttgaagtaattcttgagctggctgcaagatgcaccgatggaaatgcagacgatcgtccatcgatgaaccaggtgttgcagttgctggaacaggagggattggtgttggatagtaatcataaaggaaggagaagaggacatgggattgtggcatctagcaacgttgcttcaccttccatatgggatgattggaaacctgtcaaagccccttccactccttccctcagtgacattctttggccctctgctggggcatttgcggcaatggcaatattgggaaagatggatcagttattggcaccaaaaggactctcaatcgcatttgcgccatttggggctgtttctactatcctctttgccacacccacagctcctactgcccggaagtacaatgtgtttatggcccaaataggctgtgctgcaattggtgttctggcattgacaatatttggacccggatggctggccaggagtgctagtattgcggcctccgttgcttacatgatcatcacaaactctgttcatccaccagctgcaagcatgccattgcttttcattgatggtcctaagttccatcacttgaatttctggtatgctttgtttcctggggcagcagcatgcactctgcttacgatggtggcagagtatttgtctctcgtcattcttggaaagccagtgattgtgccaaatgggaacgcctag

SEQ ID NO: 2898 - DNA, 1002 bp, Glycine max
  Peptide Sequence Number=SeqID_119676
atggggaggccaccttgctgtgacaaaattgggattaagaaaggaccttggactccagaagaagacattagcttggtgtcttacattcaagaacatggaccaggaaattggagagcagttcctaccaacacaggtttgatgagatgcagcaagagctgcaggcttagatggactaactatcttcgacctggtatcaaacgaggtaatttcacggaacatgaagagaagatgataatccacctccaagccctattggggaacagatgggctgcaatagcttcatatcttccacaaaggacagacaacgacataaaaaactattggaacacccatttgaagaagaagctgaaacaaagtgatcaaagtgggagtgatgaaggtgttgaccacgagggacattcttcttcttcttcttctaattcacatccaaagggtcaatgggagagaagacttcaaacagatatccaaatggccaagaaagccttgtgtgatgctttgtcccttcacaagccagcaacagcaacaacaacaacccttgttgtgcctgatgatgccaccaaaccttcttcaagttctcatcatcaaccctacaaccatgcatcatcctcatatgcatcaagctacgagaacatttcacgattgatggaaaactggatgaaacccccaaactcaacgaataattcaccagggtattattcttccttcagcaacatggtcaataataatactagtactacaggatccagctctagtgagggagcacatagcaccactaccactacaacacaagatcagggttttgactgcttcttgaccctaaactcctccaaacagtactatggctctccatctcagacgcaagtgcctcttactcttctggagaattggctttttgatgatggagctgctcagtgccatgaagatctgatgaacatgtccctcgaagaaagtaccgcagaatttggtacagcttgtactggttctgcactctattatcaataa

SEQ ID NO: 2899 - DNA, 1654 bp, Glycine max
  Peptide Sequence Number=SeqID_119677
gttgacaaactttgtgggcattcttagccaaggactcagaattgcacctcctgaagcccccgcgactggctatatgtttggcaaaggggtttactttgctgacctggtcagcaaaagtgctcagtattgcttcactgataagaaaaatcctgttggtctaatgcttttgagtgaagttgcacttggaaatgtctatgagctcaagaaagcgaagaaacagtatatggataaacctcctgaaggaaagcactctactaaaggactgggcaagaaaatgcctcaggaatcagaatatgtaaagtggaggggcaatgtcactgttccttgtggcaaaccagttccatcaaatgtcaagagttctgagctcatgtacaatgagtatattgtttataatactgctcaaaattcaacatcttcaagctctgacacagtatttgctgaaactggaaaatggcgggtgcaggaagagacatgccagctaactgaagaaaacaaacagaaattggaatcccagcctgcaatacagaatgaggagacaacattcataaagcatccatattcggatggagagactgcagaaataaaccccactaatgatacagaggaacaagaagactttccagtgtctcttgccaaggagaaactagggattgaggatgatggaaaattcaatcaagaggaagcaaaagcgattgtagaagcaacaaaagaagaagtccagccaaacttgcccacacctgcaattgtccaatgtgaccctgatcaaatcatacagcaacaaacactgcacaatgatgaatcagaagcaattgataatgccaaaagcttcataccgaaaaacaaacttgaaagaatgtccattgttgttgaggacactaatcaacctgaagccatggccaatgtcagcacagtaaaagaagaacaagctgacccccatgcaaaattatgttatgatgtagatgagcagaagacagtagactcacactcggtcgataatttagagagtaagggtgcaagtgtatctgaagataaggccctgcaaatattaccccgtacaacatctgtctgtatcgaagaagttgtcaaaaacattcaagagatacatacagaagcagaattagcagtgacagataccaaagagaggcagatatcagaaaatgagtctgaggcaaaaaaggaagtatctgagtatatgttaaaaagggcatttgatttgcacagagtggcatgccaaaccagtgcggaaaatgaaccgaaagctgaattcctatctgaagagcagagctacgagactattgttacaaagcatccaaattttgaaagacagaccaaagaaatgaacccaactaatgaaactaaagaacatgaaaaggttccggcatcacagactggagagaaattagagatcattgatgatcggaatttcatacaagagggagaaaacgagatggaaaagcaactgaaaggaagtgtactagaagatgaagtccagacaaccctgcccacatcaacaattgttaaaggtgagacgattgaaggaattgttcaggaacaaacacttgaggaagaggaatcagtggcaatagataacaatagtggtagaccagaaaatgaacttgagcaaatggctaatgttgttgaggttagccagtaa

SEQ ID NO: 2900 - DNA, 273 bp, Glycine max
  Peptide Sequence Number=SeqID_119678
atggcttgctttcgaaaactggccccgatggacgcagagaaacgcgaggaactggaaccagagaaacggcacgcaaaccgaggcaggattttagcgtttcaaagctccaagcaaagcttcaacctttggccatcatttctgccccaaatcgcgaaaggagggcattttcggggtcgtgaagtgcgtggctacgagtgggacttcgaaaattcaggtttgggtggacttctttctcctttaatttttgtgggtatggggtttggggagatatga

SEQ ID NO: 2901 - DNA, 2592 bp, Glycine max
  Peptide Sequence Number=SeqID_119679
atggccattttgaatcctgaggttatcaatgtcgaaagcgatgataattctactgagttaatattatttgggcaaagagttagaaaggggaaggaaattcagaccacccatcaaaacatggaagtgtgtgaggatgtaatgggtaaatctttatggactgacaagcatagttctagttctgacagctcaaaccacaaggatgatgttgaatactatgattttttttcaaaagatcatacgatgacaacatctcaaccttcgttgtcactggagccttctggagtacaatactctcaaactccccagagtaagaagaaatcaaatgactcacaacaaaggaagcagaagttaaagttgccattggaaatcgggtcatctacatcttttgagagtaaaaagaagccaaacatttgttattcttctaaccatgaatttgcaaacaatttgaaggctaagaaatcagtgactgcaggtggggcatcacattcgggacttctccctacaggaggggcatcagattggggactgttgccagcaggtggagcaccacaggcagtaggtgggacactacacttgggactgctacctgcaggtgggatgttgcctgcagctggagcaccacaagcagcaggtgggacactacattggggactgctacctgcaggtgggatgccgccggccggtgggacaccagattgggggatgttgcctgcagctggagcaccacaggcagcaggtgggaccctacattggggactgctacctgcaggtgggatgccgccggctggtgccacaccggactggggactgttgtccactggtggaacaccacaggtggttggtgggacaccacactggggactgccacctgcaggtggaatatcgcctgcaagtgggacaccagattggggactgctgtctgcaggtgggacaccacaggcggtaggtgggacaacatattgggggctgccgcctgcaggtggcgcaccagaatggggactgccgtccacagttccaatgatgacactttacagtccatatcattcaaattttgttggaccatcatatcatcatccaggagctgaatctattaatcagatgtggtcgacgaatgctcatcacttgcaggcgatccctaattataattatcctcatccttatagttatacctatgattataattatacagctcctgttgttcaccattaccatgtccctcctgcgcaattgtttcataactctttggttcaaaattctgtgggagatgaaaataatggagcaactaccaatagtactgttgctacaatttcagatgaagctagagaggaaattctggtgaaatttcgaaactttaaacaatttgacgttgttgaagacgtttcagaccatcactttgttaatgccgactcttccatgcaacagcattcaaagaattgggctaaaagaatccagggagagtggaagtcattggagaaggatttaccagattcaatatttgtcagagtttatgaatcaagaatagatcttctgagggccgtgattattgcagcagagggaacaccttatcatgatggccttttcttttttgatgtttacttcccaagtggctatccccatgtaccgccgggccatttttcaatgcagaacgtccactaccattccggagggcttaggctcaacccaaatttatataattgtggcaaagtttgtcttagtctacttaacacctggactggccatcagaatgagcagtggatttcaggtgtttcaacaattctacaggttctggtctctatacagggtctaatcttggttgcaaagcctttctttaatgagcctggatatgcacatttgaacggttcacaatatggtgaaattagttctttgcggtacaatgaggactcattcatcctatcattgaggacaatgatgtatatcatgaaaaggcctccaaagaatttcgaggactttgttgttgggcacttctgccgccgagctcatgatattcttgagacatgcaaagcatacattgatggggctcaagttggttgtgtggtcaaaggaggggcacaagatgttgatcagggtgacaacagtagttcaatccagtttaggacttctttggctgcagttgtgcatatgcttattaaagagtttacacaaattggagccaaggattgtgaccaagtctttccatcaacagcagcaggaaatccgtctggtgaaatgctgacagcagcgggaaatccgtcccttgtaatgctgacggaagcaggaaatccattgggtgaaatgttgacggcagcgggaaatttgtccggtgtaatgccagcagcagggggaaatccatccattgtaatgctgggaaatccatccgttgaaatgccgacagcagcgggaaatttgtccggtataatgtcagcagcagtggaaaatccgtccgttgaaatgccgggaaatttgtccggtgtaatgccgacaacagtgggaaatccatccgttgaaatgttgggaaatcagtccggtgtaatgatgacagcagcgggaaatccattcaccgttgaaatgcctgattctgctgcaattccttga

SEQ ID NO: 2902 - DNA, 480 bp, Glycine max
  Peptide Sequence Number=SeqID_119680
atggtccaactctcccacgcgctgcaacgcggctcgtacctggtacacgcacctaaacgccttgtcatttggccccttgtgagtcctaaccacatgcaccagcttgtatttggctcttgctctgtcggaacttttgttggagagaagaatcacggccccaccaacgcggaaaaggcaattgggtatgagcatggccttgttgttcctgaagtaccaattctgggttatgttcttggtactgacgacgatggcgtaggtgctcgggtgaacctgaagcatgtcttttgcaaggtcaacagagatgacatcggtgctgcagcccatgccaccaaggttgaagcttttggcgttaccgcggagcttatacttgttgacgatcaaggaggagagggaatgggtggggttgaagaggctgtagtcgacgacaaggatgccgatgtctttggggttgacaagggagaagctcgaaggagagagatg

SEQ ID NO: 2903 - DNA, 212 bp, Glycine max
  Peptide Sequence Number=SeqID_119681
gtggtactctttggttgcatgcggaggtgttgtcgtcgtttgctgccattgatgatgatgatgtggttgaaggaaaagttttaccttaccccacagtggatgccaaatgttcttaccagatttggcaagacttgctcacagtggtgctccttcatgagtctctccacgaattatggtggagacatacaaagacactccggcgctcaagttag

SEQ ID NO: 2904 - DNA, 207 bp, Glycine max
  Peptide Sequence Number=SeqID_119682
atgatgagttccatgctggagatgcagaggcttagcctttgccagggaaatgctctgataaatgtgacatcgaggcatgagggggtcacaccaccactagggcaggcaaccaacttgtttagcatgtccgacataggaacccctgaaaacgggggcctagtaactatggtgaagatcacatgtttggtgcctagcgatcattcctaa

SEQ ID NO: 2905 - DNA, 468 bp, Glycine max
  Peptide Sequence Number=SeqID_119683
atggtcatgcctcctcaaccgttgatgggaaatgatctaacgatccaaacgaatgcatcttctcagttgctagaagcttcaagaaggccgagagactttcttctccattctcactttctattttcatttcctctgctcatcttcttcaattgtcttcttcctatttccagccaccctttttcttttctcggggttctgagcgctctggcggccaaatgcttttgtctgagcaacaatcaaggttcctgcatttctgttggtggcatcatcgccatcactagcaagggccctcaccaccttgttggtgtgcatcctgatcttgtgggggatgagggttttgatgattgtttgttagatccagaaacaaagtcaaagggggcaaaatggtcatttttcaagatttcagacacctattcacccaggctagcgaccaacttgcttgtgctaatcaaatttcttcagccataa

SEQ ID NO: 2906 - DNA, 264 bp, Glycine max
  Peptide Sequence Number=SeqID_119684
atgagtcggttggagacacgtggagcaacattgttccaactatctcggtggagtatctcggatagactgagcctgagatacatccgtaacagaaacttagttgagggcatttcgaaggctaacatggattttgacggtctcctcggttcttctttacgggataaccattccttgggaccgcagcctactcctgaaggtggttttattcagtcaggtgccaaaaggctgcttgtggagggagtgaaattaacttgtaggttttga

SEQ ID NO: 2907 - DNA, 612 bp, Glycine max
  Peptide Sequence Number=SeqID_119685
atggttgttttgtataaacttccttggaatcctaattgtaagcttctagtggatcttccttttttaaagactccaaatgttgacttggactctaaggccaaggatgagaaggcaaaggccgagaagtctcaagttgacaaagcacgggccgagaaggctcaggttgagaagattgctattgttcggggaaagcgaaaggagaatcatttggatgattgggttccttcaccttacactagggtcatcataagggactcctctactcttcaggccctcattcaaaattccatgcttggtcctactgaaattgatatgctaaggacgaccaaatctcgaaaggaggctttaaaggcctctgctgcagactcgacaaagaccttgcaagaggaggttgaacatctcaataaggagttcgctcttttcaagattgatgcagttgcagcagaggagaaggtgaagactaatctcggtgatgcaaaagctgagatcttgaagctcatgaagttgggtttcagaaggcctgtcgataggtcaaataaagatgtaaatggccaaggggagttggtcaataaggcggatatttctgccaatgtgatgcttgagtcagcctaa

SEQ ID NO: 2908 - DNA, 150 bp, Glycine max
  Peptide Sequence Number=SeqID_119686
atgggtttgaagaacaacatggtggtgctaaagcttgtgatcgctgtgcgtgcacacgctcgatgccaggccagtgtcgttgccttgacaccaccgacttctgctacaaaccttgcaagtccagtgatgaagatgatgactaggaattaa

SEQ ID NO: 2909 - DNA, 156 bp, Glycine max
  Peptide Sequence Number=SeqID_119687
atgcaggatatggagattgaggttgcttccacgattgctaggtgctgtctagctatctgcatgaaaaacagattttgtggtgaaagagtgaatccttatgttagaggatgggatgattggttatctagtgacacagaaggatcagggatgctctaa

SEQ ID NO: 2910 - DNA, 426 bp, Glycine max
  Peptide Sequence Number=SeqID_119688
atgaacgacgaagaacggttgaaaatcttcgcgaaatcacccacgaaaacgaaaataggggaggagcttgccacccagctcgcccaggcgagccaagttgcttcctccagaagcaaccaccttgtggaggaacatcctggaaggcccaacatgttacggaatctcacgaattgtgtaacaatgcttccttttgatctccggcatgtcacggaacttcacgtaatgtgcaacaaagggtgccaagtacctcgaagcggtcaaaaaaaggttgcatgccatcaaacaatgagaaatgcaaaaaggaagaaggaaatacctgaaggtgagtgtgttgtggcggagaaagagaaatgtgaatccgaaaaagaagaggtaaatgtggcaatggaggctgagatataccctacaggaacgaccgcgatatag

SEQ ID NO: 2911 - DNA, 375 bp, Glycine max
  Peptide Sequence Number=SeqID_119689
atgtcgaagtgtgaactcctccaccacaagactctcatcattagaagctatgaacccatctcttgcattttcatgtcttctttgttgaattttgttgggatcagagttggtgtggttgttgatgacattggctttagggcgaggctcacgggtgcgtcttccaaaggaggaaaatgcgcggagtcgccaccaacgtttatttatgggaaacgtcagaaaaaccgaaggaaatcggtcatgaagaatattccagattcgggagttgtatttacgtttgaggaaggtattagcacctctcacgtcgacaaaagcggggctcttgctcctacgtaccttccatcgaagaggaaaccagacctacgtagttctttctaa

SEQ ID NO: 2912 - DNA, 132 bp, Glycine max
  Peptide Sequence Number=SeqID_119690
atgtggataaacaaactcgcgctgtgtatgccgttgatagcggtcactcactgtgatcaacgtttcacagagagaggtaaggtaaggacggttttgaagtttgtttgcgatgacagtggggaggcggattag

SEQ ID NO: 2913 - DNA, 2931 bp, Glycine max
  Peptide Sequence Number=SeqID_119691
atgggaggtaaaataagacaacaagcaatacttataaatttgtgcactgctgcagatatcattgtgaaggttttggtttcttggcttagaagcagcaaacaaacctgtaccgagacctgttttcagagtggagaatttcaaggtgttgatggattcctacatatagaaagatcactagagctgagttattgtaataggaactccgaagaaatttcaagtccaatgaaagtgaatggcaaagaaatagaagatggagccaaccaggttaatgtccttcatctttggcataatgccatcaagaaagatttgaaagatattctggaagaacttcatctgctaagaaaatccagctgttttcagaatttagactcgatacttatccaactaaaattctttgcagatgtcctcatcttctacagtgatgctcagaagaaattctttcatcctgtactgaataaacatgcttatggttggttgtccaagtccattgaacaatttcttggtgaaagtaacattgaagatatacaacaattgctattctataactcagaaagtggaatacttttgagcaaattcatagagaagctttgccaaacacttgaatcatttgtatcaggagtcaacaaacaatttgcttttcaagaaaatgaggtatttcctatctttagaaagaactgcagaaatggaatgcaagagagacttctaagcttgagcctatatatgatgcctcttgggttactaagatgtgttataacctggttttcagttcgcttgtctgaaaaagagtctagctccattctctattgcataaagaaaggaaataattctgtctgtaaagctttttcatcactgttacatgagtggttccgcattggttattcaggtaaaacctctattgaaaaattcagacaagaactgcaacatatgtttaaaagaagatgctctcttttacccgaacaaattaaggaagctcatgaattttctttcttaaattctgagaagcagcctcataaagtctctggccagaattgtttgtcctattcctcctcctctggatccaataatgtaaacaagtatgagacaccatactccacaggaattaatctgcatatattttttccttccacagttgcgaagttacatcagcatcctacattacatgcagaagaacgttcttctatttcttttcttgatgatccgaaaccaattgacctaatatttttctttcacaaagctatcaagaaagatttggagtacctagttcttggctcaactcagttagaaaaaaatgataagttgcttatggatttccataaacgattccatctcatatattttcttcatcaaatccatagtgatgcagaagatgagatagtgtttccagccatggaggcaaggggtaaacttaaaaacattagccatgcttatacctttgatcacaaacatgaagttgatcacttcaataaaatatctcacatccttgataagatgtctgggttacatctttctgtttctacaattgatccaaatgtcaaggagaagggaattctaaggtatcaccatttatgcaggaagctgcaagaaatgtgcaaatcaatgcataagtcactttctgatcacataaaccgtgaggaaatagaaatttggcctataattagaaaattcttctcaaaccatgagcaagggaggatcattggatgcatgcttggaagaataagagcagagatattgcaagatatgataccttggctaatggcatctttaacacaggaagaacaacatgttttgatgttcttatggtccatggctactaaaaatacaatgtttgatgaatggttaggtgaatggtgggatgggtacagtttaaccaaggtaacagaggggtcaaatgttgcccctctccagcctgttgagccactggagattatatccaaatatttatctgaagaaattctggatgaattacaagaagaatcatctgccaacaaaagcataaattttttgcagaaggatcataatggtgataatgttgtgctgtctaactacaactttgatgataaagttaaggttcataatgcagaacaaaataataatcaatgttcgaaactcacaaatcaatttcatgatcataacaaacatgcttgcaatgaagtaccaaatatcataaatcctgtaaacaatgaaggtaagtattctcaactttgtgacaagtctgggcgttatgaccgacttttgaaattgagtcaagatgatttggagacggtgataagaagggtgtctcgtgactcttgcttggatcctcagaaaaagtcatacataatacagaacctactaatgagtcgttggattattaggcagcagatctcttctacagaagccaatataaaaaatgatgaactggaatttcctgggaaacatccatcttacagggaccctctcaaactaatctacggttgtaaacactacaagaggaactgtaagctttttgctccttgttgcaaccaacttcatacctgcatacattgccataatgaggaatcagatcattcagttgacaggatctgcaaattatttgatgatgaaagggagaaacatttagaggacaactgtccaatttgtcatgaatatatcttcacatcctgctctccggtaaaagccctcccatgtggtcatgtaatgcactcaacatgttttcaggaatatacctgctttaattatacctgcccaatatgtagcaagtcacttggagacatgcaggtatattttaggatgttagatgcgttgttggctgaagagagaatttctgatgagatttctagtcaaactcaggttttattatgtaatgattgtgaaaagaaaggagagacccccttccactggctctaccacaaatgccctagttgtggttcctacaacactagagttctatga

SEQ ID NO: 2914 - DNA, 1749 bp, Glycine max
  Peptide Sequence Number=SeqID_119692
atggaagaagcacaggtgcaggtatgggaagggtacgtagattggaggaacaagccagccataaaaggacatcatggtggcatgcttgctgcttcctttgttttggccgcggaggtattggagaacctagcatttcttgccaatgcaagcaaccttgttttatatctgtccaagtttatgcacttttcaccatccacctctgccaacattgtcactgacttcatgggaacagccttcctccttgccattcttggtggatttctagctgatgcgtttatcaccacttactccatctatctcataagtgctgtgatagaattcatgggtttattaatgctcacaatacaagctcacaagccatcactgaaaccaccaaactgcgtaattggaaacaccgacagtccatgcgataaaatccatggtggggacgcagttatgctgtttgcaggcctctatctagtggctctgggcgttggaggtataaaaggttctcttcctcctcatggagctgagcagtttgatgagaacactccagagggaaggaagcagagatcttcatttttcaattactttgttttcagcctgtcttgtggagcattaattgcagtaacttttgtggtatggattgaagacaacaagggatggaagtggggtttagtggtctcaactgcatcaatacttctctccattccagtttttcttcttggctctcacaagtacaggaccaagattccagcaggaagccccatcacatccatgttcaaggttcttgttgcagcaatttgcaacaactgcaaagccaagaattcaagcaatgctgtcataagcatgactacaggtccatctcatgcaactgaaaggaaagatggagaggaacaaagtaagactagaaaagaggttgttccaggccaaactctaaccgacaaccttaaattcctcaacaaagcagtgatggaaccagcagttcacccaatgttagagtgcacagtaaaggaagtggaagaggtgaagattgtggcaaggattcttcccatattcatgtccaccataatgctaaactgttgcctagctcagctatctaccttctcagttcaacagtcagccactatgaacaccatgcttggttccttcaaggtcccaccagcttctctgcctgtgttccctgtcctcttcatcatgatccttgcaccactctacaaccacatcattgtcccatttgcaagaaaagcaaccaaaactgaaatgggaatcacacacctacaaagaatagggacaggccttttcctctccatcgtggcaatggctgtggcagcattggtggaaactaagagaaagaaaactgctacaaagtttggtttgttggactcacccaaagtaccactccccataacattcctttgggtggcattgcaatatatctttcttggttccgctgatctattcactttggccggcatgatggagttcttcttcacagaggcaccatggagcatgaggtctttggccacagcactctcatgggcctcactggccatggggtacttcctcagcactgttcttgtgtccaccatcaataaggtcactggtgcttttggatcacacacgccatggctcttgggtgccaacttgaaccattatcacctcgagaggttttactggttgatgtgtgcgctcagtggactcaacttcgttcattttctcttctgggctaattcctacaaatacagatgttcaactaagcctggataa

SEQ ID NO: 2915 - DNA, 1842 bp, Glycine max
  Peptide Sequence Number=SeqID_119693
accgaaaacgcgagtataaatggagggtttaatggaggattagcgtcagtaatggatcgtcaatggcgtcctgctcctccacccaatgtctgcccctcttgcttccacccccacttccccttttgccctcctccacccccctattatcaccctcacccccccttcccttacgccaacttcaagagaccccgaatcgacgacaaccctatcaatttctccgacgacgaacgcagattaaagctcattcgcgatcacggattccacacttacgcgccacaccctaatcacaaggacttccctccccacaatgctcaattcagatcttcccctcaccccttccatgcttacccggacccctcgcagcaccgcgttcccgacgcttaccatcacgctcacgctcctcatgttgccatgcacgaagggaaccaccagcacaatttcaatggaagagtagttcactatccttatccctaccctgctgcgggtaacaatagcaacgataataataataataataatatggagccttcgagattcttcaggggacagcctcagcctccgcttccttcttcgccgccgccacctcttcccatggaaccgtccatgaatcaattgaaaccgccttctctttttcccgttgccgaatctcaacccatgtctcagccctattatcacccctctgcttttccttccgaggaagcatcgaagcagcagtacttgggagattcccaatctttttcgttaaaccaattggctgcagagagacctaaagtgatcgatgcgtcgcacttatttcgccatcctcatcgagcttcgcggcctgatcattttgtcatcatctttcgaggcctcccaggtagtggtaagagttacctagcaaagatgttgcgtgatcttgaggttgaaaatggtggtgatgctcctcgaattcattccatggatgattattttatgactgaggttggaaaggttgaggatggcgaggcatcaaaatcttcaagttcaggcagaaacaagaagcctgtgacaaagaaggtcatggagtattgttatgaacctgaaatggaggagggttgtgctgcaaggaatgtccatggatttacacaggaagacatagaaaagatgtctaagcaatgggaagaagcttcatccttgtatctgcagcttgatgtgaaggttgacatggatatggaagatgatctaggtgatgcattacctccatttcaaggaaaagaagatgagaaagttgttgaccctcctgttggggaagatgcaagtagggctgggaagaattggcatgctgaagaggaacatccaacagaagtcagggaattgggtaaaagcaaatggtcagaagattttggtgaagatgacattgatcaaactgaaggtatgaagggcaatattaatgctctgtctgggttaattcatcaatatggcaaggaacgaaaatctgtacattggggtgataagaacgaagggaaatgggtggtgcagggattgaacccatggcatcaagtgctctatggtaaagatggtagcgagagctatcagctcattggtaaacatggctacaagtacaacaaacggggtggcaaaacagggttttcaataggggctgcaaggaaggtaaatgctttgtcgttagtgatcggacctggtgctggatataacctgaaatctaatccattacctgaagaggatagtccaacccgtaatagtgtggagtcaaagaagcatagcatatttcaagaacaaatccgggctgaacgagaatctttcaaagctgtttttgataggagacggcacaggattggtgggcttgatgtggaggaggactga

SEQ ID NO: 2916 - DNA, 750 bp, Glycine max
  Peptide Sequence Number=SeqID_119694
atggccagtgcaagaggtactacaagggttggagaaagaacaagggcacgaactccagttgtggaagagatggtacctaattctggatggacactagactctgcaggacattaccttatagtggatcttcccgatttcaggaaggaagaggtgaagctccaggttgatagctatggccgtatcgttgtatcaggagagaggcacttaaatgagtggaaacgtgttcattttcggctgacttttcccgcaccgctgaactctgatatggataagatagccggaaagtttgatggtggaatcctttatgtctatgtccccaagcaagtaacacatcagaacaaagaaagtgcgactgcgaaagttggaaatcgcaaagttgaaagatcagaagaaaaagatcgccatcagcatggaaatggtgaagttgaaagagcagaagaaaaagattgccatcagcacgaaaatggtgaagttgaaagagcagaagaaaatgatagccatgcacccaaagctgatgaggggaggagaggtcccagtcagcatgatgaccatatagagcttgcagtaaaaagaaacgaaaatgaacacattggagaatttcctgaacaagtaataaggaattggcatcaagaatccgcgttaagaagtgcattgggggttttgagggaaaacaaaggtattgtaataacagctgttatagcattttccttggggttgctcgtatctcgcaaattcaacggctcaagttaa

SEQ ID NO: 2917 - DNA, 642 bp, Glycine max
  Peptide Sequence Number=SeqID_119695
atgtctgactttagtgcttttgctgccacatccattacagtagatgaacttgtacctggattcaagagccttttcaaatgcaccatacctgattctgggaagttggaactacaacacttgagcaactacactgggattactgggtgcattggattagaaggaaacctagaaaaaggatatgaccctgttctaaacttatcaggtcttgtaggaacaaacattctgtctctaggaggcaatgttgcacttgacctaccaacaagaacaatcagcaagctgaatgcaggcttaggcctcaacactaacttccttgttgcttccttgaccatgcatgacagctttgacatagtgaaagcctcttgttatcatgaagtgaacctcctaaccaagaccgccattgcagcagagctgaagcatagcttgtcaatgggggagactagtggcaccattggtgctcagcatgcattttttccacaaacattgctaaaggctcgatttgacacctttggcagggcaggtgctcttattcaacaagggttctgggagagatgttttgtaactatggctggagaagtggaatttaagaactcagataataatttgcatcccaaggttggagtctctgtggctttaaaaccctag

SEQ ID NO: 2918 - DNA, 1176 bp, Glycine max
  Peptide Sequence Number=SeqID_119696
atgacgacgccgtttcagcaaccgccccaaaccgtacggagactggtggtggaagtggtggacgcgcgcaacctgctccccaaagatggccaaggcagctcgagcccttacgtggtggcggacttcgacggtcagaggaagcgaacctcgacccggttcaaggagctgaacccggtatggaacgagcctctcgagttcatcgtctccgacccggagaacatggagttcgaggagctcgaagtggaggtctacaacgacaagaagttcggcaacggaagcggccgcaagaaccacttcctcgggagggtcaagctctacggaactcagttttccagaagaggagaagaagctcttgtttactacacgctggagaagagaagcgtgttcagttggataagaggagaaattggcctcaggatttattactacgacgagatgctcatggaagaggataaacctccgccgccgccgccgccgccgcagcagcagcagcaggagcaaggtgagagaacggagcaaaacaagccgccaccgggagtggtggttgttgaggagagacgtgtttttgagactcctggtggaccgatgatggagcaatgcgtgcctcttcctacaggtcctcctcattcgccgccgcgtgttgtggtcgtggctgaatctccgccgccagtggttcatgtttcgcaggatccaccgttgccggaaatgtgtgagcctcctccggcgtcggaaatgcagtttcagcccgaggtgaggaaaacgcaggccaacagaggggagagggtgaagattttgaagcggccgaacggggattacttgcctaaagatatttctggaaagaaaactggtaatgagtctgagcgagttcatcccttcgatctggtggagccaatgcagtacctgtttgtcaaaatctggaaggcgcgtgggctcgctcctcctagtgaaggcccaatcgtgagggttcggatgtcgagccaatccaggagatccaagcccgccagctacaggcccaacgagcccaccgattcgccggaatggaaccagacattcgcgctgggttacaacaccaccgacgcgaacaacgccgccacgctggagatttcggtttgggattccccgacggagaatttcctcggccgcctttgctttgacctttctgacggagaaaattaa

SEQ ID NO: 2919 - DNA, 918 bp, Glycine max
  Peptide Sequence Number=SeqID_119697
atgactttactagaagtaattaaggatgcttcagtcaattcaaaaccacttgattcacctattgactacccaattgttctgaacccagatggtatcttgcctaatttaaagcctgaagttgaagatgaatcttcctcatccctcataaaaccccttattgggtggcaactttcacaaactgatgctgagattattgacattagcaaaaagttctttatacaactgaaggctaagctcaagaacaataatgacttgaataagggtgagtttattggtagtttgaattcctatctagaaaacatcagggacaaattaggggttgtaattgagtttgatccatcctgtagtggttataacagggctttgattgataagcttggagttttcatgggtaaagatgttgctggcctggttttggatgggagtgtttctttggagatttgggaagtggtcaaggctttgattgttaatggtattactgagcattcttgttattcaaacctgattacaaagttagtggaaaaaaagaggtctgatttgctctgtttatgcattacgcatggtttcgatcttggttcatcagaaatacttaccattttgaggtactttctttctccgtccaaagatgcttataacagtatggtaactgtgaagaaggattgggagtgccaagtgctgttggccattgagaaagcaaatgatagcaatctgaagaagtacttgcttacggcgaaggaggcttctatcttgcttattattgcctatgatggtttctctgcgtctgagatccgtttgcattatctgtttgcatcatccaacatcaatgatgtggtgttatccccttcattcagtaagttgaatggcaaagagtcaataaatttgattcgttatttagccaagtggttgcaagaaatctga

SEQ ID NO: 2920 - DNA, 597 bp, Glycine max
  Peptide Sequence Number=SeqID_119698
atgttcaagtctttggttagcagagctactaaggattcaatttcacgcaaccacaatgccattgcttcttttgctttctctaggtgtgctcattcattatcatttgccacagtagaagcagaagaggtatcaggttctaggccagctgaagttttgcacttggtgcaaggtaaatgggtaggatcttcaaattggaacacaattgcagatcctttaaatggagactcgtttattaaagttgctgaagttgatgaaacgggcattcagccttttataaagagcttgtccagctgtcccaaacatggtgtacacaatccttttaaggcaccagagagatatcttatgtatggagatatatctactaaggcagctcacatgctatcacttcctaaggttcgtttcctggcaaggtcttttggtgtccctggaaatcatcttagacaacaaagtcatggttttcgttggccatatggtcccgcaaaaaatgagtctatgtcgttctcttgccaatggtgcttgtttattgtgccaaaattatcgattaccttgtggtcaagcacattagtctatggaagtaattggttaagtgtactctaa

SEQ ID NO: 2921 - DNA, 987 bp, Glycine max
  Peptide Sequence Number=SeqID_119699
atgggtgcactttatatgggcaacaagccagtccttaaagttgatagcaaggtgagcattgttatggaacaaatgttgcgcctgcttcatacctgtggcttacctctagaagatgtagacttcataaattctgatgggaagacaatgaacaagctgttgctggagggaaatccacgaatgactctttttactggtagttcaagagtggcagagaagttggctgttgatttgaagggccgtgttaaattggaagatgctggatttgactggaaaatactgggccctgatgtgcatcaggaagattacgtagcatgggtctgtgatcaggatgcatacgcatgcagtggtcagaaatgctcagcacaatcattgttatttatgcatgagaactggtctaaaacttccttgctatctaagttgaaagatcttgctgagagaagaaagttggcagacttgacaatcggcccagttctcacagttacgactgattcaatgcttgagcatgtgaataagttgcttgagataccaggatcaaagttgctattcgggggtagtcctctagagaaccattcaattccacctatttatggtgctattaaaccaacagctgtctatgttcctctcgaagaaattatgaaggataagaattttgagcttgtaacaaaagaaatatttggaccatttcaggttatcacggactatcaaaacagtcagctagcagttgtattggatgctttggaaagaatgcataaccatttaacagctgctgaagtcattggcaaatcagtaaatggtactacttatgctggtttaagagcaaggacgaccggagctccacagaatcactggtttggacccgctggtgatgctagaggtgcaggaattggaacaccagaggctataaaacttgtatggtcttgccacagagaaataatctatgattttgggcctgtgccaaagaattgggaagttcctccttctacttga

SEQ ID NO: 2922 - DNA, 1215 bp, Glycine max
  Peptide Sequence Number=SeqID_119700
atgggggtgggcggcacaatccatgatgttgagagcgttgaggagtgggcagcgtcagttctcggtggcggtgacaaggccgtgggaggacaaatggcttactctgcctcccgtcagtgcgagttcgagtgcgagtgtggagctgaatcaactctcgtccactccgaccaccgcactcaaatgggttgttcggtgctgcccccaccttcccagagctctggtgcacaagcttttccgtctaagacagccaaggacaccttgaacacaggagaccgtatcttacttcctcaatctgttaaagttaaacaaacgcctacacattctcatctcactccccaacaaatcaactttatccgtactcttgttatctataaggatcccgccattctcgtcctcaacaaacctccaggaatgccagtgcagggtggcattaatatcaaacggagtttagatgctgtagctgctgcatctttaaattatggttactctcaaccccctcgtctgacagagactgttctggcattctggtcatgggaaggacacacaccagtacaacagtcctgcattccatcttccgcgagaaaacttccagggcgtcagatgatattggcaaagagaagagaatactacaaagaaggtactgggcactggtccttggatgtcctagacgtccaaaggggttggtcactgcttcactgggtggtggttgacaatgggagatctgatcgaataactatcgttgacaattctacattaatgtcatcacagcatgcaattacagagtaccgagtgattgcatcatcatcacaaggttacacctggttggagctgacccctttaactggtagaaaacaccagcttcgagtccactgtgctgaggtgttaggtacaccaatagtaggagactacaagtatggatggcaagctcacaggaagtggggacattttgatttgcctaatgtggaggactcacgtgaagaacttctcaatgaagaaaaactcccctttggccttaatttgaataaagggagcatctctgagaatcatcctcgtttacatcttcattgcaagcaaatggtcttgcctaatatatctcaagcactgcagaatgtgcaatcagcttccagttgtgatctttcactagttgaagagcttgagttggtagcggatttgcctccatacatgcaaagaagttgggatgtcacaaattattga

SEQ ID NO: 2923 - DNA, 1455 bp, Glycine max
  Peptide Sequence Number=SeqID_119701
atgggcatcacgtacatgtgcgctttaatattattgtcattattgcttcattcatttatgttcattgcggcagatcaacgggtggccggattggaaactatcatagcaagtggccacgtgcacgggggtaatttttatggctctcctccaccacctccccccgagtgtcacccaccccctccaatgtgtcctccacctccacctccgccacccgtacggctggagagagctcgcaaagcgcttatcaaattcactcgtttggtggatgacccaaatggatatacgagtaactggaaggagggtagagacacttgtgagttcaggggggtgcgatgtgcaaaatatccagacggacagcaagcagttgcgggattagacctgaatggagctggcctctctggaaaaaaatgtacagcgctcatgctcaccggcatcttggacagcatacccgagctcactttcttccacgtcaactccaacaacttcagcggtgccatcccaaccgacatcaccaagtacaaatttttcttcgagctagatctcagtaacaacaaactggagggtgagttcccgaaggaagtgctccagcccaagcccaaggaccagcagctggtgttccttgacctcaggttcaacagtctctgcggcccaattccaccgcagctctttgacttggatctggatgtgattttcatcaacaacaataagttcagtggccatctccccgataactttgggtccacaccggccaggtacctcacttttgccaacaaccagctcacgggcccaatcccggcaagcattggcaaagcctccaaaaccctcaccgaagtcctcttcttgggcaatcacttccagggttgcttgccctaccaaattggctacctcgataaggctaccgtctttgatgtcagcaaaaactccttaacgggtcccatcccacactcctttgcctgcctgcaaagcatccagtacctcaacttggaccgcaaccagttttacggagaggttcctgagatgctgtgtcttctccctggcctccgcaacaatgggaacctctccttatccgacaactatttcactcaggccgcacggacaatgcacagaattcttctccaagatcaagccctgcccaaatccaaagtatctccattacgtcccttgaataaacaggagtatgagagtgattctgtgcaacctttcaagccatatattcatattttacagcattgtactgattatggcaatgtgggaagggtagatctgagcacaagacagggtgatctagtgaaggaactatttgtcaaatggaaagctccttttgacggatgggtggtgataaatactactgatggttctgttaaaaatcaggaagggggtgcccttcatggtctcaagatggcgtatgagaaagggtttcaagcggtggagctgcaaatggattcggaggcagtg

SEQ ID NO: 2924 - DNA, 2793 bp, Glycine max
  Peptide Sequence Number=SeqID_119702
atggctgataccaagtttgcgtcccttcttttggagaatttgaagctacaggatccatggcttccccccgacacatgggaatccataccttctgaaagtgggctactgctttcttctcctatacctaattcaaaccaacctctctgccacctctccactctctctgaatctagtttggtgaggttggccgtgaatgccatgcagggtgctaaatcttcccttgttattattcaaaacctgtctgccatcttttcttctgatccatctgtcaggtccttcctctggaatcgtgcttccaccactcgttctcttggaaatatacttatctctattggctgcaccggctctctgctctttcttctccgtgcttttgttgattattttacagacacttttccactcattcatcatgactctcctccctttactctcgttaatcaagcctttgctgtttctgtgggaaaagtcttggaaggctacatctgtggattggacactattcatacatctgtacttttaaggcgttcatctaaggatgtcgatttcactgtgcctgggtgtttgaagaatgtagtgcattctgaaattacacttcttgagttttacctgcacactaaagaactaaggactcagattgaagcccttgctagtgtttgtaacctacaaaagtgggttcattgctttccagacactgctttccaggacctgattactgaagctacttctgaatttcgtaacttcttcagaggggggaatctgttaacttttttgtttgcacaattacaggtagctgatcctgctcactgcaccctgctcaagtttctttttcttcaatcatgtgaaccatattgtgggttcataagatcatggattttcaaagcagaagtccatgacccatataaggaatttattatagaaaatatggactgtttacctcataagtcacatgttaaagctggccattctgttgactttccattagcaagtgtcaaggtgcgagatggagttcccattcctggatttctcaaagacttcttggttccacttgttagagctggtctgcagcttcaagtactgttgaaattgcttgaaacgtgcattcatgttgcttctggagaacacagttgtcatgactttctaccctgttggagtggcttttcaagtagtctgtcttattcttctccattgactttcagcaaagatgttatagaagctatggttcttgcaagagaaaattattataaaaggatgaatgaaaaaattgaaagccttttgagcagcttagaagttagatatcagcaggtagccatgcgtgctttagtaccttcttttgataatggtggagatattctcaggggcattggtgatttgggctctgatgtctcaagtacaatagatgagttctctttgctggaagatgtgtgtgatttatctgaaagctcatccttatacagctctgaggagcaattggattgtgatcagcttagtggctggtcttgtccagtagttgggcaacaaaatcatttatctgctttaagcttcttgaagagtagtaccttaaataattcaatacaaaattcctgccatcatgaaagctcaggcagtgattcgcatggaatctgtgataaaatggatgctactgatgtgttgatgaagacctcccatgaggtagtgatatcgagtcacatgtctaatcctctaaatccagagaattcaagctgcttatgtaaattcagtattcaagatagagagagtttgattgacagttgttcaggaatgggtcactttttgaaaaaatcatttgataatgatggaactgttgagccaaaggtgactgaaaagcacctgggacccctgaaatattctatgttatgccatgacattaataccattagcaatactttgagtggggaagccacaaaggaggatcaacctgacaataatacactcacttcacatttgtacggtttccaaccacaaaaatatggccatcagtgtaaccatcccagcattaatccccttagtgtgaaccctatgttgacaaggaattcaattcttcacctgatgggtaggaatgggggaaaatacaaggctgatcatgaacaaactttgccttacttcaatttttctactgtagaggacccatgtaaggtttatatggacaaggtacccaccaactctagatgtagaagtgcatcttcatttacactagatagtaatgtgtctaatcgtaatgataagaataatgaacatggagaaattgactgtggtagagagaatgggttggttgatgttcccaaagtatgttttgatgcttcaccggacttgatggaccataaacatttaacagttgtatctggtgggagcagctgggaaagattactaggtagttttggaaaaactgtcaatgttgatgatactcaaaaacaaagaaagcatactgtactagtgttgcctgtccttagagatgtcagatacaattatgtcagcaagctagccatcaatgtgcttgaggaagcatttaagttgcaagagcatcttttggcactacggcggtatcattttatggagttagcagattgggcagatttgtttatcctgtctctttggcatcataagtggtctgttacagaagcaaatgagagactttcagaaattcaaggtctacttgagttgtcaattcagaagtcttcttgtgaacaagacactcacaaggataggttatttgtgtacatgaaaggacatgggaaattgcctctttctgcatctgctattggtacatccatacaatag

SEQ ID NO: 2925 - DNA, 516 bp, Glycine max
  Peptide Sequence Number=SeqID_119703
atggctgaatatcttaagcctctcctgtgcttggtactaactctagctgttgaatatgttttgtcaaacaatgctggatccagcactggtggcaagatgtttgagaaacaagttggtgccgattatgcgaagcaaacactggactctgccgcggacttcacactgaagctctttcaccagagcactgtagctgacaggaagaatgtccaacaagtgaacctgattgtagaaaacatggatggacttcacttatatggtttgcttatggcctattggataaatctcccgtgggatggaaatggccaggctctttcaggactcattgaaggcattgccgattatgtgaggttgaaagctggctatgcagcagactactggggtcagccagggcatggtggtgattggaaccaaggatacgatgtcactgctcgcttcctagactattgcaatggtatcaaaaatggctttgttgccgatttaaacagcatgatgaagtcccaattctcacttaaatag

SEQ ID NO: 2926 - DNA, 879 bp, Glycine max
  Peptide Sequence Number=SeqID_119704
atgtcgtcgataacgggcatccagggccaacctcttgaggttacggtggtttcgtgctccaagttgaaggacacagaatggatttcaaggcaagatccgtacgtttgtgttgagtatggcagcacaaagttccgaaccagaacctgcacagacggcggaaaaaatccggtattccaagagaagttcatcttccccctcattgaaggccttcgggagctcaatgtccttgtttggaacagcaatactctcaccttggacgattttataggaagcggaaagattcaattgcacaaggttctctctcaaggcttcgatgactctgcttggccacttcagaccaaaactggcagatacgctggtgaagtcaaagtcatattgcattacgcaattgcaaatcatcaaaggcataaatcagtgtcaagccatgctccatcagcacctccgtatgtggcaacaacaactcctcccgtcccttcttcatattctacctcatacccgccacctccttctgctacttcctacccaccacctccttcttaccatacaactggatcttattcttacccaccgccaccgccaccagtagcatccacagtttcatatccactacctccaacagcttatcctccctattcctcacatcccccatcatcataccctccacagccctcttcatatcctcctcccccatcatacccaccgcctgcttcagcttatcctccacctccatacccaccacctgcaggctatcctcctgggctattagatggatttgtggaacacaattttgatgcaacactacacttaacacccttctttgttttcatttactcttcaacgcactctcagcctttcaatgcttgttcaaacaccctgtaa

SEQ ID NO: 2927 - DNA, 327 bp, Glycine max
  Peptide Sequence Number=SeqID_119705
atggtttatctggtgcctgtcattgaaagtggaacaaggatgcttaaaaaagtatggtcaatctttggagagtcattagaaccattggaggagctattttcagccacatgtcaggcgagaggagagagaaagctcaatgaaaaagggcaacttgagcaagatgacatggcacttggtaaaaaaactgcacaaggcagaagcaggtcagagaataagttgaaacaacaactagaaggtggacttttcaaagggatgccatcaactgcacagtggaccaaagaaaacggagcagatcctggtagggaagttgatgtgactgcaagctaa

SEQ ID NO: 2928 - DNA, 141 bp, Glycine max
  Peptide Sequence Number=SeqID_119706
atggaaattacgcaagttatgctggatgtaccagcaaatttacatggtgcacataataacactccaacacaaggtggaatcgagtatgctaggatgtacgggtgtgtgcaaaggagaatgtattttctggcgtatttctga

SEQ ID NO: 2929 - DNA, 2466 bp, Glycine max
  Peptide Sequence Number=SeqID_119707
atggcggaagggcgagggagtaggaatttgaagattaggtttagagaaggtgggaagcactggacggatgcagttcccattgggaacggacgcttgggagccatggtctgcggccacgtccattccgaaaccatacacctcaatgaggacacgctctggactgggacacccgcagactacactaattccaaggctccaccagcactttctcacgttagaaacctcgttcaccgacaacactatccccaagccactgctgcttcttctgccttaacaggaaatccatccgaggcctacctacttctcggcgatatccaattggactttgattactcacatctcacacccggcctccaacaaccttacgagagagagcttgacttggacactgctactgtcaaagtcagatattctgtcggagatgttcaattcactagggaacactttgcttcctatcccgatcaactcattgttactcaaatctcttccagtaaaccggccaaactttcatttacagtttctctcctcagcaaaatcattaaccaaacttacgtaaatgcccctaatcagattataatgaagggatcatgtcctggcaaaaggatccaacacaatccccatggaattcaattctccgcaattcttgatttgaagattggtggcacagatggagtcatccatattttggacaataacaagttgaaggttgaggcttcagattgggctgttttacttcttgttgcttcctcctccttcagtggcccatttaccgctccttcagattctaaaaaggatcctacttctcaatgtttcactacattgagctcaataagcaatgtatcatattctcatctttatgcacgccatttaaatgactatcagggtctttttcaccgagtatctctgcagcttatgagaagcacccggccaaatatatcagaggacaggtctttggaattgaagaggcttacctcatctgtagctcatttgtctcttgtagacagtactgtaacacaagcttcaacttcagacagggtgaaatcgtttcagactgatgaagatccttccttggtggagcttctatttcagtatggtcgttatttgcttatttcttcttcacgtcctggaactcaggtggcaaacctacagggaatttggaacaaagatcttgagccagtttgggatggagctccccacttgaacatcaatcttgaaatgaactattggcctgctcttccttgcaatcttagcgagtgtcaagaacccttgtttgattacatttctcttctgtctgtgaacggcagtaaaactgcacatgtgaattaccaagcaaatggttgggtggcacatagtaaatcagatatatgggcgagaacatcagcaggtcaaggtgatgttgtgtgggccttgtggccaatgggtggagcatggctttgtactcatctatgggagcactatgcttacacaatggatgaggatttcctcaaatataaagcatatcccttaatggaaggatgcgtgtcatttctgttgagctggctgatcgaagacagtgaaggatatcttgaaactaatccatcaacttcccctgaacattattttatcgctcccaatggcgagcctgcttgtgtaagccagtcatccacaatggatgtagcaatcataaacgaagtcttctccacatttctttctgctgctgaggttatagggagaacaaaggataacattgttggagaagttcgtaaagctcaaccacggttacgtccaatcaacatagcccaggatggttccattatggaatgggtgaaagatttcaaggatccagaggtgcatcaccggcacctttcacatctatttggtctatttccagggcatacgattacttttaaggaaactccagccctgatcgaagctgccgaaaaaagcctttataaacgaggagaggaaggtcctggatggtcaaccacatggaaaactgcttgttgggcacggctacaaaacagttctaatgcatataagatgatcaagcacttgatcaacttggtggatccagatcatgagagaccatttcaaggtggactttacagcaacctttttgctgcacacccaccatttcagatcgatgccaacttcgggtttgcagcggcagttgcagaaatgcttgttcagagtacattgagcgatcttttcttacttcctgcccttccttgggagaaatggccaaatggctccctgaaaggcttaaaggctcgtggaggaacaacagttaacatatactggagagaaggggatcttcaggaggttggtatatggtccgaagaccaaacgagaacaactctaagaaaaagaatacactatagaggaaccatggtcactgcagacttagtgtctggccttttttacaagttcaacggacagttgaagtgcttgaacacatgctctctttcagaaatgccttgttcttga

SEQ ID NO: 2930 - DNA, 189 bp, Glycine max
  Peptide Sequence Number=SeqID_119708
atggcgatgacagtggccacacatgctgcggagtgcggatgcagaagggaagatggaaaagacgaggtggaattgaaggagaagcaaaagaggcaaacatggacgttgataaagactattgagatacgaaggatgaagaggttgaaagcaaaagtgaaagagacattgaagatcgagaaattgaattaa

SEQ ID NO: 2931 - DNA, 675 bp, Glycine max
  Peptide Sequence Number=SeqID_119709
atgtctgctgctgtgtctgcaaccaaggatgttcccttcaatgctcatttggaggaagatatcaaaaacaaagaaatcaacaaggttgttaatgttggggaagcagaccagattccttacaatgatgatgctgaaggaactgattcagaggcagaggaagaccccaagttggaattggatcttggccctcagtgttccctcaaggaacagcttgagaaagataaagaggatgaaagtttgagaaaatggaaggagcaacttctgggaggtattgatgtgtctgctgttggagaaaacaaagagcccgaagtgaagatagtgagccttaccattatatgtccagggaggcctgacctcattctgccaattccatttacttctgatgctaagaagagtatcttcacccttaaggaaggaagtcaataccagttgaaattctctttcactgtctccaacaacattgtttctggcctcaaatacaccaatgttgtttggaaaactgggcttagaggggaacctattcagcaagaaccaagggatgggggcggaaatggaccccatgtggataaaggaacagaaatcaacaaatatcctcaactactgcttgtgctttctcaagcaaatagccaaaaggttcatcaattctttgatggtccagaagcttttgtcatatga

SEQ ID NO: 2932 - DNA, 483 bp, Glycine max
  Peptide Sequence Number=SeqID_119710
atgtggaaagagtctccgcagtcctcaccagaagcaaaaagactgggttttggcgttaacctaagcgaagagagagagaggttgaagaaggaaggtgaagaagagtatgggtctgaatcgggatgggtggatgctcgaagttggtgcgatcacctggcatcatccttatcggaggatctagggcagattccggggcctgatactccgtgccagacctgccaacacccaactgaaaactggttgtgtctgtcctgtaagcaggtcctctgtagccgttttgtgaacaagcacatgctccaccattctcgtgacactaatctcactcactgcgtcgccctcagtttcagcgatctctccgtctggtgtttctcctgcgacgcttacttggatcctcaactcattccccaactccgtcctcttcatcaactcgcctatattttgaaattcggtcagcctccaccaattccatcccccagtctttga

SEQ ID NO: 2933 - DNA, 579 bp, Glycine max
  Peptide Sequence Number=SeqID_119711
atgtctagttttgttttcctatctctgttatttcttcttctccaacgtcctctcccatccctctcaaactctgaaggagacgctctttatgccttcaaaacaagactttctgaccccaacaacgtactggacagctgggacccatctctcgtcactccttgtacctggtttcatgttacctgcgactccaacaattacgtcactcgcttggagctctatgggaataacataactggaaacattcctcaggaacttggtaacttgatcaaccttattagtatggatttgtcttataaccgattccaagggaacatcccgaagtcatttggcaacttgaagtctcttaaattcctatggctcaacaacaaccagctgacaggatctatcccaatagttgtcagcactcttaatctccaagtctttaatgtctctaataatcgcctctcagaaccacccgtagataaacttcgtatcccattgcccagaggctcttcgctatgcgaaggtatgggggagggatgttgtacgcagtcttacccttgcatatgcaaagaggctgtttccgaaaaccactcgtag

SEQ ID NO: 2934 - DNA, 1557 bp, Glycine max
  Peptide Sequence Number=SeqID_119712
atgggtgaagaggcctccaaatccaatcccaaactaacactgtttcctctcatagctcttatcttctatgaagtatctgggggtccttttggagtagaagattccgtcaggggtggaggtggtcctcttctatcgctgctcggattcttggttttccctctaatatggagtataccagaagctcttgttacggctgaacttgccaccagcttccctcaaaacggtggttatgttgtttggatttgctcagcctttggacccttttgggggtttcaggaagggttttggaaatggttcagtggggtgatggacaatgctctctacccagttctcttcctggattacatgaagcaatccttccctatctttgatcgtttggctgctcgaatccctgctcttctggggatcaccctttcactcacttacttgaattaccgtggccttcacatcgtcggcttttctgctgttttcctcgcccttttctcactttccccgttcctcataatggcccttctttccattccccaaataagacccagccgctggcttcttgtggattttgccaaggtggattggccaggatacttcaacaccatgttctggaatttaaattattgggataaggccagtacccttgcgggagaggttgaggatccgagtaaaaccttccctcgggcacttgttggaggactagttttggtggtctcctcctatttgattccacttcttgctggaacaggttcctttagctcctctcccactgagtgggtagatggttattttgcccaagttgggatgttcattggcggctcttggctcaaactctggattcaactcgctgctgctatgtctaacctcggcttgttcgaagccgaaatgagcagcgattctttccaacttgaagggatgagcaagatgggaatgcttcctgctctatttgctacaaggtctgtttatggaacgcccacttttagcattttgttctctgccactggagttatcttcttgtcttggatgagctttcaggaaatcatagagttcctcaatttcttatatgctgtaggaatgcttcttgagtttgcagcttttatcactttgaggctgaagaagccaaatctttatagaccttacagagttccactgtcaacattttgggcgaccatgctttgtttgcctcctgctttactgcttattcttgtaatgtgcttggcttctttgacaactttctttgtgagtggagcagtaattctggtggggtttatcctgtaccctttcttggttcaagccaaaaataagaattggattttatttgaagaagccactggctggcagcaatgccattcagaactgactgaccaagaaaatagcggtgttgagcttcttgtgagctcaccattggctagcgtggaagaacaattgtctttaatgcaaaatattgtccagtatcctgtcagattagtgaagaatggagatccctatgcaacatctttgactacatgtttggagcagaagttggagaaggagggctttaacagtcagcaacaggagattgtgtaa

SEQ ID NO: 2935 - DNA, 138 bp, Glycine max
  Peptide Sequence Number=SeqID_119713
atgaggcagagacttgcggacttcaccctaggcagtcccaaattatccattcttctgactgttaagcttgtgaagctacacgggacacatgttaaggagaagttcctccccaccctcatcacttacaagttgctgtga

SEQ ID NO: 2936 - DNA, 450 bp, Glycine max
  Peptide Sequence Number=SeqID_119714
ggctctaacctagaagcacttggaattgtaggcgatacagcaaacactgtcgcaaagaagccacccccacctcctcctctggtgtcacgcaaaccggcgttcattgatgcattcttgtataagatgaagaagaatccaaatcttttgttgaacaagaccatttggtcacggagatcgactatcttgccagaatttgttgatagcactgtcaagatttacaatgggaaaaccactattcgttgtaggatcactgagggaaaagtgggtcataagtttggagagtttgctctcaccaggaaacgcaagaccagagaacaagccaattccaaaaatgttaaacaacttaagaaaaagaaggcgagtcctggtgcagcggtaaagttgtgccttggtgacttgttggtcatgggttcgaatccggaaacagcctctttgcatatgcaagggtaa

SEQ ID NO: 2937 - DNA, 2467 bp, Glycine max
  Peptide Sequence Number=SeqID_119715
atggaaggaaatctattgagggaagtctctcttaaatggatcttcctagtctctgactccggcccaggcaacccaaaatccatacacattgatgatcccggtggatctagtagtggatcagcaatatcagtggccgcaaatttggtggcagggtcccttggtagtgagactgatgggtccattttatgcccttcaggttctaactcagtagtgggcattaaaccaacagttggcctcactagtatagcaggggtagttccaatcaccccattacaagacacagttgggactgtattagatgctgctcttgttcttgaaaccattgcaggcatcgacatcaatgataaggcaacaatcaaagcatcaaagtatgttccaagagatggctatgctcaatttctaaagatagatggactgagaggaaagagattaggtgttgttagagcattctacggttttggaaatgacacttttaagcatgatactttcaaactgcacctgaaaacactaaggcaaaaaggagcagttttggttgacaatttggagataaacaacattcaggaaatcttaatgatcaaagagaaacttaaggagtatggccaagatctcatgctggtagctcaaaagacaaatggagttagggaactgaaggaagcagtgctaaacatggcaagattgtcacatattggatttgagaaattaatgataacaaataaccttgacgcaatggtggtacctttttcattctttgctagtatacttgcaaggggaggttatcctggagtaactgttccagcgggatatgaaaagggtgcaccatttggaattatctttggaggtttgaaaggctcggaaccaaagctcatccaaattgcttattcctttgagcaagcaactttgatcaggaagcccccaccactccgaaagttggaggctgaggtggtgttttcatggcttccgacacggtacgaggccaaaggactctcaatcgaagaggcaaccgtttatgatctccaacttgcttttcggacaaaacaactaacctctagggaagtcgttgacttctacctcaaacaaatagaaacgcaaaacccagttctgaaaggggtgttggagttgaacccagatgcactatcacaagctgataaagctgaccatgagagaaagactaaggcaccggggtctctttcaccactgcatggaatacccattttgattaaggacaacattgcaaccaaggataagatgaacaccactgcaggctcttttgctcttctgggctctgtggtgcctagagatgcaggtgtagtttccagattaagagaagctggggctatcattttaggcaaggccagcatgagtgagtgggcattttacaggtccaatgcagcacccagtggttggagtgccagaggtggacaggggaagaatccatacacaatggatggtccaagtggatctagtagcggatcagcaatatcggtggcagcaaatttggtggcagtgtcccttggtactgagactgatgggtccattttatccccttcaaacgttaactcagtagtgggtatcaaaccaacggttggtctcactagtagagcaggggtagttccaatcaccccaagacaagacacagttgggactgtatcagatgctgctcttgttcttgaaaccattgcaggcatcgacatcaatgatcaggcaacaattgaagcatcaaaatatgtcccagaaggtggctatgctcaatttctaaagaaagagggactgagaggaaagagattaggtgttgtgagatttttctacggttttagtggcgatactgttatgcacaaaactttagaactgcacttcaaaacattaaggcaaaagggagcagttttggttgacaacttggagatagaaaacattgaagaaattattgatggtcaaagtgaagagattgctatggcatatgatttcaaattatccttgaacgcgtacctcagagacttggttaattccccagtgagaagcttggccgatgtgatagccttcaacaaggaacacccagaattggagaaacttgaggagtacggccaagatctcttgttgttagctgaagagacaaatggagttgaggaacttaatcatgcggtattaaatatgtctagattgtcccacaatggatttgagaaattaatgataacaaatgaacttgatgcggtggtagtaccttcttcaacctttagttctatacttgctataggaggttatcctggagtaattgttccagcaggttatgaaaagggtgtgccatttggaatttgctttggaggcagaaaagaaacggttttggaccttgcaaagtttgtagacaaaggcgttcaagttaagcttactggtggaagacaagtgacagggactctgaaagggtatgatcaattgcttaaccttgtcctagatgaagctgtagagtttttaagag

SEQ ID NO: 2938 - DNA, 261 bp, Glycine max
  Peptide Sequence Number=SeqID_119716
atggggcactccaatgtgtggaattctcaccctaagaactacggacctggttctcgcacttgccgtgtgtgtgggaatcctcatggattgatcaggaaatatgggcttatgtgttgcaggcagtgcttccgaagcaatgccaaggaaattggcttcatcaagctatcttcatctttctccttgagccatttagcattctgcaattctttccttgtgtttgctcaagttgtgaaagttaggtctgaatggttcttaacctaa

SEQ ID NO: 2939 - DNA, 957 bp, Glycine max
  Peptide Sequence Number=SeqID_119717
atggcaacctctccttcccctgcaccagccagcattgcccctgaaacatatgcgaggagcttgaagccacatgaagaaaggaaagcaaatccaaggttaggttcatttccagcaacatgtcaaacaaagtgcaaccaatgcaagccttgtgtgccagtcgaggtgactatcaaaacagtggcagaggaagagaacgagtactatcccatagcgtggaagtcttggatgcaaaatgggttgcaatttctgtgccactggatccatgggattcaaaaacaacctatcatccggagaaattgtggaacagctcgttcatcacaaatccgtaatgttgtcttcatgggaatgggagagcctctcaacaactattctgctgtggttggcatcattcatgctatcaacaagcttcataatgacctgtctggtttgaacttggctgtctcactgcatgcgccggcccaagacatccgttgccagataatgcctgctgctcgtgctttccctttgggaaaactcatggattcactgcaagactatcaaagtaaaagtctgcagaaaatatttattgaatacataatgcttgatggggtgaacgacgaagagcaccatgctcaccaattgggaaaactgtcaagagacatttcaagtgttcagtgcctctctcaggaaaaagttcttaaaactagatcgtcattctctgctcagttacacaatgctgttgtgaacttaatgcctttcaactctattggtaccttgagtcagttcaaacctaccagtgagcagaatgtctcaaattttcataaaattctttggggtacctatcatattcgaacaacagttcggaagcagatgggtcaggacataagtggtgcttgtggacaattggtggtgaacatacctgacaagtctcttggcaatgcagttcccctaacggacatagaagatcttgttatctga

SEQ ID NO: 2940 - DNA, 222 bp, Glycine max
  Peptide Sequence Number=SeqID_119718
atgctgctccttcatttctctttctttttaccctgttctagccttctaggcaataggtacataccattttatagaatcactcagggacagaacaaagtgctaattactgatagaatgtgggctaggcttctatcttcaacaaatctgcccagctttacgattgctaagactgtctctgaagaaaaaagggaagaagaagcaaacggtaatgtccctgagtaa

SEQ ID NO: 2941 - DNA, 719 bp, Glycine max
  Peptide Sequence Number=SeqID_119719
tgggtgctcaaaatgatcacaataatgatccaaccctcaccaacaaagaattttacaggaaagccaagagttcaaaatcaaccggattaaataaggaagaagatgaagatggtgttatatcagcaaagttacacctaaggcacagggcaatgaatcatgggaatgagcctaaaactaatgtactagactcagcaatcagggatttggtcagaattcaaactcttcatagaaaagtcatagagaaaatgaacacaaacagcatgtcaaggaagcaagaagtgaaggagagtatcaccatccagcagcagaacaacatagctaatgcttttgtagcatcattggaatcttctaaagatgagttttcaggtaacatcatcgcaaccttggagtttggagcctctcttggcagaggagagtatttcatagacatgtttgttggaacacctcctaaacatgtttggttgatacttgacactggcagtgacctcagttggattcaacgtgatccttgttatgattgttttgaacaaaatggaccctattatagtcccaaggactctattacttatagcaacataagctgctatgatcgctgctgccaacttgtttcctcgccagaacttcttcagccttgcaaggttgaaatccaaacatgtccttccttctatgaccaggcagatggttcaaaaacaacaggagattttgcattagaaacttga

SEQ ID NO: 2942 - DNA, 237 bp, Glycine max
  Peptide Sequence Number=SeqID_119720
atgatgagcaccagatctaaagaagtcggaggtgtcgctctccctcaaggtcccgctctagtgctaccacctattccaaaagatccattgaatgacctaatggaatggtttctcgttcagaagacaaaagtcatagcaccccaatttgatgcatgtgctagttggtggactcaaggacccgatgctataatgcagttggtatctttggatctttgtggtcatcttcatgttgcttaa

SEQ ID NO: 2943 - DNA, 243 bp, Glycine max
  Peptide Sequence Number=SeqID_119721
atgaggactcctgaccaaaacttgttcgatggaatgctcatgaagggaaggtctatttttgtggaagccattgcacttctcaagggaaggtggaagattcttcaagatttgaacatcggcattcagttcagtcctctttgctcgaagcaagcaaaacatatgtattcatggcatcaagttttgatagctgagaaaaaggatcgcttcattaacactaataaagaagtccatgaatctgcctag

SEQ ID NO: 2944 - DNA, 726 bp, Glycine max
  Peptide Sequence Number=SeqID_119722
atgcctaggccactcatgtgcaagatccccaagcttcctctcaaagaagaatctccacactgcaatggaaatgtgaagcatcacacacccttaggcaaagaaactctgaaagtctatgtccttaacaaaagcaaccatcaagagaaggcatcctattgtgaacaacaacaagccagagaaggaatcagaggtgtcaatcagaagcagatcatggggtgttgtcccttgaagcttgcttgtggtctcggatccgtggccaagcacaaagatctctttggagtagaatatcatcaaagctccacaatgtataagaacgaagaacgtaaaaaacaaacacccatgaccaattctaatgctagtttgatacacatgtttcaacaaattagaaactgcaatttgcctttggcatatctatcaaacaaagctcaaagcctcagactaaaacatgaaaactcacagaacgacttgaataagagatatattagacttgcttgtggtctcggatccgtggccaagcacaaagatctctttggagtagaatatcatcaaagctccacaagtaagagctattgtggaatgaagaacacacataagggtatatatagaagaaaccatttatccgaattcacttcaaaggcctttaattgctttcttacttttaactcgatggagcctctgccctctaaaccaacaatggtagttgaaattccaatcacttcgttctag

SEQ ID NO: 2945 - DNA, 303 bp, Glycine max
  Peptide Sequence Number=SeqID_119723
atgtgtataggaggagaggcaaagttaggcccagtagcagtagcatggagatataagacaatgagtggtgcgcaactgcaaagtgcttcccctgccttgaccatacaagggtcacagaaaaatgtaggttcggtggctgtggcaactgctgcagaatcaaagccaaagaagaaaatctgctgtgcttgcccagacactaaaaggttgcgagatgaatgcatagtagagcatggtgaatcagcctgtacaaaatggattgaggctcatcgactgtgcctccgtgctgagggattcaatgtttga

SEQ ID NO: 2946 - DNA, 276 bp, Glycine max
  Peptide Sequence Number=SeqID_119724
atggtatctgattcctcctttcatggggcctctagcattatcatgttgtaccctgaaccctacataagattgcaaggtgtcatcctctttaggtggaggagtgagagggaaggggttggggcgaggaagaggaggttgttggggtcgttggggaaagtggcgagggaagagaaagtgagagggagaggatcgtgcttcgattcgaaggctttcaggagagattcaagcttcgaaggttctagaaatggtgccgagaatagggttatgtgtggctga

SEQ ID NO: 2947 - DNA, 1398 bp, Glycine max
  Peptide Sequence Number=SeqID_119725
ctctgtgttccttgcccgttgtcttcctcaatctccctttcctctctttgttctcttctctcaatggctaccaacaaatcttcttttcatccggctcttgccgtatcaaacatgaggaatcatgtttccattgttcttgaaatggaaaacgttcaatattcgacgtgggcagaactcttcaagattcacgcacgctcaaccaaggtgcttgatcatatcatacctccggccaacggcacggggacggttccttctaccgaggaacagagggagctatggtcaactttggatgccatggttctttcgtggatttatgctaccatttctagtgacttactgcacaccattattgagcccgactcaacggctatggaggcttgggataaattgtgtgatatattccaagataatcaacattctcgtgccgttgccttggagcaagaattctccgccacttctatggagaatttcccaaatgtttcctcttattgtcaacgtctcaaatctctagcagatcaactgaagaacgttggggctccggtgtctgatagtcgactggtattgcaattggttgggggtcttacacaaccgtaccgtggagtgggtacgttgatccgtcaaagcaacccccttcctcccttttacaaggctcgttccatgctcactcttgaggaggccgggatggcaaaggaagcagccactgagtctgctatgatcgcctcttcgattaatgatgggtccccacaacctacgaaatcaggacattcgaagggaaaaaatggcgcgcaacattctggtggcggacgacgcaacaatgggggaggtatgaagaatgcaggttctggtggtggctggaactcgaccgacagtaaaggcggtggtcgagggcagtcctcaggtggccacggtttgcttggcccaaaaccgcctcagcaggcctatgtacatcaagtagcatctcctaatcctcatggacagtttggtttgtacgctccaaccgatatcgaggcagcaatgcacaccatgtcccttaaccaacctgacccgtcatggtacatggacatcggtgctacatctcacatgacttcctctaccgaaaagataattcaatacccgtcatggtacatggacatcggtgctacatctcacatgacttcctttactgataatctcttgtcttattttaatttgagcaatcatcctaatcctaatattattgttggtaatggtcacacgattctaattcttggctatggtcacatgaatttgtcttccccatgtcaatccctctcccttaacaatgttcttcatgctcctaaactgattaaaaatctcatttctgttagaaagttttcaaaggaagggattggtagtcctttacacatggttgggtattaa

SEQ ID NO: 2948 - DNA, 2095 bp, Glycine max
  Peptide Sequence Number=SeqID_119726
atgccaacacatcatgatacaaccctatctcttcttcctttcccagccaacatcgtttctctcaaccaccatcgcacaacctctatcatcaattacctgaggaacaaccttgacgccgatggtgattctgatcatgacactgtcgatttatggctccacttactcggaaaccctgaagattggcgaaggcctaggtcacaccaggatcggggtcccgcacaacgcggattggaccaagggtggttgcgcattgttctgagtcctggggtggcggtgtggttgcgctactggtggtgtagggtggtggcgcaacaacagagagatgtaggggtgtcgcgtattactatcaacaccccctgtgtcgaaaatgaccttgtcctcaaggttatgaagaacgcacagctcgtcccatggttcccaagaggcctcttcaagagggatgaacaatgggggtggttatcgatggagtgtttagggagagttgccggcgaaactggagtgggaccatgcgcttcgttatctgaaaatgatcgtaaaatcgcttggccagcttggtgtatgtcggggctatcgacgtctgccgatacagtcgaaggcgaacgtacacccaatctcccaccgcgaaagaaacatcacggcggtgtttatcgtcaacaacgtcattgggtgattgaccctggagatattggaccagccgcggaggtactgttcgagtgtgcgattgagcaccttcgtctacccgttggtctgcggatgacaccaagctgcacgggaagtcatggtgcttgcacaccatgtccagaaataatacggccactttgtatgcggtatgatgggtgggtagagcgccaaagtgggccgccttcgaaaaccgatcaaccacaactaatatcacggtatacccctgagataaaggaatggggaggggttgaagaagccacgcactcttcttcgtctcatacttcgtttgctggcaaggtcttggtcactcctgatgatcgtgaatgtcctgtaggagatccacatagtacgtatcctgtaacagagcatgacacaaattctgtaggaagaggaagtgaggcatggtcaagagaagggactgtggctgggttggatcacgccagtagcaagcatggaggaaatttgtttctcgatttcttacttttgaaaatggggataacgatatgggcgaacattgataggcgcggatggaggcaattagagggggtatgggctcaggtgtgggtatggggtggtgcatgtggaggaggagggagggctggcgggggagaaggaaaggggtgcatctgcacaaagggtgatgttacgacccaaatgagagaagccaccgtctaccagtataaccacctgatggcagcgcagatacccgaggaggcgaaacgtttgaggggctggagtgccgtccatcgcattcaaactgatttacggagtaattgcatgttccgccatgggagaagctggattgtcgatgggattgaggtccgctgggggctcgagttcatcattagcgatgaagagatggcagacgttggccgtggtgacggtccaacagcttatcttcttggaggcgtgcgagctccgtggcgtgaggaagggacaaaggccgtagtgcttgtacctcacggcaaagttttggaatcaagcctaaaacaaaacagctcaacaagcatgaagggggtaggcctagggtgcggtttgccaaacgctcgaattccggcgaatccgattccagagcttgcagcatcgctggccatgaagggaaaaagccgttgcgacacatccattgataccaggataacgcgggtccctccatgtaaaatgaggcaactcgcgggacctccaatttcatgtggtggcggtgaggggaagaggaagtatgtaatggtgtcagaggaggtggcagagagtgaaattgtcttgggggagggttttgacggcctcctccagcttgtcggtggtgacctggcatgtgtgatgctcaggcatggcggagaacggcgaggcaggaatagttgcgtgaggaagaagacccgggtcctcggggtcaatggcgcacgcaacggagagggaggag

SEQ ID NO: 2949 - DNA, 3147 bp, Glycine max
  Peptide Sequence Number=SeqID_119727
atggcgatgttgaagaacaacgaccaaatctcagcaaaactaccaatctttgatggaaccaactatgagaggtggacgacagagatgaaggtggtattcagatatcaaggcgtgcttgatatcataagcaccggcgtcacaccattagagatgaatcccatgaaggcacacaaggtaactcaccgtgaacagatgaagaaagatgataaagcaacctttctaattcatcaatgcgtggattcaaatatcctagagaaaatcattgactatgagacaaccaaagaagcatgggatgtgttggctacaacttacgccagtgacaagcaaaccaagaaggtgagattgatggcactccagcatcaactgggtttgcttcagatggaatcaaacgaaatggtggcacaattcgtaaataggttggtgattcttgcaaaccaaatgaagagttgtggtgaggtggtgaccgattcgatgaaggttgaaaaggtactcactggcttaacaccaaactttgatcatattgtctctgcaattgaacaatcaaaggacctagaaatgttgaaattggagcaattactgggttctttggaagcacatgagttaaagatgaagaatagagaaggtatcaagaaagaggagaaggatttcgagaaagccttacttgttaaaaatcagaagaaaggtggtggtgattcttggaagaataagaaagggaaaggcaagtggaagtatagcaaacaagaaaacagtggttctaaaagtgagaatcaaaagaaagaaggagaaaacaatggaaagggaaagaagaaatcaaaggagcacattcactattataactgtcaaaagtatggccattatgcagatgagtgcaataatcctaaagtgcctaggaagaggggtgaagaagcacaactcgcgcatgactctgatgatgaagaagtagtgttgttaatggtcattgttgacatgaaaagaagcatcaaatttggtgatggcagctcagtaatggctaaaggaattggcaaggtggacataagaagagatgggagcaaggtgactatcagtgatgtcctatatgttcctaacatggaaagcaatctgctaagcttgggacaattgctagagaaaggattctcaatgcatatggaaggtgaacacatggaagtagctgattctaatgggaaatgtgtcttggaagttgctgtgtctatgaacagaacattcaaggtgggtgtgagcaccattgagcagaagcatcttccacatgatttttgggcagaggcagtatccacaactactcacatcttgaatagatgtcctacaaagaggcttgacagtttgacaccagaagaagcttggagtggactcaagcctagtgtgaaacacttcaaggatgaagttcagattgacaatgaacaatatgtgaatgatgagcaaaatgtgaataatgggccagatgtgattggggttgtacctttgagaaggtcactaagacagatatctccaccagtgaggtttcaagactatgatgtcttccctgatactgctatcaatgttaatggtgagttgatgaacttagtgttgttagtagaagcagaaccaatttcacttgaagagacactagctagtccacattggagaaaggccatggaagaagaattgagatcaattcagaaaaacaacacttgggaaatggtgaatttaccaagtaataagaaagccatagaagtgaagtggattttcaaaaccaaagttaatccatctggtgaaattgccaagtataaggcaaggctatttgtaaaaggtttcttgcaaaagcctggtcttgatttcaatgaagtatatgcccctgtagctagaattgaaactgtgaaactcatagttgcaattgctagcatgaggaaatggacagtgagtcagctagatgtgaagtctgcttttctcaatggtccattagaagaagaattatacacaaggcaaccacctggctatgagaagataggcatggaagatagggtaatgaagctgatcaaagccctatatcgcttaaagcaagctccacgagcctggaataagaggattgatggatttctgcagaagcaaaagtttctgaaatgcaccactaaacatggagtgtacttgaaggactgtggagtaactggtgtagtgatgctatgcttgtatgtgaatgatcttcttgtcactggtgatagcaaacaggagattgacaggtttaaaaaggaaatgatggatgaatttgaaatgactgatataggcagaatagcttatttcctaggtatagaatttgtgacaactaagagtgtcatattccttcaccaaaagaaatatgcaattgatatattgaaaaggttcaacatgcttgattgcaattctgctactactccttgtgaaccaggaataaaactgtctactggtgaagacacaaacttggttgattcaacactatataggcaactcattggctcattgagatatttgtgtaattctaggctagatatcacctatggagttggcttggttagtagattcatgaagaaaccttgcaaggatcatctacttgcagctaaaagaattcttagatatatgaagggcacactagaatgtggaattctgtttcttgcagcaaaagaaaattctgagatagaaattgttggctacacagatgcagattggagtggagatgttggtgatagaaagagcacatccgggtacatgttcatgcttggaaatgctcctatatcatggtgttcaaagaaacaagatgtggtggcattatctagttgtgaagttgagtatatctcagctgcttttggtgcaagccaaaccctctggctaggaatgttactggaagagcttaacatcaagtgtagtaatgtaatgaagctcatgattgataacaaatcagccatagaccttgctaagcatccaatagctcatggatgcaataagcatatagaagtaaaatatcattttctttgtgaccaagttaacaagaataaactagcgcttgagtatagcaaaactgaggagcagtgtgcagatatgttaaccaaagctttgaagcctaagagactagaagaaatgaagaacaaaattgggatgcacaaattgacaaatttgaattaa

SEQ ID NO: 2950 - DNA, 462 bp, Glycine max
  Peptide Sequence Number=SeqID_119728
atgcaagacattttcagatcagttcgtcgatcactggtattttgcagttcgccagagaacgaagaagcctcctcgctcgaagtcataggaagcctcgttgataagatcagttattgtatccgaagttccagagtcttctccaaaccctctctgccgtcgcctccgccgccgtcctttcctaagaacgctactcctccgatccaatggcagaaaggcgagttgatcggttgcggtgcctttggccaagtctatgttggaatgaatctcgatttcggagagcttcttgcggttaaacagttagttgcatattttgacaggaagattgttcctgtgcccaaggctgaggggactgagtacgtagcttcaaagaaaaagcctccatttgggccaagattcattggagcagcttttgtgcagccaaacaaaccaggattcaagatcaatggccactctatcaggtaa

SEQ ID NO: 2951 - DNA, 776 bp, Glycine max
  Peptide Sequence Number=SeqID_119729
atgggagaagagccaaaccatattttctttagagctaatatgcaaaaggactggttggaacagagccaacatgttgttagacaggagcattacaaggatctaaaacaaaagttattcttccccaagctgattgactatattacttcaggtcctgttgtgtgtatgggggttgggatagtcgcatcggcccgtaaacttataggcgctacatatcctcttcaagctgaaccaggcacaataagaggagaccttgctgttcagacacgaaggaatgttgttcatggcagtgacaatcctgagaatggcaagcgtgaaatagaccaaactgcctcttctagggcaaatcaccaacttcctatactcgatgttgttcatgaagttgctgtttacattcataggtttcacaatctcaacctttttgaacaaggatggtacagaatcaagattactttgagatgggaggacggtgatgactcccatcctggggttcttgcaggggttgctcagtatgaaggtgcagctcctaaagtgggtgccgacaatttatgtggagttttgatgattgatgataaagacaatagtttttcaacgtcgtcattccggattagatatgcaaggcaggatgtaattcttgctatcatgatctcattctatgtatcttatggcagatacaaggccacaaatatctttgctaatgattatttttatccacagggaaaatcctctgttgttatcttgaagtttgagctctttcacactccaacacctaaaatacg

SEQ ID NO: 2952 - DNA, 408 bp, Glycine max
  Peptide Sequence Number=SeqID_119730
atgagttattacaaccagcagcaaccgccggtcggagttccgccgccgcaaggttatccgccggaggggtacggaaaggagggatatccaccgccgggatacccgccagcgggatacccgccagcgggatacccaccgccgggatatccgccacaacaaggctatcctccgccgccctacccggcgcaggggtatcctccgccctacgctcctcaatacgctcagcctccgccccgtcaacaaaattcaactggccctggttgtttggaaggctggtgcgtccctctctctctctctaattctttatttcagatccgatccgattcgttacattctcttcttgttcttggagacttcgtcacacgcgctccaactagattcattattttgtctccatgtcctctttaa

SEQ ID NO: 2953 - DNA, 528 bp, Glycine max
  Peptide Sequence Number=SeqID_119731
atggttgagataaaagcagcaaatcattgtccgttgataccactatccacaaaaccactctccatagtcaccacactaaaaacctatcctgaacctcatcaacctcaacttcaccttgttgcgaaaccattccccgcagcaccagcaaaaatccaaccattagacccaaaacacacaccattgtgcttggaaccatgtcaaacctcaccaaaatccagtcattataaccctttttctcagctgagggagtacgttgatgacacagaggattacatcaacatcatgctggatgacaaacagaaccatctcctccaaatgggagtcatgttgaccacagcaactctggtagtgagtgcctttgttgttgtggccggtatttttggcatgaatattcacattgagctatttgatgaccagaaagctgggatgacacaattcctctggactgttggtggtagcactgcagggaccatattcttgtatgtggttgccattgcctggtgtaagcacaaacgcttgctagagtga

SEQ ID NO: 2954 - DNA, 1161 bp, Glycine max
  Peptide Sequence Number=SeqID_119732
atggaaggggttgacaaggagaaagttcaaagggtagtttatgaaatgagcaaaggatccaaatattttcaaaacgaggaacgcaaagaagcgtttattaaacagaaaattgacaacatgcgaattcagtgtgcaagcctctcacaagctgacttggcccattatcaaaaggttgctgatagtagaattgttgagctggaatcttcgcgtgatctttcaaggatttggctacatgtagatatggatgctttctatgctgcagttgagactttaagtaaccctacattgaagggcaagcctatggctgttgggagcatgtccatgatatccactgccaactatgaggcacggaaatttgggtttcgagctgccatgcctggcttcattgcacgtaagctatgtccagaattaatctttgtcccaacagatttcaacaagtataattattacagtgatttgactagaaaagtttttcggaggtatgatcccaatttcattgctggtagcctggatgaagcataccttgatataactgaagtttgcagagaaaggaatgtcaaaagtgaagaaattgtccaagaactcagagctggtgttaatgaagagactggtctcacatgcagtgctggagtggcaccaaatcgcttacttgctaaggttctgggtttttcagacataaacaagccaaatggagagtatgttttgccaaatgaccgcatggctgttatgacctttgtatcctcccttcctatcagaaagattgggggcattggtaaggtcactgaaaatattttgaagcgagttttcggaattaacacatgtgagcagatgcttgggaaaagtagctacctttgtgcactcttctctcagtcaacagcagatttcttttgctctgttggtttaggtcttgggcagacagccaatcatcagcatatgaaccatgcaaagcttatgtttgcagaggagcttgctgaaatgctatcagccgacatgcaaaaagagggtctgtgtgggcgaacattgactcttaaactaaaaactgcatcttttgaggtattactagttattgatgacttgacactgttttctcttaatattttcctaatactggtcgagaacagtttagttggtttgtcacctctgaatataaaacttgattga

SEQ ID NO: 2955 - DNA, 489 bp, Glycine max
  Peptide Sequence Number=SeqID_119733
atgaatgcattggcttctcaatgcagtagtgggtgtgagtctggttggactctatacctagagcactctttccagctgaaccacaatgcctcttcacatacaacttcgcagttgttcaaagacaaacaagccaaaaaggaggaagctgaggaagaggacttgtccatggtttctgatgcttcttctgggcctccacacttacacttgccagatgcacaagataatgggagcttttattctgcatctaaggcggcaaaccttggcaagagaagtaaaaagaggcagaaagttaaggaaaaccaacacttgccttcttttcttgatgacactgctagctctcctgtctttgacttctccatgaccaatgtcactgtgaccaaccaacaaacttccacagagagcatgctagattactcacaaggtttctctactacttattatgagtggaagatactgaagatcggtgaagatggtgtgcagggaatctga

SEQ ID NO: 2956 - DNA, 195 bp, Glycine max
  Peptide Sequence Number=SeqID_119734
atggaagcaatatacaacggggagttatacacatttcacatagaaaatggagaactggcaatgtgcggttgccggcgggaagaaccaacggcgtttagggtttgggctatgaagggaatggaaaggaaaggcagagtgaagcaaactggtgaatcgaacgcaagcttcactcatcattctgctaccagaatttag

SEQ ID NO: 2957 - DNA, 1305 bp, Glycine max
  Peptide Sequence Number=SeqID_119735
atggcagagagtacagatgatgaatcattgttggctcgtatacaacaattggaacaggagcgtgatgaattacgcaaagatattgaacagttatgcatgcagcaagctgggcctggctatcttgctgtggctacccgaatgcattttcaaaggacagctggattggagcaggagattgagagtttgaaaaagaagttggctgcttgcacaagagaaaatctaaatctacaagaggagctttctgaggcatacagaattaaaggtcaactggcagatctacacagcgctgaggtttcaaagaatatggaagctgagaagcaggttaaatttttccaaggttgcgtggctgctgctttctctgaaagggatcaagcaataattgaggctgagaaggccaaagaaaaggaggagacaatgttgcaacaaataaatggcatccataagagggtagaggagctcacctcagattgtcttaagctaaaggaatttaatgatgctctgcagattgatcaagcagtacatatgaagcaaaatgaaaattgcatgaaggtaattaataagttctttcagatcaggcaacattctctgaaagaatttgaagatatgagttggaatgagaaatgtgcatgtcttttgggtgactctgaggaggtgtggagtttcaatgatgcttccacctctaaatacattggcttggaaattgaaaatcatttgaagaagagagtcaatgcattagaaaacaaacaaatttctatggacaaagtgattgagaatagcatagcagacttgaaacattatcattctaagtgtagggatgaaattatgaatttacttggtgatggagaatccagtattaaatccataatcaatgcaattgatgaaaaagtctggagttttgatctgagtactgtaccgaatttgacccctcaaagagatgcagaaccagaagagtctgaatgtgcagatttacatataagccctcaagctaaacctgtctcagagtccaagaggaatagtcctagtgcactgtcagcagatgctggtgtaaaaggtgatccatctgatgttttagcaatggcattgcaagagaaggttgctgcattattgcttttatcacagcaggaggaaagacatctattggagagaaatgtgaattcggcccttcaaggaaaaactgaagaacttcaaaggaacttgttgcaggttactaatgaaaaggtgaaagctcttatggaattggctcaattgaagcaggagcatcaattacttctggagtatgattacttttatgatgatggttactaa

SEQ ID NO: 2958 - DNA, 354 bp, Glycine max
  Peptide Sequence Number=SeqID_119736
atgaagaatcgtaggaggatgcagttgggaaatttggtggagtcgatcaaatcgaaggtgagatctttgaagccgaagaagggaaagaagccatacatgaagatggacaagagtgccagcgtcaaggacaagcgcctcagggtgaagggacctgttaggatgccaactaaagtccttaacatcaccaccaggaagtccccatgtggtgaaggcaccaacacatgggacagatttgagctgcgtgtgcacaagagagttattgatctccacagttccccagatgtggttaagcaaattacctcaatcacaattgaacctggtgtcgaggtcgaggtcaccattgcagatgcttga

SEQ ID NO: 2959 - DNA, 447 bp, Glycine max
  Peptide Sequence Number=SeqID_119737
atgtttcagacactcacactccccaaactgaggagatcagaaaaacttgttagagactatgtaagaaagctactagtgaactcaaatattctgaaattcagacctgcaaaaaaagacaaagaaaaactacaggggatatgcggaagatacagaaggaagcagctacagtttgactatgtagaaaaagacatagggtttcatgaaaatgaaggtaaagcagtttcagaatctgaagactttcagaatatcatacatgagcattttaacttgttggagaaacaatataggcaagttaaaaagatgagcaggctgttgtacgcagaatcctgtgtgtgtgtggtatcagaagagtggaaaagcttccaaatcgtaaattgggagatatacatggagataggagattcaatcacggataacattgtcagcgaaataatcgatttattttaa

SEQ ID NO: 2960 - DNA, 495 bp, Glycine max
  Peptide Sequence Number=SeqID_119738
atggaggtatctataacttcatctccatcccaaatgaaggaccccgaagatacttccttgggtggtgacttgttaccggtttcaaatggttacgttgagtggcttgactcaaaggaagacaagtccgtggtttacatttcatttgggagctactttgtgttgtctaagagacaaacggaggaaattgcaagtgctttgttagattctggttttccattcttgtgggtgattagagtgaaagaggaagaagaaggggaggaggtgtgtttgagaggagttggaagagaaggggaagttggtgaagtgttgttctcaggtggagagctaggtttcgggggtgcccatggtggtgtttcctcagtggagaaagagattaaaaagtgttcggaagaggtgatggggagtggagagttgagaatgaatgtaaagaaatggaagggtttggccagggaggcagccaaggaaggtggtccttcagatttcttgatgccatga

SEQ ID NO: 2961 - DNA, 1596 bp, Glycine max
  Peptide Sequence Number=SeqID_119739
atggcaactctctcagctctttccttcacaaacaccatcaggactttcccactacacacccaccgtctctctttttctttcagctccaaactcacgtgcagcaggtcctctctcaaagacgaccaacaaactgactcttgttcctctaatactaccacggtttctgttgcacccgaaaacgattctgagacccagcagcaggaaatggattggaagagcgacgaggagtttaagaagttcatgggcaacccttccatcgaagccgctataaagctcgagaagaagagggctgacagaaagctcaagcagcttgacagagaaaccaccaacactaaccctcttttcgccctcttcaacaacttggtgcgtgataacttgctcaatgaaaaggagaggctgcaaaaagctgaacaaactttccaggctcttgatcttaaccagttaaagagttgctttggatttgacaccttcttcgctaccgatgttcgaagatttggagatggaggcattttcattggcaatttgaggaaacccatcgatgacgtcattcccaagttggagaagaagctctctgaagcagcagggcgagaggtcgtcgtctggttcatggaagaaaaagcaaatgacattaccaaacaggcttgtgtggtgcaacccaaagcagaaatggatctccaatttgagtcaactaagctgagtactcctttgggctattttagtgctattgcattagcagttactacctttggaacagttgctttgatgagtggcttcttccttaaacccaatgctacatttgatgactatctagctgatgctgtgcctctgtttggtggcttcttatttattctgggagtttctgagataaccaccagggtaacagcagcccattatggtgttaagctcagcccttctttcctggtgccatcaaattggacaggttgcttaggagtgatgaataattatgagtcactcctcccaaacaagaaagctctttttgatattcctgtagcccgtactgctagtgcatatttaacttcactactgcttgctgttgctgcatttgtggctgatggaagctttaatgggggcgataatgcattgtatgtacggcctcaatttttctataacaaccccttgctttctttcatccaatatgttattggaccttacacagatgatcttggaaatgtattaccttatgcagtggaaggtgttggagttcctgttgatccacttgcatttgctgggcttttagggatggtggtgacttctttgaacatgttgccgtgtgggaggctagaaggaggtcgcattgctcaagccatgtttggaagaagcactgccatgctgttatcgtttgccacttcattgttactcggtgttggtgggctcagtgggagtgttctgtgtttggcatggggattgtttgcaaccttctttcggggcggagaagaaatacctgcaaaagacgagatcagccctataggggaaagcagatatgcttggggcattgtccttggcctcatctgctttctcacacttttccctaatggaggaggaacattctccagtgctccatttttcagggggtga

SEQ ID NO: 2962 - DNA, 186 bp, Glycine max
  Peptide Sequence Number=SeqID_119740
atggagagagaaataaaaataaaaatagagagaatacactgcatggtagcattgatgcaatactgccacacaggagaagaatatagagctagcaagaacaacaactctggttgccacaagaatcacgacattctgcggtgcggaaaatttcgagctggttgtgtcgggattggaggtggtgcctag

SEQ ID NO: 2963 - DNA, 744 bp, Glycine max
  Peptide Sequence Number=SeqID_119741
atgcttcaggaggatgattctctttggaatagaattctggtttctaagtatgggggttggagagcgcttgatgttgagagggtcaatcagcaggaatcactatggtggagggatttaaagaagtcatgtggcgtctcggcggttggggagtggtttaataaaggcatgaaactaaaaattggatgtgggagaagggattgggaggtggagttagtgtcagcttttctggctgaactgaataattatagtattcggccaagtgaaaaggataggtggatgtgggtggctgggagcgataatcgatacactgttagcggggcttatgcatggttgtatgaggcggtagttggatcttctgaagaggagatattcaaaagggtgtggaaagttaaagtctcaaataagtatttccgggatggtgtctttttttacgtgggaggaatgcatgccgccatcaggaatggcgagtcctccacggatggtccacgtggcagcggacttgccaggaccagtggcgatttcaagccagctggtctcgccagtcaaacttgcgagttggtccctgcccatgtctcgccagacgcagtggcgataaagccatgcactggtgcggcagtggcttcagggggcgcgcaggctagggccaaaaccgccaaaagcattggttcagtgtattctgagtgtgtgacatcgtttagcttaaatagctggttcttcctcctatggttttcgtgtgcattttaa

SEQ ID NO: 2964 - DNA, 570 bp, Glycine max
  Peptide Sequence Number=SeqID_119742
atggctaatcctccttctaccaattctgcttttccctcctcttccgctttccccaattctatcactgaaaaggtcaattattcaaactttcttctatggcggcagcaaattaaacctgttatcgacttgtacaaacttcaacgattcgtcccaaatccttcaattcaacctcagtttctctttgacaacgatcacaaagaaggaatcgagaatccagcatgtgaaacgtgggaacagcaagaccaggtcaaagctcttctccttgcacatgagtcaaggttgcagaagtatcgcaagatctcagactcaccttctgtgaatctcactcagctgtcaacaactgtgcctaattcttcctctgcacaaagttctgatgcgccaaacaaaggatcacagttgtcagatttggaaaattttcactctggttctggcggtgaatttggccgtggtgtgatggttttggccacactagtggattcagcaagtagtgtctatcttgaaaacatagatgaccaagtcatgtgcagaacagattctgttatgcagctagaagcatacttcggaaagtaa

SEQ ID NO: 2965 - DNA, 3923 bp, Glycine max
  Peptide Sequence Number=SeqID_119743
tatgcatttctgtggctggaaggttatcagagaaaaatcctgcatatgttcttccagctcttcgtcgccatcttatacagttgttaacttacttagagcagagtgcagatagcaaatgcaaagaagaaagtgcaaagttaattggttgtttgataaggaattgtgaacggctaatacttccatacactgctccaattcataaggcactcgtggccagacttgttgatgttaatgccaatactggaaccattagtggagtccttgtaactgtgggggatcttgcgagggtgggcggttttgcaatgaggcaatacattcctgaacttatgcctttaattgttgaagctttattggatggagctgctgtctccaaacgtgaagtggctgttgctacactaggtcaagttgtgcagagcacggggtatgttataactccatataatgagtatccacaattacttgggttactcttaaaattactgaatggtgaactagtatggtccaccagacgtgaagtattgaaggttcttggcatcatgggtgctctggatcctcatttgcataaacgaaatcaaaaaaccttgccagggcctcatggagacgtcacccgctctgctagcgattcaagtcaacagattcagtctatggatgaatttcccatggacctttggccttcttttgcttcatcagatgactattactccacggttgcgattaattctctcatgcgaatattgagggatccatcacttgctagctatcacttaaaggtggttgggtctcttatgttcatattcaaggttttgcctgatctttttcatactgttcgtacatgtgaagatagtttaaaggactttataacatggaagcttggaactctggtgtctattgtgcgccagcacattcgtaaatatttgcaagatttgctatctttaatatctgaattttggtcagcattcactcttccagcaccagctcgtcctggtcttggctatccagttcttcacctggtggaacagctttgcttggctcttaatgatgaatttagaacatatcttccagttattctgccaggttgtattcaggtccttagtgatgcagaacggtgcaatgactatacttatgttcttgatatccttcatactcttgaagtgtttggtgggactttggatgagcatatgcatctacttcttcctgctctaatacgattttttaaagtggatgcctcagtagacataagacgtgctgcaattaaaactttgacaagcctgatccctcgtgttcaggtcactggtcatatatcctctcttgtgcaccacttgaagttagttttggatggtggtggattgtgcctaaacgaattgccgaaactccctagcagcttgttttccaacactgagaaaatgatgtactatgaggagataactgtgttaccaatgacggaatatgccagaaggaaaaatgatgagctccgaaaggatgctgtagatgcactttgttgtttggctcatgctcttggcgaggatttcacaatttttattccatcaattcacaaacttctacagaaatatcgcttgcggcacaaggaatttgaggaaattgaagggcgtttacagcgacgggagccacttattcttgggatcacagcttcacaaagactgaacagacggcttcctgttgaggtcattagtgatcctttagatgatgtggagattgatccttatgaagatggatcagatgctcacaaacttagaggccatcaggttaatgatggtcgattacggacagctggggaggcttctcagcgaagtactaaggaagattgggcagaatggatgaggcattttagcattcaacttctaaaggagtctccttctccagctttacgaacctgtgctaggcttgcacagttgcagccttttgttgggcgagagttatttgcagctggatttgtcagttgttgggcgcagctaaatgagactagccagaaacaactagttcggaatctagagatggcattttcatctccaaatatccccccagaaattttggcaacacttcttaacttggctgagttcatggagcatgatgagaaacctcttcctattgacatacgccttcttggtgctcttgctgagaagtgtcgtgcatttgcaaaagccttacactataaagaaatggaatttgaaggagcacgttccaagaagatggatgctaacccagttgctgtagttgaagctcttattcatataaacaaccaattacaccaacatgaggctgcagttggaatactaacctatgcccaacagcatctagattttcaacttaaggagtcatggtatgagaaactgcagcgatgggatgatgccctcaaggcttatacagcaaaggcttctcaagcaacaagtccacatcttgtcttggatgccactttaggtaaaatgagatgccttgctgcattggctcaatgggatgagttgaatatcctatgcaaagaattttggaccccggcagagccagctgctcgtcttgaaatggcaccaatggctgcaaatgctgcttggaacatgggagaatgggaccaaatggcagaatatgtgtctcgattggatgatggtgacgaaacaaaacttcgaggtttggggaacactgctgccagtagtgatggaagtagtagtggtactttcttcagggctgttctattggttcgtagaggaaagtatgatgaagcacgcgagtatgtagaaagagctagaaaatgtctggcaacagagcttgctgctctggggggactgagaagggaatatttggtcgccggggggggatgtgcgagaggtgtttatcgtgagaagaagaaatggacattggattgctggtttcaggataataaattcctagatgtggtaagggcagcatgggagggggaggatgaaagggcgcttagaagaaaacttcaagacgagctatggaaggttgcaacatccactgaatctttgcttagacaaaaagggagaattaaatggatacggaaaggagattggaattctaggttttatcatatcatgttgatggcgggtggattggagaacctttgcgggttaaggaagaagtcaaactgtttttccaaaacagatttcaagaaagcatggggagaagcggtaagggagtgtgggagttctaaaagccccagtcctaaaaaatttcgtaccccattgcccggaggctcttcgctatgcgaaggtatgggggagggatattgtacgcagccttacccttacatatacaaagaggctgtttccagattcgaacccatgaccaacaagtcaccaaggcacaattttaccgctgcaccagggctcgccctcagtcctaatggatttaattttaaattcattaaggaatgttggggtatcatgaaggcagatattctgaagtttctcggagaatttcattcaagagattgtagcaaaaatcttgtcaagaaggttaaaaacgttctgcatgaggaggaagtgtttaaggtcgactatgagaaggtgtacgattcagtgcactggggttttcttttctacatgatgaggcacatgggattttgtcagaaatggatttcctggattgagggttgcttgaaatctagttcgatttcagttctggggttagcagagctcatgagggaggcaaagaagaagggtgtgtatgctggttttctggtggggaaggataaggtggaggtagaccttcttcattatgcagacgacacaatgttttttggagatgcaacagtgtcgaatgtcctcacaatcaaagccatattgagggggtttgaattattttcaggactgaagataaatttcgataagagcatgtttggggcatttggagtttcggagttgtgggtgcagaactcggccacaatgatgtga

SEQ ID NO: 2966 - DNA, 531 bp, Glycine max
  Peptide Sequence Number=SeqID_119744
atggctcccgaagacttggagcagttgacgcaaaaaactagggaccaactagaggagtcaagcacagaaaaagaactcgtactgcctcctgagcctgaggttggtccttcagttgctcatatcaacataaaggagaattgtgttgatcccttagggaacgacctagacacggatgagccagagaaatgcggattgtacgtaaaaaaaaatcctccatgtctggttgccattggaagactttatgaagggtcgaccaccattctcaacatccctttggccaatgatcaagtcaaggttggtgttgagaaagttcgagatgcagatgctcacattcctgttatgtgggatgctatcgtgtttggggtgcataatgacaacttccccttgtacataaagtgtgaagatctgtctgaaatagcacacagtggtcaatgtctcaacatctctattatacaattgtggattctgcatatgaatgagacaagtatgcgggcggggaatgccaatgtctatggattcctcgagccatag

SEQ ID NO: 2967 - DNA, 633 bp, Glycine max
  Peptide Sequence Number=SeqID_119745
atgaatgaagacgatgaggaggaacctagtgtgtttgaaaatattgattgttcttatgccttcactacttatccggtgttcgctacccatgaggacgtattgcaatgggtccgtactattgcacatgatattggttttgtggctgtaataatgaggtcagacacatcaacgggaaagagaggaagaacctcatttgctttaattggttgtgagaggagtgaaaaatatagagcatacaataaagctttagtacgaacgatgaagaacttaatatgtgggactcataatgtgggtgttccttgtgccacctcttcgcaaaatatgggtgttccttatgtcacctatccgcaaaaagcagataaaagtctcatgtcacctgtctccaacgaacatgtaatcaaagaacttaatcctgtagcagttactttaccttcaatctcaagtgtagaccttcccaattttccaccttcctcccatgaaaagccaacttcaactcggtatactcctcatgaaccttgtctacaacatgatccacatggtcaatatcctcagcaacaattgcagttccccattgtttacatgtcaatgttgtcagccttcaaagttgagggacttcttcctcatcaccaataa

SEQ ID NO: 2968 - DNA, 402 bp, Glycine max
  Peptide Sequence Number=SeqID_119746
atggactctagggatggtgtctcccgtagaggcggcggcggtgcatctgtggctggcttctgctggccttcctcttgctactgttgtgcctggacctactgcggtgcttgccttggcatgcaatatttctctatgaaggccctattgatgggaggccagatgagcttggtgggaggggaggtcagaattatggtcgctagggagaatgttgctgaggagcaacatcatccaaatctgcgtcagggtggtcatgctagtgcacatgatccgcactcgtctcccgaccatgcttcaggcaaagtcctgccctggaacacacatccgctggatgatggcctcctcatcaaaccccgaggcctggctcctcctctgactaaactcacagcgctggccctcctctaa

SEQ ID NO: 2969 - DNA, 267 bp, Glycine max
  Peptide Sequence Number=SeqID_119747
atgcagcatgtgactggccagcaggcggctaatcacaggggtcaggtgcagctgaacgagaccttctaccggtacactatgcaccaacagagccaggacaccagtcctttcccgtggcctacccccgagcagttcagggccacaattgcatggcctggagataagcctgattttgagacaggggcaagactcacaggggcccctggaatcgaggatggagctcagaaggatgatgatatggctgatgtgctggatttcttcacttga

SEQ ID NO: 2970 - DNA, 261 bp, Glycine max
  Peptide Sequence Number=SeqID_119748
atgaaaaagaatataatgagttctctcctctcctggccgcggcaagagcaacgaaagccgcagcatcctccgtgcaagtcacgtgctgcaccccaacctccacttcgggcttgctacacttcccctctccgctcaccatcgccgacatcacaaaccccttattataaaagaaattcggttccaacccgaaatccgaattggaaccggacccggaaccggacccgaggtcccagctcccgcggggagtgttcaccggagtaa

SEQ ID NO: 2971 - DNA, 1096 bp, Glycine max
  Peptide Sequence Number=SeqID_119749
gaacaacagatccaaaggcatcaaggtcaagcatgttctgcagattattctattgcttggtgtttgcttctggttgatctatcagaaaaagatattcatccaggtatggatgaagtgaatcaaaatgaaaggcatgaggaagatgagaatattttagaggatgaagataagcatgaacacaatgaacatgaagaaggaaatgagcatgaatcagaagaaaaaggttacaaacgtggagtgagaggaggaggagatgaacaagaggaagttgaaaacaaaaacaatgaggtggaagatgaaaggagtggaggagatgatgagatagatgaaaatgaccaagagcaatcagcagtggatactgatcgtgatgaggagttcatggatgaagagaaagagaaagaagaggagatcactcgtgatactggtacaactagcaccgaaagtgagacccttttagaaaactctgatgtaaactcagcaatgaatatgacgaaatcagagaacagatctacttataccaaggaaaaagctgaattgcctggtgggacttcttccaatgcagcatctggaactagcgcaaatacttcgtctgaatcaaaccaagctcaaaatggtactgtggatacattagtcactgaagatgtaaaaaatctacacaatattaccacgacatatttggacagtcattctgaagctggcagtaatctgacagcagtgatctctggtggtaacttggcaggaactagtgctaatacttcatctgaatcaaaccaagctcaacatggtactatgaatgcaacagtcactgaagatgccaaaaatgtgcagacagaaggattagagcagagtggcaatagagtctctgaagaaaacctgcctggttctaactcaacagtccctgttgaaacagaaaaggaagatgcagctgcaggtaaatcttctaatctagagggtggtgagttagaaaacacagcaaaattcgtggcatcaaatgaaactgagaacaacagtgacactgaaatgagtgaaacaaacaagaatcggaatatttcatatgtgaaggagaacactgatgttactaagaatgagttcaagg

SEQ ID NO: 2972 - DNA, 348 bp, Glycine max
  Peptide Sequence Number=SeqID_119750
atggtggctatgaatgaggaaatggattcctttcagaaaaatcaaacttgggatttggttgagttacttgaaggcaaaagagttgttggatgcaaatgggtcttcaagaagaaatttgggttatcaagcgctgaagtcatcaagtataaagcgtgtcttgtagttaaaggctacagtcaaaaggaaggtatggactataatgagcttttctctccaatcatcagacacacgtccattcgtgttttagtagctcttgttgcaactatggacatggagctagagcaacttgatgtgaaaacaacatttctccatggaaagttgaaggaagaaatcttgatgaaacaataa

SEQ ID NO: 2973 - DNA, 879 bp, Glycine max
  Peptide Sequence Number=SeqID_119751
atgcccttggggggtaggattgcatcatcaaatatcaaccattttgtttttgttccatctgagtcttcaagattcaatctagaagatggtcaacacaatcaatatcgagaaattcagaggaagaacaacttcaacctttggtgcatcaagatgcatgccttgttgaaagaagaagggaactgtgaacctctttatggacacaagttggagaaatcaatgcaacaagttgctactgaaatgatgtacatttggccttcgtatgaaggaagtgttggaaatgattgcatcacacttgaggaagtcaagtctagtctctattcaagagaacttcaacacaaagcttttggaaatggtgatgaagtctttgcctctgaattatcagtaaccagttctgcaaaagggcagaaaaagaagaaagaccaagaattcaagaagggcaaatttgatccaaagggtatctataagtactgcaaaaaacctgaccattggaagaaaaattgtcctaagaaaatcaagaaagattatgttgcagtcgttgttcaaagttattcttatcatatgagcccacatcaaaactggttcgtgacttatgagaagaaatctggtggtaatgttttggtgggtaacaatgctccttgtaagacagttggcatgggtactatacaagtcagaatgcatgatggaatttttagaaccttaaccattgtttgtcatattccaaagcttaagaagaatataatctctatgggagccatggattcaaaaggttttacctattgtgttgaaggtggagttatgaaaatcaaagggaaagacaagtttattgtaatgcagggaattgagcaaggaatatgtatatcattcaaggttcaacagtga

SEQ ID NO: 2974 - DNA, 327 bp, Glycine max
  Peptide Sequence Number=SeqID_119752
ggagcactgggagcggagacgccccgttgcgttcaccacgcactgttggcacagagcagagggcacgtcacccctgcacatgaacaggccgtacaccctgtcggacggggatgttcccagtcccacggtgttgttggagaattcggtggtggtggcgttggaagacagggaagtgaggagggtcctcaggttgagttggtaggcactgttggcggtggtgttgccgccggaacagttatggtacaggatgacccaaagtcgccgaggataagttgcgtgggtggggactacgatgagggggacacttcatacggatcaacgggttga

SEQ ID NO: 2975 - DNA, 1173 bp, Glycine max
  Peptide Sequence Number=SeqID_119753
atgtgtggatcagttttagtattagcacttcttattgggttggccactgcttgcctcagacgaaagaacgatagagagagagatgaagaaataagtgaacgaacgctattacaagagttgtctacccccaagagtgtagcagtcacagaagaaggtgacttgattagttccgatgaactcttgttcatgactttagctgtcattaaggccgctactgatgacttttctgatacaaataagctgggacaaggaggctttggtgcagtctacaagggtgttctaccagatggtaatgaaatagcagttaaaagattatcgagaaagtcatggcaaggcatggaggaattgaaaaatgaggtcatattgattgccaaacttcaacacaagaatttggtgaggctgttagggtgtgccttggagggggatgaaaagctactcatatatgaattcatgtcaaacaaaagccttgatcaatttatctttgatccagaaaagcgttcaaaacttgattggaagacataccatggcattatcagtggcatagccagaggactactttatcttcacgaggagtctcgccttaaaatcattcacagagacttaaagccaaacaatgtgttgttagaccacgaactgttggccaaaatatcagattttggtatggccaggatattttctgagaatcaaaatgcagcaaacacgaaaagagttgtgggaacatatggatatatggctccagagtatgcaatggaagggttgttctctgtgaaatctgatgtcttcagctttggtgttatcatgcttgaaatcatcatcgggaaaagaaatagtggcttttacatgaccgaacttgccccgacactgctggcatatgcatggagactgtggaatgaaggaaaagaattggactttgtggatccaatgctattggaatcatgtgatgcctcggaaattgtaaggtgtgtgcacatcgggctgctgtgcgtgcaagaaaatccggaacacaggcccaccatgtcaaatgtggtggtgctcctgggaagcgaatcaatggttcttccccaaccaagacaaccaccactttctttgggtagggtgcttcgtgccgatccatcaacaacaaccaatccttcagtgaaagagatgatattttctgatattctaccgcgatga

SEQ ID NO: 2976 - DNA, 804 bp, Glycine max
  Peptide Sequence Number=SeqID_119754
atgtttggggcaaaagctgatcgatgtgatattggggtcatggtcgctatgcttttgttcatgatcttgtcactaaacggtgttgtttctggtgcagaccctattgatacctattgtcccagtgaattcccattgtacagcctcaacagttcattccataacaacctcaagcttgtgctgaggttgctttcctccgacaacgcttcaaaggcaggtttctatgacacatccataggacaaggcccagacaaagtgtacggacaatcactttgcagaggggacatctccaactccacagcttgcaaagaatgcattgagaaagcaagccgagatatcatgaataggtgcaagagtgagaatgcaatgatatggtataacctttgccaagtacgttactcctttcagagctttaaggtcgtggcttatactggaaagtatccgcagcagaataatgaggagaagaaagtatcggatcctataagatttagggaatacttgacatatttaatgagcaatctctcagacgaggctgctttcaatcctgataagaacatgtttgcagctggggaagttgactatcctgggaacaagacaatatatggcttagtccaatgtattccagactcacagtgcagtagttgtttgacttctgccttcacagaactcactgaatgctgctccgacctcgaagctgggattattcttgatcggacttgcaatatcaggttccagttgtctcagttcttcaatgcttcatctgcatatcgcttgatttatccaacttccacagagtcccgtgattga

SEQ ID NO: 2977 - DNA, 1566 bp, Glycine max
  Peptide Sequence Number=SeqID_119755
atgacggaggagcaggtggtgaatgtgcgcggcgaagaaagcgattccggcaacgatcacggcagcgtcaaagccaatggagttgctcacggtgtcggtggcgattcggatctcgccgccgacaacaacggtgccgcgtcgtcggggaaaaattgtaacgatgcagtgtctaacggtacggcagaggaaggcaccgaaacggcgacagttgacgtcgtttcgcgggaggatgaattaaaaagtgcggatagtcaaaacggcatgggatccgttcaaaacggcgtcgtggataatgatgataagagtgctaatgctgttgcagaggagttggttacggatcacgaggagtacgttgttgtcggtgattcggatgttcagaacggtgatgatgtgactgctaacggagttgaggagtgtgaaatgctggacggtgcggaggcttcaggagacgaaaacggtgtcgttgtggagggagaagaagatgtgtgtcaaagtgatcgcgagttcgaatgtgttgatgttcacgatgatgtaactgctactactgatgagaacggtggaaatggaaatgacgttcagggaagaagtgagtctgtctctgataaagatgtcaataaaagaggggaaagtgagaatgttgttagtgcagatgtttcagatgagaaggacattgtaacggatggtgatcatgatgtggaagaagtcgttgagaagaatgaggttcctgttgttgttgatggtggctcagcttctacagatgtgaaggagtgtgaacctgaagatgctcaaaacagtttagagaaggggcaggttgagtctgtctctggtttggcggagccagtgctggagccaagtgaatgcactgaggagaatgagattgctgttgaaggtgaaccaggaagtaagctggagaggtctgaggaggaagcaggaagtgaaatagttcctgaaggagaaattttaacagccttaagctgcacagatgtgtctgacattgcagtggagagtgatggtgaaccttctgttgatgtttgtgtgatgaaaagcaatgcagttgaaagtgatgttgatgtgcatgagttgaaaaatagtgcagtagatagtgaatctgaaccttcaaatggtgcagttcagagtgaaattgtgtctgagatgaaaaacaatacagaggagagggaagctgaaccttcaaatggtgcagttgattgtgaagctgaacttccaaatggtgcagtggaaagtgaagctgaaccttcaactagtgctgtcgagagtgaagctgagccttcaaatggtgtagttgagagggaaactaaaccttcaagtggtgcagttgagagggaaactgaaccttcaaatggtgcagtggagagtgtagctgagccttcaaatggtgcaattgatagtgaagctgaaccttcaaacggtactgtggagagggaagctgcaccttcaaatggtgcagttgagagggaagctgcaccttcaaatggtgtagttgagagggaagctgtaccttcgaatggtgcagtgagagtgaagttgaaccttcaaatggtgcagtga

SEQ ID NO: 2978 - DNA, 834 bp, Glycine max
  Peptide Sequence Number=SeqID_119756
atggctgtaactgtaaggagggtacttgcctttgcttcttcctcttcagccccttttttcaatctcaatcaaaatgcaaacttgcgctatattctcccttctcctcgtcatctctccgcattttcagttgattccattttgcggttgacttgcgtttcaagcttagaggatggttctgttgctgataaatttcacaagtggcataatggaggtggcactctccacgagtcagcttccattgactccacagcactcgtagaggttggcgctgtagttcattcagagtctattgttggtccaaatgttcgtataggttctggaactattgttggcccttctgttacaattgctcattcaacaaacatagggtataatgttgcacttagtaattgctgtataggtgattcatgtgtaatccacaatggagtctgcattggtcaagatggatttggattttacgtggatggtgacggtaatatgataaagaagcctcagatgttaaatgtaataatagggaacaatgtggaaattggtgctaacacctgcattgacagaggcagctggcgagatacagttattggggacaattcaaaaatagataatttagttcagattggccataatgtagtaattgggaagaattgtttgctttgtggacaagttgggattgcaggttcagcaaccataggagattatgtgactatgggaggaagggtagcaatacgagatcatgtatccatcatatcaaaggttcggcttgctgcagcaagttgtgtaaccaaggacatcaaagaacctggggactatggtggctttccagctgtaatgatttag

SEQ ID NO: 2979 - DNA, 1656 bp, Glycine max
  Peptide Sequence Number=SeqID_119757
atgtgcctcgactatattacaaatgaatcttgcaagacatgcatcacgacagcaacagaggacattgtcaaactctgtcctctagccacagaagcagttgtatgggaggagttttgtctattacgttattccaacagcaatttcattggtagtttgaatgtcacagggaacattggcttagataataaacagaatctttcagagccagagaaatttgagtctgctgtgaatcagacaataagtaatcttactaaggtagcatcttttggtgtttcggcaaacatgtatgctactggagaagtcccctttgaagatgaaacaatatatgccttagtgcagtgcaccagagatttaattgccagtgattgtagtaggtgcctgcaaagtgccattggagatataccaggttgctgctatgcctccattgggggtagagttctgagccgtagctgttatttgaggtatgaattttatgccttttatcatggtgcaacaggacccacgaattctacaactggcaaaaaagaaagcaaaaataattcaagcaaactatggatgattacaggaattatagtcgtggtaggcttggtgatagtatttgtcattttcggactgtaccttgtcgggattaaaagaaaacggcagagtaagaatggaatagacaatcatcaaatcagtcttggatctcttcgcgtggctaccaataatttttctgatttgaataagctcggacaaggtggctttggccctgtttacaaggggaaacttagagatggccaagaggttgcaatcaagaggctctcaacttgctctgaacaaggctcagaggaattcataaacgaggttcttctgataatgcaacttcaacacaaaaatcttgtaaagcttcttggattttgtgtagatggagaagagaagcttcttgtgtatgaatttttacccaatggcagtcttgatgtggtactcttcgatccaaaacaacgtgaaagactagattggactaaacgcctggatataataaatggaatagcaagggggatactttatcttcatgaagattctcgactgaaaataattcatagagacctaaaagcaagtaatgtattgttggactatgacatgaatccaaagatctcagactttggaatggcaaggatatttgcaggaagtgaaggtgaagctaacactgctacaatagttggcacatatggttatatggctccagagtatgcaatggagggattatattccataaagtctgatgtttttgggtttggtgtactattgctggagataattacagggaaacgtaacgcgggtttctatcactctaacaagactccaagccttctatcatatgcatggcatctatggaatgaaggaaaggggttggaactaattgatcccatgtcagttgattcatgccccggagatgagtttttgagatacatgcatattggattgctatgtgttcaagaagatgcatatgataggccaaccatgtcttcagttgttttgatgttgaagaacgaatcagcaacgctaggccaaccagaacgaccacctttctctcttggcagattcaatgctaatgagccagattgccaagactgctcactcaatttcttgactctgtcagatatagtgccccagtga

SEQ ID NO: 2980 - DNA, 759 bp, Glycine max
  Peptide Sequence Number=SeqID_119758
atggcggaaatccccaagttggatttgtcatcttcttgttttgacaatggagagcctttggattcggaacagaagagccagaaaatttttgtttcggatcacataaacgcatttcaatacgcagacgagaaagccgatagctttgtgattgacatggatgccttctcttccggccacaacaaagatgccaccaatgctaattcgagaattacgaggagtctttccaggaagggatctcagcgtctgggtgactggaagctgaataacaatgctacactttatgataaggataccgttcccgccatatgctctccaaaaggtacacttgttgggcctttcacgcccgaaaagccagcggggatggcagtagggcccatgggtcattccatgaacccacacgtccataatctaacagccgacaacatccccacagagagcaaatgtagtataactcggagaaatagttttagacgaccttcttcatgggccattgatcctaaaagggttctccttttctttgccaccttgtcaagcatgggaacaatgttgctgatatacttcactctgacaatcaggtttagtggaggatggatcataaatcaccttttgctatttctgatcgttgatccttatctttttgttgtgctttgctcgtacatgcaatctaaaagagagctgagggaaagaaagccaataccataccacgagaggttcctagaagctatagcagtgtttgcctatcgacgcattcttgcttaa

SEQ ID NO: 2981 - DNA, 506 bp, Glycine max
  Peptide Sequence Number=SeqID_119759
atgcctgcaatctctcccgcgtactatgcgcctaactacaataacttgctgcaccattcaccactttataatgaaattaatgcgctctctcaaatatcaaacatttttgtcaagagtctctgcatatggctcctgcaagttataggcctcttaagccttattgttctgtgcctatggctggccttacgacccaagagcccctcctactccattgtgttcatctccataggacagccctcgaactcaaatgaaaacaacaccatcttttacaaccttgatattgaaaacccaaacaaagactcgagcatttactatgacgacacaatattaagtttcttatatggggagcaagaggatgatgtgggggagacaactataggctcattccaccaaggaactggcaacacccgggatgtatccgatacaacatggggaattaagagcaagttccatgggttacacctcaaaggtattctaccaattgattctgatggggaagctctcac

SEQ ID NO: 2982 - DNA, 318 bp, Glycine max
  Peptide Sequence Number=SeqID_119760
gccattatttctcttccttcggtgagcgatcctctagctgccttggatggtattatgggggacttcacctggtggccactcgtgaaacaggtcggacctgtaggtgggattgtgcaaccgtttgttgttgctctttctgttggagaagggggtcaaactactagaaataggcttttaacatcgattattaaggactttcaacatcggttattaactaatgttgaaactaccgatgttaaaagtctcaatgttaacatcggttttccaaaaccaatgttaagtaaattacacaaaataactactctacaattaacataa

SEQ ID NO: 2983 - DNA, 735 bp, Glycine max
  Peptide Sequence Number=SeqID_119761
atgcgaatggaatttctatcacctccgacattttttcctaatttccaatggacccacaaaatctacatgacatcctacatggtacttaatggcatatgccaaccctccacatcagccatactacaggagcacaaatgcctgacccttagcagcctgactccccaacaaacaggctcccctcttgtcaaaggcacctctccaagccgatgtattaagttcgagaccgcactaaacgatgtcaaccttgacgtgtcacggttccagattttggagcaagacccggaggacatcaagaggagcaacataggaatcgggaagcagacagaagaaaaatggaagaatgaagcagacaaagatagcggcatgagcgacaacctccaccagaacaggaacccacacagcacatcaaagagacttgaggtttcacccaatactgtcaaccccgacgcaggtccactccttagctttacaggcaaaggagttgagaccagaggatacgcggacttgatgaccccctttagtcagggcaagctcactaggagcctaaccatcaaatatctattggtcgacacagacacattatactttgccttaatggagagaaagacactcaacgagcttggaggaatagtctctactccccacctgacaatgacattccttgcattgacatgggaaattgtaactgtcaagactgaccaaaagcaagcacgtagtgctatgcaaagagcctaa

SEQ ID NO: 2984 - DNA, 588 bp, Glycine max
  Peptide Sequence Number=SeqID_119762
atgaggattcacttcttttatatttatattgtgtcctgtgagactaacactaaggatgaagagaaaggaaacgacggctcctgtgagactgagaaaggaagaaagagtttaaatggcagttcaagaaggagaacaaaaattgtgagagtgacaatgagattgcagcacgatgcgattgagggcgacagtgatgttgcagcatcacaagaggttgcattgctggtggtcatcgccaatgctccttcctctattttgacaaaaaggaagaggaatgatgctattgggtcatctagatgcaagaagtcaaaggttcctataagtctttgtgccctgaggcagtgtgtagggttgatgcccattgcgggttgcctttcgactgcacaagatgtgtctctggctccaccggtcattgaggctcctactgctgctactagtacacctactactcttggtccttcacctcctcgcgctgtcgttgttcaggaggatactcttgttgtgccagctactcaggctgactctgctatggcactgtcgtccatcatcacccaccatcgcgacacctttattaagtgttggagtgggtaa

SEQ ID NO: 2985 - DNA, 186 bp, Glycine max
  Peptide Sequence Number=SeqID_119763
atgggtgtcaagtacctcgaagtggtcaagcgagggtcgcatcccaacaaacagatgggtttccaagcgttagagagagaaggagaagagactgaagccttcattccactatctgcgtgcaatgagtatttctccctcccaagacatcattttacaaatcccaacggtgaagatatgctggaatga

SEQ ID NO: 2986 - DNA, 657 bp, Glycine max
  Peptide Sequence Number=SeqID_119764
atggtttccatcacgctcggtgttgcagttgcgacttacaatgaagccaaattcgatgcatgggtttttaagctgatactaaatgtagttggaagtatattttggaagatatatactaattctccttttcaatgtacttgcaggcttgagagcacattaaactatggtcttgaaagagtctgggctattggatacttgaagagttctcatcgggttgtgattggctatgatggaggaaaaattatggtcaaacttggtcaagaagtacctgtggctagcatggacaacaatgggaaaaaattttggtctaagcataatgaaattcagactctagctaggcagacacccaatttaattgagacatccagagataatgaaattcagactgtcaatataaaaagtgtaggagcagatgtagaggttgccgacgaagaaatgttacctttagttattaaggagtcgggcacctgtgatctctacccccaagaatattcagcctctgtctcccgtagcccattccctgttgggattatattgtttggaaggatacgtaggagcaagggtgtgttggatcttgatttggctcttcaagttggaaaaactgctactattactgatgctagtagcaatgaagagaaaacccattataagacctga

SEQ ID NO: 2987 - DNA, 346 bp, Glycine max
  Peptide Sequence Number=SeqID_119765
tgaaatgacttcaagtcaaagtttggtgaaatctgattacgaaggaggtgatccaccacaaatggacgagacgaatatgaagaggagggcattgaaccgtgaatatgcaagacaatcgcggttgagaaagcataagcgattggaggatttgaccaacgaagtcaacatgttgcaaagtgcaaacaagaagttggtagagagcatcaaggctaaggaggaagcatatgctgagacagaagttgataacaacatcttgagagcgcaaaccgtggaattgactgatcgattgcgctttttgcactctatcattcaggttgcggaaaaggccaaagggttatctgttaat

SEQ ID NO: 2988 - DNA, 336 bp, Glycine max
  Peptide Sequence Number=SeqID_119766
atggcggtggagatgacgacacctgatcgtccacccttcttctttatgtgcaggagttcttttgaggttctgggtgtcattctacccttgaccacttttcaatgggctttgttggagcacttgaatgtggccccttcccagctttacccgaacaggttggtgatggccattatttctcttccttcggtgagcgatcctctagctgccttggatggtattatgggggacttcacctggtggccactcgtgaaacaggtcggacctgtaggtgggactgtgcaaccgtttgttgttgctctttctgttggagaagggggtcaaactactagaaaatag

SEQ ID NO: 2989 - DNA, 201 bp, Glycine max
  Peptide Sequence Number=SeqID_119767
atggggctccgaaaaaaaactggagaatggagaattggcgaacagcgctacgcaataacttcgcggggctctagactcgaaggtggaggacacatgaacagcgctagtggagaatggagaattggggaacagcgctacgcaataacttcgcggggatccagactcgaaggtggaggatgcatgaacagcgctaggcaataa

SEQ ID NO: 2990 - DNA, 104 bp, Glycine max
  Peptide Sequence Number=SeqID_119768
atggctaccgaccgcttcggaagagacccgcccctgattgccggcgttgctgccgtgatagtggtgcgaatcggtattgaggatctcgcgatagtcgccggcgc

SEQ ID NO: 2991 - DNA, 399 bp, Glycine max
  Peptide Sequence Number=SeqID_119769
atgagcacatgggaagaactggatgacacattgttcggcgaggagacaaaaaaggaagaaaaagtcaacctctgcctgatggtagacactgcatcagaagaatcagactctgaattagatgaagagtatgagctctccaaaaactacctcaagatgttgttatacttcatcaagaaattgaatttcagagaaactctatccaaatttgttggatgcaatgagaaacttaacaaaatgttaagatatagcaaatgcctaactaacaaatttggaaatgaatataaaggaaagaagtatgtccatgattgtcgcaacctacccttcagcgggagggcgacgctagggctcacgggtgcgtcttccaagagaggaagatgtaacatcccactttttccataa

SEQ ID NO: 2992 - DNA, 297 bp, Glycine max
  Peptide Sequence Number=SeqID_119770
atggaagaaggatatttcacaaacaagccaccactattcagaggcgttaaatacgactacttgaaggaacgtaaaatgcaacaagctcagcttgttgacacaactttatccagaaagtggagaccatatttgacaacattgagaattgtaaagaacctgaattccatgtccattgaagaattgattgaaaccttaaaggttcatgagcaggaacttcaacaagatgaaggatttaaaaagggaaaatccttggctctaatagaccaaaaagccaaagtctcttcaacatgcaaataa

SEQ ID NO: 2993 - DNA, 135 bp, Glycine max
  Peptide Sequence Number=SeqID_119771
atggcagttcttggtaggtgtgggcacaacgtcgatggtggctgccatttgccatatgtcgatgatggaaaccagcgaatgatggtcttgcttgatgggtatgatggaggttgcaaaagggaggaaagacaatga

SEQ ID NO: 2994 - DNA, 456 bp, Glycine max
  Peptide Sequence Number=SeqID_119772
atggcggttccaaagttagaaaagatgcaaagacaagatgaaactaacaagaaacaagcggttcctctcggtgtggagaacaacgatggtttgtggtggctaatggttgctgtgggtgatggagaaagttcttggaactttagaaatggctttggaagaaagaaagaagaagaaatgacacatcttctcaaagatcccaacggtaagatcatggacaattgtcttgcttcctccagaagcttcattaagaggcttctaacacactccaaacatcttctcaaagatcccaacggtcagattatggacacgtgtcttgtgaagttgaagaccaaatttcgagaagatccaacagttaacgaaggctgggcagcgcttttaccgaggcagcttcatgtagctttctctagaagcttcattaagaggcttcctccagaagcttcctcgtggcttctttga

SEQ ID NO: 2995 - DNA, 1173 bp, Glycine max
  Peptide Sequence Number=SeqID_119773
atggacgatattgatgcaatcctccctaggaagggaccaatcactagaaccatgagcaagaggctccaagaagattgggctagagctgctaaagaaggccctagggttctcatgaaccttagggtcatactattaagcgacactattgctaaggcaacaaggtgtttgcgtgagggcaacacttacctagaaggatgggaaaggaactataactcccacatcaccagagctctttatcggtacaatgctgacaaggctagtgataagaagaccattgtctataactttatgtgtgggaaggaaaaaatatgggacaacattctgaacaataacatctactatgtagccctcatcaacaagcttttatgggatcaaggagtctactatgtgttcaacaagatggatgaggattccaagcacatcctaatagttaatggtttagtggttgctaaacaacaaaagtttagcaagaataacctaaaggctatgaaggtgtccttggaacaaagcttgaaggaaactccaaaagtgggcgtgaaagccataaacaagagaaaacaaaaagaggcaaagaagcataggaccaaaagaaggcatgagtctattacgttcgctcttacttgtccacccaccgtgaacccaatcgcacaaaggttgaaagacctgagtgagactgatgatgatgatgatgatgaagggctggtgagagtggctctccaaaagatgaaagttgttgctcctgatgcacctactcccaagaaagcaaagaaggctcagcctatagctaagccaaaaacatttgttctcacctctgccatcccatgctggatcaatacaagggcaaccaaggccaatccaaagattggtgacaaagaatgggcaatttcctttacaagaaacaaggaagatccagccttatcctcgtcagatggtgagtccattgatggcactccaatcacacccctccgcaagtttgcacctaccccacaacagtgtccatctccttctcctttacacctggataggtttaaaagggcaactccaagggttccattgagtgatgctcaatgtttcctcttggtcttcagtcatgttcgagaagaaggtgcacgtgtggaagccaattacaagactgctgctagtgcatcctacggacatccaactcttacttga

SEQ ID NO: 2996 - DNA, 255 bp, Glycine max
  Peptide Sequence Number=SeqID_119774
atggtttcttcatcattgtcatacccaaatttcatccagggaccattgtttgcgaggatgcagacctcatttgaccacttccgaacacttgagacctgcccccatggaatccgtgaagttccaaggcattctggaaaaggaacggaaccgttgttgattactccggaacacttaacactcatcatcgtgcaatccgtaaagtttcgggaggttatggaaagaaatcagcagaaaagcacaaaggggtgtatttag

SEQ ID NO: 2997 - DNA, 465 bp, Glycine max
  Peptide Sequence Number=SeqID_119775
atgatgcaaggaccttttggagttagatcatatggatggattcttaaaaagcctccacctctggctatgatggaagtgaaactgctatgcaccgcgatgttgttcaagtgttatgacctgctaggaagtatcactttgatgacacttgtgtctactttactagagatgatgaaaactacttcttcatccaacctctataaggctcaacaaaagaagagagctaaagatgttgttgttgatgctactgttgtaattgatgagcaagaagctgctactactgctgagaaagttcaagctggagcatctactaaagctgcggacaacaccaatgtgtgtggggtcatcattgaccttacaaacactagtgtcatggatgagactggtgaagcgtccaatgtagatgaagttgaaccactcattccagatcttgcatccaagctgttagagatagggggagaaacatga

SEQ ID NO: 2998 - DNA, 474 bp, Glycine max
  Peptide Sequence Number=SeqID_119776
atggaaaggacaaaaacccaacatttcatatttccatccttttggatgtgctctaaaacatccaaggcatatagagtttacaagtctagaaccttagttgaggaagaagctattcatacaagagtatctcttagacaacatggctacacaactctcatttcagaagtagaacccaagcatattgacgatgctatggaagatgagaattggctcatagaaaatgagactatatcaaatgaacataaaagtgcattcctaaatggagtaatacaagaagaagtctatgtagaacaaccccctgggtttgagagtaacacttttccacaccatgttttcaaactccataaagcaatgtatgaacttaagcaagctcctagagcttggtatcaacatcttagttcattccttgtaaacaatgactttgaaagtagaaaagtggatacaactttgttctgcaagtgctataactcctaa

SEQ ID NO: 2999 - DNA, 198 bp, Glycine max
  Peptide Sequence Number=SeqID_119777
atgtttgcttacagtcctttcgctaagcgcaagcctcgcgctgagcgcatcttttgttatgcgctaagcggagagtctctggcacttagcactcaacccttgcatctcaagctgacttggtccactaagctgaccaaggctgagctaagcccatttcaattggatctgaattgggctaagcgacggcttgctcactaa

SEQ ID NO: 3000 - DNA, 282 bp, Glycine max
  Peptide Sequence Number=SeqID_119778
atggcatatgggaccagagccgcatattcgatgaatggaggcagtggatctctagcttcgtctccatgtggatccaagcaatggaaacttggatatgtaggcttcttggtctacactggtggtggactggatggatgtggagtgggagttggagttgcctcactatcagacgaacaagagacaatgaaggatgggatcttaatgggttcctttagggttaaggacttgcatctaggtcttatctttctcttctttggaaaagaggatgtgataattggttga

SEQ ID NO: 3001 - DNA, 393 bp, Glycine max
  Peptide Sequence Number=SeqID_119779
atgtcaaactccaatgaaaacactgctcctaccataaccatcatcaccatagacaccactaccattcacactgatggagaacctactgttcatattgaacaattcttcgacatcaattccattcgaccttccacacactgtccacatcaacatactaaggaacatgaaggccttgggaggagtggaagatatctactctgccaccctcatcaacaaactcctctaggaacactagtaaatcaagatgaaatcctacaaaggaggcagaagaaactggccaagactgttgctagtgaagataagcctttgaagacctttgaacttgataaaaaggttcaaagggtccttagagagcaacagggaaaggtccaaactaggaagcaagcccaataa

SEQ ID NO: 3002 - DNA, 228 bp, Glycine max
  Peptide Sequence Number=SeqID_119780
atggagcttgacagagcttgcccaagattgcctatctgtgatgaagggaagaagaagggtttcaagctctacttcaatgaagacatgccgagtcaaaggctcatcaggaagctagatgctaatgatgttaggacctcatggaatcagacagtgtggtatgacaccaaaggagccagctcctccaactctacgcatgtgcctgctttccaacaaaggaattccatttag

SEQ ID NO: 3003 - DNA, 207 bp, Glycine max
  Peptide Sequence Number=SeqID_119781
atgggaccagtcaccagagccatgagaaaaaggctccaagataattgggctagagctggtaaagaaggtcctagggttctcatgaacctcaggcccccctctaccttctcaaagaagctttcttccttgcttcccaaggaagctaccttccctacttctcaaggaagcttcccattgtattttctgttggacaagtggcctcaataa

SEQ ID NO: 3004 - DNA, 501 bp, Glycine max
  Peptide Sequence Number=SeqID_119782
atggtgccagaggatatggaaaagactaccttcgtcaccctgtgggggacattctgttataaagtgatgtcctttggactcaagaatgccagggcaacctatcaacgggctatggtggctttgttccatgacatgatgcaccgagaaatcgaggtctatgtagatgacatgatcgccaagtctaaaaccgaggaggaacaccttgtcaacttgcggaagttgttcgaaaggcttaggaagtatcggttgaggttgaaccccgctaagtgcaccttcgaggtcaagtcgggaaaattactgggtttcatcgtaaggcagaaagggatagaggtggacctcgaaaaggtgaaagccgtccttgaaatgccagaaccacgtaccgagaagcaggttcaaggtttcctggggagtttgaactacattgccagattcatatcacagctcaccgctatctgtgagccgttgttcaaactcttacacaagaaccaatccatccgctga

SEQ ID NO: 3005 - DNA, 933 bp, Glycine max
  Peptide Sequence Number=SeqID_119783
atgaaaaaggaaaaacaaaaaaattccaattattatttcccaagcggagctctagatcaagatcctcatcatggtggtgacggccatgcccttgatgggacgaagagtcgtttgagggtggtcgaggatgttgatgaagagaaggagaaggaagaaaaaaagaaaaagaagattaaggaagtgtcacatgaatgctccttggtgaacaagcacaagcccatttggatgagaaagcctgaggagatgacaaaggaggagtattctgccataatgaacagcagttcaatcagtttaataaggagtatgacaaaggaggagtattctgccaagggtagcagtgtcttgaattcgtggaaaatgaggattagaattgctttggatgcctctcgaggaatacaatatcttcataattatgcagattcatttattattcacggagatatcaagtcttccaacattcttcttgatgccagctggacggcaagagtatctgattttggatggaagtttatgagaaacaaacaacgtataattgagaacactgatcctgagtacgttattcgaggtgcattgtcagcagagagtgatgtgcatgggcttggagttgtactgtttgaacttctaacaggaaagagacctacattcgtgtacggggaagatggaggcaccctattaagtagaaaacatttggtagactttgctgtgactgctatttcaaatggatttttggagaaatttttggatcaaagggctggacaacccgatgtgaatgaagcagaagcagtaaagttagtggctgataccgctatccgttgtgtgaatttgaaactgaaagatagaccaaccatggctgacattgtagtcagattagagcgggctttggctatttgtgattatgatagcattttcagggctttggtttcgaattgttaa

SEQ ID NO: 3006 - DNA, 129 bp, Glycine max
  Peptide Sequence Number=SeqID_119784
atggccgaccaacaggcaaccaaatccaaagccaaaggtaagcaaagtactaggacgcacctagttgctcatgatcctggggatttaaataaaacaagcgcaagctcggaaggtagcaagataccttag

SEQ ID NO: 3007 - DNA, 1841 bp, Glycine max
  Peptide Sequence Number=SeqID_119785
atgccgagaaaaggaatgagaagcattttcttcaaaccatcaacttccacctcatcgctaccaccacctccttcccgtcaacgcactttctcagactccttaatggacgaaaacatagaaaccgcagagaagctaataaccaaatgggacgattccaaagtcccgacgacaaccgcgcttttcagcggcacccgccaggaagccaaacaatacctaaacgcggtgaagggactacagtccgctatgcagtacctcgtcgcacaggattccacctccagcaccctcgtgcgcgcgcagctcctcatgcaactcgccatgaagacgctccagaaagagttctaccagattctatcctccaacagggaacacttggaccccgaaaccgtcaccacgcgctcctccgtcgacctccgcagcgtctccgattacgtctccgattacgacgacgaaatctcaatcaccgaggacgagttccgcgtctccgagaccgagcgagtttccatgctcgccatggaggatttgaaagccatagccgaatccatgatttcctccggctacggcaaggagtgcgtcaaggtttacatcatcatgagaaaatcgatcgtcgacgaagcgctgtaccatctcggagtggaaaaattgagcctctctcaggttcagaaactggattgggaggttctcgagttgaagatcaagagctggttacaggtagttaaagtcgccgtcggaactctgttccacggcgaaaggatcctctgcgatcacgtcttcgcctcggattcggggaagagaatcgcggaatcatgtttcgcggaaataaccaaagatggcgccgtatcgctgtttggattcccggaaatggtggcgaaatgcaagaaaacgccggagaaaatgttcaggattttggatttgtatgaagcgatctccgattacttgcctcagatcgaatccatattctccttcgagtcaacgtctaacattcgctcacaggccgttacgtcgatggtgaaactcggcgacgccgttagaacgatgctaacggacttggaaaccgcgattcagaaggagtcctcgaagaaaccagtccctggcggtggagtccaccctctcacgcgctacgtgatgaactacctcactttcctcgccgattacagcggcgtgctggtcgatataatcgccgatttgccgcaatccccgttgccggagtcttactaccgcagcccgatgcgcgaggaaaacccgccggcttcggagctatcggagcgaatcgcgtggatcatactcgtggtgctctgcaagctcgacggcaaagcggaactctacaaggacgtggcgcattcttacctgttcctcgcgaataacatgcaatacgtcgtcgtaaaggtgcgcaagtcgaacctagggtttcttctcggcgaggagtggttggacaagcataagttgaaggttagagagtacgcgtccaagtacgagcgagtcgggtggagcgcggtgttttctgcgttgccggaaaatcccgcggcggagttgacggcggagcaggccagggcgtgcttcgtgaggttcgacgctgcgtttcatgaagcgtgtagaaaacaggcctcgtggttcgtatccgacccgaaatttcgtgatgaaatcaaagggtcgatagcttcgaagctggtgcaaaagtacagcgagttctacgagaagaatcgggtcgggtcggaatccgttaggggttttttacccgacgatatagggaaatacctgtctaacattttgtgtaatggagattcgggcagtgtctcgtcacactcttcgtcaacgacgtcgtcttcccatcgctctaatcgacg

SEQ ID NO: 3008 - DNA, 261 bp, Glycine max
  Peptide Sequence Number=SeqID_119786
atgatgatttggaaacaacgtgcaaaattagtcatggctacagctaggtgggtactcaagcatccaatttatggcattgtgatactaaggcttgggatttacacaaaatacaaatctggggatcccacggtcatgtggctccgcatgccaccagactcttgggtcacggtaacaaaaggtggggtggtctacaaaagcagggcttttgctcctacgtatcctcaatttgtgatgaggaactcagacctacgtagttcttga

SEQ ID NO: 3009 - DNA, 112 bp, Glycine max
  Peptide Sequence Number=SeqID_119787
atggtggcgctgccgatgacgcaggacacgattgtggtggacttgaaaatgaaggttgttaagccaagggagcctctcaggatgatcacaatggccaaggctgttgcctccg

SEQ ID NO: 3010 - DNA, 1302 bp, Glycine max
  Peptide Sequence Number=SeqID_119788
atgccaactgtgtggttctctttgaagaggtctctacactgcaaatcagagccatcagatgttcatgaccccaaaacaaggaagcagttaaccacaatctttaccaaaaagggaggagggtcaagtaggtcaggttgttcaaggtccatagcaaatctcaaagatgtaatccatggtagcaagaggcatctagagaagccaccaagttgcagcccaagatccataggtagcagtgagtttctcaacccaataactcatgaagtgatcctaagcaactcaaggtgtgagctgaaaatcactggctatggaggtttccaagaaggaggggttggaagtgatggtggaggtggtggtgccaataatgggggtgtcaataatagtagtgatttgagtacctttgttggcactttaaggcctggcactcctggccctggagggcaccctacaatgcactacttcaacccttcttttaggacttcatccactcctccaaggaaatctcctttcctttcatcagataaagaagggtcaggtttgcatggtgttggagttcttggacctcattctagcacaagggtacctcttgagacagattcaaatgtgtcttccactgtcacttgccacaaatgtggagagcaattcaacaaatgggaagctgctgaagctcatcatctctccaagcatgctgttactgaacttgtggaaggtgattcatcaaggaaaatagtggagataatatgcaggactagctggttgaagtctgagaaccaatgcggtagaattgagagagttttgaaagtgcataacatgcaaaagacactggctaggtttgaggagtatagagagttggtgaaaatcaaagctagtaaactccccaagaaacatccaaggtgccttgctgatggcaatgagcttttgaggttctatggaaccactgttgcatgctctcttggtctcagtggctcttccagcttgtgtttatctgaaaagtgttgtgtttgtagaatcatcagaaatgggttttctgccaaagaggaactcaagggtggaataggtgttttcactacttccacaagtggaagggcttttgaatgtattgaggtttttgaccatgacccttcattgagaaaagcacttatagtatgcagagtcattgctggcagggtccatagacctctggagaacattcaggaaatggcaggacaaacaggctttgattcgttggctgggaaagttggtctttattcaaatattgaggagctttatttgctcaatgctagagctcttcttccttgctttgtg

SEQ ID NO: 3011 - DNA, 345 bp, Glycine max
  Peptide Sequence Number=SeqID_119789
atggacgtgcaggaatcacaggccaatccaatggtaagcacgagattgggcccgagagagaaaaagttagcccagcccacaaatcgtagctcgtggcgccaacgtccgctgacagcagctaccggtcaaagtcagagacccagccgagacaagcagcaattggcagagcaacaacaacaacaacacacatttcttcataaaccccaagcagagtcagaatcagagggagagattagggcttccattgaacccgcttctccagctccggcagcagcggctatgccggcgaaggaggaggcaacaccagcgccaccagcggctctcaattcgaaatcgagcatgtag

SEQ ID NO: 3012 - DNA, 210 bp, Glycine max
  Peptide Sequence Number=SeqID_119790
atggaaaaattcgacaagagaaatttcaaagaaaagaaagaaaagaaagaaaagaaagcaagcatcacttgggaagataatgacatggattcttcaagtgattcagaaaatgaaatcataaatctgggtctcatggcaaaagactatgaaagcggcgaagagatgcattcaatgacttgcataaagaatctgtcaaacttgccaaattag

SEQ ID NO: 3013 - DNA, 258 bp, Glycine max
  Peptide Sequence Number=SeqID_119791
atggcacgaaggaagcgtagctggtgcactctcggactgagattttataatggaagaagctatactcaggagcaacccgccagccatgttggcgatccatgggcaaggcaaatcgccattaccattggcgatttggccttgactgacgtgctctgtgctctgtccttcatgactgccatggcaggctactcagctgttggaactcgccagtttgattggcggttcccaatggcttctgcaaatcgccattacagctag

SEQ ID NO: 3014 - DNA, 168 bp, Glycine max
  Peptide Sequence Number=SeqID_119792
atgaaatgggaaatgtttgttgacgtcgaaggaggagtaagaactgaggctttcacacgtggaaagggtgcgatctttgttccaacgcacatccttgttgccttccatggtgcaaacacctatgctttgtccttgttaccttccacgaataagcaaaactatcagtga

SEQ ID NO: 3015 - DNA, 276 bp, Glycine max
  Peptide Sequence Number=SeqID_119793
ggatcgcgcccacaagacacccagtggacccggaaaagtccaacagggccctggggttccagctctgattacggccctctgtcagttctacggagtgcctgtcgccccaacaaggtcattaggccccgcattaaccgggctttcatcaagaagtactgcgcccccagacgggcgcagggcgaaacaccacaacagcctagggatggctggcagcgggcaacaaacgcaccgccaccacctctagagttcatctcaactcatccacaaaaaggttag

SEQ ID NO: 3016 - DNA, 318 bp, Glycine max
  Peptide Sequence Number=SeqID_119794
atggttttgttcgtcctccatcgctcatccctcattctgcctcaacaaaaaacatttgccaaggttgttcaacacgcctgcaccataccccttagtcaattgcttgttctttgtttaaaagggaatgcattgtccatcactattcctgaagaagaatgcaaagtggattttcattcgaatgatgtgtgccaatcaaatgctcaatgtcgggtaaggatttacaatctcccacaagaatattggagagaaaacattctctttgctatcgcgagaggagtgggtgttccccttgctctaaatgaagccaccaacaattaa

SEQ ID NO: 3017 - DNA, 540 bp, Glycine max
  Peptide Sequence Number=SeqID_119795
atgaactgggatcatcaatgttataccctgtttcctcaggggattttgatttatttgatcaactttgtgcttctcattagtcgccaagggaaggtgagattgacaaaatggtactcaccttattctcagaaagaaaggagtaaggtaatccgtgagctcagtggaatgattctttcccgtgcgcccaagcaatgtaattttgtggaatggcgaggacataaagttgtttataaaaggtatgctagtctctatttctgcatgtgcattgatcaagatgacaatgaattagaagtccttgaaatgattcatcattttgtggagattcttgaccggtattttggcagtgtctgtgaactggacttaatattcaactttcacaaggcctactatatactagatgaaattctaattgccggtgagcttcaagagtccagcaagaaaacagttgcccgattgatagcagcacaggattcgttggtggagaatgcaaaggaagaagccagttcgtttagtaatataattgcacaagccactaagtga

SEQ ID NO: 3018 - DNA, 417 bp, Glycine max
  Peptide Sequence Number=SeqID_119796
atggcaacacatggtgtgactccaacccaaacaactaggtttatggcaatgtttggcgtgacccctacccaaccaactgagtctatggcagtgcctagtgtgacccatatccaacctattgatcagtctatagaaatgtttgcccatgtgaccactagccaaccaactgtgtctatggaaatgccttgtgtgacacatatccaaccaatcgagtccatggaaatgcatgatgtgaccccaatccaaccaactaggtctacgaccatgcctggtatgacctctacccaacaaaatttaactatcacaatgtctgatgaggcacctccttcctttgagtttatgaagcagaggttggagatgatggcatcaaccatggagacttcaggacatacattttctcctcaaatgagagcctaa

SEQ ID NO: 3019 - DNA, 477 bp, Glycine max
  Peptide Sequence Number=SeqID_119797
atgatgaaggagtttgagatgagtgatctggggctcttgtgctactttcttgggattgaattcaaaacaatagataatggagtaccaatctcttggtgttcgaagaaggaatctatagtggctctatcctcatgtgaagctgagtatattacagcttcaatgagtgcttgtcaagatgtatggcttaacacattgatgcaagaaatcaaggtaaagaactcaagagaagtcaagttgtttgtggataacaaatcagcaataaacttagctaaacatcttgttgcacatggaaggagcaaacacatagaaacacggtttcactttctgagagatcaagtgaataaaggaaaattgatcttggagtactgcaagacagaactacaagttgcaaagatttttactaaggccttgaagggagaaaagttcagagatctaagagatgtgttaggagttatctctttgagtcattcaaattag

SEQ ID NO: 3020 - DNA, 621 bp, Glycine max
  Peptide Sequence Number=SeqID_119798
atgggtggacgcagccatagtttgtttggaggaacagaagaggaaaggaaaaggaaattggcaggatccggaaaacatgctgatacgagtgcgtcaggaagttctttcccttctccctcgtctccctctctccttcttcctcaccctcctccttcgctgacgccaagagccgccgcaaccaccgctccacaagcctatttttcgcgacgcaaccaccctctccctcaccacaccgtctctgccgcgttctccaccaaatccttctgcaatgagattctcatcctctcctccatcaaccacgcgaaacacgtgaaactccacaaatactgtagcgacccaaccttcttactccaaggcctcgtcgatggtgtcgttgtccggcgagaggacgaaggtgaggtcgccacagatggaggaggggttgaggaggttcgtgcggcggaggaggccgaagaagagcgccatgacagtgtccgtgatctcctcggtgcccgagcgatgggtgacatgggggaggtaggcaaaggagtggaggagcacgacggcggcagtctcgatcttgtcattggagaggcgaatgagggattcgaatttgagggaacagtcctcaacacagtttag

SEQ ID NO: 3021 - DNA, 187 bp, Glycine max
  Peptide Sequence Number=SeqID_119799
atggtgagaagcatcatccaatgctgcctatatattctaaatagaagcccaactaagaggttaagtggaaaaacactagaagatgcatgggcaggcaccaaaccagatgtgactcgctttaaagtgtttagctctatatgctttagacatgtgcctggtcaattaaggaggaagttggataacaaag

SEQ ID NO: 3022 - DNA, 676 bp, Glycine max
  Peptide Sequence Number=SeqID_119800
tgggaaaaagaagttcaataagaggaagattcagtgctactacaactataataaatggggacactttgcagatgagtgtagaagtggcaaaggaggtaagggaaaattaaatgatgaagcaaatcttgctcatgatgatgggtcaaattctgatccagtgttgttgatggtcaccacaagtagcgagtatgagtgttcacgtactaagattgataacttttcatcttggtacttggacactggttgtaccactcacatgacaggcaaaagagattggtttgtaagtctaagggctgaaggagttggtaaagtgttgatcaaatggaatgatggtaaacaatctttcatttttggtgtgctatttatgctaggaatgaagagtaatctcctaagccttggtcaattgttggagaaaaggtttgtaatgaaaatggaggataatgtgctaaaggtgtatgacaacaagaagagactgattctaaaggctcttctgtcaaagaacataacctttaaggtgggaattgatgttatggaacatgaatgtctagccacaacagttagaaaaagtgagtggctttgtcattataggtttgagcatcttaatttcaaggatctaaacctcttacatagggataatatggtgaacgagttgccacacattcaagtgccgaattaa

SEQ ID NO: 3023 - DNA, 441 bp, Glycine max
  Peptide Sequence Number=SeqID_119801
atgatgaaccaggacggcgtgcgcaacggttacgatctggatcagctaagaaaggtccgtgaagtgtgtaacgttccgttgattgcctccggcggcgccggaactatggagcacttccttgaggccttccgcgacgccaacgtcgatggcgccctcgccgcttccgtattccataaacagattattaatattggcgaattaaaaacgttcctggcagcccagggcgtggagatcaggcacgctgaatctggcgaagtgttaatgctgggatatatgaatgaggacgcgctggcgaaaacgcaagaaagcggcaaagtgaccttctactcgcgcaccaaacagcgcctgtggacaaagggtgaaacctccggcaactttcttaatgtggtcagcatcaccccggattgcgataacgataccttgttagtgttggtcaacccg

SEQ ID NO: 3024 - DNA, 1387 bp, Glycine max
  Peptide Sequence Number=SeqID_119802
tgcgctgcaaagcgccatcgacgccctgggcaatacgccgggcaccacctgggtcaaagatctgaacaagcgcaacgacgtgcagtggagcaatgtcaaagacgcttacgacagctgggattacaagagccagcacctgaacccggcggtggcggcggtgatcgccatcgcggccgcggcggtgaccgcaggcagttcactggcggccacggcggcctccagcgtttccggcgccgtgggcggcggggcggtaaccagcggtgcggtcaccgccgggatgtcttcgctggcctcccaggcggcggtggcgttggtggagaaccagggcaacctgtcgaaaaccctgcaggcgctgggtagcaatgagaacgtcaaggcgaccgccacggcgatggcgatcggtggcgcgctcaacggtttcgacagcgcgatgggctggagcaaggacgcggcgggcaaaccgctcaatccaaacaacgtcaaactgccgcagctgagcaacggcgactggagcaaggtggcgcagcgggtggccgggcaatcggtcatcagctccagcctgaataccgccatcaatggtggcagcttcaaggacaacctgaccaatgcgctgctggcgaacatcggcagccaggttcaggccgagggcgccaatctgatcggggataacggcgacgttctgggtaccgccgggaagtcagtcagccatgcggttgtggcgggcatcgccgcggaaatcgggcgcggcgatggtaaaggggctgctgccggggcgctggcggcggagctggccggcgtcgtgatgcagagcacgctgttcgaaccggccaatctcaacgaaaaggaacgccagctctaccgtctgcaggaagcgctaaacggcaatgaagtaaaagagcaaacggcacgagtgatcggggctttgaccggggcgttgacaacgcatacgccggaaggcgcctacagtgctgcggacagcgcgcagtcggtttatcgctacaacatgaccgaacatatgttgatgcagtatgcgctggataatcagaaagacattttggccgctgataaaggtgatgttgctgcggcaaaacgtgttgtggctcgccgagaagctgccgcaatagtggcgaccgtaggtggcggcggtctggtacttactgcggggggaatgacgctggtgggagctgcgccagaattggttctggcggcacgattggcgattgccggttgcaaaactaaccccgcgctttgcctgaaccaagccggtatttatgcggcggatattgtggcaccagaggcgattattggtactggtgccgtaaccaccggcagcacattgattccggggaaaaccgaagacggcgtgaggaagttgagccgacagctg

SEQ ID NO: 3025 - DNA, 759 bp, Glycine max
  Peptide Sequence Number=SeqID_119803
atggcagccaaaattggttttactgttgataaagcagaagaacttcttgaaaagcttcgcaggtcttcctgggatgctgcagtgcaaggaaataacttaggtttcgcatctttcttcctcgcagatattgaagaccttaaggaattctccaaaagtcagggagcattggaagctggtgatttgactcattgggacattacctattggagtgagaggctacctattatttctacgcatgtcaattgccaaccacatgaagaactgcgtccctttttctctctgccaaaggttatggatggactctttaaccttgcaaaatcactttttggcattgaaattgagccagctgatggtctagctccggtctggaataatgatgtcaggttcttctgtgttaaggattcttctggtagtccaattgcgtatttttattttgatccttatagtcgtcctgctgaaaaaaggcaaggtgcatggatgaatgaagtctttgctcgtagtcgtgtattatcgcgtgatggcacctcagcaagattgcctgttgctcacatggtgtgcaatcaaactcctccagtaggaaacaagccaagtctaatgacattccgtgaggttgagactgttttccatgaatttggtcatgctcttcaacatatgcttactaagcaagatgagggtctggttgctggtattagagggatagagtgggatgctgttgagttaccttctcagttcatggaaaactggtgttaccataggtaa

SEQ ID NO: 3026 - DNA, 402 bp, Glycine max
  Peptide Sequence Number=SeqID_119804
atggttaatcatctcaaggttgttaatgatagttcagagctacgctctactattgaacatgtgcagttgcttgaaattgctcttgggttatatcctgaagttgctgctcagcttctaggcttttgtttaataacatggaaggagttgcaaaagtttggggaaaatgttttggatgcaacaaagaagtttggaaagctaatcactaataagaatgaaattgaaggattacctgttattgctcttgggttggctgcacatagtgcagtatccaaggggcatgaaaatgccaccactgagaatggggaatggataattacattagatgctcctagttttattgttgttttgcaacatgctcgcaatcgttctttgcgtgaagaaatctaccgtgcatatgtatga

SEQ ID NO: 3027 - DNA, 463 bp, Glycine max
  Peptide Sequence Number=SeqID_119805
atgaaccggaagctggtttacggtgcccaactgcgcgctaacctagaccccacaaagggttttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccg

SEQ ID NO: 3028 - DNA, 324 bp, Glycine max
  Peptide Sequence Number=SeqID_119806
cttgggaggattgatggggacccggtgttgagagaaacgaggatatgggctacgtgggagtacgtgagctcagttggaggtgggcaacaggggatgagtggtacctggagatatgtcgcgggggtcaggagatatgtcgcgggggtgctattgcccaaaaccaagcttgaccaatcccgacccaacccgggcatagtcagtcagagagaacttgtgatgtacctaaacaggggtgtaatcgattaccaggcttcaaaaaggggtctggaagactatggaggcctctgtgcctttttcaggttttcatgtcctgaagctgtgtga

SEQ ID NO: 3029 - DNA, 348 bp, Glycine max
  Peptide Sequence Number=SeqID_119807
atggacttaagaggtgtttcgtccaatctaagacttggatcgtctggtgtgggtagtccaatcttaagcctggacttgtacagaaatttactagtgtttgatggaaagtactttgttgactggtgtgtaatgatgaatgtgatcttcggcttccaaggggtggaagaagtcgttaagattgggtttcgagaattagaaagaaatgaaatagaggaacaaaaggcagagtataaagaattcaagaagcttgattctaaagcacacttcctgattcatcagtatgttgatgttgcaatctttggaaaaatttccaagctacaacagcaaaacaagcctaggatattttga

SEQ ID NO: 3030 - DNA, 339 bp, Glycine max
  Peptide Sequence Number=SeqID_119808
atgttggctactggtaatcgattactatcttctggtaatcgattaccagagagtaaaactctttgtgattttgttggaggagaacattaccaggacaattattatttctattctataaataaatccgactggagacaggagtcgaccatgtacaattatcatgaaaaaggaagagctcctgatcttgaaagtgtattggcagacttcatgacatatcaatctagctctaaaggtgatggctattcaatgcaacaacaggaaactcagtttgaaaaggactatttgatggaagcttgcttgtggggcttctatggaggctggatctttgagcttcaatga

SEQ ID NO: 3031 - DNA, 225 bp, Glycine max
  Peptide Sequence Number=SeqID_119809
atggatggttcagatagaatgttgagaatgaaagttaatcaacgagctggtcatttaggaaatgcaaaccaaagttctgaaagtcatcttcctcaaacagacctctctgatcagcatactcggggacacacggaaactgtgaagcatactgtgtaccaaagatgtcgctcaacttctgccacaagaattgctaccctcaactcgcagctgagagctcatagttga

SEQ ID NO: 3032 - DNA, 273 bp, Glycine max
  Peptide Sequence Number=SeqID_119810
atggaagcgcagattagcaggtctccaggtctccgctcgactaagaagagaaagaagatcgtttatggacgtattatgccatcaaaggcaggtcgaagcaacttggtcatcagagtttccggcagtttagggagtgggggtacagacgggcatgcagaaagaattgtttcgaaaggaagtcgcgagagaaatatagtcaaagtaaacaatgatattgctgagacgggagaaagcaggaaaggatcttctttagctgaacctgagttcgattaa

SEQ ID NO: 3033 - DNA, 1833 bp, Glycine max
  Peptide Sequence Number=SeqID_119811
atgatcacgcaaataagatacagtataataactaggcttataaaatgggtaatgtgccacattaatattaacacaataagcattcctagtttaactattaatgtatctaactcctgcagggagaggagtataccagtggttagggaggcttggttgattgacagcattgaaaagcaagaaccacaacctttggaagcttatgatcttgtctctgatctttctgtggatggcaagggtatcccctgggacaaacaagatcctggggaagaggctatcgaatcactctcagcagaactcaagctttatgggaagagaggagtctataaagataccaagttgcaggaacaaggtggaaagatatttgaaagagatgggatactatacaactgtgccttctctgtttgtgaccaagggcgaggactgaatgactactgtgtcatgcaactgattgttgtcccagagaatcgtttgcatctgtactttaagaaagggagagttggggatgatccaaatgcagaggagcgattagaagagtgggacaatgtagatggtgctctgaaagagtttgtgaggctctttgaggaaataacaggaaatgagtttgaaccttgggaaagagagaagaagttccaaaagaaacctttgaagttttaccccattgacatggatgatggaattgaagttagacatggggcactaggtcttcggcagctggggatagcagcaacacactgcaaacttgagcctttggttgcaaattttatgaaggtatgcattgatggagatgggttacgactgtccggaccttccaataggaatggttacaaatcttcatctgaaaaaataaaaactgacattagaaccttatcaggtgaggacgttctcttagaattcatagacaaggtgaaatcattgaaagagactgggcccaaggctgaggctgtgtggactgattttagccaaagatggttcactctgatgcactccacaaggcctttcaattttagagattaccaagagattgcagatcacgctgctgctgcgttagagggggtgagagacataacccaggcttctcacctcataggagatatgactggctcaaccattgatgacccgttatcagagacatacaagaaattgggttgctcaatttctgccttggacaaaagttcagatgattacgagatgattgtgaaataccttgaaaaaacttatgagccggtcaaagttggtgacattgaatatggggtgtcagtggaaaacatttttgcggttcaaacaggtggttgcccttcctatgaagacattataaaactaccaaataaggttcttctatggtgtggatcacgaagctcaaacctcttgaggcacttgcaaaagggattcttgccagcaatatgctcattacctattccgggttatatgtttggcaaagctattgtctgttctgatgctgcagcagaggctgcaagatatggttttactgctgtggacaggccagaaggattcttggttttggccattgcttctctaggaaatgagattaccgagttgaaaaccccacctgaggatgcatcatctttggaggaaaagaaggttggagtgaagggaccggggaagaagaaaacagatgaatcggagcattttgtttggaaagatgatataaaagttccttgcggtaaactagttgcctcagaccatcaagatagccccctggaatacaacgagtatgctgtctacgataaaaagcgggcacgcataagctacttggtgggagtgaagtatgaagagaaggaagagaagggtgcggtgattgacacagctgaatga

SEQ ID NO: 3034 - DNA, 429 bp, Glycine max
  Peptide Sequence Number=SeqID_119812
atggctccattgccgtcactccaaaatggatggacccttgactatacgtcctcaccttcagaggactacgcgtcctcacatcagaggactacacgtcctcaccttcagaggactacgcgtcctcaccttagaggactgcacgtcctcaccttcgtagggctacatgccctcaccttcagagggctacacgccctcgccatcagaggactgcacgtcctcaccttcgtagggctacacgccctcgccatcagaggactgcacgtcctcaccttcgtagggctacacgccctcacctttagagggcttcacgccctcaccatcaaaggactgcacgtcctcaccttcgtaggactacatgccctcacctatagaggactgcacgtcctcgccttcagagggctgcactccctcaccttcagaggactgcac

SEQ ID NO: 3035 - DNA, 1245 bp, Glycine max
  Peptide Sequence Number=SeqID_119813
cgttgcaacctccaactcgtgatcaattccaatgaccctggcggagcctttcgctttcccggcatcacccatgacaactacttcttcgagtcaggccttaaggagctgatccaacacctcactaagaacaactttaaccactacgacaccccaccggcctccaagtccgttgtcaagggcttgtcagacatctctgtcattaaggagctactagcgtcagattcctcggatcaccgtggtggtcgtggcaatagtggtgatggtggtggtgtcgaaagtggggcaactccacaggtgaattggacacatgacattggacccagtgccgaaagtggaggcaacaacatcggcgaaatgggaaaacgagagaagcagaagcagaggcacgagaagggacaccgtggaagagggtctttcaactatcttcaagaggaccatgattttgatgacactccaagaccctcaccatctgaagaagaatgtgctgatgacagcaatgaggaaaaagaagaagaagaagaagaagaagaagaaggtcatgaaaaccaatctcatgatatgccttccaagttcctcctttaccaacaatctgtgcagtcacccaaaggagatataagttatttgcaaaagttctttctcatgtacgtgggtggaaggatgcccctccatcttcaagaagatttctgtggcacggcgcttcttagtacagaatggctccgcagtgattcaagaagaacagtagtaggattagatttggatcttgaggcactcaattggtgcatggaaagcaacatacctaaagttggggctgatggattttcaagaatgtctctctttcatgggaatgtcctacaacctcttcagtctaaacttgtaaaaatagatcctcagcagctggtaagtgacatttcactgtcacagaatgaagaaaatcttcagactgatgtgccagaatctgatgctccaacaggctctgttgctcaagatgacaagtatactaagagaaacataatactgcctggaagagatatcgtgtgtgcttttaactacagctgctgttgtctacataaacgagcagaactggttctgtatttcaagcatgctcgtgaggccttgtcaactaaaggtggaatttttgtgatggatttatatgggggtacgtcatcagagcacaagttgaggcttcagagaagatttcccaattttacggataatgtggatttgatccactttgacacactttaa

SEQ ID NO: 3036 - DNA, 1065 bp, Glycine max
  Peptide Sequence Number=SeqID_119814
atgaaacgctcccttcgccccctattcctgctcctcctcctcatcatcctcttcgccgccatgctcacctcccgcgacatcctgcgccatggcatcccctccatcgacctcgaatcccgcgtcccaatccgctaccttccgctgccgcagctcaacgccacgctcctccgccacgccgccgccgagatcggcgaggagagcatcagccaagagatccagaacctcctcaacttccgccactggctccacttccggagtctcctccaaaactggttccggaagcgccgattccaacccggcatcatgtccgagctgactcgctcaattaagctcccaattgatttacactacaaactacaaaccaataacaaaaacaaatactcctcttgcgccgtagttggtaacagcggaattttacttgacaaaaatcacggcagcaaaattgattcccacgaggttgttataagattgaacaacgctagggttgatagcttcgaaaccaaggtagggagaaaaaccaacatttcattcatgaaaggtaacatcttacatttgtgcgccagaaaaagagggtgtttttgccatccttacggcgacagcgttccgatagtcatatacatttgtgaagcggtgcagttaatggactacactgtgtgcaatgcttctcacaaggctccattgctggtaactgatcctaggttcgacgtgctgtgttcgaggatcgccaagtactattccatgaagaggttcgtggaggagagtggtggtgtgggggagggtttggagaagtggggtgaggctcatgaaggtggtcttttccactactactcttctgggatgcaggctgtgatgttggctttggggatttgtgatagggttagcatttttgggtttgggaaaacagattctgctaggcaccattaccatactagccagaaggaggagcttcacttgcatgattttgaggctgagtatgatttttatagggaccttgtggatggagataagcccattccctttcttgaggagagctttaaggttcctcctgttgtcttttatcagtga

SEQ ID NO: 3037 - DNA, 921 bp, Glycine max
  Peptide Sequence Number=SeqID_119815
atgtgtagatgcagctattatcgcatggcaagactgacaatcaatctcgctgcaatttacacccccgcggattacaacacacgccctttggacaccatcttcggcaacttcattgatgctattccggtgattaaatattgcactgagaacaataagcgtttgattcatttctctacgtgcgaggtttacgggaagactataggcagctttctcccagaagaatatcgacaggaccccaaatatttcatgctcaaggaagatgtcactccttgtatttttggtccggttgagaaacagagatggtcttatgcttgtgcaaagcaaatgactgacagactaatatatgctgagcacgcggagaatggcctcaagttcaccattgtgagaccttataactggattggtccaagaatggacttcattcctggtgtggatggcccaagtgatggtgttcctagagtcctagcttgcttcagtaatagtctcctgcgtggcgagcccctcaaacttgttgatggtgggagatcacagagaacctttctctacatcaaagatgcaattgatgctgttgcgttaatgattgacaaccctgagagagcaaatgggtatatcttcaatgtggggaacccagacaatgaagtatctgtgaaggaactagctgagcttatgataaaggcttatgcaaaggtgtctggtgcacctgcctctagtctatcaaccgtagatgttagtgcagaggatttctatggtaaaggctatgatgacagtgataggcgcatccctgacatgacaattatcaccaagcagcttgcttggaagccaaagacacttcttgaagaactgttagatgtaaccctccaatatcaacacaagacatattctcgtgctatcgaaagagaactttcaaaaccgtcaaattga

SEQ ID NO: 3038 - DNA, 1062 bp, Glycine max
  Peptide Sequence Number=SeqID_119816
atgaaacgctcccttcgccccctattcctactcctcctcatcatcatcctcttcgccgccatgctcacctccagcgacatcctgcgccatggcaccccctccatcgacctcgaatcgcgcgtcccaatccgccaccttccgccgccgcagatcaacgtcacgctcctccgccacgcggccgtcgagatcggcgaggagagcattagccatgagatccagaacctcctcaacttccgccactggctccacttccagaatctcctccaaaactggttccggaagcgccgattccaacccggcatcatgtccgagctgactcggtcaattaagcttccaattgattcacacaacaacaacaacaaactacaaaccaatagcaaaaacaaatactcttcctgtgccgtagttggaaacagcggaattttgttgaatagagactatggtagtgaaattgattcccatgagtttgtgataaggttgaacaatgctagggttgatcactttgagaccaaggttggaaaaaaaactagcatttcattcatgaatagtaacatcttgcatttgtgtgctagaaggggagggtgtttctgccacccttatggtgaccgtgttccgattgttacgtacatttgtcaagccatgcatttcatggactacactgtgtgcaatgcttctcacaaggctcctctgttggtgactgatcctaggtttgatgtgttgtgtgcgaggattgtgaagtactattcgttgaagaggtttgtggaggagagtgggaagggtttggagaagtggggagaggctcatgatggttctctttttcactactcttcagggatgcaggctgtgatgctggctttggggatttgtgatagggttagcatgtttgggtttgggaaatcgacttctgctaagcaccattaccacactaaccagaaggctgagcatcaattgcatgactatgaggctgagtatgcgttttatagggaccttgtggatgggaaaaggcctataccctttcttgaggataggtttaaggttcttcctgttgtcatgtatcaatga

SEQ ID NO: 3039 - DNA, 246 bp, Glycine max
  Peptide Sequence Number=SeqID_119817
atgaaccttgctggcattgcctttgtcaagaaggtgaagaagggggtgtttgctgagcattcacccatgttggatgatatcagtggggtgcccaattggaataaggtgaacagtgggttgctcaagatgtataaagctgaggtcttggagaaggtccccatcatgcagcattttcttttcgggtcgattattaagtgggcattaggttatttacttgtagttagttgtatggagtgtaggcattag

SEQ ID NO: 3040 - DNA, 288 bp, Glycine max
  Peptide Sequence Number=SeqID_119818
atggatccacaccaaagcctcagcgaagcaaaagcagcagcactccaccattatagtaaaagcttccaaggtttctcagccatgattacaccagagcaagctagtcaacttgcagaatatgaatcagtattgtccgtatttgagagcaaaatgaataaacttcacacaacacattcttgggattttcttggattagaaactatcagtaagaacaatcctaaagcactggacaccgcatccaatgtcattgttggtgaatttttgctcaggctcaatgagaactgttga

SEQ ID NO: 3041 - DNA, 648 bp, Glycine max
  Peptide Sequence Number=SeqID_119819
atgcatccttattttcctaattcagaagatccaaggtttccaacagctttgggtgttggacacaatgatcagaaagttcttgttctagcagctacaaatacaccttatgctctagaccaggcaataaggcggcgtttcgataagcgtatatacatacccctacctgatttaaaggctcgccaacacatgttcaaggcatgggcaatatacatgatgatgttcattggtcttattgtgtattgtgaacctagcaaatggccttacaatgtgcacctaggagatactccccataacttggctgaaagtgatttcgaacatttggctcgcaagacagaggggttttcaggttcagatatatctgtctgtgtgaaggatgttttatttgaacctgttcgcaaaacccaagatgccatgtttttctttaggaatcctgaggatatgtggatcccatgtggaccaaagcaacagagtgcagtacaaactacaatgcaggatcttgctgcgaaaggacttgcttctaagatcctgccaccacctatatcgagaacagattttgacaaagtacttgctagacaaagacccactgtaagcaagtctgaccttgatgttcacgagcgattcacaaaggaattcggagaggaaggataa

SEQ ID NO: 3042 - DNA, 150 bp, Glycine max
  Peptide Sequence Number=SeqID_119820
atggagaattggcgaacagcgctatgcaataacttcgcggggctcaagactcgaagtggagaatggagaattggcgaacagcgctacgcaataacttctcgaggctccagactcgaaggtggaggacacatgaacagcgctaggcaataa

SEQ ID NO: 3043 - DNA, 519 bp, Glycine max
  Peptide Sequence Number=SeqID_119821
gtaaggcatgcttgcccgttagaaggtcaccgttcatgcacagagaaaggaggcgcaaattgggaccaactcttatcaaacaaagaaggagcgtctgtcaactggttccctcgatggaaagaaggaagaaccggagttcttgtctcgttcggaggatttccgaatgttcccttgatggggacaaggggttgcatcagttacaatcccgttcttactataagacaacttggctaccctatgagaggggcagcactagaggaagtgctcgcacctgacaaagagctcagaggcagcaacaatgggcccattggtggctaccgtaagtggttgaaagcccacatgcaaggtttggattggctcccaagtctgaggaccgctaaaagggaagaagttgaggcaccggaggaagacgaagaggagaatatcgaactgagggatgtaaatgtagctaccaccaaggcattggaacaagagaccaagagggctcgtagggaagagcacggccggaacaagttctga

SEQ ID NO: 3044 - DNA, 360 bp, Glycine max
  Peptide Sequence Number=SeqID_119822
atggcctctggtaatcgattacaaagggagtgtaatcgattaccaggcttgaaaacgagatcaggaagtaaagagggcttctggcttagaaaggagactggaatgttgaaggggcctctgaggaatgggtcactggtaatcgattaccagatcgtgatggcggcgcagctaatccatgatcgagtagagatggagtgcctagagggagcctgggagaccctcgaaggcaacacgaggtgccgatttcggggcaccattcgattcacggctacttctttggtgcatccagatgaacctgcacggacgcttcagcgcacggtggagtggacagctccttggattagttttgtatatctttga

SEQ ID NO: 3045 - DNA, 186 bp, Glycine max
  Peptide Sequence Number=SeqID_119823
atggtcgatgatgttacggaggagagtagacccagtacacaggcaaacggaagagagatgaaaattgccttgctgctcaaggaaacagaaataggcaagcatgctgacaatgacaagcactggaagttcctgccaagccctgtcaaattaagcagaaagattaagaagtattctgtgaaacaataa

SEQ ID NO: 3046 - DNA, 1110 bp, Glycine max
  Peptide Sequence Number=SeqID_119824
atgagtgctcatcaaaaagaaaaacataacgcaccttcgtccaaaccaacggtttctcatccacttcacaaggtggatgatccaatgggggtgaccgatgaaaacgaaaccttgcgtgttagtaatcaatggaagcgacagaatcttcttcagctggaaataccggccagaacatcggaagagtcttcttctcaggattttgttggaataaggatgccattgacgccaagtccaactccaagtcagaaaagagtgaattttcttgtgacttctcgctctgttgatgctccaaagcctccttcttcatcatccagagccaaaccatccatgagaaacatcttaccaaaattcggcttcaggaaccgtgcaccatcgatatcgcttgatgttgaaaagggtgttactactgctgctcaagaaggttccttttctggtcatcaagagaagtcttcaatcccaagatcagtgtctctcacgaagatgtttactcctaagattaagagaacgtcttcattaccggttgaagaacttgggcgtgcaaacgtagaatctgttctgtgtggaactcttggtgcttctccattttacaagaaagagtcaataaaattccattgtgttgctttgattggaatcatggtggagattgaccaggtctatagtgttgcgtatcatggaagagagactcaggggatgatagctcgttctcgttcagtgcctgttaacaccaaagaaaaaggcataaggagactggattcggttttccgtattattccttccactcctcgcgtaattgaagtgaatgaaacaagaaaggatacagaaaatggtgatgatggtgaagatattgctgaagaggaagctgtgtgtagaatttgtttggttgatctatgtgaaggaggcgagacattaaagatggaatgcagctgcaagggtgaacttgctctggctcaccaagaatgtgctattaaatggtttagtatcaagggtaacaagacttgtgatgtgtgcaaggaggaggttcggaacctccctgtcactctcttaaggatccgaagtgttcgagctcagaatactagagcaaggtccgaacagggagatgacttcaggcaa

SEQ ID NO: 3047 - DNA, 261 bp, Glycine max
  Peptide Sequence Number=SeqID_119825
atgtcgatctcctccccaagtagctacccaattcccagacttttcaacctcgtagtccaagcttttcaggggcttagtcataacttcacctataatgcggaaaatagccaaaaaggagggcaaaagggtcatcttgggacttttttcagacccctggacccatcagaaaacttaggactgggcgagcaaggttgcttctggttggagcaacagctcgctctgacgagctgctattcaaccccctatcctcattttctataa

SEQ ID NO: 3048 - DNA, 384 bp, Glycine max
  Peptide Sequence Number=SeqID_119826
atggatccacaccaaagcctcagtgaagcaaaagcagcagcactccaccattacactaaaagcttccaaggtttctcagccatgattacaccagagcaagctagtcaacttgcagaatatgaatcagtattgtccgtatttgagagcaaaatgaataaacttcacacaacacattcttgggattttcttggattagaaactatcagtaagaacaatcctaaagcactggacaccacatccgatgtcattgttggtgttattgactctggcatctggccggaatcggaaagcttcactgattatggactaggtcctgtgcccaaaaaattcaagggagagtgtgttactggtgaaaaatttacactggccaattgcaacaagtaa

SEQ ID NO: 3049 - DNA, 1200 bp, Glycine max
  Peptide Sequence Number=SeqID_119827
atggatccaccccaaagcctcagcgaagcaaaggcagcagcactcaaccattacagtaaaagttttcaaggcttctcggccatgattacaccagagcaagctaatcaactttctgaatataactcagtagtgtctgtttttgagagcaaaatgaataaactctacacaacacattcttggaatttccttggactagagactgtctacaagagcaaccatatatcactggacactgcatctgatgtcattgttggtgtcattgattctggaatttggccagaatcggaaagcttcactgatcatggattaggtcctgtacccaaaaaattcaagggcgagtgtgttactggtgataattttacactagccaattgcaacaaagaaatagttctctctgaggagccttggctctggtttgtcattggtccattgttgcaagccagcttatttggcattgccaatggaactgctagaggtggtgccccaagtgccagactcgccatctacaaggtctgttggtttggcttctgcagtgatgctgatattctttctgccatggatgatgccatccatgatggggttgacatattatccctttcccttggccctgatcttccccatccaatttactttgatgaggcaatcagtataggagcattccattcatttcaaaagggagttcttgtttctgctggagctggaaactcatttttccagggttcttctttgaatccaataagaatggagcaatcatatggtttgatatatggaaattccgctgcagccactggagtttcagcaacaaatgcaagcttctggaagaacaacattctagatcctaccttaatcatgggtaaaactgtgatctgtacaattgagaatttcatcagtgaagacagacgagagaaggcattaacaataatgcagggtgggggtgttggaatgatacttattgatcataatgccaaagattttggttttcaatttgttgtcccaaccactctcattggtctggatgctgcagaagagcttcaagcatatataaacatagagaagaatcccactgctagaatctacccaacaataactgtacttggtaccaaacctgcaccagacgtggcaactttttcttccatggggccaaatataataacaccagacattattaaggcaagtctactcagtaggctctatgtttag

SEQ ID NO: 3050 - DNA, 1050 bp, Glycine max
  Peptide Sequence Number=SeqID_119828
atgtcacctcacctggagtttggatttttcaggaaaattattggtgctcggttctattcaaaagggtttgaagcagaagttggtcctctagagggcgttaacaagatttttttccggtcagcccgggatggtgatggacatggaacacacacagcttccacaatagcaggctccattgttgctaatgccagcttattaggtattgccaaaggaactgctagaggtggtgccccaagtgcgagacttgcaatctacaaggcctgttggtttgatttctgtggtgatgctgatattctttctgccatggatgatgccatccatgatggagttgacatactgtctctttcccttggccctgatcctccggagccaatttacttcgagaatgcaatcagtgtaggagcattccatgcattccaaaagggtgttcttgtttctgcttcagctggaaactctgtttttccacgtactgcatgcaatgttgctccttggatcctcactgttgctgctagcacaattgacagggaattcagttccaatatcttacttggtaactcaaaggtcttaaagggttcttctctgaatccaataagaatggatcattcgtatggtttgatatatggaagtgctgctgcagctgtcggagtttcagcaacaattgcaggcttctgcaagaacaatactctagatcctacattaatcaagggtaaaattgtaatctgcacaattgagaaattcagtgatgacagacgagcgaaggccatagcaataaggcaaggaggaggtgttggaatgatacttattgatcataatgccaaagatattggttttcaatttgtcatcccaagcactctcattggtcaggatgctgtagaagagcttcaagcatatataaagacagataaaaatcccactgctagaatctacccaacaataactgtagttggtaccaaacctgctccggaaatggcagctttttcttccattggaccgaacataataacaccagacattattaaggcaagtttactcagtagactatatgtttag

SEQ ID NO: 3051 - DNA, 327 bp, Glycine max
  Peptide Sequence Number=SeqID_119829
atggaagaggattataaacctatagctcatccacaaagacgcctcaatccaaccatgaaagaagtggtaagaaaggaggtagtcaagttgttagaggctggaaggatatatcctatttctgctagccagtggctaataccaaatcgtactattacgggttggagaatgtgtattgatcacaggaagctcaacaaagctaccaggaaagatcattctccattaccatttatggatcagatgctagaaagactagtagggcaacaatattattgttttcttgatgggtattcaggatataatcaaatcactgttattcctgaaggttaa

SEQ ID NO: 3052 - DNA, 567 bp, Glycine max
  Peptide Sequence Number=SeqID_119830
atgccgtggataaaagacgatgttggagttcaaggcttcccattcccgatactaaagacctttcagttaaagataatcatgtttgatggtgaaaaaacttggaatgagaatattgtcaaagttagagctctagttggcagcaaatttcagctcacctcacagggtcataacataagttggtctgctcctcgcatagggtttctaaagtgcaatattgctgctgctttccaggaggcttctaatgtaattggttctgccattggcattggcgaaacacgtgacccaggtaggggtgcagcagggtgcgcagagatgagcagagatggcagtgcagcagtgccttgcacgtttcaccattactattggcaaaaccggtgtagttttgctttcacctttttgagtggcaaaacatgtggtgcagaccctttaaatagcaagccttcgttgacgctttcttctgcgttaaaatttctaccttcatttttgaactttttctaccttgaaagccttcaagtatacgatgaattcggttataacaatcttgtatttcaatggaagagtatatga

SEQ ID NO: 3053 - DNA, 310 bp, Glycine max
  Peptide Sequence Number=SeqID_119831
tgagcgacctatcgaacatggatgtgacaggcttgaaagggatgaggacccgatcgaggttggtgtcgcggttctgctagcggctgacgaaagaagaaaggagctcgttgccaccgctgctacagttgggcttggcgatgacgatggagaggtcgtcgtcggtgaggaggagtttggagggtgtctcacggtggtggtgtgcggtgtgctgtggtgggtgacaacattactagaggatgttggaggggagggtgaagggcgacatagagcaagtggagggttgacgtgtgatactagaggaggaagatag

SEQ ID NO: 3054 - DNA, 1302 bp, Glycine max
  Peptide Sequence Number=SeqID_119832
atggcgctgtcgcgacgtgaactctttaccgggcagcgcgtcatgcctgccggcggtatcgcgttgccgtggtggcggggagagagcggctgtgacggctgtggacgctgcgtagaagcctgcgagagcggcattatccgcatcgccgctggcgaagcgccgcagctcgactttctgcagggggaatgcaccttttgcgccgcctgtgccgacgtctgcccgcagccgctgtttcagccgcgcgacactgaaccttttagccagcgcatccgcatcgacagccgctgtatcgcttttcttggcgttaactgtcgcagctgccaggagagttgtgagcagcaggcgatccgttttcgcctgatgcccaacggcatcggccagccggaaatccttccgcaacactgcaccggctgtggcgcctgtatcgcgccgtgtccggcacgtccgaccgcgatcgcggcggtgcggcaggcgctactgaactttgccgacagcgacatcgcggcggaagatgccgcacgcggcacgctggcgttaacgctgggcgcggccgacagcgccacgctgctgagcaacattgaagccacccgcaacatcccggatgtgctggcggccaatgcggcggctgctgctgcaacggctgctggtctcaccattccgaccgtgaccaaagcggccaccagcctggctgagccgattcgctgggaaaaagcgccgtgccggttttgcggcactggctgtggcgtgctggtcggcacgcagaatggccgcgtggtcgcctcgcagggcgatccgcaggcggaggttaatcgcggtctgaactgcatcaaaggctacttcctgccgaagatcatgtacggcaaagatcgtctaacccagccgctgctgcgcatgaccgatggcaaattcgataagaacggcgagtttaccccggtaagctgggatcaggcgttcgacatcatggaagcgaagtttaaggcggcgctgaaagccaacggcccggaatcggtcggcatgtttggctccggccagtggaccgtatgggaaggttacgctgcatcaaagctgatgaaagcgggcttccgcaccaacaacctcgatccgaacgcgcgccactgcatggcgtctgcggtggtgggctttatgcgcaccttcggcatggacgaaccgatgggctgctacgatgacatcgagcaggccgatgcgtttgtgctgtggggatcgaacatggccgagatgcacccgattctttggtcacgccttactgcgcgtcgtctcagcaatgagaacgtcaaagtggcg

SEQ ID NO: 3055 - DNA, 878 bp, Glycine max
  Peptide Sequence Number=SeqID_119833
cgccattcagcgcatgatcgacaacgcgcgtgccggcggcacgtttgtcattctgaatccggcaccgtggcagaaagtcagcgatgcgctgctggctaaggtggatctgttaacgcccaacagcaccgaagcgatgcagctgagcgggataaaagtgaccgattttgccagcgcgcagcgcgccgccgaagtgctgcaccgtaagggcgcgcgtcaggtgattattacgcttggcaccgcgggcgccctgctctccagcgcggagcagcagctgcgtattccgctgtttcctgcccagccgctcgacaccaccggtgccggcgatgccttcaacggcgcactggcggcgcgcctggcgtccggcgatgcgttaccgcaggcggcgctgtttgcggcggcgtttgcctcgctgtgcgtcgagcgttccggcgcggccaattccatgccctcctacgccgaagcgctggcgcgcatgcaggctcatccggaagtcggcattcgtgccggccctgcgaattaccgccgcggttatgcctgcaaccagcccatcagctgcgcatacggcgaaaaagtgcagcaattccgttacgccgcccggcgacatgtaggcctcaaacagcttttcgaccttaccaacctgatagccggtctcttccaccgcttctttacggatgcaatcttccggcgtgtcgttatccagcagtccggcgcaggtttcaatcagctcaccgctggcgttgtcgttaacataggtcgcgatgcggaactgacgaatcagcaccacgctgtttttttcacggttgtagagcaggatggtggcgccgttgccgcgatcgtagacttcacgtttgtgacgtaccacgtcgccgttactgcgg

SEQ ID NO: 3056 - DNA, 875 bp, Glycine max
  Peptide Sequence Number=SeqID_119834
tgaatgttgaggaacaggctgaaggtcaaggtattggacccagcagtcctcagggatcgaatcagagaagttcatctgaagaacacttttccgatgaagaggccatacaagaggctgaagctggaggttcagacattttcccagcgtcttcgacatctaagctttccgctagcatagggatagcagaggatacattcattcaaatgcaagacgaagaccctgctgcagcccttcgactcctgctgaacaccagtcaagccaacacctcaagtgaaaagaatcctggtgcttcgtcctcatctgatgctgatataacctctacagtacgccaagattgcctgcttttgaagttatcaatggaatacgcacgggcagacgtacttaaatccattgaagagaacccttctgctgcttttgggcacctgaactttttgaagaaattgcataacccccttacttctgatgagattctgggcaaagttatacaaatcgagtccattatcgatcaatttgcaaatactgtgcagaaaaaacgcgaaaatggcgccagactcgatgcccagaaacaggcacatatccttctgctcgagaaagcccgagcggctcaacgtgaagtcgagcgtctcaccaaagaggcgaaagaaggatcttctgatatcaaagcctgtgatgataacatctcctcctgggaggcaactattacaaatttactgtctcagaagctggttgccgaaaaagggagggaaggcctgaaggcctttagtgcatctcaagcggtagcagatgaggcgagagctatggagagtgctgaccaggttttgagcaaagagatggccaccttgaagaaactatatgaggacttagtcctgcattag

SEQ ID NO: 3057 - DNA, 177 bp, Glycine max
  Peptide Sequence Number=SeqID_119835
atgggtgatttagcctctcattgtcatgagagggttactaatacaaaaagaaagcaagagccagcatgtgctcgcgaagcgcacatgcaaagtccatctgacataagtgaatgtgcgttaagccgcaaggtgcaggctaaaccgcagatgcgtactaagccgccacatacaggctaa

SEQ ID NO: 3058 - DNA, 519 bp, Glycine max
  Peptide Sequence Number=SeqID_119836
atgtcctgcccaacgatcataactccgacctccctctgtcgaagtgtcagctggtgtatgccgcctaccaggcaccctctagacccagataagtctaacagggccctgggttttccaacattgatcacgggtctctgccagtcgttcggggttcctgtcacacctagtaaggccccagacgcaccgctgccacctcatcaggctgatccagctgggtcatttgacacggagtggtatttatggcatttggttttccagcaaggggccaaccacagggcgcacgtgcagacccatgactgtctcgaccagctcagcctcagcctgcagagccagggtttcgctccttttccatgccttactccagatcagttcaggacagaggtcgcatggcccagagattggcctgaggcccaggaagggaaggcgcccgtagaggctcccgacgatgcagatgaggcccgcatggacgaggagatgacagatttactcgatttcttgggagggagcggagccacatga

SEQ ID NO: 3059 - DNA, 750 bp, Glycine max
  Peptide Sequence Number=SeqID_119837
atgaattcctccatttatattcttgtctttgtccaccttttgttgttaagcttaccatgcagagagagtgtgtgcatcccaagtgagcgtgagacacttttgaagtttaagaataatctcatagatccttccaataggctttggtcttggaatcctaatcataccaactgttgccactggtatggagtcctctgccacaaccttacttcccatcttcttcagcttcacctcaacactacagttcctgctttcgagtttgatggctaccctcacttcgatgaggaagcttataggagatggagctttggtggagagataagtccttgtttggctgatttaaagcatttgaattacttggacttgagcggcaatgtattccttagagaaggtatgtcaattccttctttccttgggacaatgacctccttgactcaccttaacctctctgctactggattctatgggaagattcctcctcagattgggaatctctcaaatttggtgtatcttgacctgagttatgtttttgccaacggaagagtaccctctccgatcgggaatctctctaagcttcgatatcttgacttgagccacaattatttccttggagaaggtatgtcaattccttctttccttgggacaatgacttccatgactcacctcgacctctcttatactggattctatgggaagattcctcctcagattgggaatctctccaatttgctctatcttggccttggagggtaa

SEQ ID NO: 3060 - DNA, 246 bp, Glycine max
  Peptide Sequence Number=SeqID_119838
atggggatgcttcagaagatgcatagggcgtggaatcaagtggaaaggaaagataagaagcgtaggggaagaagcaacgttagagtgcaagagattgcttggctcaaaaagttagagggtccgaatgaagtagagatggaggtgcccgaggagagcgaagaggggcactcagagatgagcaggcgaaggtcagccttgcaggttgaaaaggaggcaagggaggaagtttgcactcacaataaatga

SEQ ID NO: 3061 - DNA, 162 bp, Glycine max
  Peptide Sequence Number=SeqID_119839
atgcagtttagagccactgttgcatggcctggagacaggcctaatttccaggacgaggcaggacctgtagatgctcaaggagctgcccaaggagatgaaggcagagctgagaatgatggagacatggcagatctgcttgattacttcattggaggaggctaa

SEQ ID NO: 3062 - DNA, 357 bp, Glycine max
  Peptide Sequence Number=SeqID_119840
atgcagagcacggggcggatcctcttgccctcccaaccctatctttccacaaccctttttcggtgtgccgccgacgtcgattccgacaacaaagagcaacccttcaacaaagaccttctgacggtgattttggttttggtttccggtggtgttgttggggttggtcggggtgttggtgtttggctcagatctggacctgtgggtgttgtttggatggatagtggtggcggcgcttgcgatgatggcggtcggaggcgttgcggattagatctggtcgcttatggtggtttggtggtggtggagggtcggcgcacggtgattggaggtcgcgcgcacgggaaagactgggaagtcgac

SEQ ID NO: 3063 - DNA, 891 bp, Glycine max
  Peptide Sequence Number=SeqID_119841
atggggaatatcgaaagccggagaaggaggcggcgccaccccactccaccaccaccacaacaagaggcaaacacaaactactactttgcacctcgtcttccttactaccccaacacccttcttcctccttatcactactaccctcaacaaccaccttcccttcaccacgagaaagctgtcaccatcaggaatgatgtcaatatcaagaaggacactcttcgaatggagcctgatcaacacaaccctcaccattttcttgtcactttcacctttgattccattgctcctggatgcattacagtaatgttttttgccaaggaaactttagatggtaagctgatagctgtaaagaaaagcttgctcaaacaaatctcaatgccttttcagcaaggtctttgtcagaaattcagacaaccttctggaactggcattgaaatctcaatgttagaggagacaggactgaccaaagtaggtgacacagaagtttatcctcttgtgctgaaggctgaggttcgaccattaaaccattatgaaaatgagggaaacccatcttctcaaattactttggctagttttggaaaaagggagaggggtgagtacaaggtccaagtaatgaaacaggttctctgggtcaatgggaagaggtatgaactgcaggagatatacggcattgggaatgttagtgatggtgatagccatgaatctggtggagattgtgtaatttgtttgtcagaaccgccagacataactgtcctaccttgccgacacatgtgcatgtgcagtggctgtgctaatcttctgaaagttcatacagccaactgccccatctgtcggtatccagttgagaggcttttggaaattaaagtaaataatggatatggtgagcaatga

SEQ ID NO: 3064 - DNA, 748 bp, Glycine max
  Peptide Sequence Number=SeqID_119842
tctcaacacattcctggagacacctgtggtattagctcagggagagactgtacccgcctactccagatactgtaggttgcctacagacttcagagagatagaggctgccttatgcatacctggccgagggttcattttgaactctgagggccaacctgggaagattctcaggaaggatttgactacactagctcaggtgtggagtgtcctctcatactccaacttggcccccacatcacatacctctgatttgataatggacagagttaggctgatctttggcttagtctctcacttggatatgaacataggagcattgatctctggccagatgacctctatagcccagtctaacacctctagacttgggttccctgctttaatcaccatattatgtagagccagagtggttgtctctaacagccttaccttcaagtgcttgagcccggtcattaacctggcctacatcaggaagaactgttggaaccccgaggatctaacaatctctatccgaggggctaggagggcgagggcaaggctagttgagcttccttctacttctgcagctcctactccaacatccacttcaacagccccttttgtcccaactcagacaaattctcagcgctttgaagccatgctccaaagcattcatcagggacagatcattttactacagagtttacagatgatggcacctccagactctattcctatagtagagcagtttaatgagatggtagcctga

SEQ ID NO: 3065 - DNA, 292 bp, Glycine max
  Peptide Sequence Number=SeqID_119843
atggcccttaacattagctcgagatttttgacaatagttgcccttgcatttctagtcataatgcaaggaactcttcatgtgaagagaacaggggaagaagcttacacgtgcaggacttcggctgaaaaacaaattaaggggcatactgaaagtgagaaatgcatcaaggcttgttggttggacagaaaatcctttggaatctcatcaattctcttatggaaagtggtttcacacaaaacctttgcttccctcagtgctacaaaagctgcttcgaccttgctgctggtgaagg

SEQ ID NO: 3066 - DNA, 1237 bp, Glycine max
  Peptide Sequence Number=SeqID_119844
tttcaattttcaaatcttgtcggtgattcatttggtattgtattgcactcgcgtttctctctttctgttttcgtcaaaggttatggtttttcgtttctagagggaggggtgggggaggaggatggaaagaaagtgaataactttctggaaatggataggggggaaggagtgaatgatggtttttctggacctggaccaaatgattcacttattcctggtcttattgatgatgtagccttgaattgtcttgcttgggttagtggatctgattatgccgtgctatcgtgtattaataaaaggttcaataaactgatcaatagtgggtatctatatgggttgaggaaacaattgggggctgtggagcatttggtgtatatggtttgtgatccaagaggatgggtggcctttgaccccaagataaacaggtggatttctttacctaagataccttgtgatgagtgctttaatcatgcagacaaggagtccttggccgtgggctgcgaactgttggtcttcggtcgagaattgatggagtttgccatttggaagtatagcatgatttgtcgtggttgggtgaagtgccaggagatgaaccaaccccgttgtttgtttggatctagtagtcttggttcgattgctattgttgctgggggaagtgataagtatggaaatgttctaaaatcagctgagttgtatgactcttcaacaggtatgtgggaacttttaccaaacatgcacgcaccgcgtagattgtgttctggtttttttatggatggcaaattctacgtgattggtggaatgtcgagtacaactgtttcattaagttgtggagaggagtatgatctcaagacaaggagttggcggaaaatagaggggatgtatccatatgttaacgtgggtgttcaggcacctccacttgtggctgttgtggataatcagctatatgcagttgagcatctaactaacatggtgaagaaatatgacaaggaaaggaacacctggaatgaattggggaggcttccagtccgagcagattcttctaatggttgggggttggctttcaaggcttgtggagagcaacttttggttgtgggtggacaaaggggtccagaaggtgaagctattgtgctgagttcatggtgtcctaagtcagggatcagcaatggcaccatagattggcaggtacttggcgtgaaggagcatgtcggggtgttcgtgtataattgtgctgttatgg

SEQ ID NO: 3067 - DNA, 216 bp, Glycine max
  Peptide Sequence Number=SeqID_119845
atggataaatgcctcaggtgtggggtatcacgatacaaagtgaaggatgatgacgagtgtaacaatgacaaaagcataaagaaaggtccttcatcgaaggtgttatggtatcttctaatcattccaaggtttaaatgtctatttgataatggagatggcagtaaagaccctacatggcatgtagatgggagaaactatgatggaatgctccgccat

SEQ ID NO: 3068 - DNA, 543 bp, Glycine max
  Peptide Sequence Number=SeqID_119846
atgcagaatatagtgcatggggatataaaacctgataatctgttgattactcatcatggcactgtaaagataggggatttcagtgtcagccaggcatttgaggatggcaatgatgaactccgtcgatcacctggcactccagttttcactgcaccagaatgttgtttaggtcttacttatcatggtaaagcttctgacacgtgggcagtaggagttactttgtactgtatgatattgggtgaatacccatttcttggagacacacttcaagacacatatgacaaaaaatctgagcttactgtttcctcccttatccagatagtcaatgatcctttagttctgccagatgacattaacccccagttgaagaatttaatagaaggattactatgcaaagacccagaactgaggatgacattgggcgatgttgctgagcatatctgggttattggagaagatgggcctattcctgggtacttatgttggtgcaaacgcaagagcatggtgactgaagactctgatgggagcgatatacttgcttga

SEQ ID NO: 3069 - DNA, 573 bp, Glycine max
  Peptide Sequence Number=SeqID_119847
atggacgtgaatgcgggttacctcatctctcaccagatctctattatagcacagcatgactcctctaagcttggatttctagccttaatcatagctttatgtaaagctagaggagtcacatctgattctaggactcttgagagccttagccccgccatcaatgtggcatacattaagaagaactgttggaatctggatgatccaacagtaacattcagagggcctaggaagactaggggaaagagatcagaggctcctactacttcagcagcaccagagacaaccgcaccttcttcatccactcctccaacacctcccagttcgattatacctccaacaccttccacttcgactccagcacaccttaagagcttaggcctgccttccatcatgaacatggatgagtttgagactcaggtggcttggccaggagtccagtcttctccttctagagagggtaggacctccgcagctcaagagcctgaggctgtaaaggagcagataccagcagaggaggatgagcctactcctcccgagccctttgaatttgtttctgactcagtggtggcatag

SEQ ID NO: 3070 - DNA, 603 bp, Glycine max
  Peptide Sequence Number=SeqID_119848
atgcacgtactaaaattgatggttaaggataaaggcttctctgtctcacttgtactagttatccatcaacacccttacaacatcagctcaaaaactctccccggttcaacctccgatccaccaacgcaaggaatgaacacggttccccttgtacccacatcacccgcgggttctcctgtctccgccaccccgaaacctcccaccatagacatttcccaaagccaagagattctccgtactcaccgtctcaccaaccccgttcagacccaagccggcgatggctccccaaggctccaactcaacgtcaccacctacgccggcagccgagttagcatggccaccggcgccgttaacgccaccgtgacagtgcttgttccgcttgattttgtgctttcaaaggctaaggatccctcgccgacgaacggagtttcgccgaaatccggtgaaacgggctcgtccgccggcgggagcgggaaaagtggtagcggtgatgatgttgttccggtggatgctagttctgcgggttctgtgagtttgaagaaggtggagaaaatactgtggatgactattgttcttgttcttgctcttggagtcacgatatga

SEQ ID NO: 3071 - DNA, 480 bp, Glycine max
  Peptide Sequence Number=SeqID_119849
atgggctgctgtggttgcttcggatttgtccaaaaaccaagacgacggcgtcgggataaacgtggcatcagtaatcttctctcccaggggctattattggatggagaaactgaaggcgatgagacatatagtggtgacgttactagtaactgcaccagtgtagatgacaatgaggtgcaagctgtacgcaaccgttcagaggatattttaaactttagagctaagaatggcatggtttgcaggccgtttcctgttaaggagacttgcaaacttgatcgctcagaggatgaaaatgggaacaagatgataaatggatatgttcgagagtataaaattggttctggaagctatggcaaagtggctctttatcgaagtagtgttgatggaaagcattacgcaattaagtcctttcacaagtctcaattacaaaagcttcgagttgcaccgtctgagactgctatgactgatgttctacgtgag

SEQ ID NO: 3072 - DNA, 1569 bp, Glycine max
  Peptide Sequence Number=SeqID_119850
atgatgtctcaagaagcaatatctgttccttccaacaacctcagagacccctcggttcaacttcatgaaccaaactcaaactcaaattcaaaccctaataatcctaaccctaattcacttaagagaaaaagaagcctacccggaacaccaggcaagttattcaactccttcatgttatatatgcactgttatccgaatgcagaagtgattgctctgtcgccaaagtcgctgatggcgaccaaccgattcatctgcgaagtgtgcaacaagggtttccagagggaccagaacctgcagctgcaccggcgagggcacaacttaccgtggaagctgcggcagagaaacaaggaagaggtggtgaagaagaaggtgtacgtttgtccagagaagagttgtgtgcaccacgacccttgcagagccctgggagacctcaccggaataaaaaagcacttcagcagaaagcacggtgagaagaagtggaagtgcgacaagtgctccaagaaatacgctgttcaatctgactggaaagcccataacaagatttgtgggactagacagtacaaatgtgactgtggcacaatattctccaggaaggacagctttgtaacgcacggagccttttgtgacgccatggcggaacaaaatgcgaggcttccggcggttttatcaaaccttggaagcgagattttgatgaatgctgctcaaggtccaagagtaatgccacaggctttgcaattacatgggtttcataattcagagtttggtgggccaggctcagaaccatacatggggaattttgcggatgtgaaccatgtcgagcataataagctaaggatgccactatggctagaccagaccaataatattcctcttcagcttaatcatcatcatcatcatcatcctctaagcgtctcaagcaacaactcttcaagtttgttctcaccaggaacaaccttggctgaggcaaacaacatgtttgggacatcatcgtcgtcacagggacagtggctgaattaccgataccacccagaagcatcatttacacatgccaacgtttctattcctcatggactgaagctagagcaagaagaaaacaaaggggacttgtcgcatagtgtgagctctttgtaccaaagtcacatggaacctacaaggatgagtggtggtaataataatttggccttcgacaactccaactttggcctgttggacccgaacatgtcaagcacgtccagcaacaacaacaaccgctacaacaataacgtggttgaaattcagaaattgttcaagcaaggaaaccaggctgttgagaacttcaaccacatggtgaattcccaagcaagcaccaacaatattattggaggtgggttttcattgagtagcaccaagggtttggagcacatggtgatgccgcggattgaagagtgggagagtggagaaccagaaataatgcagaagcaacaactacgttcaagtacttcaaacgctactgaagagcacttaaccaaagatttcatgggtattggaccagtgatcaacctgcaaagccagttccgtggacattactga

SEQ ID NO: 3073 - DNA, 387 bp, Glycine max
  Peptide Sequence Number=SeqID_119851
atggctcgagagtgcatgcaagcttatttgggcctgcgattgtgtctctgttgtgtcttcttcctggacccaatcgacaagaaggaattcgcccaccgaaatagcatcctcgtcggcagtcaaaagaacatctttgaaggacatttgtggcctcgactaaacttttcatcacatttgaagcaaaggcctttctcacaccggattgctatctccttcgaggaaaagcgtttgaagggtactggggaaggcttgggtgggaggggcagcaagggtggggatgatataggtggtaagggacaaatgggaaaagatccaatgggaacattggtgttggttttaccgcgaaacatccggcaagagtccgaaaacttctcctccaggaggtga

SEQ ID NO: 3074 - DNA, 1662 bp, Glycine max
  Peptide Sequence Number=SeqID_119852
atgggagacattgatcctgcttttatacaatccacagaacaccgtcccaaagcaaaagtggtggaagtttgtgagattccagtgatagacctttcagaaggtagaaaagaattactcatttcacaaattggcaaggcatgtgaggagtggggatttttccaagtaataaatcatggggtaccctttgagattagtagagaggttgagattgaggccaagaagttctttgagatgagcttagaggagaagaagaaattgaaaagagatgaatttaatgcaatgggttaccatgatggggagcacaccaagaacgtgagagactggaaagaggtgtttgattaccttgttgaaaacactgcagaagttccatcttctcatgaaccaaatgatatggatttgaggattctcaccaaccagtggccccaaaactctcctcgctttagggaaacattgcaggagtatgctcgagaagtggaaaagctagcttacaagttgttggagctgatttcactgagcttgggtttggatgctgaaaaattccatggctgtttcatgaaccaactcagcatggtgaggctcaattactatcccacatgccctttccctgatttggcacttggtgttggtcgccacaaggactccagtgctttaactgtgcttgcccaagatgatgttggaggattacaagttaaaagaaaatcagatggagaatggattccagttaaacccaccccaaatgcatttattatcaatgtgggggatatagttcagtttggtgctttaattgagcttatggcggatttcactcggtttaagtccaatatggaccgcattgaagaagccattgccaaactcacctccactcaacttcatcttaccgctacccagaattccctgtccgtcaagctggacgatctacttcagaaattcgcacagatggaaacaaacccctactctccaatgtcgtccactgcaaaccagcatattgcaacacagtcctcaaccctacatcgcatgaagttagaggtcccgcgttttgatggattggatcctatggggtggatcttcaagatcactcagtttttcgagtatcattccacaccagactctgaacgattgatgataacctccttctacatggatggctctgcacttgcatggtaccaatggatgacacatctgtcgcgaagtgcaagcattctaacctctgacgttgattcaggcagtttcactcgctcacctcctggaggagaagttttcggactcttgccggatgtttcgcggccacaaatgtccttcaaagatgttcttttgactgccgacgaggatgctatttcggtgggcgaattccttcttgtcgattgggtccaggaagaagacacaacagagacacaatcgcaggcccaaataagcttgcatgcactctcgagccatatggccccaaaaaccttacgcgtattgggtcgtgttgccaatcagcaggtgttaacattaattgatggaggtagcatccacaatttcatccaagagctactggccacaaccttgggccttccaacgcagcccactccaccgttgtgggtcttgggcaagaattcatggtggatcttcatgttcttcgattatgcgacgaagatcatgtattgtgagtttagtggttga

SEQ ID NO: 3075 - DNA, 108 bp, Glycine max
  Peptide Sequence Number=SeqID_119853
atgacatgcctcacggaaggggtgacagcttcctgtcgtgatgacgttgaagaagctgcagtggagaggacaatcaagcagcttaaagatggttttcatttgacttaa

SEQ ID NO: 3076 - DNA, 696 bp, Glycine max
  Peptide Sequence Number=SeqID_119854
atgtctctaaaactgccttactttcctgaattagttagagtcttctataataacttgaaaattcaggatggtattatttattctgaggtgcatggtattccaatgattattgatcagtccttgttcttttccttgacaaaactgcccagtcaaggtgttccttttgagggcaccattgttgatgactggaaatttgattattctagtcatgatgctcaccgtatagtctgcaatgacaaggttgacatgattggtagattactttctaggtcattaacttttgattgtcgcatcatgcattatatcattgttcgcattttgcttccacgatcctcaaaccttgctcaagcctctgaggaggatttgattctgatgtgggcttttcaaactggtcatcagatcgaatgggcccattttgatcagtaccagatgcataaggcattacgggccaatgcacctctcccttatcctcaccttgtcactctttttctttatcatttcaatattcctttggatgatgaaccatttgtcaaggtcaagcgatctttctctattggtgctggtgcggttacctcttttggttaccgaaaatatgttgatggtctatgggttcgtaaacaagacttgcctccacctattcctaacgaacgtaccccatctcctccacctcaaagggttgattcctcttctctttag

SEQ ID NO: 3077 - DNA, 453 bp, Glycine max
  Peptide Sequence Number=SeqID_119855
atgaccaatgttgaggagtacctgcatgggtggcttcatcatcacataatcaaagttgggattattgttccagttacttgttgttggctcatttgggtcacaaggaacacaatggtgtttgagggtagtcaaataccatggcacaatattggtaaccagcttattgctttccatgctcgagtggtaaaggcttttggagctactaaggttgagaggatgaaggtggatcaggctgggatttcatggaggagactgaatatggatgaaattattttcaatgttgatgggagtgttattgggataataaggagggaaatttcatttgtggtttctatggtcacatggagaatgcttctattctccaagctggtgaatgaaggggtttcagatcatcctttgttggcaactaccattttacaaatcaagaattttctagagagattggaacgttaa

SEQ ID NO: 3078 - DNA, 562 bp, Glycine max
  Peptide Sequence Number=SeqID_119856
atggcgcgttcggcggagagctttgaggccaggtcaaacgcgacggcgaggtccgagactgggagattcggtaggagacaacccgggtcgagcccgaacgagaatttgcatatgttgtcgaacgagaatcttcgtagtatatcttgcaaatccaaaacgcagacggagtttaattcgccacgcgcgactcgccatcttgcgctggaacttccacgattcgccgtcgacgttgaagattcctcttcccaaaagatcgccgaggatggtggagaagggttttcccttggggtagttttggaaattcgtcttgagaatgtgctccacgttgtggggattcgaggtgatggtgttccccagcacgtgaacgtggatggtgccggttggggatttacgcaagagatgagtgtaccagtcgcagagattggggaactttttcagccaactcaccgtcaagtagctcttgcaaagatcgcagttacaccagggcttcatcctggagatgaagacgaggaaggagaagaaggagaagagaagggtgaaggagaagaagaagaagccgcag

SEQ ID NO: 3079 - DNA, 198 bp, Glycine max
  Peptide Sequence Number=SeqID_119857
atgccaccatggaagacgtgcagctattcgaactgcaagaataaggaggaacccaggaagacccagataactgtcaattttttcaatggggaagaagaaaaccaactttctaattcgtcttctgtctcaagagaaacaatggtagtggttgatttgaggctacaaattaaagctttgcagaagaaaatgagaaattaa

SEQ ID NO: 3080 - DNA, 594 bp, Glycine max
  Peptide Sequence Number=SeqID_119858
atggcctgcaccaagaaaactaggcagatgacgtttgaggcaacaaaggaaattgctgagaagattgattctttggaggagaaggcttcacagggttcgtttgtcccctatggatgtcagtatatcctgactgctgccattgggcgacaagaacaccctggtcgtgtgcgtgatgctagagccggtgtgaccataaagcaatactttggatcagctccacgaacctcccacagttctttctccatagctcctgaagaactcgaacagctgactcaacaaatcagggaccagctggaggagtcgatcacagaaaaaggacttgcactgcctctggagcctgaggttggtccctcagctgctcgtgtcagcacaaaggagagttgtgttgatccctcaaggaacgatctagagacggatgactcagacaaatgtgggttgtacatcgaagaaaatccttctcgcctagttgccctaggaagagtttatgagggatccacagtggttcacaacatccctttgttgcatggccaagtgaaggttagtgttgaggaggttaaagatgcagaggctctcattcctgtacccattgacgag

SEQ ID NO: 3081 - DNA, 909 bp, Glycine max
  Peptide Sequence Number=SeqID_119859
atgtccgtcatcgacattctcttccgcgtggacgacatatgccacaaatatgagaaatacgacatcgataagcagcgcgagctcaatgcctatggcgatgatctcttcgctcgcctctacgccgctgttgattccagcattcaatctgctctcaataaatcggaggttgcctccacggagaagaacagggcttctgctgcggctttgaatgcagaggttcgtcgaaccaaaggtagactcatggacgagcttcctaaactccgcaaattgatgcacaagaaggttaaaggtctcacaaaagaggacatggccgttcgacaggatcttgttctggcattgccagagagaatccaagcaataccagatggtatttctggtgctgctgttcaaactgcaggatggaccgctacctcatctcagccgcatatcaagtttgattcatcagagggacatcttagcagtgattatttccagcaaagtgaagaatccagtcagtttcgacaagagtatgagatgcgcaggacgaaacaggatgaaggacttgatatcatatcagagggattggataccttgaaggatctggcacatgaaatgaatgaggaaattgatcggcaagttcccttaatggatgaaattgacacaaaggtggatagagcagcagctgatgtcagaaacacaaacgtaaggctgaagaaaactctcaccgagataaggtctagtcgaaatttctgcatcgacattgttctgctctgtgttcttcttggaatctttttgtatttatacaactgcttgattcacatgctttctaacatgaaataccactactcatttgtgtactttacaagactacttatcgtgactgcttttaagcacactacttcctttcttgcatcgaaagcaacattctag

SEQ ID NO: 3082 - DNA, 1050 bp, Glycine max
  Peptide Sequence Number=SeqID_119860
atggagggagatcaacagggttctaattactcttttccacctggcttcagattccacccttctgatgaagaactcatagttcattacttgcaaaacaagatcagttcacgtccacttccagcttccattatagctgaaattaatctctataagtataacccgtgggagctaccgaataagtccttgtttggagaggaagagtggtatttctttagcccgagagacaggaagtatccaaatggattgaggccaaacagggctgcagcctcaggatactggaaggcaactggaactgacaagccaattctttcttcttgcggatcaaagcgcataggagtgaagaaagctctggtgttttattcaggtcggcctccaaagggagctaagacggattggatcatgaatgagtatagattggttgacacaatcaccacatcctccaggctaaaaggctccatgaggttggatgactgggtactatgccgggttcgacataaaggctactctccgaagaattcatgtgaaaatcaagagagtcctaatgaactaaacttgtctgcaaaactaccaaggagtgaagaatacccaacaaacatgaactgtcgggctgacatgatccctgattatcaatacaaagactatcaaatcatagcctctattcttgttggtggacctattcctcccactgaaagcatgccaaaccttagctttaagggctgcaaaggcaacaatgtagtttcagtttatgaagatgatttcactaaagtgaattctcaagcgacaattccttctttggaaagttatttcaacccactgacaagaaaatccagtgaagatgaacagtatggaaatctcatttcttttaacaggaagttcaacactgagaacagaatggatggatccactagcaaagtgttgaccagtagagaattgaattgctataaccaaaaccagtctcaagatgacattttcaatgtgaacccaccagatcctagcatcaattttcaagagctaaacgaattagacttttcgggaaggtaccatcagtga

SEQ ID NO: 3083 - DNA, 198 bp, Glycine max
  Peptide Sequence Number=SeqID_119861
atggcgtggcatggtcagcctgtgaagatagaggaaaaggaaaaccagaggcagctgagtagtgtggtggtgatgctcctgtggctttcattaagtcatgaccgtgttgatgatcagaagcacattagcaaccatgaccgtaccatacgccgccttcgtgccatgcaccatggtccacccaaccacaacctcttctaa

SEQ ID NO: 3084 - DNA, 645 bp, Glycine max
  Peptide Sequence Number=SeqID_119862
atgggtcaaagaattcaacaacgaggagaggttgtaaagggagtgccactggtgcaacctggggatgatctcttctggtttaacaaacctcgacttattctttacctcattaatttcgtgctctttcagaatgcttttcagcttgctttcttttcatgggctgcggacttgtgggtgcaattgttatctgaacaaatgctattactacatttctgttcgcataatttacccctgatgaatgctccaatttatgatgaaatcctgtttccattcccaaaaacaggatgtggtgatcagaatctcaatgggatgggttcaacaatgaagccaaccatttttaacgaaagagtagccagggctctaagaaagtggcaccacacagcgaagaagaacgtaaaacataaccgtggattgcgattgcagactcccaaccacactaagtccaacgctaatttcctgcgccgctaccatagtgaaatggccacttatccctcttctccaataaggttcgatttggatgcccatcttccttgtgaggtcaatgctactagttcttctattcaccaccgtcaaatggaaatgggtcaccaggcccatgagattgatattgaacgtggcaaggatttttcttttgataaaaaatga

SEQ ID NO: 3085 - DNA, 462 bp, Glycine max
  Peptide Sequence Number=SeqID_119863
atggggtactatgactcagagcacaccaagaatgttagggactggaaggaggtgtttgattacactgtggaggaacctaccatgatgccggcttcacttgaccctaattatcataaagaactcactcattggtataaccagtggcctcaatacccaccagagttcagggtcattaagagaggcattccaagagtatgctcagcacatggaagaactagcactcaagttaatggagcttattgctttgagcttagggttgccaccaaaacggtttcatggcttcttcaaagaccaaaccctaaccttgttttgggattaggtcgtcacaaagacagtggtgctttaactgttcttgctcaagatgatgttagtgggttagaagtgaagcgaaaatctgatggcgaatggattcgggtcaagccaacaacacctgattttatattatcaatgttggagacataa

SEQ ID NO: 3086 - DNA, 152 bp, Glycine max
  Peptide Sequence Number=SeqID_119864
atgggcgccaagcacctcacgaggaccaaagaatggtcgcacgttatcaagcaaaggtccccggacgaaattagggaacaacaagctgagtgggcaaacgcgcagagacagattctgcgccctttatcattcaggaacaacaagctgagtgg

SEQ ID NO: 3087 - DNA, 480 bp, Glycine max
  Peptide Sequence Number=SeqID_119865
atgcgtgcaagagcggataaaggccgacataggggccttgaaagagcatatggccacaatgatggaggccatgatgagtatgaagaagatgatgagcaaatgtccccgtctggccttaaccaaataattcatccaacctcagatatggtaggtcagggaggcaaagaattgggaagtatgggcgccccctattttgtgcaagttcaaaacaagcatcccttctcgccatatggcttgcctcccaattatacaccacccaatgtggtgcacactcccaatgagaatgtcaataactccactcccatactcattgagagccaacaacctcaatctggtcatgcccatatccttcaacccatggaggagacacatgaaataccccaccacaatctagctgacatcgagccttgcctcggatacaccactgaggggcaagcaattggtggtgtacccctgccaaacactttggagggcccttag

SEQ ID NO: 3088 - DNA, 351 bp, Glycine max
  Peptide Sequence Number=SeqID_119866
atggagggatctggcagcccaagtggtgcccccaatgacggaaaaggagatgataacaatgatagtagacacgttaccgggaaggaattttccaacaaaaaacctatagaattcaccccaattccggtgtcatatgctgacatactcccctatctgctcgataatgcaatagtagtcataaccctagccaaggttcctcaacctccattcttcctaggatacgacccgaatgcagcatgtgcttaccatggaggagtcccgtggcatgccattaagcattatatgaccttgaagcgtaaggtgcaaggtctaattgatacaggctggctgaaatttgaggagaattgctag

SEQ ID NO: 3089 - DNA, 1080 bp, Glycine max
  Peptide Sequence Number=SeqID_119867
atgttggccttcaaagagaacttccgtaaagcatacaacatggttaactggaaattcttggactacatgttgcatagattaggattcaatgtcaaatggcgtcagtggctgaaaataattgtctcctctagtaacatatcaaccttggtaaacggatccttaacttttgagttttcagctttaagaggcttgaagcagggtgatccgttgtccccatttttgttcttgatagctgctcaaggtctaacggggcggttcatagcacggtggagaaaagactattcaaaggtgactcatgatagtctttgggcaataaaagcaatattccgaggcttcgaattggtctctggattgttagttaacttccttaagagtgtcttttatgggattggcacaaaccaaagatttaatgagccagctgcaaatttcctttcatgcagggttgcttctccaccttttcactttttgggactgccagtcggggcactgatgaaggtgataagggagttggaaggtatacagcggcacattttgtggaatggagtttcggaccaggcgaaaatcaattggctaaagtggactagagtttgtacacctaaacaaatgggtggtctcggaatcaagaatctaagcatcttcaacatcagcttattgactaaagctatttgggctcctattttgaaatttcattatggctcattagacttgtcaaacacaggctcagccagccgcacatcccaatggtggagggatattttaagaattggcaactgccaatatcaaccaggctggctaactagcaccttctgcagaaagattggtgataggaaggatactttgttttggagacacagatgccttaacgagactcccttaatgcaatcacatgcaagactctttagcctagcaatggataaagacatatcagtccaaggtatgtcagcttgggatgtagaacaatctgattcctggaattggtgttggagtagacaaccttttcaatgggagttggaactcattgcagaactggaagcattgctggccggggactttttagttcagaatcagaatgatacctag

SEQ ID NO: 3090 - DNA, 243 bp, Glycine max
  Peptide Sequence Number=SeqID_119868
atgacgttgctatttagcaacattctgcccagcgaccacaatgccaatctccgcctgcagatgtatcagttggaatcgcacccacaaagacactcagtgataccagctctggttacgggcctctgtagtcctacagggtgctcgttccccccggcaagctcacgtcatcatagggatcgcgcctgcaaaacacccagtggacctgaagaagtccaacagggtcttggagttgtcaagctctaa

SEQ ID NO: 3091 - DNA, 822 bp, Glycine max
  Peptide Sequence Number=SeqID_119869
atggcggaaaggacagtggtgcttacctcgacggtcgacgctgacgatgctccctcgacggtggacggtggtttgtggttcgtggctcctcttcacggtggttcgtggtttgtggctgctcgtgcttcgtcgttcgtggctgaggaagaagaagaagaatcaaacggagaagaagaaaaaggtagcgcgaggaagaagaagaatggctctggggaagaatcaaatgctttgtgggagaagaagaatcaaaagctgggcataaagggctttttatctcaagtgctgggtgcaccaacaaaaatgttgggtgcaccaagcagcactcctaaatatttccccctttggatcgattcttcttctctcccggaacacagattcttcttctctcccggaacacagattcttcttctctcccggaacacagcttcttcttctctcccggaacaacttcttcttctcccggaacctgcttcttcttctcttctccgtgaagcttcttctccgcgaggcgcgccaaggctttcttcttcttctccgcgaacagacccgttaggggttcttccggaagttccggaagaacattttccggaaagtttctggaagaactgttcttccggaagtaaccaaacgtcttccggaagaacccttcttccggaagactcccggaaaacctcttccgggaactttccggaagaagtggttcatccggaagaattccggaagacgcactcttccggaagaactttcaaatttccggaagacctttccggaagaaccccttcttccggaatgtttccggaagaaccacttcttccggaagtg

SEQ ID NO: 3092 - DNA, 534 bp, Glycine max
  Peptide Sequence Number=SeqID_119870
atggcaatgcgagagagtgtttggtttctagggttttctccagtttcaaaacgcaaaaaagatgtgccaaggggtaaaggggaagagaaagaggagaataaggatagaggaggtatgaaagggtgggcgcctcctcctccggaagaagcacttgatgttgcttcttttcttgcttcttttggttcttccaggttcttgcttcctcttctccgtcagcgacaccgtgagccaagcgccaagcttcttcttcttctccgcgaacgaggcttcgagaagacaaggatagaagacgccggaaaaaatgggaaaaaggggcttacagcggcagcttctggaagattcgttagaggttcttccggaacttccaaaagaagttgttccggaaacattccggaagaagtgttcttccggaagaaaccaaaggtctttcggaagaacacttcttccggaattctcccggaacacctcttccggaaagtttccagaagaagtagttcttccggaagaattccggaagaagtgttctaccgatga

SEQ ID NO: 3093 - DNA, 429 bp, Glycine max
  Peptide Sequence Number=SeqID_119871
atgagcatgatgagagagctgaaattcttccttggattgcaaataaagaaaacaccccaaggaatttacattcatcacacccagtatgtgaaacaattgttaaagaaattcaacataagtgatgcaaacaagatgaaaactcctatgcatcccactacatatcttggactggacgaggaatcaacaaaggtggacaggactcaatacagagcaatgattggttcactactctatctcactgcgtttaggccttatattatgttcaatctttgcctatgtgcaagatttgaaaaagaaacaagggaactcataaccttggtcttatgttcaaaagaaaagaaagtttcagactcacaagctattgcgatgcggactatgctaaggataaagttgaaagaaaaagcacaagtgaaagctgccactttatag

SEQ ID NO: 3094 - DNA, 2538 bp, Glycine max
  Peptide Sequence Number=SeqID_119872
atggtttggaaaacttaccagtcctctgggcatgctgcaaaccagccaatttccaaattgtggaccaagaagaatgctgttggaaaacaagaagtggccaaattagtggatgacacgtttagaaagttgcaggtatccggggccattgatcttgcatcaaagggacagggtgcctcagatagcagtaatgtgaaaattaaaggtgaaattgacgattcctatcaatcagatacaaagattcgctgtctctgtggaaatgtattcgatacagagccattggtcaagtgtgaagatacaagatgccatgcgtcacagcacatcagctgtgttattattccagagaaacctatggatggaatcccacccattcctgataaattctactgtgaaatatgtcgacttgatcgggcagacccgttttgtatttcagtgacacaccttttgtttccggtgaagttgaccacaaccaatattcccactgatggatcaaacccagtacagagtgtggaaagaatgtttcaactctcaagagcaaacaaggagttggtatcaaaatcagaatatgatgttcaggtttggtgtatgcttttgaatgacaaggtttcattcaggatgcaatggccacagtttgcagatctaaaggtcaatggtcttcctgttcgtgcaattaacagacctggttcacagttgcttggggctaatggtcgtgacactggtccagttatcacgccatatacaaaggacggaattaataagatttccttaacagggtgtgatgctcgcatattctgtgtaggggtccgtattgttaaaaggctcagtatgccagaggtcctaagcatgattccagaggagtctaatggtgagcattttgaagatgctcttgcacgtgtctgttgttgtgttgggggtggaaatgcaaatgataatgctgatagtgatagtgatttggaagtcgtttcagacacgtttagcatcaatctccgttgcccaatgagtggttcaagaatgaagattgcaggaagattcaaaccttgtgttcacatgggttgttttgatcttgaagtttttgtggaaatgaatgaacggtcaaggaagtggcagtgccccatatgccttaaaaattatgctttggagaatatcattattgacccttacttcaatcgcatcaccactctgatgaaaaattgtggagaagagattgcagaggttgaggtgaagcctgatggttgttggcgggtcaaggctaagaatgaaagtgaacgccgggagttggggactcttgctcaatggcaccgtccagatggatccctctttgtttctactgatgaagtcaagagcatggaaaatataaagctcaaacaggaaggtgtttcagatagtcctattggtgttttaaaacttggcatcaggaagaatagtaatggtgtttgggaagtcagcaaacctgagaacacaaacacctcttctggtaataatagattgaatgaggatttagaaaatcatgaacatgttattattccaatgagcagcagtgatactggaagtggccgggatgaagatgatcctagcgtaaatcagggtggtggtgagcatattgattattctactaccaatgggattgagatggattctgtgtttaacaataatattgattcagcttatggatataatgttaataacgcttctgctctgatgggtgatgcacaagttattattcttagtgattcagaagaagacaatgatgtattgatgtctcatactcgtataactgggtacaaaaataatcaaactagtgatgcagttgatgtttactcagtgctacagcctggaattattgatccatatagggaagatcacaatcctggagtttttaataatcccagtgaagatgattttggtatgccctccctctggccattgcaatctggaactccagcagtcccgggattccaattattcagttctgaagtggaggatgatgtgtcagacgcattgattgatttgcatcatggcaatattaattgctcctcgtcactgaatggttatacgttggctccagatactttgggatctggcactctcataccagattcctcagcaggtcgacctgacgatgatttaaatggtgggttggttgacaatccactggcatttcccagagaagatccatcccttcagatttttctccctacaaaaccagcagaatcatctatgcagcatgaactgagagatcatgcagatgggtcaaatggtgtcttcactgaggattggatctctcttagtcttggaggtggtgccagtggcagtaatggtgacacttcctctgcaaatgaattgaatttgagaccacaaattacacccagagaagatgccagagattctttgacagatgctgctcctttgcttcttggtgtgaatgatgttagacctgacaaggcaagtaggcaaagatcagatagccctttctcatttccccgccaaaagcgttcagtaaggccccgcccatatctttctattggttcagattccgagtag

SEQ ID NO: 3095 - DNA, 243 bp, Glycine max
  Peptide Sequence Number=SeqID_119873
gaaaaattgcaacatttccgtataaaagagctcaaagatgtgctcactcatttgggactctcaaaacagggaaagaagcaggatcttgttgatagaatattagctatcctctcagaggaccaaggaatcatgaagaaagaagggttattgccaagctcaattcagaagttgatcttccactatctcaaccagcaatgtgctgggattttcttcaattgctcatcaggggaccacattgattag

SEQ ID NO: 3096 - DNA, 165 bp, Glycine max
  Peptide Sequence Number=SeqID_119874
atggcgaaagaaatgaatatagtaaaagctcccaagcaggccaataatatacccatacagttgcaatttactttaatattagcagcagaaccctacgaaagaacaggatatcacaatttgtctaacagcacctatccaggggcacaattttttttgctatattga

SEQ ID NO: 3097 - DNA, 153 bp, Glycine max
  Peptide Sequence Number=SeqID_119875
atggcatggatgagggagaggttgcagaaaaaggttgaaatggaggaggtgcatttgtcggagaaattgcagaatggggcagctaggcgaaaggagaggtatgacagtgagaggcggaggaggccatcaagattgagtattacaaaaggttaa

SEQ ID NO: 3098 - DNA, 606 bp, Glycine max
  Peptide Sequence Number=SeqID_119876
atggagctcaacattaaagccaaatatactttgacatgtgcccaatcaaaaaataagtacaaaaagatctacaaattgagaactgctaaagagatttgggagtcattgagcataaactatgaagacactgaagatgtcaaattgaggaaagtcatgactctaaccagacgttatgaaagattcatcatgaaagatggagagtttgtggatggcatgtttagaagacttcaagttcttctaaacaatctagggactattggacatatgtactccaaggatcagataaacttgaaagggctggatagctttcccaaggaatatgatggatcaagcaactctaatggatccacaaataatgaagtgactctcatgtccaagaaattcaaagagatgatggattcaaagggaaagtttcaacattcctccaaacataaaggttctagattcaaaaataagaacaaggaggaaagcaatgagattatttgctttaagtgcagaaagcttgaacatatgaagatgataaggtcacctgggatgactcagacaatgagaagagtaatagttcaagtgatgaacaagccaacatttgtctcttggaagatatag

SEQ ID NO: 3099 - DNA, 171 bp, Glycine max
  Peptide Sequence Number=SeqID_119877
atggtggacgtggatgtagttaaagaacaagttccacaaaatcttgaacctaccaagtgtgatggttgggattggtacgagtgggatcatttgtcacaccctctgtttgggcctcttgagaaaatggatgcacgtaaatttgtaaaacttctaattcagaagcaacattga

SEQ ID NO: 3100 - DNA, 2217 bp, Glycine max
  Peptide Sequence Number=SeqID_119878
atggcggcgagtagtaccttctgcttgctccactctcccctctaccaattcccatcttcttcttcttcttcttcttcttcttcttcttcttctgggctcagaaagttgcgagcttccacaacttcttcgtgcttgggccagcaagacaaagacccagtctgtaacaaaagaaccattcttttgtcgagcatcgctcttcttccgtttcgccgtttgaagcgggcccctgctcttgaatccccacctccacccccaaccccaacagaagaaactgaggtgaagacgcaagaggataaccaggaagccgagaaagcatctgaagtggaccaaccatcaaattcctttctgactctcctgaatggaattggaatattttcttctggtgtgttgggtgctctctatacacttgctcagaaagaaaagtccactgctgttgcaacaatagaaacaatgagcagcaaactaaaggataaggaagaactgattgtttccttgaagaagaactatgagttgaagttactgaacaagcaggaggaacaagccaagctggttgaaaaggcaaaggaagagcaactggcattgataaaccaactgaattctgcaaacagtactattaaacgcttgggacaggagcttaaaagcgagagaagtttgattgaggacctgaaacttcaaattggccaacttaaaactgagctttcaaagactgatactgataaaaaggatcttgaaaacaatttgaaagaaaagatagattccattggagttttacaggaaagaatcaatctgctgagtgtggacctcaagggcaaagaagatgttgttcaaaatcttaattcattccttgcagaaaaggagttgcaattgaagagtttgaattctacctatgagcaaaccaaggatgacttatccaatgttcaattgcagattcaagggctgaaagatgaactactgaaaagccaagaggaactagaagcaaaagattccttggtgatagaactaaattcaagagtgagttccttaactcttgagaacaatgattttaggagtaaatgtgatgtcatcgagaaggaatacaatgtcctaaagctcagtgctgaaaagaaggctgctttggactctaaggttttaagagaaaaagatgaggagcttcatcagctaaaggatcagttcgaacttgccctaggtgaagcaagcaaaaaccagaccgtcattgttgatttatcccaagaaagagatgatttgaaggaggctctagagaatgaatctagcaaggtgaatcatttgaagcatgaactccaagtcacccaagagaatcttgcaaaatcaagaaatgagtttgctgaattggaaaactttctaactgagtcaattaaactgcgcaaagagcttgagctcaaggtctctaagcttttgtctgagctcactgaagttaaagaatcactacagagaagccttgaagatggaaaacatgaggcacaaatgctagcaagtgagcttacaactgccaaggaacacttgaaggaatcacaagcagagctgcaaggtgtgtcaaaagaactaacaactgctcttgaaaagaatgatagcctacaaaaagaattaattgatgtctacaaaaaggctgaaaccacagcagaggatttgaaggaacaaaaacagttagttgcttctttgaacaaagatttacaagcattagagcagcaagtctcaaaagacaaggagtcccgaaaacctcttgagagggacctggaggaggcgaccaaatcactagaagaaatgaaccgaaatgcggtgatcctttctggtgaactacagagagctaattttcttgtttctagccttgaaaaagagaaagaggtgcttactaagtccctaaccgaccaaaggaatgcatgcaaagaggcccaagacaacattgaagatgctcataaccttatcatgaaacttggcaaagaaagagagaatttagggaaaaaaggtaagaaatttgaagaggaattggcttctgccaagggtgagatattgcgcttgaagagtcgaatcaattcttcagaagttgctgttaacaatgaccaagtgcagaaagatggaggtgaaaacaaggtcaattcttcagaagttgctgttaatgagcaacagaaagatgaaggtgaaaacaaggttactgtaagtgcacgtaagactgtcagaagaagaaaggctaacccacaataa

SEQ ID NO: 3101 - DNA, 1311 bp, Glycine max
  Peptide Sequence Number=SeqID_119879
atggagtctcaagacctcaccgaccacctccacagcctcagcttcacttccaccaccgcagaaatcaaacgcagcacaagcttcagctcctcaaccaccacctcaacctcctcccacttcaacaccccactccccaacgccaagccccacgcgccctccttcctccaacgccccctctccctctccgacctccacttcacgcgccgcctcggctccggcgacatgagcgccgtctacttggcggtgcccaaggaaagcgctggagccggcggcgcggtgttcgcggcgaaggtgatggagaaggaggacttggcgaggaggaacaaggaaggcagagcgaggacagagagggaaattctggaaatgttggatcatcctttcttgcccacgctctacgccttcatccacgcgcctaagtggctctgtttcttgacgccgttctgccccggcggtgacctgcacgtcctccgccagcgcttccccaacaaacgcttcctcgaatccgccgtcaggttctatgcatcggaagtgttgttggctcttgaatacctacacatgttgggggtaatctaccgcgacctgaagcccgaaaacgtgttaatcagatcagaaggccacatcatgctcacagacttcgacctttccttaaaatgcgacgattccacatcaacggcacaaatcatctccgatcaaaaccctccccgcacagtcccacgcaacgattcccacgtggaacccacacgtgccacttcttcatgcatgatccccaactgcatagcccccacggcctcatgcttccacccaaaacgcaagaaaaagaagaaacaaacccattttaatgggcccgccttcgtggccgagcccgttaacgtccggtccatgtcgttcgtggggacccacgagtacttggctccggagatcgtgtccggtgagggacacggtagcgccgtggactggtggacgttggggatattcatgttcgaactgttttatggtgtgacaccgttcaagggcatggaccacgagctaaccctggcgaacgtggtggctcgggccctcgagttcccgaaggaaccggcggcttcggcagccatgaaagagcttatctcgcagctgctggttaaggacccggcgaagagactggggtcggtgatgggggcctccgcgatcaagcaccacccgttctttcaaggcgtgaattgggcgttgctgaggtgtaccactcctccatttgttcccccacctagtagtgccaaagctatatatgatgatcatcaaacttgtcctgagattttcattgactgttattaa

SEQ ID NO: 3102 - DNA, 408 bp, Glycine max
  Peptide Sequence Number=SeqID_119880
atgtgctttctacggatcaacttgatccggaagccatccgtacgtccgcgacgaacaaacgccatctgcgtaccttgtttgccgccaccgaccaccgcaaagcttgacgccggaaacttcaccttcaccgctgcactcaaccttgctacccccacgaacaagagacaatgccgcaggaaaaagtggaaaatgagaagaaagctttttgaaaatggaacttatcaaggtaatctttgtggcgtctaccctgatttatcttccttcactgaaagtggcgtcatccaaatctccgtagcctgtatcaagcgatccactcctactcaggatcacatcaataatggtgacaatgtgctatgggtggtggtggttgtggttgtggtggaacggtggcgacaacaatgggagtga

SEQ ID NO: 3103 - DNA, 293 bp, Glycine max
  Peptide Sequence Number=SeqID_119881
atggtagcctgtgtaatgttggggcataggtacgagcccgaaaagggtttaggttggaacggcaacgacatggcgagcttggtggagttcaaagagtaccgcggaaggggccaaagcatgggccagcagcaaggaccgcaagtgaaagggactcctttatgtcacatcaacaagagtttagtcagcgcgggctggacatgtgaaggacgggtcaccatgatccacgatgcagtccctcaagatcaatcaaactgggtgcatccatgccctcctaagttcgagttgggaaattg

SEQ ID NO: 3104 - DNA, 795 bp, Glycine max
  Peptide Sequence Number=SeqID_119882
atgacatcaatcaagttcttcacttcacattttcagagtagcgttcatattttttcccctttcccaacacttgcggtgccgccacgtgtcccatcgttttcggtgttagtttccttccttctcagcgatcggattcggattcggactccgtctcgggaaaattcgagaagatttttcgaatttttcaccactgctttgtgcgcagcgatcggtttcggattcgggctccgattttcgcctctcgcgaagagcttgggttcatttgcactaatggaggggaaggaggtttgcgcgtcggagtcggcggttgatggaagccgcgacgtttggagttcggagccctcgctcgcttcctccgcggatcacctcgttgtaatggtgaacggaattctcggacgtgagacggattggaaatatgctgcggagaaatttgtcaaggagttgccagataaagtgtttgttcactgtagcgaacgaaatgtgtctatgcatacactagatggtgtggatgtaatgggagagagattagcagaagaggtacttgaagtgattaaaagaaagccaaatatgcgtaagatatcctttgttgcacactcagttggaggattagtggcacgatatgcaattgggaggctgtataggccacctgaaaaaggatcaatggcggactcatgcaatgacgaaagtaaggagggctctgtgggtacaattggtggcttggaggctatgaatttcattgctgttgccacacctcatctaggatcaaggggaaataagcaggtactgacatcttga

SEQ ID NO: 3105 - DNA, 1290 bp, Glycine max
  Peptide Sequence Number=SeqID_119883
ctactagctaataacaagttttttcaatttccgcaatcatttgtttcagataatcttggagaagactgccctgtatttgacaacttatttgaattttgtcagatttatgctggtggaactatagatgctgcacgtcgattaaacaatcaactgtgtgatattgctatcaactgggccggtggactacatcatgccaagaaatgcgaggcatctggattttgttacatcaatgacttggttttaggaatcttggagcttcttaaatatcatgctcgtgttttgtatattgatatagatgtgcaccatggtgatggtgtagaagaagccttctacttcactgacagggtgatgactgtcagttttcacaagtatggagattcgttcttcccgggtactggcgatgctaaggaaataggagaaagagaaggaaagttttatgccataaatgtcccattgaaggatggaatagatgacagtagcttcactcgacttttcaagactattatttccaaagtagttgaaacatatcaacctggtgcaatagttctgcagtgtggagcagattcgcttgctggagatcgcttgggttgcttcaatctctctattgatggtgcttatctcccacttcgtaaagagattcaatttgccattgctggtgagtttatatcagtttatgtttgccattgctggttgagaattgagatttacaggaatgaacttctgccaaaggtcactggaggtgggggatacacaaaagaaaatgttgctcgatgttggactgttgaaacaggagttcttctagatacagagcttccaaatgaattcccatgtggtatatcattggatttctttagttgtgcaccacagtcaggaatgatggaaaaatatgttataccatatgtttcctttgggagcatagagagagtggaaacatttcttacctgctttttctgtctttcagagattccgcaaaatgattatattaaatactttgcaccagaattttctttgaaggttccaaatgggccgatagaaaatttgaatagtaaatcatatcttagcaccattaaaatgcaagtcttggaaaatcttcgttgcatccagcatgctccaagcgtacagatgcaggaggggtcacaggtccctcctgacttctacattccagaattcgatgaagatgagcagaaccctgatgaacgcattgatcagcacactcaagacaagcacatccagcgcgatgatgaatattatgatggtgacaatgacaatgatcaaatgaatatttcatga

SEQ ID NO: 3106 - DNA, 423 bp, Glycine max
  Peptide Sequence Number=SeqID_119884
gttccatttcttttgggggtacctgcttttgagaaggttgctagttgtgttattcattttatttttagaagaacaggtcggcatcttttccttactgatgatgatgaaggaaaacctccattgcttgaacgcatgtggaaggataccatcaatgaaaaatatccacatgttgtatatgaagagcattgcaaagcatgttctgatgctgagcagtgtgactcaacagaagattacagctatgacaagatagaagaggggcttgtaacaggcttatctcgagtgtcttgggaaaaagtagatgttagcttccgcaatagcaagaatagatttgcttctcatactatcattcaggtcaaagaccaaatcacccaaatagaaggtgcagatgttatccagcatatgattgattattttcttgtctag

SEQ ID NO: 3107 - DNA, 618 bp, Glycine max
  Peptide Sequence Number=SeqID_119885
atggcaacaccaaaacagtcatatgagcagcaacaacaacaacaacaaccaaatgtgcagcgagtgaggaactcggggatgattaacagcaaccagagtccaatgagggatgacaaggaagaggagatgtcaagatcagctttggcaatgttccgagcaaaggaagaagaaattgaaaggagaaaagttgaggtgagggataaggttcacgcttatctcggtcgagtagaggaggaaacaaaacgattggctgagattagagaagagcttgagggtctcacagatccattgaggaaggaagttgcaatagttcgaaagaagatagacagtgttaacaaagagttaaagccactgggccaaacctgccagagaaaggctatgtttggtttgctggtcggagagctccaaactcactttggagagaaaagtgagtttgacatcatgtttgatttctttccaaaggagagagaatacaaggaagcccttgacgctttcaatgagaaaaacaaggaaaaagctcaacttgttactaaactaatggagctggtgactgaaagtgagaagttgaggatgaagaagctggaggagttaagcaaaaacgtagataccctgcattga

SEQ ID NO: 3108 - DNA, 183 bp, Glycine max
  Peptide Sequence Number=SeqID_119886
atgcgctccaaggacagaatcgcttacttctacgacggttttagattgtggtttacaaccgcaattgtggctgcaatatcaaggttttggtggcttccacaaccacattgccgcatttatttgcaatatcaaggattgcaggtgatgtcggtagtgtttactttggggcgaagcatccgatga

SEQ ID NO: 3109 - DNA, 645 bp, Glycine max
  Peptide Sequence Number=SeqID_119887
atgcgtgctgctgcaaaagttcttgtgaaaaaatttgaggatgaaggattacctacggtgaaggttgctattgttctcaacaatggtgactcatctttctctaatagagatagttggaatcatataaaaaatcttcgaaggaagaatctagatgttggagtcattgaagctgttttcaattattacgagtcagagagcacttttacatgtttgtttaagacttggctggaggcaatgggtggaaaaaaaaaccctgtatctatcctaattgatcaagatttagcaattggagctgctatagcaaaaagaagcgagagtattaatgctttttttgattcttttgttcatacaacaacaaccctccaagaatttgtggtgaagtttgaaaaggcggttgatagccggttggaggcaaaaagaagggaagattatgaatctaggcacaaatctcatattttgagtatttggtccaaacttgagaaccatgctgcatttgtttatacgaggaatgttttaggaaaatttcaagatgagcttcgaaagatcaatcaatatactaagaaaaagattaaaagagacggctcagttatgtctattgaatgtctagttgttatgatgcttgacatacctttattgttgatgtag

SEQ ID NO: 3110 - DNA, 315 bp, Glycine max
  Peptide Sequence Number=SeqID_119888
atggacacgagagactttggagatgttaagactaaggagaatatagcaactgctagtttgttacatactggagtagggaaacctgcttcattgtacatttcaaggcttcagatgtcggaagcaccattcagaccacgagaaaagcttgctgagaagcaaaaatatttccagagtatccacaggcatacctacttgaagggacccatggataagattacatctgtggccataccactggctttggctgcaacatcaatttacatgattggacgagggatctataatatgtcgcatggaattggaaagaaagaatga

SEQ ID NO: 3111 - DNA, 471 bp, Glycine max
  Peptide Sequence Number=SeqID_119889
atggtggttgcgcaacagaggggtcacaaaggtggctcgagggccgacggtggttgtgcgagggaagggcgcgatggtgttacatggcgcgatggaaaaaagaagagaaagagaatgagaaaagtgagaagtgggggagatccgacagagaaaagaaaagaaaaagtggtgagggaaagagggattctaaacatggggaaggctctagaagtgtgtggagaagttgtgtatcaagaagccaacaacaactacatggcaacaccactaggcataggcaaagaagaagagtggtacattagaatcgtgaagaaggtcatggtcgattacgtgctcaacgatcatgatgagtactttcaaatgagggtcgatgcattgcgtcaaataggcctatctccattgcaaaagtgcacaactgctctttgtatattggcttatggcttacctgttgacagtgtggacaaatgtgtttga

SEQ ID NO: 3112 - DNA, 543 bp, Glycine max
  Peptide Sequence Number=SeqID_119890
atgtcttcaagtcttcaagtcttctcaaactcaacaacttcttccttgtgctctaaaaataacacttataatgagatgataatcacattgaataaaacaggttccaaaaaggagttttcaaatagtgtcgttcttagccggcatgatgaaggaattcagaatctcttccatatcccaaatggaggatgttacaaggaggatgctcaaaacaaggagaaaaagagaagaaggagaagaaataaaagaaaaacactaggtttgctaagaggccctcaacctttctcactaatcttatcagaagtgagaagagaaaaagtaagttccgaggaagttcagaattgtgaagagttgaagccttctaaagaccatgttgggtctatcaaagattccttgttcaacaccgagaatatgcagagtctctttaactctcccatctttgacacttttgttaaaattatttgtggccttcattccttacatggtgaacccttaaccttttttcattccccttcctcaatttccttgcaagccagccactactaa

SEQ ID NO: 3113 - DNA, 1221 bp, Glycine max
  Peptide Sequence Number=SeqID_119891
atggctggcaactattacaatgtagtcattatccataaacaaaaagtaaggcttcttatttatctctgtttgggaatgggagatcgaggaaagcacgaggatttgcaaatggcgatttggatgagcatgcaacacacgacgccagagccatttaagaagaggaaagaaagaaacattttgcagaaaatgaagaaacgagctcttgtgagtccgtttcttctagatgattctgcagaagatatggatgaaagctgtttaggtgatccacctgggtctggtgacagtttatttgctgaagatgactgttcaaacaatagttatgacatgcttaaagatattgatccagttgcagcaaatagaatccatccaaataaccatagaaagataaatcaatatattaatttgtacaatcgcactggtgttcttcctagcaatatttttcaaggaaaggcagcagagtgtctttcctcaagttatcgccttgataagcgattacaattcactaatcaggcttcctcactatttccattttgttctgttggtggaaaattgatgtgggcatcaagtggattaataatggaagaaggatattcaattgctcatggtttattgcaatatatgaaatctaacaacttaagatatgattgttgttttatatgtgtggatgcatctctccgtgtacttgacagatatgtagagcagagggtagattgcatgatgtatgagggattactcaatgaagtctacaacatttataatttgaatgcagtttatactagaggtttgcgtcaggccattggtgtccgtgagtttgagcctcttcttagaacttgtgttgtcaaagacatgtatgaaagagagagggaattgactgaaggacccagcatagaaaagggagcgacattatttaatcgtaatttgatggagttggtgagatcttcctctaatactgaacccacaattcttttggaagaagcaattgaaaaagtaaagcttaatacccggagacttgttcgccgtcagaagaggatgctcagtcgactgcaaacactgtttggttggaacatacactatgttgattccacagaatcaatatcaagcaaatcagaagatgtatggacccgccaagtggttgaatctgctgtggagatagtcaaatctttcctgatgagaatggaagcttgccatccacctttgggacgtcaaatgacactgggatga

SEQ ID NO: 3114 - DNA, 300 bp, Glycine max
  Peptide Sequence Number=SeqID_119892
atgaatgggagcaacacaaacaaggtcgtgggcaccgaaaacgtatttctcgtctcaagagtaaggggcaagttcctggttttgtggaagagaaggatgagtattctgcgtgtgaacagtgagatatcttgtaaatttgaaatcccttccagttatgaaatgaaatatatacgggtactgttgttgacggcttgtcatggccgtgtagaaaaggcatggcctagaccctccgcgccgttctacatgtccctaactctcgcacccgatcgacgtttcgcgaacttggacagtgtttcttga

SEQ ID NO: 3115 - DNA, 351 bp, Glycine max
  Peptide Sequence Number=SeqID_119893
atggtgcaaaaaggtggtcctttaggtaaaggaaaacgcattgcacattctcccttagctcctactactccaaaggcaaccccttggttttctaaagagcactatgagccttcttacaagttcagctatgtgaagaaagagattattcaaccgaagttcctcaatttggcttggcttagaagtgaaggttttgcatttcctgagttgatagggtaccatgggttgaagaaactagtagagatgaagggcacctactacactagcttgatacttggcaccctttgttgcacaatatgtgaagtcctgagacgtgccaaaaatcaaaaggaagcaggcttacgcgatccgtga

SEQ ID NO: 3116 - DNA, 485 bp, Glycine max
  Peptide Sequence Number=SeqID_119894
atgaacaagaattcgctgctcgccctgggccttctggctgctctgccgttcgctgcatcggcaaccgatggcctgtcgtacaactacgttgaaggcggctacgtgaacaccgatgccaagggcggcgacgccgatggttggaaggtgaagggttccgtggcggtgcacccgaacttccacatcttcggcgactacagcgcgcaggagaccgacacgttcaagaatgacgtcgaccagtggcgcatcggtgccggctacaactacggtatcgcaccgaacaccgacctggtggcccgcgttgcgtaccagaagtccgacatgaagcatggcctggacttcaacggctactcgaccgaagtcggcgtgcgcaccgcgttcaacccgtacgtggaaggctacgtgatggccggctacgaggactacgccaagaagcacggcatcaacccggacggcgagttctacggccgcgtcggcgccaccgccaa

SEQ ID NO: 3117 - DNA, 715 bp, Glycine max
  Peptide Sequence Number=SeqID_119895
atggcaccgctgccggcttctcatacgcaccacgctcgatgcttgatgtgggcactgatcctgatcgcctcgccggtcgcgctgctgcaggcacaggcggctgagcgcatcgtttctgccgggcacatcgtcgtgcagacagacgatgtcacgcgcttcttcaaggtgatggacgccaaccaagggcgcccaagcgccgatgaactgcaacacggctatctggatgcgggtacggatgccctgcgcagcttcaccgacagccgtatcggctcgatggagcggctggccagggccatccaggacaagccggcattgtttgcgaaagcgggaacctgcgcgacagcattgccatcgatccgcacgcgcgtcgccgctgccgtcgatcagctgggcgccttgttgccgtctgcgcgctttcccccggtcaccgtactggtgggccgcggcaacagtggtggcgttaccaccgaagcaggcgtggtcatcggcctggaagcgctgtgcaacgccgactggatgcaggccgatatgagtgaccgcttcgtgcatctgatcgcccatgagtatgtgcacgtgcaacagcctggtgcacgcgtggaggtcgagcagcccaccctgctctatcagacgctgctggaaggcggcgccgagtacgtggccgaacggatctccgggcaaccggccaacgcgcatctgcagcgttggacgcagggtc

SEQ ID NO: 3118 - DNA, 714 bp, Glycine max
  Peptide Sequence Number=SeqID_119896
atggaagatgatgaggcatgcatcacgagtctgagccttggacttggaataatgggagggcatgctcaaaagaaggagaatgagcagaaagttcattgcttggacctatcctttgagctttgtccaaaagggaaagaagaagtagaagaagccattgacgtggatcaacaacaacaacaacatgctaataaggcaaaagggttgttgtgtttgaagcaccctaatgatgaaacaagccctgatagcaacaatagcaataacggtagcagaaagaaactgaagctcacaaaggagcaatcagccacccttgaagatattttcaagctgcatagcactcttaaccccgcacagaaacaggcacttgctgagcaattgaatttaaagcatagacaggttgaagtttggtttcagaacagaagagcaaggaccaagctgaagcaaacagaggtggattgcgagttcctgaagaaatgttgtgagaaactaacagatgaaaatcaaaggctgaagaaggagttgcaagagctgcgtgcacaaaagattggaccaacaccattatacattcaactctccaaggccacaaccttgaccatttgttcatcttgtgagaaactgttgaagccaaatgaagggaacaacaaaggagccatttccaatgtgatccgaaacagtagcaacaaattgaagaacagcatagagttagggggtatctag

SEQ ID NO: 3119 - DNA, 1347 bp, Glycine max
  Peptide Sequence Number=SeqID_119897
atgagctttgtagaatctcttcttggccaagatgtagcagaagttacttcaccctctaatgagtcacatgcaccaccgcaccaatccgaatcattgttttacatcctcggaggaatagttgtgctggccatagtgttgatttttttgtatgtagttcgcaagcgaattaaacggccagcacagacgatgacagttgcaactaatgagcagcaaggtagtttgagaaatgagaaaagtatcacaaagtttgggggacacaatgaatcggcagaggtgatgaagatgatattttcatctaatcaacactcaggatcaaaggagttctttagtgggaaccttcggactattagctgctttgactaccagacattgaagaaagcaaccaggaatttccatcctgataaccttcttggaagtggtggatttggacctgtttaccagggaaagttggtagatgaaaggctagttgctgttaagaaattggctctaaacaaatcccaacagggagaaaaagaatttctggtagaggtgagaacaatcactagtatccaacacaaaaatctggttcgccttcttggatgctgcctagatgggcctcaaaggttacttgtctatgaatacatgaagaacagaagtttggacctctttatacatgggaacagtgatcaatttctgaattggagcacaaggttccaaattattctgggagtagcgcgaggactacaataccttcatgaggattcacacccaagaattgttcaccgagacatcaaagcaagcaacattcttcttgatgacaagtttcatccaaggattggagactttgggctagctagatttttccctgaagaccaagcttatcttagcacacagttcgctggaactttaggttatacagctcctgaatacgctattagaggagagttgtcagaaaaggcagatatctatagttttggagttctggtgcttgaaataatatgttgcaggaaaaacacagagcatactttgccatcagaaatgcagtacctcccagaatatgcatggaaactgtacgagaatgcaaggatattggacattgtagatccaaagctgagacaacatggattcgtagaaaaggatgtcatgcaagcaatccatgtggctttcttatgcctgcagcctcatgcacatttgaggcctcccatgtcagagatcgtggcattgctgacattcaaaatagaaatggttacaacaccaatgaggccagccttcctcgatcaaaggccgagagaggatggtgagaaccatcctttggaagcattatcccagggtttcacatctcccatttatgtaaaagcatctgattga

SEQ ID NO: 3120 - DNA, 273 bp, Glycine max
  Peptide Sequence Number=SeqID_119898
atgtattacaacgggaagcagaacataccacgccaaggtgagtttttggattactcctttactggaactaatccaataagatttggcattccttcgggatgtgacatggagaaactcaaggatttaatcaagcaagttgcacctataggggttccccctaatggaattcacggatcacaattggaagaagggaagtcggggtgccagaacccgacttccgtgaaaagcttcaaacagtgctatagagccaagagatttcttgatagttattga

SEQ ID NO: 3121 - DNA, 1128 bp, Glycine max
  Peptide Sequence Number=SeqID_119899
atgtcaagtgcgttatcaacactttgtggacaagcatacggtgcaaaagaatatgacatgatgggagtgtatcttcaaagatcatcgatagttttgttcttaactgcactctgtcttcttcctgtgttcatcttcacaagcccaatattgatgctcttaggccaagatgagaacatagcacaagtggcaggaaccatttctctttggtcaattcctatcttatttgcttatattgtctcattcaattgccagacattccttcaatctcaaagcaagaatgtcgtaattgcattcttggcagctttatcaataatcattcatgtgtttctttcttggctattgactatacaattcaagtttgggattcctggtgcaatgatttcaacaattttggcattctggattcctaatattggtcaattaatatttattacgtgtggttggtgcgatgaaacatggaaaggtttctcatttttagcattcaaagatcttgggcctgttgtcaagctttccctttcatctggtgccatgttatgtcttgagctctggtacaacacggtattgattcttttgactggtaacatgaaaaatgctgaggttgaaatcaatgctctctctatatgtattaacatcaatggatgggaaatgatgatagcacttggtttcatggctgcagcaagtgttagagtggcaaatgaacttggaagaggaagctcacaagctgcaaaagaaaaaatagcttatctttttacttcaaacgaagatgtggttactgctgtgggggatttgtcacctttgttagcgctttctttgttactaaatagtattcaacctgtactctcaggggtggctgttggagcagggtggcagagcactgtagcgtatgtgaacatagggtgttattacctcataggtattccagttggaatagtacttggtaacattattcacttggaagtcaagggtatttggattggaatgttgtttgggacactagttcaaactatagtcctaactataatcacctacaaaactaattgggatgagcaggtaactatagcccgtaatcgtattagtaagtggtataaggtggaacttgatcatgaaacaagtacatcagataattag

SEQ ID NO: 3122 - DNA, 315 bp, Glycine max
  Peptide Sequence Number=SeqID_119900
atggctccacctaaagaaattgtgaccatcatttaccaaaatggtcacattgtagacgatctagttcaaggatcgacatacacatctcaactattcgacaatgatgatcttagaggcgcgatggaaacaattcttcagaatccacaattgaattatgccgaattctatgttgttactgagcttattcctcaaccacaaccatcatctccacaaccctcatatccacaactacaactaccgcctccacaacagttaccatacaacaatatagatctcaataatccagtatcttcatacaacaaccatgccacctaa

SEQ ID NO: 3123 - DNA, 690 bp, Glycine max
  Peptide Sequence Number=SeqID_119901
atggactttgagattattaacgaatctcctgattccacttcactctcctccccctcttcactctcaccatgcacaccaccaaactctaatccactaagtgattctccaaatccacaaccaagtaatatatataccaatccatctcacaagagaaaagcaggtagaaagaagtttagggagacacgccaccctgtgtataggggtgtacggcaaaggaacaggaacaaatgggtgtgtgaaataagggaaccaataaaaaaatcaaggatttgggtagggacataccctactcctgaaatggcagctagggcacatgacgtggctgtcttggcacttagtggcacctcagcaaacttcaacttccccgattcagtttcccttctcccacttgcaaagtcacgttctgctgtagatataagagaagcagcaaaagctactactactgctgaggctttcataccaaacacggtctttgcttgctctcacaagaatgctgaagacacttgtttgaacattggcatgcacgatgatgggtccgaaatgttctttgatgaggaggcagtgtataatatgccagggttgttggatagtatggcagagggtttgcttattaccccgccctctatgaaaagagctatggattgggacgatatcggttgtgtaatagacctcactctatggacaaattaa

SEQ ID NO: 3124 - DNA, 435 bp, Glycine max
  Peptide Sequence Number=SeqID_119902
atggtggttgcggtagaggtggcggtggtgcatttacggcaggctgctgctgtgctcttgccccaaatgtgcctgccttggcatgcaccatttctaaatgaaagacctattaatgggaggctggattggctttgtgggcataatcggcaccctatagaactagcagagacctgtgatcaaagttggaaatcccagtgctcaattggacttttctgggtccactgggtgtcttggaggtgtgatacctacaaattggatagtgtagaccagctggcatttaggcagtggaagatcagaattatggttgctgggaaggatgttgttgaggagaagcgtcatccagatctgtgtcaaagtggtcatgctagtgctcatgatccgcacccaccttcctgttacacttcatgcaaagtcttgtctcggggagcacagtag

SEQ ID NO: 3125 - DNA, 549 bp, Glycine max
  Peptide Sequence Number=SeqID_119903
atgaggtccttcaatggtgattttccaccatggagatgcagcggaagatataggagaagaggtgagaggaggcgccatccactagggaatgagccatggaagaaggagcttcgccaccaagaatgtgccttggataagaagcttggagaggatgcttcaatggaggaaaagaaagagagagagaaagagaggacccaaccttggcccgttggctcagaaatctaccctgaggttcatgagaaccccaaggccttctttaacagctctagcctaatcctcttggagtcttctatccaatacccttggggggggcctgatggttatgcttccagtattggaaaatgtgtagatacatcttctaaaagattgattgggatgaaaagcaatgattgccatgtttttatggaatgtctacttccaaatgcttcaagtgcttttcctgaacctatatggaaacccttaactaagctcaatcagtcttcagatatttatgttcaacaacgttacaggaagatcgtttattgcaaatggaagaaaacattcacatga

SEQ ID NO: 3126 - DNA, 192 bp, Glycine max
  Peptide Sequence Number=SeqID_119904
atggaaaaatttgacaggaaaaccttcaaagataagaaagcaaagaaagcttacatcacatgggaagatagtgatatggattcatccgaagactcggaaaatgaagttgtaaatctgagtctcatggccaaaaactatggaagcgatgaagagatgcattcaatgacttacataaagaaaaggaagttttga

SEQ ID NO: 3127 - DNA, 960 bp, Glycine max
  Peptide Sequence Number=SeqID_119905
atgtggtttcctggcagttttcccttcaccagttatcccaatttcgtgaatattaatcagtgcacgcttcgtgttcgattaattgcctctgagcctaacttgcgttcatgcttaatggacgaagggctaactggtgaacgtcctgaattgaagctatccttccatggaaagaaggttcagaaatttgggaggcctgctcctgaaattgaagggctagtcactgccataggattaagtcctttgatcgcatgttcattggacattgacgatcaaggacttatatcggcttttgtggagaggtggcataaggaaatgagcagtttccatcttcctgttcgagaggtgaccatcaccctcaatgctgtggcctctctgcttcatcttcccattataggcacattccataacttcgagactcttcatgtcgacaaaggggtcttgatgttggtggagttacttgaagtctctggagatgaagctagagttgagacaatacaatgtcatggggcatactgttggatttatgagcaatttccctctattgctgaggcttttacggacccagactatgatgaatggtcaccctgtgcctgccagtggacttctacgaaggcttctatgaagtcattactagcattgatgtatcggagacgtcgagatcgactgacaattgctgatgtttgctggatgccttatgatgactactgtgcagtgcgagattttgatctaatttcatgcctttcaggacatatccaatggggtcctgttgtcgtgatacatcgagcagagagggtggtgaggaaatttgggtatgttcagaccattcctccacacactccgggttcaaggttatccttggaagatattgatgatagatggatgcatttctctgactatcttgcaccaatggggcagatttgtgttgtgtcaggacaatgtgcatcagattacatccactag

SEQ ID NO: 3128 - DNA, 147 bp, Glycine max
  Peptide Sequence Number=SeqID_119906
atggagatgaaaggctccgtacgcgggacgctgggatgtatgtggtttataggcgttcagaatccagacgaggttgagccatggagacaaaaagatgaggagatgaaaaaacgtgaagaatggagtctggagagtgagatacgttag

SEQ ID NO: 3129 - DNA, 174 bp, Glycine max
  Peptide Sequence Number=SeqID_119907
atgtggatagtggcagcaccagccatattcacaaggtttacgacctttggcatcaatgttataagccaagcttttattggtcatattggttcaagagaactcgctgcctatgctcttgtattcactgtcatcatacgtttcgccaatggtattctgattttcagagtgctttaa

SEQ ID NO: 3130 - DNA, 1395 bp, Glycine max
  Peptide Sequence Number=SeqID_119908
atgccaggaaccatcatggtttcagtactggaattcatggatcttccattatcttcatcaacattcataagggcttccttggggaaaatagagtaccaagtgaatgacaagggaaacttatccttccccttaactagcctccgcgatgatttgatcttccaaattcttgattctgaggggaatgaaatatcacatacaggtgttcaaataaaattgatattggagaaaggtgttttggaagacaactttccccttggaggtggccatctgcgtttgaagttgcaattcatccttagtgatgaagagcgcgacagaattcgttcattgagacaatctgcattaaagaaaaaacatgatgagcttcttagttccagtagaagaggtgaagaaagcgatagtagaaccgtgattggaaatgctgcattgcccttccgcagaaatgatgaggtctcagaatcaccaaagatacaacatcaacacgaagcagatccccaatcgcgaggtcctgctggttccggagacggcaaagaatctgaaactagaagtgtagttggagctcagcttgagcagaaaaagcagctaaccacaaacattgcagatcaatatagggagtcctcatacacaaaacctgtgtcacaaaatgttactctcactcaattacagcaaaagggtaagaagcctgcttatcagtcatcatctccagatcgatcaccatctgagaaacatcctcagagaggtattggttcggaagaaattgcagttttgtttggctcagaaaaaaaagatgccctgacaagtaatctgacacaacctaaaatagaggaaagtgatcttcagtattctaagaagaggacctcactggggagaattccaagtaatgtgaagaaaatgataagtgcctttgaaggtggattggatcaggataagagacctcagattaaaccacctccaacaaaacaacaagaaagttcaattgaaagaagagattcttccaagactcagcatttggagcaagataagtcaaagaacatagacccagcagacttgcaagaaagggtgaaaagtgcctccctggacatggtgcagttgaaagaattgagcaccttaaatatactgaacagacatattcagatggcagaaataaatccaaataaaagtgtaaggggctattgtggaaagtctagaagattggatttctcaaaaatagaaaatgtggaaaagaatgaagcaaatgatggaactggaactgaggagagcgagtatgaaaagatacaggaaactaaagaatcaaagcccaagacttctgataataatggagatgaaaattctggaggaccatttaatcaggttataatctgtcaaactaaaagagaagaacagaacataagaacatga

SEQ ID NO: 3131 - DNA, 261 bp, Glycine max
  Peptide Sequence Number=SeqID_119909
atgttctcttccttcttcgcaattgttggttatatgtctacagtctacactatggaatcaaactcatgtactaggaggttaactacaactcacacacactgctcaactgagctagacccccttagttctctaaaattaggattacagcagactctaaattccctgtctttgcttactactttccctcaatttgcctggaactgttacagatgtgaaatatacattccagcagaagactgcattgttggtttctacagttaa

SEQ ID NO: 3132 - DNA, 657 bp, Glycine max
  Peptide Sequence Number=SeqID_119910
atgataccaacttatcgttactcagtgtcttcgcctatgcctatagatcttaatgaagatcacacccaccacgtcttcagtacaagccatcaagcctcttcttcgtcttcttctctatctttttctattctcttcaacccggatcatcaaggtcaaggaggatcttgttgccactgggaatcaaagcacttacaaagtgatgaagaggtattctggtcagaaggactaatctctcgggcccagaagattgttccttctagtgaatcatgggagcatccagtatctgaaaaggatgaaaacagaagtgatctcaagctgagagtttggaagaaagaagataagtgtgaaaattttcaagttgaagataattcaactaagtggatgcctttaaagatgagaatgatgcggaggatgatggtgtcagatcaaacgggttttgatacagaaggcatgatctctaactctaagcagatcaagaatgaagagaaaaacccaccactgacacctctaggaactgatgatagtaataactacaattcttctgcaaaccacagcaagatcactgttagggtttgttctgattgccacaccactaagacccctctctggagaagtggaccaaaaggtccaaagatcagatggttcaacagtgtctaa

SEQ ID NO: 3133 - DNA, 186 bp, Glycine max
  Peptide Sequence Number=SeqID_119911
atggaggttgaggaaccttggttggggttatggctaccattgaattatcgagtggatatgggatcaagtttagcatatgacaacggaatttggggtgaaccctacaggctttttgctgcaaaattcctttttgttggtgtaaaagggatggcctttgtggataactgggtggtgggtaaggaggag

SEQ ID NO: 3134 - DNA, 195 bp, Glycine max
  Peptide Sequence Number=SeqID_119912
atgggatcgagtcaggcgccctggcataaaaagaggttctatcaagtcaagatcaagagcctaggagtcgccagtctgaaagagttaggacagttgatgggtcaagtccagcgacaagcctttcacaaggcctatgcctttgaggtgcttcacctttggggacttccagttaacacccacggtggaagagtttga

SEQ ID NO: 3135 - DNA, 171 bp, Glycine max
  Peptide Sequence Number=SeqID_119913
atgttgaaagatcaatcagacatcactaatcaacaagagtccaattcaatatggatacataaaggcaatcaaggggagttgggagggaaagttaacatgaatggctataagaaaggagttgggcagaagacagagccaggaaaagtagagggcagtgagggagagtgctag

SEQ ID NO: 3136 - DNA, 1170 bp, Glycine max
  Peptide Sequence Number=SeqID_119914
atggatgaagacagcaaaatcattgaagagctacgtgatagcaataattatttaagggctcaagtatcacatcttgatagaactctgaagcaagcacttgcaagtcaagaggagctgaagatggcaaatgatagtgaaattctcaagtccaaagaagccattaatgacctgaacaagaaactagcaaactgtatgagcactatagatgctaaaaatattgaacttttaaatctacagacagctctaggacagtactatgctgaaattgaagccatggagcatttagaaagggagttggctcatgcaagagaagaaatagctaagctttctcaacttttgaaagaagcagatcacagagcagatgtatcaaggaatgaaaaagaagaaattttaggcaagctttcacaatctgagaaggtgcaaactgaatggagaagtagagtaaccaagcttgaggatgacaatgccaaattgaggaaggttcttgagcagagtatgacacggttgaatagaatgtcgatagattcagattatcttgttgacaggcgcattgtgataaaattacttgtaacttattttcagagaaatcacagcagagaggttttggacctcatggttcgcatgctaggattctctgatgaggataagcagaggattggaggtgctcaacatggttcgggtaaaggtgttgttcgaggagttcttgggctgcctagccgcttggttggaggcctcttgggaggaaattcgactgacacagctgcaaatgcaggatctgataaccagttgtgcggttgtgccttaacattgaacatcttccttatttataccagcagatgcttttcttttgcagatttgtgggttgattttcttctcaaggaaacagaagaaagagagaagagagaatcatcagaaaatacaggtaaagccatggaaaattcttccgataaaagtccttatactatccctgtcactccaccattttccaatcggaggtttgatgctggaacaccatctgcttttcaaattactccaacaaatcaaaacatcagtcgtccccctcgtggttattttcagcattctgaacattttgattctgagttctcaacagttcctcttacatcatctgatggtaaaactactagttcaaaccagcatccgagatactga

SEQ ID NO: 3137 - DNA, 735 bp, Glycine max
  Peptide Sequence Number=SeqID_119915
ggcaaagcgattgggtcaacgcgcggtgtgagaatttcctgcaaggtgaaagattgtgtggttttggatgagaacgtgaattcgtacggtcaattttcggttccggtgaagcaagggtcgaagcagagcaaagaggaggaggaagagaagcagaattactatgtgaatgtgggatatgctatccgaactctgagggaggaattccctgatcttttctacaaggaacttagctttgacatctacagggatgatattgtgttcaaggatcctatgaacacattcattggtattgagaattacaaatctatcttctgggcactacgatttcatggcatgatgtttttcaaagctctgtgggtggaaataagtagtgtatggcagcctgttgagaatgtcattatggttcgctggactgttcacgggatcccacgagttctatgggaaagtcgtggtaggtttgatggaacctctgagtataaacttgacaagcaaggcaagatttttgagcaccgggttgacaacattgctatgaattcacctcctcggttcaaagtgttgggtgtggaagaattaattcgatctattggctgcccctcaattgcaagaccaacctattttgaaatttcttcacctcccaagagaacctgtgagaaaatggtcttttgccatagacttggctatatggttctattggcaccagttatagggtcagtgttggctattgtgactagttga

SEQ ID NO: 3138 - DNA, 303 bp, Glycine max
  Peptide Sequence Number=SeqID_119916
atgtggggcaccattgccaatttgaaggagaacctcaacaagatcgccctcgatgttcatgacgacgacgacgacgacgaaattttccgagtgtacggtgccggaagcccatccaatggcggcagctctgccgtctccgatcgccggagctcccacggctccgtccgttccagatcggggattaggtcgccgctcgcaaacggcatcgatcatgcctctcttcctgagattagtgaaatttcaattctaattggaaaacaacataatcaacaccttaggaactatatacaagttgagaaatag

SEQ ID NO: 3139 - DNA, 522 bp, Glycine max
  Peptide Sequence Number=SeqID_119917
atggcctttcaggatcatattgttaaattaaataaagaaaatggctcactaaagcagaatttggaggctacaaatgctgctctgcgtgtctccagaatcgaaggttctggagcatctacaaatggcacttatacagtcaagggaagtagtgatcagtcacccaatcaacagcataagttcaacactcaacggaaaaatcggtatgctataaacaatggaaccatgtctgctttggaatctgatgctattcaaagtgagatggaaatcaaacattcaaatttacaaggaaatcatcaggagcttggagatttggttgatggaaataccacagtagctgtacaacatgccccagaaatacagaagttgaggttagaactagagcaagaacataatcaattggcgaacattcagctaaaattccaagaggaacagagattcaacaagtctttccaggaggagcttaacatattaaagttggaaagagacagagagcatacttttgaacctaagagagctatgtga

SEQ ID NO: 3140 - DNA, 1074 bp, Glycine max
  Peptide Sequence Number=SeqID_119918
atggatttaacagccataattgctcaacctgtgattgggtatccttgcgtcttcaacgatggctacgaattcgattacctcatcctccttccgaatagtctcaaccagaatccgtctctctctcttctgcaaaacctcacttttccttacattccccacaaaagtctttctcaaaacccatcaccttccacagatttcaaccatcaccaccaccctcatcatcatcaccatcagcatcccttcaacccatcgaagaccttcctcccaagctccaagggccaatccgtccccgaaccaaaagccaaatacgaacagctcatcttctacggcaagaacctcaaacccctcgaaccccaattcaaaaccaacgacaacaaggtccaaggctgcgtctcccaggtctgggtccgagcctacctcgacccgaaccgaaacgtcgtctacgaggcggactccgactccggcctcaccaagggcctcgccgcgctacttgtccaaggcctctcgggtcgacccgttaatgaaatcattcgggttacgcctgatttcgtcacgctgttagggttacagcagagcttgaccccttcgagaaacaacgggttcttgaacatgctgaaattgatacagaggaaggctcttatgttgtacgtggaagctgaaaagggtggtgaatctgatggcattgttaagaattcttcaagtggtggagaaagttctgaacttggtggtgattctaagataccattattggaattgggggggagggggaagaggggcattgttgagaattcaagtggtggagaaagttatgaacttggtggtgaatctgagataccgtcagtgtcagcatcacgtggtgatgagaatttggaattgggggggagggggaagagggaagtggaagaagtgtcttatcagcatgcggggcatgctggggttagagggagtgatggggagacacatttcaatgtgagagtggtgtctatagagtttgcagggaagagtttggttaagaggcagacttatctatggcctgctacaagagcagttggatgctggactgcacacgattga

SEQ ID NO: 3141 - DNA, 258 bp, Glycine max
  Peptide Sequence Number=SeqID_119919
atgaggcttcattgttatcaagcgagtcagagacctagtatgaccacaaatcgacctccactccttgtggctcacatagacctagtccccagtggagttgccatctgttgcaacctaccctacgatggaagggcgaggcaaaacgccaaaggtgtgtcttctaaagagaaaacacgtgggagtcgccaccaacctttattggaggaaaacattagaaaaaccaaaaagaggtatgcaaatattgaaaagacaggttag

SEQ ID NO: 3142 - DNA, 189 bp, Glycine max
  Peptide Sequence Number=SeqID_119920
atggagttggagcacccgaccgcgacgccgctcaactccgccatgacctacgacgaagcctccatggagcgcagcaagagcttcgtcaacgccttgcagggaaaattggtcaccgtcactaattgtcataacttgttgggaattagcgtctatcgagtcggtgatggttcagacttcagaatgatatga

SEQ ID NO: 3143 - DNA, 2383 bp, Glycine max
  Peptide Sequence Number=SeqID_119921
aaaaaaggactcctgcactggtgacaaaaagaggcaatctgcatcttcaccaaaaggatccaagttacctccggtttgtctgagagttgatccactaccaaggaagaaaaatggcaacgggagtttgagtttgagttcaaggtcgaggtccccaagtccaccttcatcaaaagggcaatcccaagctacaactggtgaaacattcaagactcctgtgagtggaacacatgataaaggtcagccaaattcggatcatcagaatgggccaacaaacaccagtgagagagttaaaccaaaggagaagaccattccggtgtcagaaatatgcaagactaatgaaaaccagggtgttgagtgtagggatggatgtcaaagccagataaatgtaaacatacctagtgaagatccgaaagggacaaggggaacatgtccagatggtgatgacttcaagactgaagataaaaaggcagataaaggggcagataaaatgagggagaaaactgcagaactaaaagatgtgaaggattcaagcgcacaaactgacgcaggtcaaaaggaggtaagagttctgtcagatgcagatgcttctgttttgatacaagctgcatatcgcggacatcaagttagaaaatgggaagcattgaagaagttgaagcagatagatgaagtcaggaaggaggtgactgatgttcgagaccgtgttcaagcctttgagagatcttctgatcttcaaaatgatgacaagcaaaaaattgcaattggagagaccattatgagactcctgctgaagttggatactatacagggtttgcatccaagtatcagggagatcagaaaatccttggctagagagctgacaattttgcaagaaaggcttgattatataatggccaagaaacctcagcagcaggtgcaggatttcaatgttcaggaacatgttgaagtcactccaatgaatatgcagaatgaagaacaagttgctgtaccagcagactcagctgaaggcattagtgatgatgcaaaaggtccttgtgctaatgttggtggaagtgaatcccagtcaccagttgatcctacatcagataagggagcagagtctgttgtgcttccgaatggctcgcataatgatgatactagccaagtggttacagatgacacattgaattctacaagtgatctgtctgagacggacaaaatggctgtggaacccgaagctaaatcagaagcgaaagacattcccactgcggaagacattctaaacgaggttgataaattgtataagactgttttggaagaatttcctgtgggagttgttgatgaagatatcgatgatgttattattgagaaggaagaacaagatgatgttagttctggaagtctccaagccatggtggatgattcggcacgagatggattagagaaccatgcaatgatggaaatgccagtgggattatttgatgaggatgaaaggaacaatgaaatgaatatttctaaagagggaacacaaactgagaatgacatatttattgagcttcctatgggactacttgatgaggatacagcaatatctgaagttaagaagcacgatcgagctaagcctaaaacatataaagaggttctactagctcaagaaggggaatgcaatgcagatgagaaaacaagttcttcaacagataacactgcgaacgaaactcaactagggcaacagcagaagctggaagagcaaaaagaggtgcattcttctggggaatgctgggtgaaaatcaagtaccaggaagaaggtgaactcaatggtgatgcaccaatagatataagaactgagtgtaagtcaggtgaggaagttgaaaatgatactaagttacctcctttgacaacacaagtcaatgatcatggaccaggaaatgaagatgtatgctcaaaagcaaatgatgtaaataacatatcgcccgaggccaagccaatggagttagtaccttccaatgaaacacagaaggaggaggaaccagaagagaagattgcacttagggagacacaagagatggttactgagcaggcaattggtgctgatgataaagacccagaagctttgtttaaagagaaaaccgaactatcttcgcctccacctgcattacaagaacctgagctgcctgcggccatgcgcgatggagagttcaacggtgacacgaagttactggaagagaatgagaatttaagggagatgatgaagaagttgcttgaagccgggaatgaacagttaagcgtgataacaaatttgactggcagagtgaaggacttggagaagaaactagccaggagcaggagtaagagagtgaagacaaaacggtatagaccagcaacttccaaaatgtcttgcatgaaatga

SEQ ID NO: 3144 - DNA, 621 bp, Glycine max
  Peptide Sequence Number=SeqID_119922
atgatgatgatggtcgaagggagactagctagggaggtcggttcatttttggaatttggtgaggaagttgataaagaaggaactagtgtttatgtgggtgcacttttgcctgatgaattggtggagcgtatcctagcctatctccccccattgcaagcattttcagagcaagatgtgaagctcgatgggcctctaggtttgaaatctcgtgactacaatgcattggcaatgtcaatgaataaaaaatcccacaattacaaagtggcaattgtgaaatcaaagcaaatccctgaggattttgtccagtggggtatctcaattcatatatacgattcaaagaatgagaccaggatgacaaattcaacagaggttttgatggggtggagaggtgtttactcagtcatgggtgttccatcagaaagttgtcatgcgctgattgcatacgatatctcccattgctcttcgcaaactaccttgagaaggagctttattgctctaccttgttcaccaacatgtggtcgtctgatgaatatgaatgagaagcttgtaatggtgggagaaattggtaagcatgatcgacccgacataacaaaaagagttggagataactctaaaatttga

SEQ ID NO: 3145 - DNA, 207 bp, Glycine max
  Peptide Sequence Number=SeqID_119923
atgtcactcattgccatcattgtgcaacccaaactacacccacaccaacagatttatgcgccacaacaccatcgcacaatggggaaatcgcacaagcagagccttggaggtttagtcttgcacacaaatggaggtgaaatgatggtgtggcgagcgccatgctggttgctacaccaagggggtcatgcacacaaattcagagtctag

SEQ ID NO: 3146 - DNA, 636 bp, Glycine max
  Peptide Sequence Number=SeqID_119924
atgatgcctgcatatagaagcatggactcatacccatatcagagaaaccaaatacctttcccacattattatcatcctggcattgaacctattcaccctcaaatgaagcttgatccatccaaaccacccttttcttatgaccaacattggccatatgctggcaacttagggcaccctattcccccacatttctgctgtggccacaacaacttcccttgtcattatagctacatgccttcaaatcctcatgctccttctccaatgtactattctggaacttgtccttcatatagtgaaccatattttgttccttattcactacaaccacattatactatggatctgcccagccaaaaggaaggtagaagtgtgaagattgaagaacatgaacctgatggtggaaagaaagtgaatgatgctttggctccaatccagctcaagaattacccatatcccttagtttggattccacaggagtacacaagtaacaaacagctgaagaatcctaatacaatggaagttggggaacaagacaagtctcctcgttttgagaattctaatgctgatgcacagccagcacaggatcctagagtatggaatggatggcttcccttcaatataaagggtgccccgaac

SEQ ID NO: 3147 - DNA, 1980 bp, Glycine max
  Peptide Sequence Number=SeqID_119925
atggataggagagaaaaaagtttagagggaggggacaaaaggggttgtggattaatggtggaaaagttgagggaaggggtttcggtggggaaaaagggagggcctagtactccaccacccacatggagacttgagcaaaatggtggtgataaggttcaagagtttcttaacttttccacttcaactctttctgctagaaagctctgtgccaacctctgggaagttctgccccaccaccaacagcaacaacaacacaccccacttgtcaaaatgaacaagcttggcaccaccctccgccgccgccggagccaccgtaaccgccgccgccggagccaacaccctatggacactggctctgaagtgaacaacaacagccaattagctgagcctccaggcaccccttctgattctgatcagctggcatcatctgctagtagctcgaggaggcatgttgcagcatcacctgttcagcaccatggatcagtggaaagaaatggctgtgctctacagcctgtatcccctgcctgctacagtagctcagaggaagtgacttcatataaatgtacagtaacccccacaagttccgtagacttcaaaggtagaattggagagtcaagttacaatcttaaaacgtccaaagaattacttaaggtactcaaccgtatttggaaccttgaagaacagcaggcatcaaatatatcagtagtgaaaaccttaaaaatggaactagatcgctctcgggcacagataaaggagttactacgagagaagcaaatgaataggcatgaagtagagaacttgataaaggaaattacagttgacaaacttattaggaagaacaaagaacatggtagaattaaagctgcagttcaatcaatcagggaagagctagaagatgagaggaggctacatcagcattcagaaagcctccatcggaagctggctagggagctttctgaagtgaagtcttccttctctggttgtttgagaaatcttgaaagagagagaaaagcacgaatcctcttggagaatttgtgtgatgagtttgccaaaggaataagagactatgaacaagaggtacattctcttaggcggagttctgagaagggtcagggtcaggttaaagggaatgatagccttgataggctaatacttcacatttcagaagcttggcttgatgagcgcatgcagatgaagctagctcaatctgacggtggtctcatagagagaaattcaattgttgacaagttaggttttgatattgaaacatttcttcatgccaaacgatcagttgatttgaaaaaatatggatactcctccccaaaggagctcaaggaaattcacccttgtcagcagtcattggattccttcccactaaaagaggctggaagtgcacctcaaaatatggctcaggaagattccattgacaccaacttttttgagccaaaaatggctaatggtgaaggactccaaaatatcagctccagactgcaagcaaacatgagcaggaacatatcatatgatgataatgagaggttttttgctgataggaaatcgagcgaaatgggagaagacaacacagctctactaaatgaagagaccagacatgatccacaagagagtgatataccctggatcctaagaatgagctcaagtcacaggccagatatcctggttgcaaacagttcgatgtcatcagaaggtgataaagtttatcccgagagtatttgcaaggaagattcttgtgttaagtctgcagttacagctaatggtagtcctgcaagactgtggaaatcaaagttgtctgcttcggattttgacaaatctgagtcttctaccaaattgcccaagggagtaaaggaaaacacactgatggcaaaactccttgaagcgagattagaggcacagaaatctcgctctagagccagcaaaagcacttatggatcaactagagaagcttataatgagaatatggaatag

SEQ ID NO: 3148 - DNA, 171 bp, Glycine max
  Peptide Sequence Number=SeqID_119926
aagttgaagaaggcagagaccttaatatgggtggactttgtggagtgtcctaaggttgaagtagtctatggttcaagttggaaaagtggggaccttgaaatggaggaccttgacatagacttgatggggaccttgatatggatttggtggagtggccagcggtttctctag

SEQ ID NO: 3149 - DNA, 198 bp, Glycine max
  Peptide Sequence Number=SeqID_119927
atgtatacttgggagttgacacttgacaatatccaaagaatcaaattggttaacatggcacgaaaggccatgccagaaaacttagaaatgtccactaaactccaaaaacagctccaagggagaaagtttgtggctcaagaatcctatgcctatggttcacttctctatacgccaaaacctcacatcactcctccttga

SEQ ID NO: 3150 - DNA, 1803 bp, Glycine max
  Peptide Sequence Number=SeqID_119928
atggtggtgaagaagccacggattgtgataattggagcaggaatggcaggcctaactgctgccaacaagctctacactgccacagcctcaaaggacttgtttgagctgtgtgttgtggagggtggaacaaggattggtggaagaatcaacacctcagagtttggtggtgaccgtattgagatgggagcaacatggatccatggaattggtggcagccctattcacaagattgctcaagagatccactcactccactctgaccaaccttgggagtgcatggatggcaacactgtcactgatgatgccaccactatcaccattgctgaaggtggcttccacctccaccacccttccattgttgaccccatcacaaagcttttcaacaccctcatggaatactctcaagggaagctcaatgataccacttcaaagggtggaagtgaacttgaaagctatcaaaagttggctgctaaggttgcttctgtttctgcttcttccaacaacaacaacaagaacaaccttagtgttggttcttttctcagacaagggcttgaggcataccaggtttcaaaggaggagcaagaggaggtgaaagggtgtgggaactggagcaggaagttgcttgaagaagcaatctttgcaatgcatgagaacaaccagaggacatatacttcagctgatgaccttttcacactggactatggtgctgagagtgagtacataatgttcccaggtgaagaaatcactattgctaaagggtacttgagcataattgagtacttggcttctgtgttgccacctggtttggttcagttgggtaagaaagttacaaggattgagtggcagcttgatgatgagaagaggaagaagggtggtgctgtggaaaataatggatgttgctcttcttcttctaggcctgtgaagctgcatttttgtgatggctcagttatgtatgctgatcatgtcattgtcacagtttcacttggagtgttaaaagctgctattcttgatgatgatgatgatgattcgggtatgttctatcctcctcttcccccttccaagactgaggctatttcaaggcttggttttggtgttgttaacaagttgtttatgcaattgagtccaacacatggaggattgaaacaacatgaaaatgaacaatccgacaaagggttccctttcttgcaaatggctttccattcacctcaatctgaaatgaggaacaagaaaataccatggtggatgaggaggacagccacccttttccccatctacaacaattccagtgtcctcttgtcatggtttgtaggggaagaagcactagcacttgagtcactcaaagatgaagagatcataaacggtgtttcatccacagtctcattctttctacagcatcactctcagtggcaaaagggttccaccagttgtagttcacataaactgtgcaatgggaatgtgaactctgatgagggaagatctcactacctacaaaatgaagtgaagtttagtaaagtcttgaagagcaaatggggaactgatccattgtttttaggctcatacagttatgttgcagtaggatcaagtggtgatgatttagatataatggcagagccattgccaaaagataacagcagttgtcaagcttcttctgcagcttcatcatctccacttcaaattttgtttgcaggggaagcaactcacagaactcattattccacaactcatggagcttacttcagcggtcttagggaagccaataggcttcttcaacattaccattgtgttgggatttataacaactag

SEQ ID NO: 3151 - DNA, 1002 bp, Glycine max
  Peptide Sequence Number=SeqID_119929
atgtctcatccatcacgaacacgaacggagagagacataaaagaaaggcctaaggaagtgaaatcttatttctctcattttcaaggaaatcaaagtgcaccagacggaagttcctatggagaaagccaccattcctttgctcttggcttcttcaattgggcctctcagcaacccggtttcacccacacgcccttcatcttccactcactcctcaagtccctctcacacaccaaccacttcactgccattcactcactcctcaaacaggccaaggccctgaactttcccatcctcccttccttgttgagctccattatagcgtcccacattgctcgcaactctgcccgcgaagcctttttgctcttcagtggtgttggctctctctgtagtgaaattggaggggctacatgtaacttcctcctggctgcccttgccttggacgggtgcttgaagagtgcccacagggtgtttgatgaaatggctgagaggggggttggtttctgcatgctgggatttggggtcttcgtttggcgggtttgtggagaggatgatttggagaaagtggtgagtctgtgttggaggctttgtggatgttggatgaacttgggcaggggatggaagcctgatttcatggcttactgggttgttgcagccgcattccggtcaatgggaaatgtggctgatgaggtgaaggttttgaagatgaagaggaagttaggggtggctcccaggagtagtgattacagggacttgatacttggtttggttttggagaggcggatttgtgaagcaaaagaagttggggaggttatagttggtggtaattttcctgttgaggatgatgttctcaatgcattgatcagatcagtatcaagtgttgatcccggtgcagtgattgtgtttttcgatttcttggttgagaaagagaggttccctactattttgaccatcagcaatttgagtaggaacctatgtaggcatggcaaggcatggcaagtttga

SEQ ID NO: 3152 - DNA, 462 bp, Glycine max
  Peptide Sequence Number=SeqID_119930
atgtatgagtatttgaatgatgcgtcaaagagcacgacccgacaacttgcaggatatatcacattattacaatgttggatttacaagcactttcctattattggtgctgctattgctgctgaggattatgatgagaggaaaccacgtgcatgcctttggaagtctgagaaggcattatcagtattgacgtatcataagcgtttgcatagattgacgtctgatgccgtgtgctggattccgtatggggagaacaatgcatttaaagagtttgaggttatctctttatttttcgagcatattagatggggaggcttaccaagcaatagcttaaaggttggaaagcttgctcaacctaaggatagcgatcgagggaacaaaagcatacactgtcaccaaagaatgcctgaggatcgcaaaaggtgtcattgtgcaacggaatgtctacgttcgatcgagacgtag

SEQ ID NO: 3153 - DNA, 660 bp, Glycine max
  Peptide Sequence Number=SeqID_119931
atggaattctacatggatggtagtggtggtggagcatgttcgtatattgaatatagtccatttagttccaaaacttgcaagggtttagaggacactccaattgatgtggttgctggagatgtgtgtgatagtggtgaagatgactgtattgatatggaattagatgatggatgttcagtggactcaatagaagggagtgatttttctataactgataatgaaggttactgttttgatacagaggtgaaattgatggaaccgccaatgaagacaaggaagggttctggagcaagaaagggcaaaatcttgaaaaataagaaaggtaaaaaattttgcgacaaacttttttgtcataggaaaggaaaaagagaggaccgtgggttgacaaatgagaagcacaaaaggtatataaggcgaaaaacaaggtgtgggtgtagaacagagtgtagggtgcatatcggcattaactcaaggcttcggtatgtatcatatattcataatggtcacagtcatgagttgctgaacgatgaagaatgcaggatgttgccaagtcataggacaatgagtgactttgatttaatgcaagtgaataatgagagttgttggcataagtacgccacaaatctatggagcaactacatatcagtgtggaggttatga

SEQ ID NO: 3154 - DNA, 450 bp, Glycine max
  Peptide Sequence Number=SeqID_119932
atgcatatcataaacagcatgaacatagtcactgaggaggtcatggagtatctaaagaggatgttcacatggattagtaaattctcctacaaatatacggtggatgaacaggtgcgtctccacgtgcattttggagacatccgatgccacgttttgctgttagatgggccccagatgccactaatcaccatagacgcacatgctacataccacttcccgtttgagcgcatggtgctaacgagtgggccactagatctactttctgaggatacatccgttgaggtcttaaaggatatgggagattttgtcgatgatgaggatcttacaccattcaagatcacattctaccgtggggtctgtgatgaagagatatccgaggaagatatggtttcgtccacaacaaggagtgcgattcttgagaagatgagagcgactcttatgaggatatga

SEQ ID NO: 3155 - DNA, 1197 bp, Glycine max
  Peptide Sequence Number=SeqID_119933
atggaaaaaactgaagattctgttttgagatggatgatattgaccggacaccaagataatgcggaatttgctcttgctatgtgcccaactgaaccctatgttctttcaggaggaaaggacaaaacagtggtgttgtggagtattgaagaccatataacatctgctgctacagactccaaatctggtgggtcaattatcaaacaaaactctaaatctggagaaggcaatgacaaaactgctgatggccctactgttggaccacgaggtatctattgtgggcatgaggatactgttgaagatgtggctttctgcccatctagaaagaaaaatggtgggatccacaaatatttggtctcttctcatgagaagatattaggaatcagtcaaattgcacaggagttctgtagtgttggagatgattcttgtctcatcttatgggatgcacgtgttggctctagccctgtggttaaggttgagaaagctcataatgctgatcttcactgtgtggactggaatccccatgatgataatctgattcttactgggtcagcagataattctgttcgcatgtttgatcgccgcaatctcaccactaatggagttgggtcacccatccataaatttgagggtcacaaagctgctgttctttgtgttcagtggtctccagacaaatcatctgtatttggaagttcagctgaagatggtctcttaaacatttgggactatgagaaggttggtaaaaagatagagcgatctggaaaatcaataagttctcctccagggttgttttttcaacatgcaggtcataggtatgaaactgctgttttctgggataaagttgttgacttccattggaatgcatatgatccatggacgattgttagtgtgtctgatgactgtgaaagtactggaggagggggaacgttgcagattctacttttggaaaaaccttttgacattaaacctaatgagagacatgtatccccgaaagatgacccatttattaatattcacaaaaacacatccctaagagcaaccaatctctttcctcttccaagaactgcacaaacattttccaggctcatcctgatatggcgcatgagtgatttgatctacagaccagaagatgaggttttggccgagctggagaaattcaaatctcatgttgtggcgtgtgcttcaaagactgaaaaatga

SEQ ID NO: 3156 - DNA, 414 bp, Glycine max
  Peptide Sequence Number=SeqID_119934
atggaaattgattttgttgtgttgttattcggtagtagtgcaatttgtgtgttgactgatggtagtgtgccgaatactctggtgattgcgaattgcgaggttgtgaagcctagggttgctgctgctgagcacatttcgcagtttaatgaagaggcgcggtccccatttgtgaagaagtacaagaccatcatacatcctggtgaggtaaacagaattagggaattgccacaaaattccaagatagtggctacacatacagacagccctgatgtccttgtttgggatgttgaaagtcaacctaatcgccatgctgtccttggagctacaaactctcgtcctgatttgaagagtgggggtagcaatattggggctagaatgggcttgggtgcaaaggcctatgatgcacatacatga

SEQ ID NO: 3157 - DNA, 786 bp, Glycine max
  Peptide Sequence Number=SeqID_119935
atgaaggctaatatgaaggccatgaaggaacaaatgacaatgatgatggaagcaatgatgagcatgaggaagctgatggaggtcaacgctgctacaactgttactgccaatactactactaagagggacccaattcacctgttcgatttcaatcaagaaggtcatccaatcttagatgtagtaggtcaaggaggcgaggcaaggcgatggcaaatgcgtatgggcctcattatgtctaggtccagagcaagtcttcttttccaccatatggtttgcctccaaattatacactacctacttttatatatgttcatagtgagaatattggtaattctgcacctgtattcattaagagtcaacaacctcaacccgttcatacccatgcctatgtctctcaacccatgggggaaacacatgaagctccctaagactacactctggccagtttcatggggacccttatgttttgtgaaaggaggaggacctcctactatagtcaaaaaggaaaattttgatcatatagaggagaggatgtgggccattgaaaaaagaggaagttatggctttgctgacatgtcagaattatgcttggtacccaatgtggttattcctccaaagttcaagcaatacaactctaacatggctccagataaaatgcgactacagaacatatgcatgagagataatgaatctttcaaggaatatgctcaaagatggagagatctggcagctcaagtagtgcccccgatgatggagaatgagatgcacctcatgttgtggctgtag

SEQ ID NO: 3158 - DNA, 213 bp, Glycine max
  Peptide Sequence Number=SeqID_119936
atggagccaaaagaactgttcactactcaaagtatgaatttcagagagcatagagcagagcaaggggccaagttttcatcttttagggagattagtgagtttttgagtgattgtgagattcctagaggtggaggaaacatccccactcctttggactttagcattgggaaatgtactgtttccttagaacttgatagagcagggactgaataa

SEQ ID NO: 3159 - DNA, 381 bp, Glycine max
  Peptide Sequence Number=SeqID_119937
atgggtatccgagtgcgcgccagagaagaatggatcctactgaaaattattatgaacagcaacaatgatgacgatagagatattagtggtggctgtattaataatggtgacagtgacgatgtggtgatgatagtcaatggtggcaatgttggtagtgatggtgacgatcataatgataaagatgatgacagtggcagtgatgatcaccaagtggtggcaggtgatggttgcgatgatattggtggttgttctgatgatgacgaaggtgcttgtggttataatgataatgacgataacagtgacactaataatagtgtgatgatggttatgtcgatgacgatgacgataacaatgatgatgataataacaatggtgtggtag

SEQ ID NO: 3160 - DNA, 1755 bp, Glycine max
  Peptide Sequence Number=SeqID_119938
atgaaggattcgaattcgaattcggatctgtttgacccggtcatggcgatggagtccgagtggtctcgcggcggcggcggcacctccgacgccgatttcgccttcgccttcaacgacagcaacttctccgacagggttctccggatcgagattatgaacgaccccgtcgacgcccgccccgattccgacgcctgcgccaccattgccgactgggcccgccaccgcaagcgccgccgcgaggatatcaaaaaggataacggtgtggatcttgcttcggtgccagatgagcaagttttgaacgggcatcaatctgaagtggatgagtgtgagaatcaagatgaagagcctgatgcaatggttgaagaacctcattctgagaaatttgggtgttaccagagagtatggtattctccctttctgagtaacggatatggatatccattggttccttcttttcttaagtatgaaggtgatgaagctacaaacagtaatgattcagactggagcatggattgctctgcaggtgcagttgttagagttaaaacactgcatatcagttctcctatcctggctgctaagagtcctttcttctataagcttttctcaaatgggatgaaggagtctgagcaaagacatgtcaccctcagaattaatgcctctgaagaggttgctctcatggagctactgaattttatgtacagtaataccttgaccactactacggcacctgcattgctggatgtgttgatggctgctgataaatttgaagttgcttcatgcatgagatattgtagccgattattgcggaatatgcctatgacacctgactctgcattgctttatctggagcttccttctagtgtcttaatggctgatgcagtccaaccattgactgatgctgcaaaacagtatcttgctggtcgatacaaggatataaccaagttccaggaagaagttatggccttgcccctagctggagtagaggcaatattgtctagtgatgatctccaggtcgcatcagaagatgctgtatatgattttgtgttgaagtggtctcgacagcagtaccctaaactggaagataggcgagaagtcctgggtgcccggcttgcacgactaattcgcttcccttacatgacctgccgaaagcttaagaaggtcttgacctgttccgactttgaccatgacattgcatccaagcttgtactcgagggcctatttttcaaggccgaggctccgcaccgccaacggtcgctggcagcagaagactccgcttcttcaaaccgtcgttttgtggagagggcatacaagtaccgccccgtgaaggtggtagaattcgaacttccccggcagcagtgtgtggtgtacttggatctaaagcgggaggagtgtaacaacctgttcccgtccggccgggtttattctcaggcattccatttgggtggacaaggttttttcctatcagcacattgcaacatggaccaacaaagctctttccattgctttgggctgtttttgggaatgcaggaaaagggctcagtgagcttcgccgtcgactatgagtttgctgcgaggtctaggccgacggaggaatttgttagcaagtacaaaggcaactacgtgttcacagggggaaaggccgtcggctatagaaacttgtttgctattccatggacttcgttcatggccgaggatagtctttactttatcaatggtgtcctccaccttagggctgagctcacaatcaaacactga

SEQ ID NO: 3161 - DNA, 489 bp, Glycine max
  Peptide Sequence Number=SeqID_119939
atgttacggatcaacttgatccgtaagaagaaaatcaagcaaggacaatttcatcatttttatagaatgctgggtgcaccagcaataatgctgggtgcacctagcaatactcaaataaatttgtttggtctgtgcgcccacctatcaccaaagctggcaccgacaactatctcacaacaggtgcacctcttggatatgtttaagttaagtgaggaaggagaaatcggaactacccttgggtctaataatgaaccatcaaactcttttcctgatgagttctaccgcatacaaaacaatggaattgtgatcacaaattgggcaccacaattggatattttgaagcacccatctattggtggttttgtgtctcattgtgggtggaactcactaatagagagtgtttcatgtggggtgccaataattggattgcctctttttggagagcaaatgatgaatgccacgatgcgtgtaacattctatttttcgtaa

SEQ ID NO: 3162 - DNA, 189 bp, Glycine max
  Peptide Sequence Number=SeqID_119940
atggttggaagggaggagttatcaaaagcaataaggaagataatggataagggtgacaaagaagggagtgtaatgagggaaagggctaaagagcttaagcacatagcaaaaagagcttggtctcatgatggtcctacttatttagcactttcaaaaatcactcactcaaatgggtggtactcgcgatga

SEQ ID NO: 3163 - DNA, 714 bp, Glycine max
  Peptide Sequence Number=SeqID_119941
atgctccgcctcctaaagccgcaacctttcccctccgggcaccaactccgcaccgtgagcggcaccgcaaagggaaaagccaaaatcaaagcaggccaagccctaaaacgctcccgcatcaccaccaagaaacccggctccgccatcgcagcaggcttacccatgtctcgcgagcgccaagagcgcgagcgcctctacgaaaagtgcctccaagccccaacccctctccgccacctcaccccaaagcagcgcgaacgagaatctgagcgcgagaaattgggtctcgtaagcaaggaccgccagcgagaaatcgacatgatgaggcgaaaagacgacaaatttagggtttcggagaaacccacgataattgggacacctgggttggattatgtaaccttagggcttgtggatgcggagaagttgccgaagtatggtttgacggtggaagatgggaggaggttggcgaaggagtatagtagggttttgatgaggaagcatagggcgagacaagctgcagaatcgaatcttttgaggatgaaaaaagaggctattgaggctttgcctgaagggttgagagaggctgctttggttcctgatttggctccttttccggtgaatcggtttatggcgacgcttacgccgcctatcgagggttacattgagcaggttcgggaggccgcaaataggatcagtggaaaggagaagattaggtga

SEQ ID NO: 3164 - DNA, 834 bp, Glycine max
  Peptide Sequence Number=SeqID_119942
atggtggcaagtggctcacagtcttatttttacgaccgtgaatcgttagatgactttcttcgcaagcaagcgaacaaagagacagaaaggcttagaaaaggtgtgctatccaatgtttaccttccttctaacttcacaggaatggaagtttcagttgttagattgcgcagtttctctttatggtcaagaggaatgaattatagttccttcaatcttccaccgcggattgtactgcagcctaatgcgaagaggatagctattttgtttgaaaacttgggcaattggtcttctaattattacaatgtgcctaaccacacaatggtggcttcagtttttggtgttatggcttatagttcttcagaaacagcatttgtagatgagaagattaactttaccacccatggtgaccctatcagaattcggtttcctcatgttgatcaacatggggaaaatgacacaccaatttgtgccaagtttagagctggcgggttggtgaaattcaaaaacatgactaagccatatgtatgtgaagtatatagccaagggcactacactcttgtagttccatcttttccttctccaaaagaacctaatacccggagtcatagcaagagatttaccaaatggtgggtgttgggatttgtaataggttttgctgggttggtcatattggttttaatcttgctagctttagttaaggaggccaagaagagaagaataagaaaaatggagaagaattcagaaggaggtgagctttttgatacattttggataggagaatctaaattgccatcagcttcaatgcttagaacccaaccaacccttgagaattaa

SEQ ID NO: 3165 - DNA, 159 bp, Glycine max
  Peptide Sequence Number=SeqID_119943
atggcgtgtcctttccctgtcctttttgtgccaggaatttctcgctggcagcagagatacggtgtggcctgttgggacacagggacacgtgtaaagataaaggaaggtgaatgtggtgtgaaagatgaaagctgcagctgcaattgcatgagacattag

SEQ ID NO: 3166 - DNA, 405 bp, Glycine max
  Peptide Sequence Number=SeqID_119944
atggttgaccccttccctaacttcatcaaggatcatgtgagtgcctcttgcgagaaaagatggtcgagggtgctcatcattgacgagtccaagcttgtcaactattttgggggtagcggattggctatgcccgttgaggaggttgggtgtgttgcaaagattaggactttcggggagaaaaaggagccttatgtcacaaacaatgggaactttattgtggatttgtattttgagaggagtattggggatttgaaggttgctagtgatgcaattttgcaacttgatggggacacctcaaatgcacttcttttccttctctcagaagcacgcactggtaatatgtatggaaatggatactctcatacagagagttacgaagagatgcagaagccacccagtgtctaa

SEQ ID NO: 3167 - DNA, 3165 bp, Glycine max
  Peptide Sequence Number=SeqID_119945
atgggagtggttttggcactgattctgcagctggtgaagctctgcatcattggctttgttgtggaattccaaggatctgaagggtctgttatatccccatctccagcattccttccagtcattcatcctagtggagaagcacctgctcctatccatcatggactgtcatgggaaagcagtcctccaaaatcaccttcagatccaaatgaatttggtatatccccatctaatgaaatcatacctgtggatccttcccccagtgaaccacctggtactttacacccaagagaaccatggagaactattgcaccaatccctccagaagtaccaaatgggtcattcttgccccctccagttactacattaccacctccaacatcagctccaactcctcagaaggtaaaaggatttgaaccatctatatctcctagtcctagtacaagcaccatagcatcatcaccaccagcaccatataatgctgctcatgcaccatcaacttctgaagggagtgtgccaccatccatacaaccaagtccacctcaaagcaaaacaacacctgctattaggcctcctgtgtccacaccaattgctccagctccaattgcaataacttctggcaatttgccaaaaacttcacctgtcagccagccaattgaacatggaagtttgcctcctaagattgatgagaggaataagagtcacaagccagagccagctttgccagcactagttccaataccatctaccatattacccaaaatttcacctgtaagccaaccaactgaaaacggaagtttgcctcatagagaggcccctacagtattcagttttcctgaacactcgccagagagtcagccaactgaacatggaagtttgcctccaactgtccccagaaggaatatcaacactggtcgcacactggagccagtttcacaagccccagttgcaacagctcctgcaattttgccaaaaaattcatcagtcagtcaacctactcatcatggaaattccccacctgatgttcaaaatagaacagcaaataatggtcacagtcacaccccagcaccagaaatgccaccatcagttacaccaccacgtccatttccagtagatcctccattggtccacccagtcataccagcagcacctccaccaaaatcaccagcacctggtggagaaccagtttctgcacctgtgtacaaaacaccaaagccaccatcagctatagtgcatttccatgctcaagcacctgttgtctctcctgtatcaacaccttctagaagcttcaattggaccaaaggtggagaaccagtttctgcacctccatacaaaacaccaaaaccactaccagttatagtacattcccctgctcaagctccttcttctgcacacaaagcaagacaatttcaccatgctcctgagccaccgatttcatctcctgaatctcctttcaacaaagatcatcctcctgcgtcttcaccttcaaccacattttataagcatcaccatacaaggaacacagtcaccagccctgctcctgcatcatcacattctatttctccttccacttcaaaacaccaagatggatcaaatcctcccttgccgcttccaacaagtaggcaaagacatcatgctccaccaccaatgaacacaggttcctcagtttccccatctggcctccctattcagtcaccagtgagccaagtttcacctgctccttctccgctattcaaaatatccccccactcaaccaaaattccattgcctcctcctaaagtgtctccttctcggccttcttccaagacccctaagaagccagttcggcctcgttttcaagcactgccacccccacctccaaatgaagattgtatatctctggtttgctcagatccctatacaagtactccacctggagcaccttgcaaatgtgtgtggcccatgaaagtcggtcttcgccttagtgtttctctgtatactttcttccctttggtttcagagtttgcttctgaaattgccactggggttttcatgaagcaaagtcaagttcgcattatgggagctgatgcagcaaaccagcaacctgataaaactattgtattcgttgatttggtaccacttggggaagaatttgataacactacagcctttttaacttctgagagattttggcataaacaagttgttataaagacttcttactttggtgattatgacgtgttatatgtgacctatccaggtttgcctccatctcctcctttacctccttcaagcatttccataatcgatggtggtccgtattcgggtggtggcaataatggtaggacaataaaaccccttggggttgacatatcaaagaggcagcataaaggtggacttagcaagggcataattgctattattgctctttcagtttttctagtagttgttttatgctttgctgctgctttggcattgttcaagtacagagatcatgtgagtcaaccaccgtcaaccccacgggttttacctcctcttaccaaagcaccaggtgctgctggatcagtagttggaggtgggcttgcttcagcttcgacatcatttcgatctaacattgctgcttacacaggatctgctaagactttcagcatgaatgacattgagaaagccacagataatttccatgcttccagagtacttggagaaggtggttttgggcttgtttatagtggtacacttgaagatgggacaaaagtcgcagtcaaggttctaaaaagagaggatcatcatggcgaccgtgaattcctatctgaagttgagatgcttagccgccttcaccatagaaacttggttaagttgattggtatatgcgcagaggtcagcttccgctgtctagtttatgaactcattccaaatggcagtgtggaatcccatttacatggagttgacaaggaaaacagcccacttgattggagtgctcggttaaagatagctctcggttctgctcgtggactggcttatctacatgaagattcaagtccccatgtcatacatagggacttcaagtcgagcaatatcttgctggaaaatgattttacaccaaaagtatcggattttggattggcccgaacagcagctgatgaggggaacagacacatatcaacacgagtgatgggaacttttgggtaa

SEQ ID NO: 3168 - DNA, 223 bp, Glycine max
  Peptide Sequence Number=SeqID_119946
atgggcattgaccatctacatgttcctggaaatttctacttgaaagtttggtggcattgtgagttcctaacctttgaatatgactatgttgttgccattgagttccaagacgaggcaattgttgaagttgttgatccttttgctgtgaaagccctcggacccagcggtggagcaggggcagcagagcttcttcggcattgggtgtcgatgaagaagatgaggg

SEQ ID NO: 3169 - DNA, 522 bp, Glycine max
  Peptide Sequence Number=SeqID_119947
atgccagggaacatcaatcttgaagatgcacaacaaaacaaaatcatagaaacagaaatagacattggtcaagtaatgaaggaattgaaaaaaacaactcgcacagtcgtactcgaacttcaccgttgcacactcacacttgaacttcactggtgtggactcgtggtctcgcggaggataccttcaccgttgcactccggcaccgaacgcataacgacaaatggtgttgacaatgtctatatgtttgatgatgttgacatatgttctagtgaagatgaagaagttgatgacgaaacatttcaatttgaagatgaagaagaacttggttgtaggaatgagtcatcattgataaccatcgcaaattatgatgaattgcttggataccttacaagacaattaactaagctaaagttgaagaatggtagtgcagaaattattaacgaaggtgatacagagacacatgtgcacatggaagaggaaccaacacaagaatctaaagtacaagaccttcctcgtgtatga

SEQ ID NO: 3170 - DNA, 564 bp, Glycine max
  Peptide Sequence Number=SeqID_119948
atggcagaaaaaccccaaccggttcgggttctctactgcggcgtgtgcagtttgccccccgaatactgcgaattcggatccgatttcgagaaatgcaaaccctggttgatccaaaacgtccctgacctataccctgatcttctcaaagaagagaaggaagctgataaagttgctgacaaactacaaagtacgggtatatctggagctggtgatggagctgcttcctcagcaccgaagcaagaagaggataagcaagaggttgttattgagaaggtcgtacgtaacaagcgaaagtgcatcaccactgtgaagggactggaactttttggtgtcaagctcagtgatgcttccaagaaactcgggaaaaagtttgctactggagcctctgttgtcaagttggcctcctcaacctctgctgcctctgctatccatagtttccaaatcattcctgaacctctttggccgttttctggtgaacatggacctactgagaaagaacaaattgatgttcaaggggatatagcttatgatgttgtggagttcattacagatacatggcctgat

SEQ ID NO: 3171 - DNA, 4137 bp, Glycine max
  Peptide Sequence Number=SeqID_119949
atggcatcaaaccagatcctgaaagagctacaatgggctcagcaagctatcaaatctgagggcctaaatctgcacagtatttccttctacctgtcccaaccaacctcaggctgctatcaagaaacagacaactccataagcataaacatttccaaggaaaaccttccattcttttcccacctcttgacaactctagcagcacctaggagcaccaactcttcttccttgagaaacttggagttccacagagttgaatgggactcacaaaaggtaagaaatcttggcaccttgcttgggaataaccaaaatgtacaacaagtggtttttagaagaaacaggttcaatggaaaaagcctgtcagagctttctgacattcttaaggctaataaagtgatcaaagagatcatgctttcagaatcaggtatcgggtctgttggagctgggctcattgcttctgctcttgtggtgaatgatagtttggaggagctgcagatatgggaagattcaatagggtcaagaggtgctgaggagctctccaagatgattgaagttaactcaactcttaagcttttgacaatttttgactcaaatgccatcacagctacccctcttatatcagcagttttggcaaggaacagaacgatggaagttcatgtttggagtggggaaaatggggacaaaagtttcaaggtggttgagtttgtaccggagaacaacacacttagaatttacaagcttaacctctcaggtgcatgtagggttatttgctctttagggatgaacttcactgtgaagtcgcttgacttgaccggcgtcaagctaaagtcacagtgtgctaaggaatttaggtgggttttggaacaaaaccagaccctcaaagaggtaaacttgtccagaacatgccttaaagacaagggcattgtgtatgttgcagctggcctctttaagaacagaagtctgcaaaccttacatcttagcggtaattggttcaatggagtaggtgtggagcatctactatgccctttgagtagattttcagcactgcaaatgcaagccaacactactttgacatgtgttacttttggaggagggaggacaagaataggaagggatggtctagctgctattatacagtttctaattagcaatgaaacagtgaggaagttggggattcatgatgatgagagtttgagatcggatgactttgtgaaaatcttcaagagtttggagaagaatgctagcttgaaatgtttgtctgtacaaggctgcaaacgtgtggagggagagacattgctgcatacaattatggagacaatacagataaatccttggattgaagatattgatctctcaagaacacctttacacaactctggaaagactcggggaatttatcagagattaggccagaatgagaagactgaaccagaaatggatttggtcaaggacatgccactaacagaacccaagagttgcagagtttttttttgtggtcaagaaagtgcaggcaaaaccacactttgtcattcaatatcacaaaatttctctgctttatcacttccctacttggatcaagtcagaacaattgtgaacccagtggagcaggctgtcaaagcagtaggaatgaagataaaaactttcaaggatgaggatacaaggatttcaatatggaatcttgctggtcaacatgagtttttatccctccatgatctcatgttcccagggcatgggagtgcatcatttttcatcatcatatcaagtttatttaggaaaccaagtaacaaagaaccaaaaagttcaactgaaattgaagaagacctgcaatattggctcaggttcatagtctccaactctaaaagggcaatacaacaatgcatgctaccaagtgtcgctgttgttctcacacacactgataaaatcaaccaaccatcacaaaatttgcagcacacagtagattcaatacagagattgagagacaagttccaaggctatgttgaattcaacccaactgtattcacagttgatgcaagatcatcagcatcagttagtaaactcactcatcatatccgaaagacaagcaagacaattctccaaagagtgccgcgagtttatcaactttgcaacgatttgatacagattttatcagactggagatctgagaactacaacaagccagcaatgaagtggaaggagtttggtgagctatgccaagttaaagttccgttgttgagaattcaatcaagaaatgaaaataaagagagggtggaaatgaagagaagagctattgctacctgtcttcatcacattggtgaggtgatttacttcgatgagttggggtttctaattttagattgtgagtggttctgtggtgaagcacttggtcagctgataaagttgaatgttaggaagcaacattcctcagaaaacaatggatttgttagcaggaaggaactggaaaaaatcttaagaggaagtttgcagagccctattcctggtatgggttcgaaggtatttgagaacttagatactagtgatcttgtgaggatgatgctaaaacttgaactttgttatgagcaagacccatcagatccaaattctctgctattgattccttccattcttgaagaaggaagaggaaagcctcagaagtggcagctaagcatgccagactgtgtttatgctggacgtcacctcgagtgtgatgattcaagccacatgtttctaactcccggattcttccctcgtttacaggtgcaccttcacaacagaatacaggctctaaaggatcaacatggggcaacttacagtcttgagaagtgcatcatatcaatctgcattaatggaatctacataagagtagaacttggaggacaattgggttactatattgatgtccttgcatgctccaccaaaaacttgtctgaaactttaagagtcattaatcaacttataatccctgcaatccaaagtgtttgccatgggatcaccttgactgaaaatgtcataagacctgaatgtgtgagaaaactgacaccccctagatacagaaaaactcaatttgcttccatgcagcaacttaaacaagcattactttcacttccagcagacagcatgtatgattatcaacacacatggagtccagtcctagactctggtaggccaattctccaagatggatttgattttgctcgggaccttttatccgatgatgacttccgggaagtgttgcatcgaaggtatcatgacctgtacaatcttgcacaagagctgcaagtcccacctgaaaataaccctgaagggcaaggtcaatctataaccatgagtaatgaagctgcaaaggttgaaccaacctttggtggcattgcaaaaggggttgaagcagttttagaaagactcaagattatagaacaagaaatcagagacttgaaacaggaaatccaggggctgagatactatgaacatagacttctccttgagcttcatcgcagagtgaaccacctagcaaccttcaatgtccaggttgaggagaggaaagtccccaacatgatctattttgttaagacagaaaactacacaaggagactggtcactgccatgctttcaggtatgaatgctctccggcttcacatgttatgtgagttccggggacaaatgcatgttgttgaagatcagttggggtgtgaaatcatgcaagttgataatgcggctgtgaagtctttggctccatatatgaagaagttcatgacactggtaactttagctctcaaaataggagctcatcttgcagcagggatggggcaaatgataccagacttgagcaaggaggtggctcatttggctggctcttcagttctctgtggtgcagctggggcaactgctgctggtgttgtaggggtggccgctatggatcgtagaaacaggtccattgaaggttcaagggacattcaacaagacttaagagcagcacaacaatgggtggttgatttcttaagggaaagaaggtgctcctcagggaaggatattgcagagaaatttggactgtggcgaataaggtatagggacaatggtcaaattgcatggatatgcaggcagcacatgtatgccagatctgcagagataatcgaagtgcctgtttga

SEQ ID NO: 3172 - DNA, 636 bp, Glycine max
  Peptide Sequence Number=SeqID_119950
atggctgaagacatgaacatcgatgctatcaccctaacctcgatgcaaacttctgcaatgtcaaatgctacctttgccaagccactccgagacatgtcaaagtttaaggaacatgttggcacactacttgatatgcatggggtagcctttgcccttaccaccaagaagccaaactctgcaacacctaccaaagagcttgaacaatggaatcatgcgaataaggtagaaaacacaagcatacaagatgaatttgtttccaagctctatattgagaaattgcctgaatcttggattgattacaaacaacaattaaagcacatgcacaaacaaatgtccctatcagaccttatcactcacatcatcattgaggataccaacaacaaggaatgtactattacaatagacaaaactttatataccaaggcaaatatggtcaatgttgtgaccaatgtgagcaaatgggtggaagactttgggattaccaagtacatttgtgctgatagaaatgcttttacctcctacattgttgtgggggatagagaagaacatgtctatcttggtgattcgaggactactctagttctatgcaaagaaaaagttcttctcaagctcacatctaggaaagcgattttgtga

SEQ ID NO: 3173 - DNA, 681 bp, Glycine max
  Peptide Sequence Number=SeqID_119951
gcatgccagctaccagtagagctggagcacaaagcatattgggctcttaaattcctcaactttgataatagtgcatgcggagagaagaggaagctgcagttactggaatgggaagaaatgaggttgaacgcctatgaatcatctaggatttacaagcagaagactaaggcatatcacgataagaagttacaaaagaaagaattccaaccagggcagcaagtgctactcttcaactctaggttgagactattcctaggaaagctgaagtcaaagtggtcaggaccgttcattattaaagaaatcagacctcacgaagcggtagaattggtggaccctcgagtagaaaattatgagaagaaatgggtcgtcaacagacagcgcttaaagatttacaatggaggacaactagagaagttgacgactgggcccaacaggtgcgaacaacaaacagggggtacgaaaagcaaaggcccagcaggtgaagatagcaacaggagggggcaaccaagggatgcttcccttggtgcgcttagcggccacatgcgtgctagatgcgcaagtcttacattcctggggagtattagcgcgttgagccccaggaagggcccaaggggagaagatagacgccccacagacgcgctaagcgccacttcgcaagctgctgcagtacagtgggaatga

SEQ ID NO: 3174 - DNA, 342 bp, Glycine max
  Peptide Sequence Number=SeqID_119952
atgaaaaatcgttatgctacaaacaatgaaaccacatcttctttggaatctgatgctagtcaaagtaagatggtatctaaacattcaaacttacaagtaaagggcaaggaacaagcagatatgatagagggaaaatttagtcccccagcagcagtacaacatattcatgagatacgaaaaatgaagttggaactagagcaagaacgcaaaaagttggtaaatattcagctaaaactccaggaaacgaccaacaatctggatctttctttaatgccagaagaagagaaattgaacaagtctttccaagaggagcttaaattgctaaagttgaaaagagacaaa

SEQ ID NO: 3175 - DNA, 930 bp, Glycine max
  Peptide Sequence Number=SeqID_119953
atgcccaatccgattcccctagaaaacatgccaaattctcgatcaaacccatttcgtctgccaccaatgtcatcacaagactctcttggtacctggaggttcatgcgcctgtggcgagggaggtccatgtgtcttgtcggcagcgaaaattcaaaattcactaggtttagtgttagcattagtgtcactgtcggcgacgccatagggaacgtttcggctgcgaagcttaaggaggcgaagcattcgatggtagcaaaatgcaaaatcttagtggaaaaggggaaagaggtgattggagtagacacgaagacagagagcaatgggcgttatgagaatttgagtgcgaaagaggcgtgtggcgatgagataacgaatgcagagttgaaggttgcgagtggggagaaggtgtggggctatgagatgcagtgtgatttggaaaacgttcatgtgtataagaagttgcttgaggatgttgggaagagaagtggcacgcttcagagtctaattttgagattgatttgcatgagaagtgcatggactattatatataatttggtgcggccgaagaaggaattggttaagtgtgaattttggaaaatgggaggaagtaaagaagaggaagtgtcgcaagagccttttgttgctcttacaagtgaggaggaagatgaggttgaccgtgtaggatcttggttatccacgagagagaagtttcagtgccttatacccactgaatggttaaatgaggttataaatttgtacctaacattgcttaaggaaaaggagcaaagagaaccacagaaatttctaaaatgtcatgttttcaatacctttctctacaaaaagatgattgataaccattgtgaagaagagggccattttcctcctcttcaagcattggtttcagttatgcaagagtttcttatcatttaa

SEQ ID NO: 3176 - DNA, 756 bp, Glycine max
  Peptide Sequence Number=SeqID_119954
atgggtggtgtctgttgcaagccctctgccattgaggatagcaaggagagtccaagggagcgtatgtcgaccaagtcagcttcgttggactcttgtgtgccgaggggtgcttcgttgaggagggaggatgcatatagggtgaaagataggtatgatggtaataatgtgaggactgctttgattgataagcaagggaacggttctgtgcggttgcaaagtgaaaatgttgagaggaagagggagagaatggagtgtgttgttgctgctcaacaacatccgggggctggtagtgttcccaaggccttggaaggggagcaggttgcagctggatggccatcctggctggcagcagtggctggagaggctatcaagggatggttgccgcgccgtgccgattcgttcgagaagttggataaaattggacagggaacttatagtaatgtttatagggctcgtgatcttgagcaaaagaaaattgttgctttgaaaaaagtgaggtttgataatcttgagccagagagtgttcgcttcatggcaagggaaattcacattctacgtaggcttgatcatccaaatgtcataaaactggaaggtcttgtcacatcaaggatgtcttgcagcttatacctagtttttgaatacatggagcatgatttggctgggcttgcatcacatcctaaactgaagtttactgaagcacagcttatagcatattccaagaagaatctcatggctacttatatctgtgtaatgtga

SEQ ID NO: 3177 - DNA, 1479 bp, Glycine max
  Peptide Sequence Number=SeqID_119955
atgcagcaacttttacgaggacttgaacactgccacaactgtggtgtgctgcaccgtgacattaagggttcgaaccttttgattgacaacaatggcatcttgaagattgcagactttggtttggcaagtgtttttgatccaaatcgaacacagcctctgacaagccgagttgtcactctttggtatcgcccaccagagcttttactgggtgccacatactatggcactgctgtagatttatggagtacaggctgtatacttgctgagttgtatgctggcaaacctataatgcctggaagaactgaggtggagcagttacataaaatttttaaactgtgtggttcaccttctgaggattattggagaaaatcaaagttgccacatgcaacaatatttaagccccaacaaccctataggcgttgtgttgctgacacattcaaggatttcgctgcacctgctttagcactcatggagactcttttgtccatagatcctgctgatcgtggaactgcagcatctgctttgaagagtgagttctttacaacaaagcctctaccttgtgatccttcaagtttgccaaagtatcctcctagcaaagaattagatgccaaacttcgggatgaacaagcaagaaggcagggggcaacaggaagcaagggccagagacatgatcttgaaagaagaggggcaagagaatctcgagctgttcctgcacctgatgccaatgctgaactgccactgtcaatgcagaagagacaaagtcaggctcaatcaaaaagcagaagtgagaagtttaatcctcatcttgaagaagcttctggatttcccatcgatccccccagaccgtcacaagctgtagaagtaggtatagaacctcaggtaccgcagcataaaagagcctcccattcgggtccgctggctcaccgaactgcatggggtaaagctgggaagaaccaggatgatgctccaaagatttcagtcgggggcgatctatcaacaatctcaggcttagttgcagctaggagtatgttgtcagatgatcgcagagaaagatctggatcgtcacaaatggaggcatcaaaattgatgaacaggttcccaggatcattcaaggacatctctgaattattgataaaacaggatcaaaggcatcatgtaccgggccaagtaggcacttcccaaaaggaagaagggagaagcagcaacaaagaccttgttcttgttgatctcatggcattcactactggcatatcattatcgttctacaaagaggatctgaaagttggttatggatcaaagggtcataaaattcattactctggtccattaacatcaagcaacatggatcaggtgttgaaagaccatgaccgccaaattcaagaggcggttagacgggcacgtttggataaggcaaaaatgagaaggctccaagctgaagggaaccagataaccaattcattatttgtttcaggccgttga

SEQ ID NO: 3178 - DNA, 501 bp, Glycine max
  Peptide Sequence Number=SeqID_119956
atggcggactgccttgaactattgaacaattttcttagtagcaatgcattcaaccagaaaaaggtgttggaccatttgttaatattaggtgttgaaagccaatgggtacctgttcccatttgttgtgcggcaatgcaatgcattggtgatttgattgttggagattcaaagaatcgtgatcttcttgctagcaaagttctaagagaggagccacacgttgaacctactctgaactctatacttagaatccttttgagaacttctagcatgcaagagttcattgttgctgattatattttcaaaagcttttgtaagaaaaatgatgatggccaatcaatactggcgtctacgctaattccacaaccatattccatgaatcatgtattcctcaaggaggatgtcaatatgccttttggcaggattaaatttaaagagaaaaatgatcattatatactacaagatagaatgactaaaaagataaaaagaattatgtacagataa

SEQ ID NO: 3179 - DNA, 357 bp, Glycine max
  Peptide Sequence Number=SeqID_119957
ccccgaagtctagatcacggtgttccacactgtcgtcgacatcatccgcttgttcttcaagccctcaatgtttcacgagctcctccgtgcaatcgtgattggcatcttgacactcctgtctggcttcaaatgaagattctgaagccgtacatcaacgacatgtttctcgacatgcttcagattgccgagagtggtggcttgaaccatgaaggttggtttcatggatgcagcaaggtttgcaaggatgacaaatgggttttgcctaaattgggaggacttcaatttgatgttccaactgctatatccaaaaatggtctgtctctgtcttcctcttcaagttacaggaagcaatattga

SEQ ID NO: 3180 - DNA, 864 bp, Glycine max
  Peptide Sequence Number=SeqID_119958
atggcccaaaataattcattgcaaccgacccatccaaaccttataaaacactgtctaatcgctctcactctttccctaaaccccaaagagactcaggcgctgctgcccttcagtccttcagcaatggtttacgtgaagtcacagaaatcaaaagcctacttcaagaggtatcaagtcaagttcaagagaagaagagagggaaaaaccgattaccgtgccaggattcggttgattaatcaggacaagaacaaatataacaccccgaaatatcgctttgttagcaacaaagacattgttgcacaaataatatctgctagcattgctggcgatattgttcttgctgcagcatatgcacatgagctgccacgatatggtcttgaagtagggcttacaaattatgctgcagcttattgcactggtctcctgttggcccgaagagtcctcaaaacacttgaaatggatgaggagtacgaaggaaatgttgaggctactggagaggactattcagtggaacctgctgagagcaggaggccattccgtgctctccttgatgttggtcttattaggactacaactggcaaccgtgtctttggtgcccttaagggagctctggatgggggtttggatattcctcatagtgacaagaggtttgctgggtttgataaggagaagaaggagcttgatgctgagatcttggcggaagatgaacctgagaaatatcagtcacacttcagtgaatacatcaagcgtggaatagaagctgatggtattgaggcactgtacaagaaggttcatgctgccatccgtgctgatccttctctcaagaaatctgagaagcagcccccgaaggaacacaagaggtaa

SEQ ID NO: 3181 - DNA, 963 bp, Glycine max
  Peptide Sequence Number=SeqID_119959
atggaggttggatttttgggtttggggataatgggcaaggctatggcaatcaatcttctacgccatggcttcaaagtcactgtttggaacagaaccctctccaagtgtgacgaactcgtgcaacatggtgcttcagttggagaaaccccagcaactgtagtcaagaaatgcaagtatacaattgcaatgttatctgatccttcggctgctttatcggttgtgtttgataatgatggtgttcttgagcatattaatggaaaaggttatattgacatgtcaacagttaatgctgatacatcttccaaaatatctgaggctatcaaagcaaaaggtggttacttccttgaaggtcctgtttcgggtagcaagaagcctgcagaagatggccaactcataatacttgctgctggacataagatgtatccagtcttaccccctccccctcatgaagagaggctttttctaggatttgaacctgtgacttccaggtcacaaggcagtgccaaggcattgtatgatgaagtgcttccagcatttgatatactggggaagaagtctttctttctgggtgaggttggaaatggtgcaaaaatgaaactagttgttaacatgataatgggcagtatgatgaatgctttctctgagggaatcacactagctgaaagaagtggtttgaaccctggtactcttcttgatgtgctggatcttggtgccataagtaacggcatgtttaaattgaaaggacctacaatgctccaaaacagttattccccagcttttccgctgaaacaccagcagaaggacatgagattagctcttgcccttggagatgaaaatgctgtatcaatgccagtagcagctgcagcaaacgaggctttcaagaaagccagaagcatggggttgggagaccttgatttttcagcagttcatgagactttgaaagctcctgatcattcatcttga

SEQ ID NO: 3182 - DNA, 879 bp, Glycine max
  Peptide Sequence Number=SeqID_119960
atggtaactagctttctcaaaaatttatttaaagaagagggtgagcatgaacaactttgcctcaaaggtaaatttcctagccttgattttacagaggtggagatgttagggagggggattacagatgaggagattagaaggggcatttttggtatgagaagctttaaagctccaagggaggatggattccatgctttgttctatcaaagtcaatgtgatggacaaagtcaggacaatatcattatcactcaagaggtcattcactctatgagaaggaaaaaagggaagaaaggttggatggccataaacattggtctgcaacaggcttatgataggcttaattggaacttcatcatcgacaccctaaaggaaattgggcttcctacttcctttattgatgtagtctatcactgtatatcatcttttttgtcagcatgcttcagaaaggggaggctttctcgccaagtagaggtatcaggcaagggggaggagattagtgacaccattggctttcaacgcactgatgatctagggaagtatttgggagttaaacttcaccatgaaagggtgtttagaaattcttatgatcatattttagaaagggctcaacaaagattgagtgcttggaaggctaagaatctttcttttgcaggaagattgatgttagcaaagtctagtttgagtgcactacctttatataccatgcaatctgattttataccaaggtatgtagttcggtcaaaatatggttgtggggaaggagttatgcccatagtggagaaaaagatagcagggtcaaatttatggaatggtgtgaaacatatgtgggactgttttcttttgaattgtgagatgatagggctcagtgatatgaggtga

SEQ ID NO: 3183 - DNA, 873 bp, Glycine max
  Peptide Sequence Number=SeqID_119961
atgattggtggaatttccatgtcagtgtcccttccggcgaaatggggatgcaagacagacggcgttaatccatcagaattttgtcatgcactatcaaatgctaaacatgatagtacagtagcagttacagattatcctgttaagggtgtgaaggttaaacaaagatgtgatttttctgctgtatgtgttgttgaattagttggagctgaaacgttagataaaaaccagtctagcagcaagtttattcttgtcaaaagacctgaagaaggattgcttgctggtctctgggaatttccatctgtcttactggatggagaagcagttccattagctagaagagaagcaatggatcccttcttgaaaaaaaatctcaaaattgacatcagaaagacttgcaatatagttttgagggaagatattggggaatttgttcacattttcagtcacattcgcctcaagttgtatgttgaattgctagtgttacaattgaaaggaggagtagatgatttgttcaaaagcctggacaataaagcaacaacttggaagtgcatttacagcaatgcactttctagtatgggactgacaaccagtgtaagaaagattgcaagtaaatttaaaacggccagcagaaacagaattacctgctctgccgttcaagaatcatctcctagcacagcagctactactgctgaaacaaaggaggaggtaaaggaagccccaaaagccgcagcaccagcaaagaaacctcctgctaaagctccagctaagcctctgcctcagatgatggaggaggatgtgatcccttcactgaaagcaatatttgaagcccaagaagatttctcaaatattgagctggtcttcaaggacaataag

SEQ ID NO: 3184 - DNA, 393 bp, Glycine max
  Peptide Sequence Number=SeqID_119962
atgaagagtgaaatagaccacttgggagcacagataaaattagtgacactcccacatggtttggatccagaagatgacagaagtgaccagccaaaggtgattttgtcactcaaaagcaccatgcctactaagcttcacgagctcatacttgacatcaataataataatgctttggatgctgacaacaacaacaagatcacttgtctggttgtttctaagaacataggatgggccttggaagttgcacacaaattgggaattaaaggggctcttctgtggcctgcttcagctacttcattggcctcttttgagtccataaggcttattgatgaaggaattatagactctcaaactggtgtttggcttggttgggcaccacttgtgctaaattaa

SEQ ID NO: 3185 - DNA, 258 bp, Glycine max
  Peptide Sequence Number=SeqID_119963
atgtctgaagtgaatgcaacccctgaaatccctcaaaacaaagccatctacatcaacaacctcaacgaaaagattaagattgatggcatgctactttttagggagatacttgaggtgttagctttcaaaaccctaaagcacaaaggtcaagcttgggtgttctttgaagatgcctcttctgcttccaatgttgtgaggcaaatgcaaggtttccccttttatgacaagctcatggtgtttggatatacttttaattag

SEQ ID NO: 3186 - DNA, 327 bp, Glycine max
  Peptide Sequence Number=SeqID_119964
atggtgtggttatggagagtcacgtggagaaggagacttttcggcgacatccgccgagccacttcgtgttttctcacgccaccaccgagaagccaagatgggtgggtatacatcttcctaaggacgcacgtgtggagtttttacacgacgtggttatctgggaccatagggttgaggatgatgttgttcggtgtcgggattgagccaatgacctcaatgaggaggaagccgccgtcagaggttgtcgtggaggggctgaaagggttcaatagagtagaaacggagagggcagagggagagaaggaagagaggccatcactggattag

SEQ ID NO: 3187 - DNA, 1011 bp, Glycine max
  Peptide Sequence Number=SeqID_119965
atggtggtagcttcaaataggcaaggtcctctttcttcttgttcagatttagtcaaagttggtttgcttttatgtttgcttttttcaaagtttgaggtgcgatcattggcagcagaatctgatcgggcatatcagaatggcccccttgagcgtacattttaccaagaagcttccctaagacctgaagaagaagatgtagatataaatttatctagtttccaattgcccagccagtacaccagcaggttggactggtttgctttcaatcttgaaggtgaacattctgccatggatggtgcgattctggaagagcacactgaatatgttgtatatgctatacacaagatttgggaccaatataaagtttcttatgacgctggaacaagagaaagtgttgcagtttctgggagtttgccaaaaagtgtgatattagttggtcattcaatgggaggttttgttgctaaggctgctattatccaccctcgtcttaggaaatcagctgttgaaactgttcttacactttcaaccccacatcaatatgcttcattgggtcattactttgcacgtgcaaattcagaatggataaaaggatataaggttcaaaccactaacacgggacattatgtgtctgatccagtactctctcatgttgtagttgtatctatttctagtgcatacaatgattatcaggtacggtcaaaattaacatcacctgataatattgtgcccccaacccatggcttcatgatcagtagtacagccatgaaaaatgtgtggttgtctatggaacatcaggctattttatggtgtaatcaattggttgtccaagtaggtttctacatcggttatcagtcaaccgatgtagaatgggaagagtatgggcttatgattatacctgaaaacttaggccaggcctttatagccaccattgattgtggactcaaatataaaggcaaggttgctgaaatagctgtcaagaacagaaacctcctctgtgaaaaactacaatga

SEQ ID NO: 3188 - DNA, 555 bp, Glycine max
  Peptide Sequence Number=SeqID_119966
atgcttttcagaactcatattgtctttccatctcccttctcccttcacgctgttgccgtgacctccgcaagctcgtccttgaaaggggaaggaaggaaggcaaggaaggagagtggatctccagaaggatcctcctacctcttgcagcgtcgcgattccatttccatggcttcctccctcgacgacaacttcaaccttctctctcctgaacagcaagagctggtgaaggtgctactggataacggccaagagcacctgtttcgcgattggccagctcccggcgtcgatgataaccacaagaaagcgttctttgaccagttgactcaactcgattcgagttaccctggtggtctggaatcatacatcaaaaacgctaaacggctcttggccgattctaaggctggcataaaccctttcgacggctttacaccttccgttccaacgggtgagactttggcatttggtgatgagagctacatcaaatttgaggaagcaggtgtacttgaagctcgactgcttttgttcttgttgccggtggtcttggcaagcgtttag

SEQ ID NO: 3189 - DNA, 150 bp, Glycine max
  Peptide Sequence Number=SeqID_119967
atggcattggcacggcagaacaattatgtcaggccttcgttgactaaagaaaatttgcttgatataaaaaatggaaggcatgttttgcaggaaatgactatagacacgtttattcctaatgacactaagattcttcatgatgggatatga

SEQ ID NO: 3190 - DNA, 579 bp, Glycine max
  Peptide Sequence Number=SeqID_119968
atgaagccatctccaagacttctcttgatactcacttttcttggttcattcttccttgcaagcccagaagcatactcgtgcaccagcaacctaagcctcaatgtttcaatcccttttgatacaacaaaccttcactgcctttctgtatgggatgctcaaagtttcatcctcagatatgttcagacttctgcaagcacttggagcttcattctctcaaccccggacacaaattcttacatagctattggattctcggccggcggcggcatggtgggttcaagtgccatggtggggtgggtagcatcaagaggagccagtggagggattaagcagtattatcttggtggggtcacaccaaatcaggtggttcctgataagggcaacctacagttagaaactaccgaacctttgtcctctctgatatttgccactggatccaccggcttgttccctgcaccaccaagttttgcactaacaaaacacctagacaaggtgtccacaagaatagactattcaaaagaaacagtcctaaggacacttgttaacattggcctatttttaaaaggacaatcaatttga

SEQ ID NO: 3191 - DNA, 489 bp, Glycine max
  Peptide Sequence Number=SeqID_119969
atggtagatggactctggcctgactataatgatggaagctggccgtcctgttgctctggatctagttttgatccaaaagagatatcaacattgactaatgctttagagcaatattggccatcattgagctgtagcaagccatcattatgccatggtgggaaaggaacattttgggctcatgagagcgttctaaatgatgctggatatgttccctctaatacagaaaagtatccccttggaggcatcatctctgccattgagaatgcttttcatgcatctcctcaaatagtttgctcaaaagattccattgaggaactttacctatgcttttataagaacttccagccacgagattgtgctcttggatctgacattaaaatcgacatggttacttcaaaaaaatcttgtcccaaatatgttagcttgccagaatctgtatcagtggttgctcttaaccaccaaactagtttgctaaaagttacatattaa

SEQ ID NO: 3192 - DNA, 1146 bp, Glycine max
  Peptide Sequence Number=SeqID_119970
atgaaggcatctctagcattcctcatcttcactatttgtttccatgcttcagccaacattggaagttcacaaggggatggaaattcttcacaagtaaatggaagtacttcacaatcagcagactcttgcggctccaatctaaacctcagtgttcctctcctcttcgacacaaccaacctcaattgtcttcctgtttggaatgctcaaggatacatccttagatattctcagacatctcaaaacatatggagcttcattctctcagcaccaaacccaaattcatacatagcaattgggttctctcccaatggaggcatggtgggttcaagtgccatagtggggtggatctcatcaaatggggcaggtggaggcatgaaacagtactatctaacaggtctcacaccaaaccaagtggtgccagatagaggcaacttaaaagttctcaccaactcaaccttcatcacatcacagtcctcacgtttgtacatggcattccagttagagactaaccaacctctttccaagttgatttatgcctttggacctaacggtgtgttcccttcggcaccaagttttgcattagcgctgcaccaagacaaagtctccatcacgttgaattacgcaacaggttcaagtgcaacaacaggaaagtcatataacctgaaaagaagccatggattgttgaatatcttaggatggggcatcctaatcataatgggagcaatagttgctcgctacttcaaggaatgggatccattttggttttatttccacgcttcagttcagtctttgggttttgttctgggaatagttggtgtaattagtgggtttgtcttgaataatcaacttcataccgacgttagtcttcacaaggctcttggaatcatcattttcgttctaggttgcctccagataatggctttgcttggtcgaccgaagaaggaatcaaaagtgagaaagtattggaatgcataccatcacaacatggggagaattttgatcatactagccatagctaacattttctacggaatcaaattaggtaaggagggaagtggatggaacatcggttatggaattgtgcttgccgtattattcactatggcaattacttttgagactcaattgtgcagtagagacgattaa

SEQ ID NO: 3193 - DNA, 246 bp, Glycine max
  Peptide Sequence Number=SeqID_119971
atgggtaaagtagccaagaagaaaagagaagaaataaataagaagaagaaaaagcgcaaaaatgaaaaagagaggtgtcagtggaaagtgctaaaggcaaaaggggctaaagtgggaaatagccaggccccattacaagccataaaagtccttagtgatccaacgaagacacttgtgagcagagagaaacaccagctttgtaaggaagtaaggcaagccggacctgttggaattccagataattga

SEQ ID NO: 3194 - DNA, 572 bp, Glycine max
  Peptide Sequence Number=SeqID_119972
tgcaaggccaaggggtcatgccgggttttgatggttgtttgtcatttctagaaacaaaagccatcaagaggggggaaaatgataatttcatggaattttctgacttaaactcgcccaggccagcatctggctcgcctgggccatgggaaaggcgaagggtttcaggggttggaaaactgaggaaagaaaggaaaaacgcagaaaaggagaaagaagagaaggaaaaaaagcaaagccaaggcgctgccgaatcgaaccgtgaatcgtttcctacatcatttctcttgctagccttgtaccctgtgcaacagtcgatatgtagaagcaagggcagatggcgacaccttaatgagtattctattttctttcaatgtcccgtcgttaaccaggttgcgacagatggcgactccgctggggagattgttagagagttaagacatttgatcaatgttgctccgttcacacatgacacctacactttttgcatagactttgagacattaggccctatacccgggtctgtgcgagccatagggaatggaggtcgatctgtggtcatgctaggtctctaa

SEQ ID NO: 3195 - DNA, 360 bp, Glycine max
  Peptide Sequence Number=SeqID_119973
atgcaccccattttcgtgcttttagctggtttctttccaaaacttcccggaaccttatggattccatggagatgggtgttaaacgttttgaagtggtcaaatgagggtagcatgccgacaaacaattatcctcggactaaattagggtatgacaaaagggcttttctaatcgatcaccagtcacagaagagagaaaaaacatcttttgtacttgaaaaacaaactgttgttaatcaagaggcaggtctgttgatttctaagttttctaaacacaagggaaggatatccctgggtggttcagaagttgtaaaggaatttacaagtatagtggaaatcttaagtggattgcttgaggactag

SEQ ID NO: 3196 - DNA, 303 bp, Glycine max
  Peptide Sequence Number=SeqID_119974
atgaaattagggtctgacactttgtggcgaatgttgcaaaggtgttgcaacctacccttcaacgggagggtgatgcgaggctcacgggtgcgtcttccaagggaggaaaacgcacagagtcaccaccaacgtttattcgaggaaaacgttagaaaaactgaaacatgtggtctacgaactttaagtgtgaaaggttcaggagttgtttttacgcatggggaaggggtggtcgacaaaaacggggcttttgctcctacatatcctcaacttgtggtgaggaactcagacctacgtggttcttga

SEQ ID NO: 3197 - DNA, 318 bp, Glycine max
  Peptide Sequence Number=SeqID_119975
atgattcaacctaaactattgggattaatttggatcaatttgaattcacaaattttgaagcccgattatagagtaagaattgacaaaggggaggtttcgttattttatgattcattcctggatgagggacctctgtacagcaaggtggactttgctcactatgctgacatgaacttgatcactaaagacattttggggaatgatcagtggcattggaatttaattgcgacacctctatccgcggatataaagaatcagcttcttcatattattctgaatgagtctgttgatgatgttttccccgcgtttgcagtttga

SEQ ID NO: 3198 - DNA, 1638 bp, Glycine max
  Peptide Sequence Number=SeqID_119976
atggctacactgaagacgatctctgcagcactgaacctggtcgattccaagaaagagaatctcaagaaagccttcgacgatctccaatcccttttctctcccctccctctctcatggtccgacctcgattcccacttcaccaccgtccaccactccctcacccaccgcttccacctcctccaatcccaatccgaaaccctaaccctaaccccaaattccgacccaccaccccaaaccccccaaaacgcgaacttttcgtcaaaccctaccgacccatcatcgaatcacgacgaatcttcacctggggtgtccccccaaaacgacgccgttaagggctcggtcacgcccaggaacgaattggtcgctttctgcgagaaaatggacggtgtaggattgatgaattacgtcaatgacaactttcaggatagggcaaggattcaggcggagcttcccggcgcgtttcgacacgcgccggacgccggcgcgatggttctgggagctttggagaggtttcacggggagggtagtggtaatgaattgaaggaatgggaattgaggaggattaggaagacttgcattgtgatgttgaagcagttcagggttgctgctctgagtgtgagtgctgaggcaagtgtgagagccaggaagttggctttggcatggaaagagaggttggtgggtgatgatgacaatatgtttggagctttggggcttttgcatttggtttgtgcatttggttttgtctctgaattcagcttggatgagcttgttggcttttcggttgcggccccgactaatgaggaggacttcccagagctgtgccgggcggttgggttgacggagagagttcctgatattgttcaaaaacttatagataaggacaaacatattctggctgtcaagtatattcttgagtttaatcttgctgacaggatttcacctgttcctattttgaaagcttgtgtggatgaagctaagaaacttggtaaaagacttttccaggaaggaaagtcattgaatgagagtatgtctagagaaattaatacactgagatcggtgatcaagactattgagagttataagcttgaatctgaatacccactagctagcctggaacagcatatagagcaattaaagaggcagaagacaaataataaacgtgctgcaccagctcctgctgcaaagcctcctcagcatcaacagcaacaacaacagcaaaagagaaatatgcagaaccaacagcagcagactgggatcaagcgtcctcgagcatcagcaccagttggccctgcagctgtcctcaagaatgtcaattcaactattcaccactaccagcaatctcttgcccatcaatcaggtttgtttccagagcatccaaatccatacatgagctcgccagccatgccatttggcatggtggctcctaccccaaatgttcctccttatgcaggtccttcagctgggccttatggtcatgatggtgtcccaatgggtcccagtggcaaccccaatcttggtggttctcatcttagcttgtcagagccacatgtgcaaactggtggttattatgatagagcctctacttatggtgggattgggctgcaacattattaccaagcatcttattatcctcaatag

SEQ ID NO: 3199 - DNA, 339 bp, Glycine max
  Peptide Sequence Number=SeqID_119977
atgtacatgtatattaaattgggggatgaagattgtgaattccaaccttgtttagtagaaaaagaaagcaaggattgcatctccaacaaattggcagtccacttcgatatgcttggtgtgttcattggaaaagataagattcttaacaatgtgcaatgctgtttgaccgtcacaataaagttgcatggcttacggtgtagcttactggctcattttcctattcaagagctgcaagaaacgcacgatgtgccaaagaaaagtgatcacaattcaaatgatgtgaaagaggatagacacccaaatgttctgagatgtttgagtgaaggaggctgcacatga

SEQ ID NO: 3200 - DNA, 753 bp, Glycine max
  Peptide Sequence Number=SeqID_119978
atggaagcgactcagggtttctctttctccagtgattatttgaatggtttaggctcaggtaaagatccttcggacgacggaggtggtggtggtccaccaaatcaaaaatcctttcgagatttggtggtaagtcagagacaacttcttagtccacatcctaatgtggatcttattcagcaaaaactggcaaggattaagtacgagggaggcaatccaatgaaaccaatggttttcattgatgattctatttacgaagggttgtgtgctccttgggaggacacattgctcatcaaattgttagggaaaactgtagggtatcattttttgaaggagaagcttgtcaggctatggaaattgtcatcatattttgacattttcgacattgggaatggttattacatgttaaagttcagcgatgaagatgataagaagaaggtgatggaagaaagggacatggacgatcttcaatcactacttaatgttgttggtagacctaccaaggtggatagcaatgtgaaagatgataggagggggagattggctcgagtgtgtatagaggttgatctgaccaaacaagttgtggggaagggagtgtcctatctgtcttctcatttagacatgtataagaattccagcaagggggtggagagctcttctactgcaatcaatgtggagtcagcatttacaattactaataaaaaggatacaataattgaggaatttgatttctctgttgtctctattgtcccatga

SEQ ID NO: 3201 - DNA, 417 bp, Glycine max
  Peptide Sequence Number=SeqID_119979
atgccttcgaatgaggaagcttttcatcaaggtatgtatgttaagatcagtcatgcctccacaagttctgacattgcccatatccttcaaagtggagatgttcccccagatattcaaaacaatctttggaatcaccttacaagcatgtctaatagtattgatggaccttggattctcttgggagatttcaacaagattcttcatccttttgaggtcactggaggtaattttagtgtttctcgctctctccttttggctcaagttgctaatgattgtggcatcagtgatcttgatactcaaagtggacattctttacttggaggaagaacattcaaaatgaaggtcatatccgcaaaaagttggacaagagtatggctaattcttactggtgtcttctttttcctcatgtctttgtag

SEQ ID NO: 3202 - DNA, 243 bp, Glycine max
  Peptide Sequence Number=SeqID_119980
atggacgccggcgaagccctctctgacgatccgaatcggcccaattccgccgccgacgcagctccggccaccgccggagcaaggtacaagctcatgtcaccggccaagctcccgatctcgcgctctccgtgcgtcacgattccgccggggctcagtccgacgtcgtttctcgagtcgccggtgctgctctccaacatgaagggcttcttattttttggggctaggttcaatgttcgggattga

SEQ ID NO: 3203 - DNA, 1065 bp, Glycine max
  Peptide Sequence Number=SeqID_119981
atgcatcaagatgcactggtggaaccttcaccgactacaggatccctttctttgcttcatcaaacagcacatggttccgtgacttctgccgcatcttctacatttcctgtaaccactctagtaaaactgatgaatataaaccttcaagttcccgcagactttgacaaccatgcaagtgaaaaatctactcaaatagatggtcaaggaaaagctcaagcttttgattcatcaccattagtaaaaaatgagtcagcatccccttcaaatgaattaagtctatcatcacctgttcaaatggattgctcaggaggtagtgcccgtgttgaaggtgatttggatgaattgaaccctagaagcaacataacaactgggcttcaagcatcacaagttgacaatagaggtagtggactttccgttgcagctgatagagtatctgatgatggatacaactggagaaaatatgggcaaaaacatgttaaaggaagtgaatttccacgcagttattacaaatgtacacatcctaattgtgaagtcaagaaactatttgaacgctctcatgatgggcagatcactgagataatttacaagggaacacatgatcatcctaaacctcaaccaaaccgccgttactctgctggaactattatgtctgtgcaagaagagagatctgataaagtttctttgaccagccgagatggcaatggatcctatatgtgtggccaggggtctcacctggctgagcctgacagtcaaccagagctatcgcctgtagcaacaaatgatggtgatctagatggtttgggggttttgtcaaaccggaataatgatgaggttgatgatgatgatcccttctcaaagcgaagaaaaatggaccttggaattgctgacatcactcctgtagttaagcctatccgggagccacgggttgttgtacaaactctgagtgaggttgatatcttggatgatggctaccgctggcgcaagtatgggcagaaggtggtgagaggcaatcctaaccctaggtatgtcctctcattgacgactatacagcataaggaaaattga

SEQ ID NO: 3204 - DNA, 222 bp, Glycine max
  Peptide Sequence Number=SeqID_119982
atggaaattaaacagagcttcttctccgtgagacgcgccaaggctttcttcttcttctccgcgaacagcactagtaaccttagggtagaagacgagaggggagaagacgagagtatgccggaaaaagtgggggaaaaggctgacggcggagtcttccgaaagacccgttccggaagaacctcttccggaaagtttccggaagaagtgttcttccggaagtaa

SEQ ID NO: 3205 - DNA, 417 bp, Glycine max
  Peptide Sequence Number=SeqID_119983
atgggaacacgaactgaagcagatatatcaaataacaaatgcaaaagcaggtcgagcagggaagttggagccgtgaagtccacctcgtccacttcaatggaagaacaacaggctacggggaattggatgacgccacttccagtgaaggaagataagtcagggagcggatcgtttgatacaggctacgaaggtttggatgacgccacttccggtgaaggaagtcagggtagacgccacaaggattaccttgataagtctgataattggttcaacaaggaacctagagagaaactctcacccaattttatcaaatgccaaaagccttcatccttctccacttgggccttcatccttctccactcgggggctttatccttctccacttgggccttcgcccttctccacttaggcctttag

SEQ ID NO: 3206 - DNA, 192 bp, Glycine max
  Peptide Sequence Number=SeqID_119984
atggcactacatgaaagtggtgtttgcatcaaggagtggcagtttgtcaacaaggacattggagtcactgcgaagaaaccagggaagatattcgaacaacaactgatacctacttcactgggctgcaaacggaaagagaacaataaccctcagatgcagaatttgttaacactccaataccagaaactttaa

SEQ ID NO: 3207 - DNA, 180 bp, Glycine max
  Peptide Sequence Number=SeqID_119985
atggacaaaaatgtttatgaacccactggaggtgcttatggcacagggagaggggaatccaagagagaagttgatgagggttttcatgcgcaagagcaaggtgaaggtgaggaggatcagctagaagcagaagatgcagcactatcagcgctgatggtgggggctctaggcggtaggtga

SEQ ID NO: 3208 - DNA, 138 bp, Glycine max
  Peptide Sequence Number=SeqID_119986
atggaccggattgagacaagtagtaagagaacatatagaggaaaagtcaagaagtctgaacttgttcaaaaagaagtaagcaatgcacttgatgttctcaatgatgaagtggtgactataccaacaaacttgagataa

SEQ ID NO: 3209 - DNA, 150 bp, Glycine max
  Peptide Sequence Number=SeqID_119987
atgcactctatcagcttcttgctctgccagtatctcctggcaaaggtgtgcgatatatatccacgcattgaattggctaacggccaaaccaaatacgccaaatacagtgattcaaaaagcattcaaatgcctaaggtgcgccgcatttta

SEQ ID NO: 3210 - DNA, 294 bp, Glycine max
  Peptide Sequence Number=SeqID_119988
atgggcaataggcttctagaacttgggggcaataaccattcttatgatgttgatcagttaagaaatatgagagttcctatcgaagataggataacagaagataacaacatggtctccacaggagatgctttgtccattcctagaaaccaacccgtggatagacatataattcaggaaacaccaatgcaagaaagagctaataataataataataataatcttgaaaatgaagttaatgtcccaacacggttagtggatgatagagaacaaccaaaccctattttggtgacttga

SEQ ID NO: 3211 - DNA, 2271 bp, Glycine max
  Peptide Sequence Number=SeqID_119989
atgagcagagagataaatggcatagtgaagggctgggaagcaacggttcgcaaatcaagtggtgcaaagaaaagggcaaacaacatctttacaccaatgttcgtggcccatgtggatgatgataagtcaacagaggtgtgtcaggttgagaagattctccctaacggtgacttctacataggccaatggcttgaaaggtacccccatggccaaggcaaatacctttggacagatgggtgcatgtatgttggtgaatggagcaaaggaaccaacatggggaatgggaggtttagttggcctagtggggccacctatgagggtgaattcaagagtggtaacatggatgggagaggcacctacattggttctaatggggacacatacaaagggtcttgggtgatgaacttgaagcatggacaaggaattgagagttaccctaatggggatttctatgatggggagtggagaaaaggactgcaaaatggacatgggaggtaccagtggaaaaatgggaatcaatacattgggcaatggaggagtggggtgttttgtgggaatgggacaatgatgtggagcactggcaataggtatgatgggtgttgggcagaaggattgcctaagggaaatggtacttttaggtggggtgatgggagtttctatgttggggtttggagtcaagatccaaaggagcagagcgggacctattactcttctagatcttcagatgaccacatggatcgagatcctcatgatgtgttcaaggtggagctgaatgatttccagatttgtccttgtgagaaggtggcaatttacccttcacagaagacattgagtgtgtgtggcaaagaggatgataataagccagtgcataagaaaagaactgatgagagtggaaggccatggtggacttctgaggatggaagggttagtaattacaactctaaaaataggtcttatgcatttgatgtaggtaggaaatctagatttagttccttgggtgatcattccattttgagccgaaacagtttggattgtttgagaataaagaatcccaaaagacaaggagagaccatatctaaagggcacaagaattatgagcttatgttgaatctgcagctaggcatcagacattctgttggaagacctgctccaagtgcatctcttgatttgaagtcttctgcatttgatcccaaagtaaaagtatggactagatttccaccagaaggatccaagcacactccaccgcacccgtcttgtgagtttagatggaaagactactgcccagtagtgttcagggctcttagaaaattgttcaaagttgatcctgctgattatatgatttcaatatgtggcaatgatgcccttcgagagctctcatcccctgggaaaagtggaagttttttctatttgaccaatgatgaatgttacatgataaagaccatgaagaaagcagaagtgaaagtttttctaagaatgcttccaacttattataagcatgtctgggcttttgagaacactctagtcaccaagttctttggcctctactgcgttagacaaacaggggccacacagaagaaggttcgttttgtcatcatgggaaacctgttctgttcaaagtatgtcatccacagacgctttgacttgaaaggctcaacctttggtcgcactactaataaacctgaatcagaaatagagccaacaacaacacttaaggaccttgacctaaattttatattccggttgcagaagtcttggttccaagaattctgcaggcaagtggaaagagactgtgactttcttgaacaagagaggattatggattacagtatgttggtgggtcttcacttcaaggaaacaacatccgttggcactatcgcaccttcttgtcacagttcaacaagttgcactaccccaactggtgttgacgatggattgccacatctttctggagtggatgcaaatcattttattatagatcctagtcggaggattcaactaggagtgaacatgccagcaaaggctgaaatgacgacaagaaaaagcactagtgacactcctcggctggttggagaaccaactgggaagttctatgagatcataatcttctttggcatcatagacatattgcaagactatgacatcagcaaaaagcttgagcatgcttacaaatcattccaatatgattcaacatcaatctctgcagttgatccaaggctatactctaaacgctttcgcgatttcatcttcggagtttttgtggaggacacttga

SEQ ID NO: 3212 - DNA, 912 bp, Glycine max
  Peptide Sequence Number=SeqID_119990
atgtggccttttcctgtgttgtgtcatcctctgcacaatctgataccaacactttttttcgcatctgctactgcaaactatgttcagcagaattcctactcttcacatactgattggaatcagaatcagaatgctggtcgtggtggttgtattaatggcagatctggtggcagagggggtcatggaggacgtggcggtcatagttctctgcagtgctatatttgtcagaagtttggacatgtggctgcagattgttggcacaagccctcaactactgtctctccttattccatgatgtttccttgtccaaccccaaatggttcttatgcagccaatgcaacaacctgttatgcaacaggcattcatgcagcaccctctcatgcagcaacctgttatgcaacaaccagccatgcagcaagtggttcccacacagatggctatggtctcccctcaccaaatgacaagttacactcccaaatagaatcatgctctcaagctatgactattggttcaacttttgaccaatccaacatttggtattctgacttatgtgcctctcatcatgtcaatgccaatgttgagaacattaagcagtgttcttcatttgagggtcttgatcaagtgattgtagtcaatggtcaaggtctgctcatcaaatctattggttcttcctcctttatttctccttataatcattctgctgatctagttctaaatagaatattgcatgtatccaatgaggttcttctcaaaggacatcttggatccaatggcttgtacacatttcccaagctgttgtcaaattccacttcttcaagctcaattgccaagtctacttctaagactgatttgttgccttccattgtaaaatcccactttcctgttaattcagcctctataaatactgtttga

SEQ ID NO: 3213 - DNA, 387 bp, Glycine max
  Peptide Sequence Number=SeqID_119991
atgaacactgtcctttcgtttcttacgttgtccaaaacatctgtttctttttgtcccttatttttcaatttcgctgttccttcttccaaatccactcacattgaacttccccgcaaaaggggttctcaaaacactggacttcgctgcaaatgtagcatctggccaggtggccctggctctggtgatagtgatagcagcaacagaagtgtcctggatgcatttttcttgggaaaagctgtagctgaagctctaaatgagcgcattgaatcaacagttggtgagattttgagcaccgttggaagattgcaagctgaacagcaaaagcaagtgcaggactttcaggtatggagcagtttaaactggcattatcttgtgctagataaataa

SEQ ID NO: 3214 - DNA, 123 bp, Glycine max
  Peptide Sequence Number=SeqID_119992
atgggagatgaggctatgtggcattctctggttcgtgaggacaagcgcagaagtataagttcatgtcttttcatcttccctaggtcaggttttagtgtttttgagcttcctaaaccattatga

SEQ ID NO: 3215 - DNA, 207 bp, Glycine max
  Peptide Sequence Number=SeqID_119993
atgcgcgagaggcgcgctaagcgcaattccaacccgagagagaattgcactgagtgcgaattgtcgcgcttagcgcaagaggaattgtgctcagtgcgaattgttgcgattagtgaaaatttcaacctaagaggaattgcgctaagcacaaaaaactcgcgcttagcgccaaaaatggactcctgcttagcgagacgagttggctaa

SEQ ID NO: 3216 - DNA, 1075 bp, Glycine max
  Peptide Sequence Number=SeqID_119994
gactacacgtcctcgccttcagaggactacacgtcctcgccttcaaagggtcatgtaccttcaccttttgtagggctgcatgtcctcaccttcgtagggctacacgccctcacctttagaggaccacacgtcctcaccttcagagggctacacgccctcgccatcagaggactgcatgtcctcaccttcgtagggctacacgccctcaccttcagaggactacacgtcctcgccttcagaggactacacgtcctcgccttcagaggactacacgtcctcgccttcaaagtgtcatggctacacgccctcacctttagaggaccacacgtcctcaccttcagagggctacacgccctcgccatcagaggactacacgtcctcaccttcgtagggctacacgccctcgccttcagagggctgcacgccctcacctttagaggactacacgtcctcgccaacagagggttgcacgccctcaccttgagaggactacacgtcctcgccagcagagggctgcacgacctcaccttgagaggactacacgtcctcgccaatagagggctgcacgccctcacctccagaggactacacatcctcgccttgagagggctgcacgccctcacctttagagggctacgtgtcctcattttcaggacaagtagtttccttttaacggttcctgggccaccccctgatattggaggagggccaactgtgcgagcacaaccagagagggaggctatcacacggctactatgcataccggggcaagatttcacccgtgccgctgcaaagagacgacaacattctgcccagcgaccgcaataccgatctccccctgcggaagtatcagttggtctgtgtcgtcccgacatagggatcgcacccacaaagacacctagtggacctgaagaagtccaacagggccctggggtttccagctctggttacgggcctctggatcctgcccgcaagacacctagtggacccgaagaaggccaacaaggtcttggagttgccagctctaaatacgggtctctgtcagttatagggagtgtctgtcgcccccagcaag

SEQ ID NO: 3217 - DNA, 423 bp, Glycine max
  Peptide Sequence Number=SeqID_119995
atggcttctctagcaagcttagatattgttcaaccatctactatcaagggccttgctggatcttcccttactggaactaagctctctttcaagccctctcaccagagttttagacccaagaatttcaggaatggtgttgtggtagcaaattatggtgacaagagtgtgtactttgatttggaggatctaggcaacactattggtcagtgggacttatacgtcttcgatgcaccttcaccctacaaccctcttcgggcattggaagcaataatattggatagtttcagttttttcctcttggcctttactaaatttttgtattgtatggcttacgcgaatttggatatcaatggacaaggaagtggttatgctacgtggtttggtgatctaattgatattagacagtttgcagttggaggctag

SEQ ID NO: 3218 - DNA, 303 bp, Glycine max
  Peptide Sequence Number=SeqID_119996
atggccgtcgccagcttccaaaggacattcaaagagtacaaaaaccagtcggtgaccatcgatttcccgtgcgattttctgggaatatcgatgctggagcagccgaacaaatactacttcatcatttgtggccataagattgttttggaggttgattcttctatcttgcttatcatggagaaactccagtcctacaactccaaagtcgcccttcatttcaagtgtgtttatgatgtaatagcagtttttgccgaagcctcactgcaatggagtcgcaatagcggattggaggatttccgttaa

SEQ ID NO: 3219 - DNA, 258 bp, Glycine max
  Peptide Sequence Number=SeqID_119997
atggacaccactactaaaactacccccaaaaagtaccctaagaagatccctgagaggatttcacacaaaccctcctttggatcctcttcgggatcctcctctatagcatcctccatgtcgttgttgatcacaatcaaaagtagagcctctctcctcgcctatggggtagctaaaactaaatattgtgtagtcaaaggaattaggctaaaggtgagtaacgccgccctagggatagcaacattagaaggcgtcgcctaa

SEQ ID NO: 3220 - DNA, 150 bp, Glycine max
  Peptide Sequence Number=SeqID_119998
atgggtgaatacaaccaactatcattaagaatctcatccttagaccaaaaacaggcaaaaggtggaataccgcaaagagaaagcgtacccactaaaaaagaagtttttgtaattgctggagaatatccgacaagagcttccattgaatga

SEQ ID NO: 3221 - DNA, 345 bp, Glycine max
  Peptide Sequence Number=SeqID_119999
atgacggccatgacaacaactttacacaggcttatgctacagcgacgacgtgtgcgacaacggcagtacaaccctgacagtgagctggtgatggagaaaggctgcaatggcgagctggtggcaaggcctccgcgacggcaaactgggtgcgctgaagatttaaatttccgatggatccatattctgtcggaaattccaccagtaattttcgacaaaaccaaatccatggacaaaaatctgtcaataataaaggttttccaacaggatatttatatgtcggtaaatttcgtcaataacgtcacaatttccgacaaaatattatccgccaaaaaattttgtcaataa

SEQ ID NO: 3222 - DNA, 267 bp, Glycine max
  Peptide Sequence Number=SeqID_120000
atgatgtgttccccgttagatgagggtggtttggatatccctttggcctccttgataaatgatgctgcctctctcaagctctattggaattttgtcttctccaatgagatttgggaacaatttctgagggtcagattacttcccaatagctgccaggttctagttacaataccaatttttggaatgattcatggtgtcttgatagatcaatctctgatgttcttaatctccctacctctattagaaggttgctttcttcctcagtga

SEQ ID NO: 3223 - DNA, 273 bp, Glycine max
  Peptide Sequence Number=SeqID_120001
atgggtcccacttatagggacctctctctgataagcggaccactgaatctcggtgggtcgacctgtaaggtacagacacgtggacaacaaagaggttttggaagggtttctttgattggggatcaacagcggcagggaaagcaggagattgcgaagcggtggaactggaaggggtcagccgataggggtgcatttttcattaatgggataattgagtatcacgactttgtaggaacccccatgttcttcatttacttcccccacttcacataa

SEQ ID NO: 3224 - DNA, 195 bp, Glycine max
  Peptide Sequence Number=SeqID_120002
atggagtggaaaacgttggagtttgtcgaagaagcaaaaaactcaaattgcagtagagcaagactcacaatctcgaactggagcaaagcagtcaatggcttcttcactttcacgagagacataggaacctgctccgtgttccaagatgggaatcaaaccatggtcgcaagagggagagatggctatttcgaatga

SEQ ID NO: 3225 - DNA, 591 bp, Glycine max
  Peptide Sequence Number=SeqID_120003
atggcccgcaccaagttaactggccagatgacatctgaggcagcaaaggaaattgctgagaagattgattcgttggaggagcaggcgtcacagggttcctttgtcccccatggacgtcaggatgtcctgactgttgccattggagccagtgtgacgatcaagctatactttggaccggctccacggacctcccgcacttcttcctccatgactctcgaagaactagagcagttgactcaacaaatcagggaccaactggaggagtcgatcacagataaacttgaggctggtccttcagctgctcgtgtcagcataaaggagaattatgttgatccctcagggaatgatccagacaccggtgactcagacaaatgcgggttgtacatcaacgaaaatcctccttgcctggttgccctacgaaaagtttatgaggggtccataaccatgcacaacatccctttgatgcatgatcaagtaataaggagacactacaagaaaaatgacttatacctacagacaaaaactatcactataagtaaaaaatccataggtaaatgtttagatcttagagagagcttagaacatacataa

SEQ ID NO: 3226 - DNA, 230 bp, Glycine max
  Peptide Sequence Number=SeqID_120004
agcctgcatcagggccagctcctgatcatgcagagcttgcaggatgtggtccaccagcaaccagttatgagcgtggaggagtttctgcagaagccactcccactccacctgagccatttatttttgaggatgatccagtgactgcagagggtactcaacaggcatctccagcaggcactcttacactggatctgaatgagcatgccatgaactctgcacaggatcattga

SEQ ID NO: 3227 - DNA, 408 bp, Glycine max
  Peptide Sequence Number=SeqID_120005
atgtttcaattcaatcatgatcgtgcagatataaggtgtacattgaaggttctgcttggtcagtcagtcaaaaatacattctgtcatgtgactctaccactctacgtgtacgactacatgtttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgatcctccaactttgtatgcaacattacagagaaaggaaagctcaattcaacaagttgagtcatgggagaaaagttattgggataatcaaaccataacatcttaa

SEQ ID NO: 3228 - DNA, 324 bp, Glycine max
  Peptide Sequence Number=SeqID_120006
atgcctccaacaaatttggctaaggttgactttaaagcacaagtttgcttcctcttttccttcttcattagaggagttgtcatccaagtcctcccaggtcctcatgagactcttcgtgttcttcgacttgaaatgttccttaagatgaatgcaagctcatcatcctcgccagattctccatcagagaagttttccatgctcagagctttggacgagcatttggacattgatctagaagatgactcattggataatggaatctttttgggcttctgggcactgagttctgaatacttccctttcttgactcatccatcttgttga

SEQ ID NO: 3229 - DNA, 1266 bp, Glycine max
  Peptide Sequence Number=SeqID_120007
atggacatcattggaaactttcttggctttggtccaaacatcatagcaatttgtaaaatcccggattattgtcagtcaaagtggtcaagggagcagcacgaccttggccttggaaccacaactaaacaacagcccaagttctatagtttgctttcctggttaattttcgcatgggatcagcaaaatagtagtaaaattaacagtaaaactcgcgacagtagtacaatcgggagagaggccatgagaagccacataaaaagtgccaagcatggggtggtagtcccagaccggtgttttggcaatttaaattctttggtcgtggaaggatgtgaatttttatcaaaaggcgtagtactaccttctcatttactttgtttcctaaataatttgaaagtgttgcaagtgcggaaatgtaattctgttcaggcggtacttgatcatacaactgatcttgtttccatccccctgaggaaactgattttggaccaacttccaaatttgaagcatgtttggaatggaggaagtcaaggaagtctcaaccttccacatctggaggaagtgttagttgatggatgtgaaaatatagaaagtttgtttccagcatcaatggccaatgatgagctacgaatacttgaagtggaaaactgtgtcagtttagtagaaattgttgcaaaagatgaagtagccacagaagaagtaaatacagagcgtattatattccaaagtctgactttgctgaggctgtggaatttgccaaaattgaggtgcatttatcctggaatgctcattctaaaatggccaaagttacaaaaattagatgttttacattgtgaagtgctgaggttttttgccactgaatttcaaaattccccagattcacatctagaggatcgaaatagttttccaactgaccagcaagaatctgtctcacttaggaagagatttgatgaatcagatgtatttccatttgttttcgtttcagagaaattggaggtgttaaaagacggatttgataaaggacatgatttaaattctgtgatcaaagaacaatctgatgatgccagtagtgtaatgacagattcgaacgacttctataattttgcacgcaagaggatatggtggagaactagaagcttgttatcattcccttgtctaatgcaaattttccagcagcaacagagcaggaaacctgaatgtgggtttagtcatttgtgtgcatttatttttccatcttgtgcaaagatgcatgaatatgatcgtacatga

SEQ ID NO: 3230 - DNA, 318 bp, Glycine max
  Peptide Sequence Number=SeqID_120008
atggaggcaagggccactaaacaagctgaggacgatgttgccaagattactaaggtcttaattgatctcaacatatctaatgcattgcaagagtttgaagaacaagcagtgtccactgcaaagtcaaatgctaccaaggctgctagtgctctcattgaagacaacatccaagagatgttgaatcaagcaatgcaaatacaaagggagaaaacaaggcaggcacttcaagttatagttgaacaatggagtttggagaatgagcaatatcgactttccatgcaaaatgccattgctactcagttcaccaatttgtcttag

SEQ ID NO: 3231 - DNA, 240 bp, Glycine max
  Peptide Sequence Number=SeqID_120009
atggctttggtagagagagttgtggttttgtttacagtgatgacaattgtgaaggtttcgtatgaagttatatacaaggttggagactctgctggttggactacccttggcaccatagactatagaaaatgggctgctaccaagaacttccaaattggtgacactatcacggcgccgatggtgacacgaaacaacgatgacaaggtgatggtggtgtggcaaaatgcagcaatgtcgtga

SEQ ID NO: 3232 - DNA, 294 bp, Glycine max
  Peptide Sequence Number=SeqID_120010
atgaagtttacagaaattgagggcttaaagagaaagttgactagcaagcttggtgctaattcatcagttgttgtgcctgactggtggttattgagttctttattggattggattgttgctctatttttggactgtgctgctcatcatcacaggtggtcattgagttatttattggattgttgctttgattttggaccgtgttgctcctcctcacagttgttctctgagtgcatacttgattatcaaggaattaatctcaccaatttcatgtcgtgtacttggagaccaacgtga

SEQ ID NO: 3233 - DNA, 609 bp, Glycine max
  Peptide Sequence Number=SeqID_120011
atgcagagtggatcccaatctgaatcatttgatgtagaaatgagagatcgcttggaggatatgatttgtgaccttggacaagagtcttttcagcaagcacatgcccctatgtatggtacattgcaaactgattcaaagaagcctttgtatccgaggtgcaagaattccttgacattgttgtcggcgatgttaagtctagttaatgtcaaggcagatatgggtagagtgacaaaagcttcactgcttcaagtagtgcacgatatgcttccagagaaaaatatgttacctaaaagttactatcaggccaagaagatattgtgtccgatgggtatagagtatcagaaagttcatgcttgcctgaatgattacatactgtacagacatgaatttcaagaaatgcccaaatgccctaggtgtggggtattacactacaaagtgaaggatgatgacgagtgtagtagtgacgaaaactcaaagaagggcccctcagtgaaagtgttgtggtatcttcccatcattccaaggtttaagcgtttgtttgctaatagagacgatgcaaaaggccttacatggcattgcatcaatgctatgacggtctctgatgcttga

SEQ ID NO: 3234 - DNA, 303 bp, Glycine max
  Peptide Sequence Number=SeqID_120012
atggttgtacattctaatttggcttcatcagagaagaaatctagcaatggagtgaatgagttgctgaattttaatgctgagaacatgcaaagcaacatgaaaattatatattacaggtttggtttgcttgctggagttgccctaacaattagcatgttaactaaaactaaacaacataagcacatgctttcgactaacaacaaactggaatcaacactggtagggttcataccttttaaggagttgacagatgaagtggtccgctgtatcttcgaacaccttcaactcagagacctaggctaa

SEQ ID NO: 3235 - DNA, 717 bp, Glycine max
  Peptide Sequence Number=SeqID_120013
atgctccttccaattatgcttagcttccactctcaaaatgctttgtactgggactctttttactttcatgagaaaattttaggttggattgaatttagagttagtataagagttaatatgccttatattcctatgttggtgttacatatggcctcagagactttgcaaaacaatcttttcaaggctcgggaagaaaaatgccaatcgagaataagagtactcgaggcacttgcatttggaactatagatgagagtgagggtgagaagatcaaagagaaagtaaagaaggtagatgagaatgaagtttttaggttgataaaagagcaggaggacaaaaatatggaaatttcggctttgaaggtagaactggtaacaaccaaaagaacatatgaagtacaattctcacaaatggaagaagaagctaagagttttaaagcatcattgacatggaaggtccaagaatatgagcagcaattggaagaattaagaaatgaggctgaaaagatcaacgaggaagtaaaaacgacagatgaagaggaatctattaaattcatgaaagaacaggaggaaaaaaaattggaaatttcatcattaaagcaatgttcacagttggaagaagacgctaaagatgctaaagcagaattgacacagaaggcccaagaatatgagaatcaattggaagcattagggaataatgtaattgtttctttaccttga

SEQ ID NO: 3236 - DNA, 1083 bp, Glycine max
  Peptide Sequence Number=SeqID_120014
atgaattcaagattcaagagaagaaatcaagaagcaacaagtcaagacttcacaagggaagtattggcaaggatttttcagaaaccaagcatagcacagttttgttttacaaaaagagttttctcaaatttttctaagttaccagagtatttactctctgtagaaggtacatctacttgggttgttgtaattgagaacaagagagggtacatctcttgtggatcagttcaagtggagggtacatccacttggttgtttaaagagaacaagggagggtacatcccttgtggatctttgcttgtaaaggattttacaaggttgaaagaaatctcaagaaccgatggttgcttagggactggatcaacacattccccttctaccttgaagaggacaagaaaagcgacacgactaagatcattggcgactagaccagttggggcggagagaccattggtccatgtggatcctacggccaggaaaaccgtttgtccccacagaaagaagttaaggacatatttatggatcgttgctcgagataaggtggatgtgacatatgagaattggaaacaagtccttactgcccataaggattggatatgggaggatattcagtggtggagacagtttaagtctgatttgacggtgaaatggacatttccagccaagaaggacagtgtcgatgacactgtatgtgaaaagtacggcattatcaaggagaagtggacccaatttcgtcaaagtcgtagagacccttcgtgggaagagaagaaaaagaaacaactggaggaagcagctaaatccggaagtactaataccgtcattgatcctccatctcccatcagacgacacgtgaagtggaagatggcccgcacgaagaaaattggccaaatgacgtccgaggcagcaaaggaaattgctgacaagattgatgtactgactgccaccattgggcgaccagaacaccctggtcgtgtctgtgctgctagagctggtgtcacgatcaaacaatactttggactagctccaaggacctctcgctcatctttgtctttggctctcaaagatctggagcagctgatgtaa

SEQ ID NO: 3237 - DNA, 741 bp, Glycine max
  Peptide Sequence Number=SeqID_120015
atggtctatcttaactggttgctctctaataagcccatagacctggaaactgaactaacactaggatttttgaatcaccttctgttgggcacctctacttcaccactgaggaaaatattgctagaaagtagactgggtgatgccattgttggtggtggggttgaagatgaactactccagcctcatttttgcattggaatgaagggtgtttttgaagatgatattcataagggtcaatggatttatgatatgaatccctttgagccactgaagtatcagaagcatcttcaacacctaaaatctaaaatagcaaaggagggttctaaatttgggttttctcctctaatagagaaattcatcttgaacaaccctcatcaacttaccatgggaatgcagtttctttattacttatctttagaaacttctcacccaccagaagctttgaaaactgttcctagcctttctctacaaaaattccctaaagaacctattcatgttcccactgaggttagggatatcaatggagtaaaagttttgcagtatgatctcttcaccgatgatgtcctttacactgaaatagtattcaacatgaaatcattgaagcaagagcttcttccattggtgccacttttttgtgaagctttggtggaaaaggttgtggagacaccatatatgacacctactacttctccacctttctttactcctcctttcactactcctatcagtccctgtaactag

SEQ ID NO: 3238 - DNA, 300 bp, Glycine max
  Peptide Sequence Number=SeqID_120016
atgatgaaaactgtgcattatggggacattccatcgcccaaggacagtagggggaccttgaggaattcgtttttcttgccgtcactatgggaaagttacatgcaatacctgcaactgctggaagagttgtcctttgccaccgccatgagcaaactcaagttcaaacatcatttggactctgacatcgttgattttgaggtactagcttcacttgtaattgtggtttgtttgattgagatggttgtgcttgcgggaacctttggcaccaatgtggttaatattgtgatgttgaatttgtag

SEQ ID NO: 3239 - DNA, 1092 bp, Glycine max
  Peptide Sequence Number=SeqID_120017
atggagggcaaagaagaggatgtgagagttggagccaacaggtacggagagaggcagccaataggaaccgctgctcaggccaaagactacagagagccaccctctgcacctctctttgaggccggggagttgtcatcctggtctttctatagggctggcatagcagagtttgtggccactttcttgttcctctacatcacggtcctcactgtgatgggtgtggccaaatccaagagcaagtgttctaccgtgggcatccaaggcattgcttgggcttttgggggaatgatatttgctcttgtttattgcactgctggcatctcggggggtcatattaacccagcagtgacgtttgggctgttcttggcacgcaagctctctatgacaagggcaattttttatataatcatgcagtgcttgggagctatatgtggtgccggtgtagttaaggggttcgagccacacctctatgagaggcttggtggtggtgccaacacaatcgctaaagggtacaccaatattgctggccttggagcagagattgttggcacatttgtgcttgtttacactgtcttctctgccactgatgccaaaagaaatgctagagactcccacgttccgattttggcaccactgcctattggttttgctgtgtttctagtgcacttggctacaattcctgttacagggactggtatcaaccctgctagaagtctaggtgcagccattatcttcaacaaagaccaagcttgggatgaccattggattttttgggttgggcctttcattggggcggcacttgcagctttataccatgggagttgctacgtgcacccagcattattgctggggcacccagcaaacagtgaagtggcgaaactgcccttcatcaattcttcttccggaagaagattttttccggaaactttccgaaaaacctctttccggaaattttccggaagaagaatttgtgacttctggaagtacccagaaactacttccggaaaaacgtcattcggaatgtttccggaagaatcttcttccggaaacttccggaagaaggttcttccggaagttagtttttttttttaa

SEQ ID NO: 3240 - DNA, 492 bp, Glycine max
  Peptide Sequence Number=SeqID_120018
atgaagaaattgttgaattggttgttattttatgcaggagaatacttggctctaacaggagaaaagctcaacggagtagatcgagatggttacttgttggcttgctacacactgttaaacactaggcttccattgatcatagaacagttggggaaattggttactgatgacccgtctgtcattgaaaccactttagaacagtatggtgagcttgtacatccagatagcagtagtatacgggaaggtagatttcagacacttgaccaatgcttgttgcgtgaataccgtatggctttacaagcaatacataggcagatatttggggattctggagtgagggcacgcgtggtggacaaggacttggcaccaaagtgggatcctccaaccttagaaaaggtgtctcaagatatggtggatcagtacttcttatctttgagtgaatctgaacctgatctagagctgcccacaaacagtagtgaagcatttttgtag

SEQ ID NO: 3241 - DNA, 516 bp, Glycine max
  Peptide Sequence Number=SeqID_120019
atgacaggcctagtcaccatcctaagtggcaaggggttgggttggaaccgggtcaagggttgggaaaccttagttgcctcacgcagaaaatggccaaaggggaaccaccacagagggtggcgccctgaccccaacaccgctagtgttaggctcaacaatatgagaccgccacaggggcagcagcggtgtgacgggggcgaaggtttcgcggtggtgtcgccggcggcccaggtgcacaacagtaagatgaagcgaaaaaaaaatggagggaaaggaaaaagcgaagaagaaaagaaagaggcaaagcgaaaggagaaaagaaagaaaaaaatgaggggaaggcagacagcgaagggaagggaaaggaatagaggatacctagagacccctctcccttctctgatagcagtgccaaatgtcacccttctgttggccaattctcttccccaggatccatgctcctctcccagactttccttctttcccttttttgatgcagtgttatcctcttcttga

SEQ ID NO: 3242 - DNA, 372 bp, Glycine max
  Peptide Sequence Number=SeqID_120020
atggcgtccaaccgaaacaaaagcagtagccgggctcgcggaggaggagaactcacagggtcgcggaagagggaaaagcataagcaagaggaggagagggccttccctgcactaagaagaaactgcaggtctatatttgctggaggtacatcctttgtggtacaagtagagtgtacatctacttgggttgttataactgagaacaagagagagtacatctcttgtggatcagttcaagtggagggtacatccacttggttgttcaaagagaacaaaggagggtacatcccttgtggatcttttcttgtaaaggattttacaaggttgaaaagaaatctcaaggactgcaggtcgcttggggactggatgtag

SEQ ID NO: 3243 - DNA, 225 bp, Glycine max
  Peptide Sequence Number=SeqID_120021
atgggtgggtttagaatcgagttagggcaacctgacccaacccgtgattatgcaacagggttggaaaaccctagttgcctcacccagaaaacggcgcggccaaaggggaaccaccacggagggtggcgcgctgcccccgacaccgttagtgttgggcccgacaatatgataccaccacaggggcggtggtggtgtgatggcagtgaaggttttgcagtggtgtaa

SEQ ID NO: 3244 - DNA, 429 bp, Glycine max
  Peptide Sequence Number=SeqID_120022
atggatgagatgctcaaaaggctagatattgtgctgaattctatcaaccaagtgttggaggatgctgaggaaaagcagtacagaagccctaatgtgatgaagtggcttgatgagcttaaagaagctatatatgaagcagagttgctgttaggcgaggttgctacggaggcgtcacgacagaatctggaagctgaatttcagcctgctactagcaaggtgcggggcttcttcatggctttgattaatccatttgacaaagaaattgcatctagggtcaaagaattactagagaacataaattttttggcagagcaaatggatgtggtaggactgagaaagggaatttgtgctggcattgaagttggaaactccccaaaagattgccaactacatccttggtggatgaatccaccatatgtggtagagagg

SEQ ID NO: 3245 - DNA, 663 bp, Glycine max
  Peptide Sequence Number=SeqID_120023
atgaataatttttttactgttcaatgttcacaaaatacacgtggtctcccctcttgtcctcttaacaaagggtgcctcaatccaacgtgcgagatcgttgaacccaccttggccacgtccaccctgactcagccagctccagattttggtaagtatatttggtgcccaccatgggaccgcggtaaaacttatcccgtggcttctctttcacccatggttagcatacggtttgacctcagatgtaagatctcttttgaaggttccaatcctcgtccaacaaccatggcagatattgatactctccaacaactccaaacccgcattgcagagatagagcgacgccatgaggaggagcttagaaagctaaaggctggccatgatcaattgaaggatcatgtgagatgccccaagagcgacgaacactatgctcacacaatgcctgagcacactcaaggggaatcacacccccaaaacacgtcaacacccaagattatcttagtctctcccacatacaccgtcctaaagggtggactactcgtcaacaccccctttgtcgaccgcatcatggaagctgacatgccccttggttggaaaccactcaacctagaacaatgcgatggaaccattgatctaaatgaacatctagacatattcctcacctag

SEQ ID NO: 3246 - DNA, 285 bp, Glycine max
  Peptide Sequence Number=SeqID_120024
atgatgaagggtctctcatttgtgctgctgttgatccttgtgatcatccactacaaggtggtcaacgccaacaacaacaacaactgtgtcacagaagattgcctcatcggtgataattttgaatcagagttctcgtttggttcccatgtggcaagaatgctctatgatatatgtattatataccttttcttctcagatttactaccctttgcatattcaactctgacagcaggagtcgcaggagtcaattttgaataccattgtggcattgttccttcaatttaa

SEQ ID NO: 3247 - DNA, 258 bp, Glycine max
  Peptide Sequence Number=SeqID_120025
atgaggatcaaaaggtcttttaaggttgtaatggggccaaggacaaggcttgtagtgagcttcaaaacaaggaaagggaaacaaggctcaaaagggctatcaaaggaattgattcagggtaagtccatttggctagaagcttataagaacaaaattgcctcaatcatttccaaatatgcatgtgaattaggacgcatcaacaagcatcaagccaaggctattgtgcaagcaatcaatagggcaaaacacaccaaatga

SEQ ID NO: 3248 - DNA, 208 bp, Glycine max
  Peptide Sequence Number=SeqID_120026
atgtctttgcttggtaatgaaacctcgtggaccgctgattttagcaaagttttgcttttccctaaccttgtcaaacatgttgtgtactccttaagtgccaatggcaacaccttcccgaatcatgctctcagaaacgtttgtcacaatcgggtcgtaattgaaacggatgaggctgtgaatgcaaatgtttttgtcacagtggatcaag

SEQ ID NO: 3249 - DNA, 792 bp, Glycine max
  Peptide Sequence Number=SeqID_120027
atgtcccttgaggaactagttggtccctcaaggttcatatacaagaacttcaataggaccaaggaaccaaaagagaaaattctttggctttcaacaaccaagagaacaagaagacataatcgtccagagaacatgtatcgagaagttcgtctaaatctcttaagtgggcgaaacaaaggtggctccaagtggaagaactcctcacgaagaatgcccaaagataagaaagatagagacaagagctccataatttactacgaatgcaaatatcctggacacttcaaatctagatgtccaaagttggagaaaggccaagacaagaagaaatacttcaagaccaatgaaaagaagggacttatgagcacatgggaagatctagatgacacctcgtctggtaaagatgatgaagaagcctatatatgtctgatggaaaatacaacttttgatgaatctgaatcagatcaagaagatgaggtaaatcttgatgaccctgaggtggaatgtgaagaacacaaaagaactgtgaaattttttaatgataagtttttgaagaacaaaaaagttatgggtcaacctcaagatgttgtcaaacttcatgaggaaattagaaccttgaaaactacattagctaaatttgtcaatggtacgaataatctcaacaaaatgttaggatattgtagaagttcctcatacaaatttggaaatggatatgatggaaaggtatatgttcatgataaggacaccactgtctactacttctgtggaaagactggtcatatgacatcagtgtaa

SEQ ID NO: 3250 - DNA, 2451 bp, Glycine max
  Peptide Sequence Number=SeqID_120028
atggtccgatttttcttcttctgcttcttcatttccacgttattaatacaaggcaccctcgctataattactccaaatgagtcaatccaaggcaataggaccctagtttcttctgctggaacttttgaagcaggattcttcaactttggaaattcacaaggccaatactttggtatatggtacaagaacatatcaccaaagactattgtgtgggttgccaacaaagatgccccagttaaagactcaacagcatttctcacactaacacatcaaggagatcctgttattcttgatggctcaaggagtactactgtgtggttctccaattcatcaagaattgctgagaaaccaattatgcagcttctagactcgggaaatcttgttgtgaaagatggaaacagcaaaaaagagaattttttgtgggaaagttttgattaccctggtaacacttttcttgcaggaatgaaacttaggacaaacttagtttctggtccttataggtctctcacatcttggaaaaacgcagaagatcccggttctggtgagttttcatatcacatagatgctcatggatttcctcaactggttactacaaagggagaaattttatttagcagagcagggtcatggactggctttgttttcagtggagtttcttggcgaagaatgcttagccttgtaactttttcgctagcgattaatgacaaggaagtcacttaccaatatgaaaccctgaaggctggaactgttactatgttagtgatcaatccatcaggctttgtgcaacgtttgttatggtccgaacggactgggaattgggagattttatcaactcgtcccatggatcagtgtgaatactatgccttttgtgatgtgaattctttgtgtaatgttactaactctccaaaaacatgtacatgcttggaaggttttgtacccaagttttatgagaaatggagtgcattagattggtctggtgggtgtgttagaagaataaacttgagttgtgaaggtgatgtgtttcaaaagtacgcaggaatgaaattgccagatacttcttcttcttggtatgacaagagtttgaaccttgagaaatgtgagaaattgtgtttgaaaaactgctcttgtacagcatatgcaaatgtagatgttgatgggagagggtgtttgctttggtttgataacattgtggatttgacaagacacacagaccaaggacaagatatttacatacggcttgcagcttcagagttagatcatagagggaatgaccagagctttgataacaagaagcttgtagggatagtagtaggcattgttgcattcatcatggtacttggatcggtcacattcacatatatgaagagaaagaagctcgcaaagagagagatgctaaaaatatttcactggaaatacaaaagggagaaggaagatgtggagttatcaacaatatttgatttttcaaccatctctaatgctacagatcaattttcacccagtaaaaagttaggagaaggtggctttggaccagtatacaagggtttattgaaagatggacaagagattgcagtcaagaggcttgcaaaaacttctgagcaaggagcagagcagttcaaaaatgaagtcatgttgatggcaaaacttcagcaccgcaatcttgtaaaacttcttggatgttctattcaccaaaaagaaaggctcttgatctatgaatacatgtccaacagaagcttggattacttcatttttgattcaacacaaagtaaacaactagatctgacaaagcgccttcaaatcatcgatggtattgctcgagggctactctatcttcatcaagactctagattaagaatcatccacagagatctcaaagttagcaacattcttctagataatgatatgaatccaaagatatcagattttggtttggctagaacatttggaggagatcaagctgaggctaatacaaatagagtgatgggaacatatggttatatgcctcctgaatatgcacttcatggacgtttttcaatcaaatctgatgtatttagctttggtgtaattgtgctggagataataagtgggagaaagaatcggaatttccaagactctgagcatcatcttaatcttcttagtcatgcatggagactgtggattgaagaaaagccacttgagctaatagatgacctattagatgatccagtctctccacatgaaatactgagatgtattcatgtgggtctgctatgtgtgcaacaaacacctgaaaatagacccaacatgtcatctgtggttttaatgttgaatggtgaaaagttgttgcctgatccaagccaacctgggttctacacaggaacaattcagtatccaattcagctagaatcttcttcgagaagtgttggagcatgttcacaaaatgaagctacagtgtccttgttagaggcacgatag

SEQ ID NO: 3251 - DNA, 926 bp, Glycine max
  Peptide Sequence Number=SeqID_120029
atgctcagaggttcccactagcattcattaatggtaatcatgcacctaaaatcccatactctaagtttatttatgttgaacatgttgataaggaaaccatcaatgaccaagcacctacatggacgaagtatgactatgaacataccccatctaaggcctttaaggctttaccaatagatgccatagttcatcttcccttccctcaatggacttgtctagcgcaacccaatgttatcaagatgcctcctcattggaatgcatatgctgctaaaaagaaaggcttcaagtttaactacaatgaagagataccttcaaggaaaatgaagatggaaatagtcatcaccctcagaattgaagctccttattcaatgaaaaaaggcttctttgtgcttctgatgcctatgatgctaggaccttttggaatcagattatatgggcgaacactcagaaagcctctacttttggttatgatggaagggataatgatgatcattgcaatgtcattcaagtgttacgtcatgttaggaagtatcactttgatgatgcttgcacctgctttacaaaatatattgataatgactcttgatgcctctatcctagatgaagcatctactaaagatatggatgacaccattgtacttggggtcatcattgatctcaccaacactggtgtcatggacgcaactcctaaggcatccaatgcagccatagttgatgaagttgaactcaacactatagaacttgcgtccaagaagtcaacaacttcaaataaggctacttctagagacatgggagaacctaatgtcatcatcatctactccaatagttcaggcactactcccttcaactatgcacaaccttctattgttatcagggatcaagtgcaagacatgatagggcaagttatggaaaccttcatcgaatga

SEQ ID NO: 3252 - DNA, 2898 bp, Glycine max
  Peptide Sequence Number=SeqID_120030
atggtcatagaaaatgaatacagggatttggagaaaatgcttgaagtaacggatcttcatgaaaaagatagtagtgggggctattatacttggacaaataaccaagctaatggtgtgatatactctcgtatagaccatgtccttggcaacttaagctggctgcagcagcacgtagacttcaatcttcaaattatgaattctggggtgtcagaccattccctcctctgcttgcgcaaacaggaagacagacgtcccagtagaactcccttcaagttccaaaatgtggtcactaatgtcttaggttttcaagaatctgtgagagataactggaataatcctattacgggcgctactgctatgtgcagactttggaaaaagcttaaacgactccaacccgttgtcaagtccttgagcagaaccttccaaggcatttcaagagagctgatcaaagccagagatcaactcaatgttgtgcagcaggagcttctaacggatcgttttaatatgcaggttattgagaatgtgaaaagatgcccgatacaagttctgaatctgagcaaccttgaggagcagcttctcaagcagaaatcgaaagttgagtggcttaaactaggagacgggaacaatgcttattttcatgcgtctttaaaatcgaaaagtaggaaaactcaaattctatcgcttgttactgagaatggtgatacgatttttgagcaggagaaaatagaagatgagattgttaatttttacaggaagctagttggcacgaggagcagtcagttaaatagtattgatcttgtagctatgaggcaaggcaagcaactgactagtgatcaaagggcctctttgacagcgcctataactgaagaagaaattgttaacagtctcaaaggcataagtgatatttctgcaccggggatagatgggtacaatgcgaaatatttcaaagcgacatggaacataacgaaggttgacgtcatttcggcggtgaaggaattttttgaggaatgtctaatctacaaagcagttaattgttccttaatcactctaattcctaaatcggacaatgccaatatggtgaaagattttcgccccatctcttgctgtactgttgtttacaaaatcatatcgaggataatgtctacgcggctggggaaagtgttgagctcagttctgcatcagagtcaagcagcgtttataccgggtcagcatattcatgaccatatattgttggcttatgagctgatcaaaggttacaacaccaagggaggaactccgagatgcatgctccaaatggacttacaaaaagcgtacgactccgtggaatggtcggcgttagaagccattttaaatgaattaagcatccctcacatgttcattaagtggattatgattacggtgactactgtgtcgtatagataccaagtgaatggtgtgctttctaatattgtgcaagctaagagagggctcaggcaaagggaccccctttcccccttgctctttgtgatcgttatggaatatctctaccgtgttctgcagaagttgaagcaggttccgaacttcaattttcatccgaagtgcgaaaagttagccataatcaaccttagctttgccgacgatctgcttatgtttacaagaggagatcccatgtctgtaagattggcgatgaatgcttttaatgatttctcagcagccactggtttaagggttaacccatccaaatgtaacatttattttggaaatgttgcggatgaggtgaagaaagagattcaggccaatgtgaactacaatgaaggcaccattccatttcgttatctgggcatccctttatcaaacaaaaggctttctgttgcgcattgcctgctcatagcggataaaattacggcgagaatcaaacattggagtgcgcggcttctgagttttgcgggcagggcgcaattgattaacagtgttctttttgcagtttcgaatttctggctgcaatgcataccgctacccaaggaagttatcaagaggattaatgcaatatgtcgctcgttcctgtggtcgggtggagataagcttacgcgtaaatcccccatatcttggaaacgagtctgtacaccgacgaagcaaggaggtctgaatattatttctattgaggaatggaacaaagctaatctcatcaagttattgtggaatctaaatggtaaaaccgatagtttgtggataaaatgggttcactgttatttcttaaagaaatggagtatcatgaatgtccctatgaagactaacacttcctggattttgaaagcagttttatctcaaagacaagaagtgtgtatcaatccaatttggcaaagtatgttgcagggacaaaattatcaaacaggcagaatgtacaagtctctaattcatcagttccaagaggttaaatggagatacttattcaaaggtaacatggcccgtccgagagccctctttatcctttggatggcttgtcatgagagaatggcaactaaagatagattaatgcgatttggaatgctcaatgatgatacttgctgttactgtaaagaaaaagagaccattcaacatattttcttccaatgtaatgtgttgagtcaattttggaaacacacccttaaatggctagaggttccacattctccgggtggttggaatgaggagttggattggattattaagaagtgcaagagtaaggggagcaaagcgaagatcataaaatgtgcattcacggaagcggtttatgaaacctggatgttcagaaacaacaagtgttttggtctggatactactagtagtaatgtaggcactagaatcaccgacaccattgttcacatatgttggttgaatcctaagcttaggaatcatttgggtaggcttatgatcccttag

SEQ ID NO: 3253 - DNA, 2496 bp, Glycine max
  Peptide Sequence Number=SeqID_120031
atggaagtcatggaagagagaaaattttctaaattgttgtcagagctgatagttttggctgatgaggtttcttctattgctatgaactctgaaattgaggtggatatttttgctgagtttgccatgttggttgagaaattgccaccaatcttcaatgacttgagggaaaaaaacactgttttggacaagccgcctataagaaaatccttggaatctcttgagaatgagttgaggcgtgctaaagctttgataaaaagctccaatttgagacaacctatcaagcaaattgaggacataacgcatgatatcggtcgatccttgggccttctgcttgtagccagccttgaagtgtccacggatttcagagaaaagattggtacattgcaaagacaattgatgaatgtgagatttgatggcagtttaagtctagcttcaagtccaaaatcagagttttccaccagtgacatgaagctgaccggagaaatagaagaggaaatagttaatgtctctatcgatgatgttgttttgcaacttaagaatggtaatgatgaagaatttgcggttgcaattttgagactaaagcagttcatgaggagtgaaagactggatggtggcttgtttaacgaggaagcaactcttgccattcttttcaatcgtctaggttcatgtaaggcagacaataggttggcgatcattcgattgctaagaagtattgcttttggaaatgatgagaaaaaggataagatggtagatattgagtatttatcagcagtggtgaagtcactgacaagagattcagaagagaggaaggaagcagtagggctgttgctagacctctctgacattcaagcagttcgacggcgaattggaagaattcaagggtgcattgttatgttagttgctatacttaatggggatgactctgatgcctctcatgacgcagcaaagttattggatatattgtctagtaatactcaaaatgcacttcatatggctgaggctggctacttcaggccactggtgcagtatttgaaagaagggtctgacatgaacaagatcctaatggcgacagcactttctaggttggagctcactgatcacagcaaactttcccttggagaagctggggcaattgagccccttgtgaatatgttttgtaccgggaaactcgagtccaagttatcatctctaaatgcgctacaaaatctgtctaccatgaaagaaaatgtgcaacacttgatcagttctggaattgcaggatctctgctacaacttcttttctcagtaacatctgtgctcatgactttgcgcgagcctgcatcggctattcttgcaagaattgctcagtcagaatccatccttgttaatgaagatgtggctcagcagatgctttcacttttgaatctttctagccctataattcaaggtcatctgttagaagctctaaataacatagcctctcatcctggtgcatccaaggtgagaagcaaaatgaaggaaaaaggtgcacttcagctgctcttgccctttctgaaggaaaacaccaccaaagtcaggagtaaggtcttgcaattgctatacactctctcaaaagatctaacagatgagttgactgaacatcttgatgaaactcatcttttcaacattgtcaatattgtctcaacatcaacattagacagtgaaaaggctgcggctgttggcatactgagtaatcttcctgctagtaataaaaaagtgacagatatactgaagagggcaaatttactgcccattttaatatccattatgtattctagcacaggaagtaattcatccacaacaaatagtttcttaacagagagtattgcaagtgttattattcgcttcacaatttcctctgacaagaaactacaacttttttcagccgaacaaggggtgattcctttgctagtaaaactgctctcaagtggttcaccaatcacaaaatcaagggcttctatctctctggctcaactatcacagaattctctgtctcttaggaaatcgagaaaatcaaggtggtcatgtgttctgccctcggtgaatgcatattgtgaaattcatgagggatattgctttgtcaacagcacattttgtttggtcaaggcgggtgctgtttctccccttattcaattattggaagatactgagagagaagtagttgaagctgctttgcatgccctctcaactcttttgcaagatgaaatctgggaaggtggtgtcaattccattgccaagttgtcgggtgtgcaggctattataaaaagtctacaagttgaggatgcaaaggttcaagaaaaagcaatatggatgttggagagaatattcaaggttgcagaacatagattaaaatatggagaatctgctcaggtggttcttattgatcttgcccagaaaagtgattctagattgaagtcaacagttgcaaaagttttagctgagctggagctcttgcaatctcaatcaagttacttctga

SEQ ID NO: 3254 - DNA, 653 bp, Glycine max
  Peptide Sequence Number=SeqID_120032
atgaagcacattctacatcggtcttcaaccatcgtcgtagcaggcgtcatagaatgtgtcatggtctacgatgacgattcacaacccgccgtagaatgcagcgcattctacgacgatcgcctccacagacctagcggtggggttctgctagggttccaaagcgagaaccaccggcctggggagggtgatgctttgtctgtgcaaaacactacctcttttaacactggaaatccaattgtgagtttacccacacctggatttctaggcatgactgcacctgagccttggagaccaccggcttcaagatgggctgctcctagtcaggggctgcctcccgtgaatgtaggtggctgggttggactcggtcaaggttgttcccatgtaaatacgaatgcagattgggttgggcctagtcagggtcttgcacttggaaatgccagtcctagttgggttgccccgattgggaatccaggcatgtggggaagtgagcaaagtcataatggagataggttccccaaccaaggggattgtagacattctggttattctggtaaatctcggaacaagctgtcatcatttggcaacgggggcagaggaggttcttccagtccccctttgggggacaaaaggatattctctaattgtttatcggg

SEQ ID NO: 3255 - DNA, 273 bp, Glycine max
  Peptide Sequence Number=SeqID_120033
atggccaaacaccccaaaacaagggcttgtaattggaatcgaatttggcagatttgggtttgcatctggacgaagatgatggtttacggggtggatttaactgctggtggtgatgtcagaggtgggtgtttgcagaggaggttcagaatggagcacgagaaacatgtacaaagggaagcatcggagggagtcaagatagcggaaggatcgatccaagggacaaaagccgtggttgtggcgtcgaagagtgacgacgtcgccgttgtgagctag

SEQ ID NO: 3256 - DNA, 285 bp, Glycine max
  Peptide Sequence Number=SeqID_120034
atgacagtggttgaggtagcaggtgggagtggggacggtgataatgatggtgtcgatggaatggtggtggtggtagtggtgatggtggtgggggtggaggcaacaacggtggggtgcgatggtggtggaggtggtggcaacggctatggcgggggtagggtgataacagcgacaatggcaaggatgatggtggtggtggtgggagtgacggcggcggccgatagtggcgctaatggcatgttgatggtggtgacgacagtggtggggctgaaatcgtggtggtaa

SEQ ID NO: 3257 - DNA, 225 bp, Glycine max
  Peptide Sequence Number=SeqID_120035
atgggtggtggtgggtggaatagttgcataacgacgacaataatgatggaggtgattaaatgtgatgacggcgacgacaatgatggaggtggaaaaatgatggtggcgacaattatggtggtggtagtgaaagcgaaaaagacgaggtgcagtaatagtggcgatgacaatgtcgatggtggtagaatggtgaagacgataatggtgttgtcaatgtggtggtga

SEQ ID NO: 3258 - DNA, 933 bp, Glycine max
  Peptide Sequence Number=SeqID_120036
atgtgttcgtctgaaccaattaatggtcctactgttggtgatgttgatggagatggccatactgaacttgttgtgcctacactatctgggaagattcatgttcttgatggcagggatgggtcatctattgggcggtatccatatccaactcatggaagaataatgaatcaagttcttctagtcgatttaagtaaacacaaggagaaaaggaagggattaactattgttaccacatcatttgatggttatttgtacctcattgatggacctactggatgtgctgatgttgttgacattggtgaaacttcttatagcatggtcttggcagacaacgttgatggtggggatgatcttgatctaattgtcacaactatgaatggcaatgtcttctgcttctcaaccccgtctcctcatcatcccctaaaggcaggatatgcatggaggttgcctagtcaaggaagaaacaatgttgcaaatcgttacaatcgtgaaggtatctatgttactcatccttctagggcattccacgatgaggaaggcaaaagcttttgggtggaaattgagattgtagataattacagatacccatctgggcatcaaggaccatacaaagtcactacttccttgctagtacctggtaattaccaaggagagagaacgataaagttgaacaatacctatgatcaacctggtaaatatcggattaagctgccaacagtgtcggtaaggaccacaggaacagttttggttgagatggttgacagaaatggactgtatttctctgatgatttctctctcacattccatatgcactactataaactgttgaagtggcttcttgttcttccaatgcttgggatgtttggtgtgcttgtgatccttcacccacaaggctcaatgccattgccatctttttcaaggaacattgattaa

SEQ ID NO: 3259 - DNA, 849 bp, Glycine max
  Peptide Sequence Number=SeqID_120037
atggaggatgctttattcctcaactggacatggttaaaaaccagagacaaacacttcagcatttctttcaaccaatggtcttctaatcttgagcgtgaagaaagaaagagacggttgaagagagaacgaccggatgatagacctgtacatgtgtcacaatcacctggatatgatcagctatttcataccaagaatcaaagatcatatgataaaagcaggcttcctcctggctatggcagccgtgagacatggggagttcatggcatctgcaatggccatggtggaatctctcttgagaagaaagaggcaaaggggttggggtggttggattgcccttcatctggccaggaaatttgttgcatgataccttctaaggttccacttggtgaatcgttcaatgactgcattcctcctggatacatgatcatccactatctaatgcgtgctatgtcaatgtctgttactcaggcaataaaaatattttctgaagctcgccctccaggaatctacaaacctgattacattgatgcattgtactcattttatcatgagaaaaaacctgaaatggtagtttgtcctcctactccggagtggaagagatcttctgaatttgatctcaatggtgaagctgttccagatgatgatgatgatggagtaccaggccctgatttgcacgagaaccatgagacagacacacgaatgacaaatgatgatgttttaggagatgagatacctactgatcagcaggatgcattgcgtcagttctgttatcaaacgcttaaattgggtgttggggtaagcctttttaaatggctgtctttcatgcacgagtatattgcttatatttga

SEQ ID NO: 3260 - DNA, 1209 bp, Glycine max
  Peptide Sequence Number=SeqID_120038
atggcttttatggaggcttataatgagtatctctgtttagtctattttgatcatagtctgctccttatgagatgtgggggaaaacaacctaacaaaccaaagtgcctcttccgctttcaggctacttgttctagtcacaagggttttgaactcattgtcaagaaggcttgggcaaagcaagcattcaatatccaagggaagcttgataatgtcaaagagaacgctttggtatttaacaaaaaggtttttgggaacatattttggagaaaacaagacattgaagcccgactgaaaggtgttcagagaagccttgagaagcaagattttgaaagtcttaaaagacttgaaaaggaattacatgaggagtataatgaagttcttctcaggaagaattcttgtggtcaaaagtcgcatgagaaatggccggacatgatcccccacccttatctccctaacgaggattgttgtgctctcttggctcctatcaccaaggaagaggtaaggaaagttatgatgaagatgaaattgtttaaagctactagtccaaacggtttccaggtcttctttcacaagcagtattggcttacggttgaggaagagctttggaagatggtatcagaagcttttcgaaatggaactttagatcaatcactcttggatactctcatagtgttgatctcgaagggtagtttcatccctggtaaaggaaccatgaataatgccatattggctcaagaagtactcaaccacatttctcactctaagacgaaggagggaagcattgtaattaaaattgatctcgagaaagcttatgatcacattaattggaatttccttgaagacatgttcaatctttttggcatccccagacgcatgatagggctcatcatgctccgtcaaagggatcctgtttcgccttatctttttgtgatcggaatggatgatgacattcttctgttttgtagggcaacagaggaacaaccatgtgctggacaaaattcaatcgactggcatcatggaagggatgactccttaacaaagctggatattgatagaacttgtagaaacttcttgtggcccaagaactgtaacactaggagttggaatttggtgaaattggagaagattatcaaaccaaagggcatgggtggtctgggcatgaagcttgctcgtaccatgaacgttgcactgctaggcacactaatatga

SEQ ID NO: 3261 - DNA, 1689 bp, Glycine max
  Peptide Sequence Number=SeqID_120039
atgggtgtggttagagatgaggatgcacttgtgaattcgaagtgtcccaagaatttggagctccgatggcaaacagaagttagttccagcatctatgcaaaccccttgattgctgatattaacagtgatgggaagcttgagattgtggttccgtcttttgttcactaccttgaggttctagaaggtgctgatggggacaaaatgccaggctggccagcattccaccaatcaactgtgcattctagtcctcttctatatgacattgacaaagatggagtgagagaaatagctttggcaacctacaatggtgaagtgctgtttttcagggtttcgggatatatgatgtcagataagcttgaagtcccccgtaggagggtgctaaaaaaatggtttgtgggcttggatcctgacccagtggaccgttctcatccagatgttcatgatgaccaacttatccaagatgctactatcaagaattctatgtctcaaatgaatggaagtagacatgaagccagatcttcagctgccatatcaacagaaaaccaccttgactcaaaaaaattgcctaatcctgagccagaaaagaaaataaatggtagtcaagcagatgaaagtattaaggtgccaaatcctgagccagaaaagaaaataaatggaagtcaagtagatgagagtattaaggtgccaaatcctgagccagaaaagaaaataaatggaagtcaagtagacgagagtattaaggtgccaacgattgtggataactcctctgtgaatgctgggtctctggaaactgttcatgcagataataaaaccagcactgggagacgtcttctggaagataacaactccaaaggagcagagcaaggtggttctgaatccaaagataaagagggtattcatgctgcaactgtggaaaatgatgaaggcctggaagcagatgctgattcatcttttgagttattccgtaatagtgaagatctggctgatgagtatagctatgattatgatgattatgttgatgaatcaatgtggggtgatgaagaatggactgaagttaaacatgaaaaattagaggattttgtgaatgttgactcccacatcttgtgcactcctgtcattgcagatatcgacaatgatggtgtttcagaaatgattgttgccgtttcttatttctttgatcatgagtattatgacaaccaggagcatcggaaagaactgggtgatattgacattgggaaatatgttgctggtggtattgttgtttttaatctggatacaaaacaagttaaatggactgcagaacttgatctgagtacagatacttcaaatttccgagcctacatatattcttccccaactgtcgtagatttggatggtgacgggaatcttgacattcttgttggaacttcgtatggcctgttttatgtgttggatcatcatggtaaggttagacaaaagtttcctcttgaaatggctgagattcaaggagctgttgttgcggctgatgttaatgatgacgggaaaattgaactagttacagctgatacacatggaaatgttgctgtatggactccaaaaggagatttaatatgggaaaaacatctaaagagtcttattcctcagtggttcccatcacaatactcatcacgcattaactcgtcgcttttaaaggctcttacagtcgtgtga

SEQ ID NO: 3262 - DNA, 279 bp, Glycine max
  Peptide Sequence Number=SeqID_120040
atggcggcaacaatggtgacgatgatcatggtgacaaaggttgtggtggtggttgatgacgatggtggctacagtgatgatcatggtggtggaagcaatagtagtggtcatggtggtggtagtgacgacaacgacaaagtcttggaccttgtcataggaactccaatcccctgtaaaggatcattagatgagctggttgcacctccatcattcactcagagcgaaaggtggtgcttagcgccaaaattagagttttacttagtgagacgagctcactaa

SEQ ID NO: 3263 - DNA, 264 bp, Glycine max
  Peptide Sequence Number=SeqID_120041
atgaatgagagtgttacatttcggggtatccgagggagtcgtcagaggcttcgcgctcgcggaaggtgtttttcttgtcggaatcatcggagagaacgaaggtggcgtggtggagaagtagcagagagagcagaagaagaagaagaggctttgtccgcaagcacgcgtagtgagtttgttgggagtggatggaatgaaaccctagctagcgcggtggcagtagcagggtttctttgggtgcgttcgatctacaagagtgagtga

SEQ ID NO: 3264 - DNA, 510 bp, Glycine max
  Peptide Sequence Number=SeqID_120042
atgaagattcttccactatacaaaatgatagtagggttacaaggatgtatttacaaaattgactcactctatggtggctcactcaagcttgaggatagagacttcccaagctatttatcttctctctcaaagaggctctttctcactctaagaagtggattcactctttgtcttggatgggtgaagattaattctctagaatgctccacacattctaggagtctctacactcttctactcccctccatactcttccataaggtttcagaaggttccacacatctccagaatattctacaggttattgctattttggcaatgagccttaatccagttggggttaccaattcatgcccttccaagggtaatgctccagttaagatcctatgttttaattatcacccacaagacccgggacctagacattcaaaggacaatgattccttctctcaagggagttctcaattggagattgttgcccctacaacgaacatggatatggtcatgtga

SEQ ID NO: 3265 - DNA, 186 bp, Glycine max
  Peptide Sequence Number=SeqID_120043
atggacttgaatgcctcgccagttccagaggaagatgaagatatctttgaggagaagatacatgttgaagagtttcatgaacctgaagaacgcatagaaactggagctgatatagcacgccggcatcatgacagtgacagtgtttgttggccatgtgcttggtgccttgggctaggactactgtga

SEQ ID NO: 3266 - DNA, 297 bp, Glycine max
  Peptide Sequence Number=SeqID_120044
atggcattggaattagggttgagaaatctttgttgggcttataacttgcattatcgagcagttaggggatgtttggtctttgatgtgcatcgggtggattttgtggccgatttggggatgacctttatggatgattgggcgttcttggctgctggtgcctcactaagcgaggcttgtgcgcttagcgagagtcatgcgctaagcgaggcactcagcccgcttagcgagttggaggaatctgcacacttagcgcgtcatcagcttgctcagcgaggcgtttgtctcttcccgcgctaa

SEQ ID NO: 3267 - DNA, 423 bp, Glycine max
  Peptide Sequence Number=SeqID_120045
atgcctgaggcttatccacatctgattctcgataatttctcaactaagttaggtgacagaaccgcaaacattctgaagcatctttttccagtgccaaaaccagacacaaaacgtattgtcaccttttccaaccagtctgactatatctcattcaggcatcatatttatgaaaagcatgggggccctaaatctatagaactgaaggaaattggtccccggtttgagttacggctttatcagtgctttaccttaaactccagtattcttcctaagtcgattgttgttgaaaccgggcctattcctcataatacaactctgaaacaaataaagttgggaacggtggatcaagctgaagctcaaatagaatgggtcatcagaccttacatgaacaccaccaaaaagcggaaatttctcagtaattga

SEQ ID NO: 3268 - DNA, 411 bp, Glycine max
  Peptide Sequence Number=SeqID_120046
atggattttgaatccaccaacacccttcccaaaaacacattgcccttgaaccaagagcccaaaaatttgataataggagttttcatgagacctctcaggcatctacaaccatttttggtcaatcgaacccctcagatagtgaagttgcatgcttcaaagtggtggatgatagccatcaccagtttgatgaaagatcttatcaaagcacatgatcttcaattcatggcaattgttaaaccacacattagtagagaccttagtaacgctagtgcagaggactctcttatttggcttgtgtttaatgatggtaatctgtctactaaagatgtttatcttatatatcaatgtggatggttcttatatatcaaccatggccaaagctgtttgtggtggtcctgttcgagattatga

SEQ ID NO: 3269 - DNA, 291 bp, Glycine max
  Peptide Sequence Number=SeqID_120047
atgtcgtactttgttgttcccatctttcttgatcttgatgattcccacagacggtgccacttgttggttcttcttatatcctttgagacctacacaagatcaaagaaacaagaacaagcacaacaaagaacaaagccaagaactacagaaagattttacgttgttcagcaatgtgtctacatccacgggaaagcctcaaattacatgactttagcaagatgttttcaacttgcattctccccaggagcatctctttggaccaagaagtgtatgcatgtggttcaattgtag

SEQ ID NO: 3270 - DNA, 1152 bp, Glycine max
  Peptide Sequence Number=SeqID_120048
atggccaagagacgaaagaacaagttgtcactcttgggtttattacatcaagagacttcaaaagctgcttttcttgaggaaaagcttcaagcactttgtcacaggattcatcagttacaatgcaaagacacactccagaaaaaggagttgccagttgcttttgtaacattcaagtcacggtcaggtgctgcagcagcggctcatttgcaacatcattcacatccacttctttggatcactgaacttgccccagaaccaagggatgtttcatggaggaatatgagagtatcctacagagtggtgccgctatataaactaggtgttctcattgcagcatcactgcttacagttttctttgccataccagttactgctgttcaaggaatagccaaatatgagaaactgaagcaatggtttcctccagccagggccgtacagttgataccgggattaagctctatagtgacaggttatcttccaagtgctgtactcaaaggatttatatacattgtaccgctcacgatgtttgctatggctaaaatagctggatgtattgcaagaagtaaggaagagatcaaagcctgcaacatggttttctactttctggtgggaaatgtgttcttctggagtgtgttatcaggatcccttcttgatttaattggacagttcattagtcatcccaaaaatgttccaagtcagcttgctggagccgtctccgcccaagcagatttctttgtgacatacatcttaacagatggtctgtcagggttttctttggaacttctccagcccggcatgctaatttgggatattttaaagtcttgtgttcatggatgtcaaagagagacaagtccttacctttattcattgccttactttagaataatccctttagtctctctctcagttctaattggcatagtgtatgcagtagtggcgccactgttgctcccatttctcatcctttacttctgtttaggttatgtcgtctatgtcaaccaggatgctgctgaaaatgatgaacttgatgaaaagtgtggtctattggagttacattatgagaatgcaattaatgcctattgtccaccaggtttacgaccggtgaatttcatggcatcagaatccagctccacaccattagtttcttcgtga

SEQ ID NO: 3271 - DNA, 228 bp, Glycine max
  Peptide Sequence Number=SeqID_120049
atggtcttactctacgacggaggtggctttgtcagcggcggcgatggtgcaatgaggccgactggcttaaccggggaagagtggtcggagaagacgaagacgcaacaaagggcagcaaggatgattggtaagaagcacctgcaagcaaacaattccacccaagatgaagctgaatatgttgttgtgctggctattgctgctttcatttccaggtcccttgaaggatga

SEQ ID NO: 3272 - DNA, 480 bp, Glycine max
  Peptide Sequence Number=SeqID_120050
atgaaccctcacagcctcttggcttctgcagcgataaacataggcttggccttggtgactctgcctctgttctccgtgctcaagaagcagccttccaacgctcccatctactacgctcgtcctctctctcgccgccaccacctccccttcgacgactcttcttcttctctcaaccgtttccttccttccctcgcttggctttctcgcgcgttccgtgtcaccgaagatgagatcgtccaagatcatggcctcgacgctctcgtcatcatcaggctcttcaaatttggcattaagtttttcacagtgtgttctcttgttgggttggtggtacttctccctactaattatggtgcccaggaggttcaaaatgggagctactttacaatggattcttttacaatatctaatgttaaaagaggttctaatagatcatgtcatattgaaaatcttactagttttagaaacacaagattagcttaa

SEQ ID NO: 3273 - DNA, 252 bp, Glycine max
  Peptide Sequence Number=SeqID_120051
atgagggatggagggaggtggcttgccaaatgtcaatggagaaaaccctgtggccgaatgaacaaaagtgttataagaccattcagccagtgtgagaaaaagcagagccactttagcgaggcaaccagctcacttagcgaatgggaaaccctagaagaagataagtcagagatctgcacgctcagcgcgcagccagcctgctcagcgaggacgttgtctcttttcgcgcttagcacgcctaagctcgcttag

SEQ ID NO: 3274 - DNA, 369 bp, Glycine max
  Peptide Sequence Number=SeqID_120052
atgcctagctatccatgcatgccacttcacgaggttgctgatagaggactaagctacactaaggcctccttagtgtcctcctgggccttccgctgggtgcttgggttgtgttgctatcaacaccctcccctagaaagtcaaccttgctctcaaggttgtatgcagtctacagagactcccaactctcccagatggtgtcttcaagggataagccacaccattggacgagcaccattttggaaggagacgacgttgtatgattccacttccaggatacatgaaatactgggtgtattctggagtctgatgacagttggaggtggtacacgatggagccaatacgttctgatacctggaaagggccgttga

SEQ ID NO: 3275 - DNA, 126 bp, Glycine max
  Peptide Sequence Number=SeqID_120053
atggttggaggtagacagaggattggcgtcgaagtggttgaaggattagcgtacatggggctagttattgcgatgggaataaatgctaaactaaaacatattattggaagacaatgtaaggattga

SEQ ID NO: 3276 - DNA, 585 bp, Glycine max
  Peptide Sequence Number=SeqID_120054
atggcttgttccctcagaatcgatgaaggagtgtctgcccagactgagaagcagttcactgtgccatcgaaggtggtgcacttccgaaaccttccaaaacagtgctctgaagaggagctcataaagttgtgtagcccctttggtaaagtcgtcaacatcatgtccggtgttggtcccaatagaaaccagggttttgttgagtttgaagatataaatgaagccaattcaattgtttcatactatctgtcttcaaatcctgttcaacttcgtggtaaaactatttatgttcaatattctgagagaccagaacttgtcattaacaaatacactaaaggaaatatcttgattgtaaccatggaaggcatccaagctggagatgtaggcattgatgtcatccacttggtcttttctgagtttggctttgttcaaaaaatttctacatttgaaaagaatgcgtgtttccaggctatggttcagtttcctgatgttaagactgcttcttcggccaaggatgcgctagacggaaaaagcataccaaggcaactaatgcttttacatttcctcctttgctcttcaccttcataa

SEQ ID NO: 3277 - DNA, 762 bp, Glycine max
  Peptide Sequence Number=SeqID_120055
atgtgcagcaggactgctatctccaccatcttaataggaatagcaaaatacaaggattacacaaatcctacgcttcctgttaatcagacttctattgatagggcaatacagccttttgaaaatcatgtcctatgggcttcatttgaaaatatgcagtacgatgtcactgtggatgtccttcattcagtgttctctgaatatggtactgtgcaaaaaatttctatatttgaaaagaatggtcaaactcacgcactaattcagtaccctgatatcgccacagcaacagctgccaaaaaagctctaatggggcattgcatatatgatggtggctgttgtaagcttcgtctatcatactctcatcatactgatattaacgtaaagggttccagtgacaaaagtagagactataccatgcccaatcacggtgtatttgaagaacaagttgaaacaacagatttggagaatcctcattcgacttctatgtcccataatagtagtaatagtagtagtgctcatgctttacaggctcaagtacatggaggacaaattccttcatggaacccaatccacaattacatgtttgcacctggtacttttcctaatcaaacttatgcagttcctccatatcttgtctatgcagttcataatgaaagttacatggaaatcactccacctggggttcctggtttctcacctcacatgcaagctggttttgtgggttttttacctcttggtgtacaaccttattattatggatactag

SEQ ID NO: 3278 - DNA, 234 bp, Glycine max
  Peptide Sequence Number=SeqID_120056
atgaatggtgaggttgcattaataaagtggatgatggacatagatacattggagtgtagtgggcagagagtgcacatggtgccggtagatagaccagatgttatgtccatcaccatcgatcactctcgatactgctacattccttggggatttaagtctcgccagcaactgaagtggtttgaagacatttttatgtgggcatggaagtgcctcacgatgctcaagaactcatag

SEQ ID NO: 3279 - DNA, 234 bp, Glycine max
  Peptide Sequence Number=SeqID_120057
atggtgaagctcttgaacaatttcaaccctagctctagaagggttcgtcaaggtgatccaatctctcctttactttttgtgctttgcattgagagattatttcatatgatcaatgtggcacttgatgaaaatctttggaatcctataactttgagtagaggtggtcccaagctcgcctatttagcctttgtggatgatatcttgcggcagcttcaaatgctcaagtggaattaa

SEQ ID NO: 3280 - DNA, 318 bp, Glycine max
  Peptide Sequence Number=SeqID_120058
atggccctagtgagttctgaaggcggttttgggatatccgcatctgccatatgtatttggtggaatccatggcaaaggtccaacttggaaaaccatgacacgtcgcctagctcgtcgaggagttcatcgatggtgggcatcacaaatttttccttcactgatatcgcgttcaacaaaggttcaatgaataagtcttggaatctggagagaatggctacaatggctggaggggtggtgtcgttggaaatgggtgaagaagataaaagttgggttaggtcgggaatatgggttatgtggaacaaggccgataggaactga

SEQ ID NO: 3281 - DNA, 186 bp, Glycine max
  Peptide Sequence Number=SeqID_120059
tatttcattgatcctagaccattggaaccagaaagattgaaggcgcttcacaaccagtgggcaaagaagtacctaacaacaatgcactgggacatagttgcaattgctgatgctagtgctgactctgaccaagatggcaatgaagttattgttggtgggaagctttggcttgtgcttgatatgtaa

SEQ ID NO: 3282 - DNA, 186 bp, Glycine max
  Peptide Sequence Number=SeqID_120060
atgttttgggattatgctggcgctgatccgaaacttaatcacttgttcaatgatgccatggcaagaagtgagaaccttaaatatgttgcaggggacatgtttgaagcaattcctccagctgatgccattctgttaaagctgaagaagaaaaggaacacgtggttaaagagcacggtgagagtttag

SEQ ID NO: 3283 - DNA, 1141 bp, Glycine max
  Peptide Sequence Number=SeqID_120061
gcagcaaattatggattcccatgatgaggagcatgctgccaaactacttagagctcaaacccacatatggaatcacatatttagcttcataaactccatgtcccttaaatgtgtggttgacttaggcataccagatatcatacacaactatggccaacccatgccactctcaaacctcattgcttcactaccaatccacccatccaaaacttgctttgtccatcgcttgatgcgaatcatgatccattctggcttcttctctcaacaaaatcatgacatggagaatcagctagatgccaagtatgtgcttaccgatgcatctgtactattgcttaagaaccatccgatgagtgtgacacctttcttgcatgccatgcttgatccaattttgacaaatccatggaatcaattttctacttggttcaaaaatggtgacactacaccatttgaaacggcacatgggatgatgctttgggattacgctggcgctgatccaaaacataataacttgttcaatgatgccatggcaagtgatgctcgatttgtcactagtttggtgattgagaaatgtaagggaatgttcatgggattggagtcattggttgatgttgggggaggcacagggaccatggcaaaagccattgctaaatcattccctcgggtggaatgcattgtgtttgatctaccacatgttgtttctggcttgaaaggaagtgaaaaccttaaatatgttgcaggggacatgtttgaggcaattcctccagctgatgccattctgttaaagtggatattgcatgactggaatgataaggagtgtgtggacatattgaagaaatgcaaagaggcgataacgaggaaaggcaaagaagggaaggtgatcatcatagacatggtggtggagaatgagaagagagatgatgaatcagttgaaacacagctcttctttgatatgctgatgatggtgttggtcactggaaaagagagaagcaagaaagaatgggctaagttgatttcctctgctggttataacaactacaagataactccagtcttgggcttaaggattggcgttagtgtagttagtgcggtgggaataaatgctattattggaggacggtcatacgtggagctagttattgcg

SEQ ID NO: 3284 - DNA, 189 bp, Glycine max
  Peptide Sequence Number=SeqID_120062
atgtctcgtgtgtatgttggtaacttggattcaggagtcaccgagagagatctcgaagacgaattctgtgttttcggagttattcagagtgaaggacttagggaggcctatgatggagatattgcatttgcaagtgcttggaaacttttggtggtgggcataatgacccaatcagtgtggctttgggag

SEQ ID NO: 3285 - DNA, 795 bp, Glycine max
  Peptide Sequence Number=SeqID_120063
atgacccaccctctccgagtcgcagtcatcggcgctggcgtggctggcctcgccgccgcgcgctccctccgccgcgagggcctcgacgtcgtcgtattcgagaaaagcaaccacctcggaggaacatggagctacgatccgcgaaccgactccgaccctgtgggcttggacccgaaccgggaggtggtgcacacgagcctctaccgttccctccgcaccaacctcccgaggcagctcatgggcttcctcgactacccgttcccgaaccgcaacaatggtgacccgagaacgttcccgggtcacgaggaggtgctgtggttcttgaaccggttctcggacgagtttgggctccgcggtctgacccggttcgggagcgaggtggttcgggtcgagctagtttcggaaaagagtgactcgtgggtggttgagtcgaggaggaatcgtgactcggttttgactcgggaggtttttggagcggttgttgtctgcacggggcacttcactcaacccaggttacccacaattcctgggattgaaaagtggccaggataccaaatacatagtcacaattaccgagtgccagaaccttttcagggtcagatcgtggttgtcattggatttgcatctagtgcctttgacatctcaagagaaattgcaaaggttgctaaggaggttcatatagcaactagaagtccagatgtaaaggttatgaagctagcaaatcatgataacatgtggcagcataaaatggacatgtatgaggaatgtaacatttggtatctcagaatccattag

SEQ ID NO: 3286 - DNA, 648 bp, Glycine max
  Peptide Sequence Number=SeqID_120064
atggaagctcagcctgtgccagccatgattgtggttgaggcggtggcttcgggggtggtggtggtggatgtggtggcggacggagcaaggccaagtcttgacggcgaaaagaatccaaaccaagcacggaggaatttgatgcttgatggcattgttgcggagcaagatggtgtcattgccgtaagggattttgcggcaatggtcgtggcgataacgactgagctggaagtggcgcggggaagtggcagcggagccatgggtgcgactgtcgtgggtgctgttgtgggtggtggttgtgcggaggatggagctgacatgggtgctgttgtaggtggtggttgtgcggaggaggacggagctgtactcgcaaaatcaatagttggcagcagcggcggcggcggcggtagtggtggctgcaccgaagaaggaaaccatggcatccgagtatcgcacaaggctagcaagtggatccgggggagggtgggaactgagacggaagggatggctcctgcggagggtggtgtgttatggcatagccggagtaggggtagaggcagccatgggcgaaaggaggaagaaggtgagagtaacggagagagacgcgttttccttgattcgaggccaaggaacctcctgactaagctatga

SEQ ID NO: 3287 - DNA, 3285 bp, Glycine max
  Peptide Sequence Number=SeqID_120065
atggagcacagagtgattccgttttccacgagagggtggaggaggacttatgatgttttcctcagttttagaggagaggatacccgttttggtttcactggtcatctctacaacactttacgtcatagagggatcaacactttcatggatgatgaggcgcttgagagaggagaacaaatatcagaagccattttcaaagcaattgaagagtctgggaaagccatcgttgtgttctcgaaaaactatgcatcctcaacatggtgccttgaagaacttgtcaaaatcctcagttgtatgaaaactaaggaacttaaagtttatccactattttacaacgtggatccatctgaggtacggtaccagagagcaagttatggtcagcaattggctaagcatgaaatcaaaatgaagtatagcaaacagaaggtgcaaaactggaggctggctctgcatgaagctgccaatcttgtagggtggcattttaaagatggacatggatatgaatatgaatttatcacacggattgttgacgtggtgggcatatcaaaacccaatcttttgcctgttgatgaatatctagttggaattgagtcacgtatacctaaaataatattccgtttgcaaatgactgatcccactgtcatcatggtggggatatgtggagttagtggaattggtaaaaccactcttgctcaagctttgtataatcacatcagcccacaatttgaaggttcatgctttctcaatgatgttagaggaagttcagccaaatatgggttagcatatctgcaagagggaattctttctgatatagctggtgagaatatcaaagtggataatgagcacaaaggaattccaatcctgattaggaagttgcacggcaaaagggttcttttgatacttgataatgtggacaagctggagcaattggagtatttagcaggagaatgcaattggtttggtttgggcagtagaattatcataactagcaggtgtaaagatgttctagctgctcatggagttgaaaatatatatgatgtacctacgttaggatattatgaagctgtgcaacttttaagttccaaggtaaccacgggacctgtacctgattattataatgccatttgggaacgtgcagttcactgttcccatggccttccattggttttgaaggatattggttctgatttgtcagaaaaaatgaatgttattggttctgatttatcatggccttcaattgatgaattggggattgcactagaaagatatgaacgagtttgtgatggagaaattcagagtatacttaaagtgagttatgatagtttgaatgaatgtgagaagaaaattttccttgacattgcatgtttcttcattggagagccagtatcatatgttgaggaaatactatcagctattggtttcaatccacaacatagtatcaacagacttatcgatagatctctcctatctatcgattccagtggaaggttgatgatgcatgaccatataaaagacatggccatgaaaatagtgcaacaggaagcacccctgcatccagaaaaacgaagtagattatggtgccctcaagatgttcttcaagttttaaatgaaaatgagttagttgtatttaacttattcttgctttcaaagggatctgataaaattgaagttatgatgttggttgacttaccacgaggaaatgatgtactgaagttgagtgacaaagccttcaaaaatatgaaaagcctgagaatgttaattattaaggatgccatatattctggaatcccccaacatctctcaaatagcttgagagttctgatatggagtggatatccttcaggatgcttaccacctgattttgtcaaagtgccttctgattgtctcattttgaacaatttcaagaatatggagtgtttgactaaaatggatttcactgattgtgaatttttgtcagaagtacctgacatttctggaatcccagacttaaggatattgtatctagataattgtataaatttgattaagattcacgattctgttggatttcttggtaatcttgaagagctaactacgataggatgcactagtctaaaaataattccatcagcattcaagttggcatctcttagagagctctctttctctgagtgcttgagacttgtgaggtttccagaaatattgtgtgagatagaaaatttgaagtatctcaacttgtggcaaactgccatagaggaattaccattctctattggaaatcttagagggcttgaatctttaaatctaatggaatgtgctaggcttgataagctacccagtagcatttttgcactaccaagacttcaggaaattcaagctgactcgtgtagagggtttgacatttctattgaatgtgaagatcatggacaaccgagattatctgcttctccaaacattgttcatctgtatctgagctcttgcaacttaacaactgaacatcttgttatatgtctcagtggttttgccaatgtggtatatttggacatatcttacaatagttttacggtccttccagcatgcattaaagaatgtatcaatttgaagactcttctgctaagcaattgcaaccaacttcaagatattttagtcattccctctaaattagaagacatagatgcattaaactgcacatctttgacatctcaatcatcaagtgtactattgagccaggcatttcatggaactgggcagaaaactgtaattcttccaggtttaaggattccagaatggtttgatcattgcagcagtgaaagatccataaccttttggggccgtgagagattcccaaggatttgtgtgtgtgtttcttttggaatgctcgaaaattcactgcaccaccattttcaagttacattctgtatagtcatcaatggccacaaaaggatattgtccaaccgttgttacgattggtcagttcagacagatcatgtgtggctttttgatctaactgcccttgttagttatgaagatctcagaggaacattggtgaagagtgactggaatcatgtggagattgaaatggaatggaattgctgtatacaaggtgaccatgggccaacaagaatggctattgtgaaatggtatggaattcacgtatacaggcaggaaagtaaaatggaggatatttctttcacaaatcccaaaaatctacaagaaaatattacaagtaaaagggttggtactgaggttttggattcatcagagaaaagccaaaagaagttgaaagcaatttctcagtgggattga

SEQ ID NO: 3288 - DNA, 1284 bp, Glycine max
  Peptide Sequence Number=SeqID_120066
atgttgctctacagggtgcccctgcttctttttgtgtgcttctgttttgccaattctgctgctgtatctgctaatgaagcctctacaggaactgaggtgaccattgatgccaagccttcagataaaaagttaaaaggcacagagtcatttccaaaagagaaaaagacattttcaataccattttttaagcctgtaccaaagttggttccgattgttaaacctataccaatgccttttccaaagcctctacctctacctatcccagttttccagaagcctataccaaagtggattccagatgttaagcctataccaaagccaattcctatcccggtgttcaggcctgtcccagttccagtgaagccaataccaaagccatctccaacaattgagaagccaaagccatgtccaatagccaaaaaacctgtacctactccagtggttaagaagcctttaccaaagccaattcctattgttaagtcaatcccaaaaccatctccaacagtgaaaaaacctctacctatcccatcaattaaacctgtaccaaaatcaattccaatagctaagccaattcctatcccagtgttcaaacctatcccaaagccatttccaatagagcctttacctattccagtaattaagcctatacccacgccaattcctatcccattgttcaagcctatcccaaagccatttcctatagtggtaaagcctctacctataccaataattatgcctgtacccaagccaattcccatttttaagccaattcctattttcgagcccatcccaaagtcaattccaatagtgcaaaggcctcaacctattccaataaccaagcctgtacccaagtctattcccattgttatacctattccaattccagtgtcaaagcccatcccaaagccaactccaataatgaaaaagcctttacctattccagttactaagcctatacccaagcccgttccaatagttaagccaattcctaagtctatacccaagccagttccaattgttaagccaattcctacctcaatattcaagcctattccaaagccatttccattagttaaaaaacctctacctattccaataattaagcctatacctgagtcagtcccacttgttaaacccattcctattccagtatttgagcctatcccaaagccatttccaatggtgaaaaagcctttacctatttcaatatttaaacctataccaaagtcattcccagtgggtaaaatgcctcaacctgttcaagtttctaaacctattccatag

SEQ ID NO: 3289 - DNA, 1524 bp, Glycine max
  Peptide Sequence Number=SeqID_120067
atgaggaagagttacacttttcaaagggtgcctctgctgcttcttctttgcttttgttttgccaattctgctgctgtaactgctaatgaagactctacagctggaactgaggtgaacattgatggcaagcctttacatacaaagccatttccaatagaggaaaagacacttccaataccgttgtttaagcctctaccaaaattggttccaattgttacacctataccaaatcctctgcctatcccagttttccaaaagcctataccaaagtggattccagatattaagcctataccaaatccaattccaattccagtattcccaatcccagtgtttaagaagccaattccagatgttatgccaataccaaagccatctcccatagtggaaaaaccaaagccaaagccttgcccagtagccaagaaacctattcctactccggtgattaagaagcctataccaaagccatctcccatagtggaaaaaccaaagccaaagccaaagccttgcccggtagccgagaaacctattcctactccggtgattaagaagcctataccaaagccaattccaattgttaagccaattccaaaaccatctccaatagtgaaaaaaccactacctattccagtaattaagcctgtaccaaaatcaactccaactgtaaagccagttcctatcccagtgttcaagcctatccccaagccatttacaatagtaaaaaagcctctacctattccggtaattaagcccgtgcccgtgccagttccaattattaagccaattcctattcctgtgttcaaacctatccccaagccatttcctataccattgttcaagccaatcccaaagccatttcctattccatttttcaagcctatcccaaagccaatcccaaccgtgaaaaagcctcaacctattccagtaacaaagcctttacctaatccagttccagttgttaagccaattccaaagccaacaccaatggtgaaaaagcctctacctattcccgtaacaaagcctataccaaaaccaattcccattgttaagcccattcctattccagtgttcaagcccatccccaaaccaattccaatagtgaaaaagcctctacctattccagtaactaagcctatacccaagccagtcccaattattaagccaattcccattccagtattcaagcctgtcccaattattaagccaattcccattccagtattcaagcctatcccaaagccatttccaatagtgaaaaagcctctacctattccagcaattaagcctataccaaagccaattccttcactaaaaaaacctctacctactccaacaattaagcctgtacccgagccagttccaaccgttaaaccaattccgatcccaacattcaagccttttccaaagccatttccatttgtgaaaaggcctttacctattcctccaatgatgaaacctataccaaagccatttacatctgttaaaaagcctccacctattccaatttccaaacctattccatag

SEQ ID NO: 3290 - DNA, 111 bp, Glycine max
  Peptide Sequence Number=SeqID_120068
atggcaccatcacaacaactaagcatggttcaaagtttgcacacctacacaaacatgttcatcactgccaccaatttctacaagctctttgaatttagagggtttggatga

SEQ ID NO: 3291 - DNA, 218 bp, Glycine max
  Peptide Sequence Number=SeqID_120069
agagagcaaaatcgaggtggcattggcaatgctcgacggttgacactcaacgctgcgatagggaaggcgatggtggtggcgacgatgacaacaacaaagtagaaagaaaaagagatctacttgacagagacacgattctccaacgagatctgacggtggcggaagatgtcgacaacggagtgcgaagacacaaggagctgagacagagaaaaagatag

SEQ ID NO: 3292 - DNA, 510 bp, Glycine max
  Peptide Sequence Number=SeqID_120070
atgttggtggttgtagctagtggtggcagtgggagaggtggtattaatggtggtggtggtggcagcaacagtgatggtggtggtagaagtgttgatggtgatggtggtgatagtaccagtggtggtattgttggtagtggtggtgtgatggtggtagcaatgccagtggtgatggtgatggtgatgtcgatggttacgatggtggtagtgacaatggtggttgtcgtgttggtggtggttccaatgaatagtagtggtgatgttggttacgatggtggtggcaatgatgatggaggtggtgattttgatgatgccaaaaagcaaatgatagaaagagaaaaacaaaataacatgaagagtcttggacaagagcaagtcaagcacttagaagatttgatttcaatggtagcggaatggagaaggaagaaagatgattggagatgtcacttcaaggagaagacgagtcaagcacaagctcaccaccataggaagtcatggataaaagcttaa

SEQ ID NO: 3293 - DNA, 156 bp, Glycine max
  Peptide Sequence Number=SeqID_120071
atggagcataacagaatgcgtcctctaccacatcgcgcagttgattgcggtatgtttttggagccgggagaaataaatgagatgcaacggcgggctaaggaggtgacgaggttgaccacggttacgcgacagtcacgcgatttgggcatggtgtaa

SEQ ID NO: 3294 - DNA, 543 bp, Glycine max
  Peptide Sequence Number=SeqID_120072
atgccgccgccaaccaccacaacattgaacatcgctaccttcactttcactgaacctaactgttgccaaggagccaaagaaaatacggcaccgaagagagaaaagcgagaagaagagtgcgcaacaatggctgctctgagaaagaaggcagaggcaattttgccatttttaaagaatgttgggtgcaccagcaaaaatgctagaaacattgatgaattgaaagatttagtgaaaagatttcatgaagttgggatcaaagttcttggagatgctgttttaaatcaccgttgtgctcattatcagaaccaaaatggtatgtggaacatatttggaggccctcttaactgggatgatcgttcagttgtagctgatgatccacattttgaggctgcttggattgtggatgattctgatgaggaggagtcggattgtgacaatgaaaacaatgatggtatggtgttggatgaaggggaagatgaatttccttgtcaagaggaaaatatggtggtaatcatggcccctggctgggttgctttttcttaa

SEQ ID NO: 3295 - DNA, 396 bp, Glycine max
  Peptide Sequence Number=SeqID_120073
atggttccagcaggtgaggtgtgtgttgtgtcaggtcagtgtgtcagcgactacatggactggttcttccacatctcgcatcctttcatgacaccagaccacgcatcagatcctctgtcagatggtcatgccccgcagccccaagtcgtccctcaggccccacggatagatatccctcacgtgccggagccaggagcaccgtcgacatctgcgaggcccgttgtggaggagcctagacatgtagtggaagtttgtctttggattactgagaggttggagcgccatctgagcctaggagtggtcacgccaggctcatcgacacatgaagtgatcgaagaatgcctcaggatggccaggagtgtcacacaggaccagctagtatatgttaggtcttga

SEQ ID NO: 3296 - DNA, 558 bp, Glycine max
  Peptide Sequence Number=SeqID_120074
atggtgagggcttttgaagttttgtatcctttctccaacatctggcctagtgtactggtcttcttatttttcttccaaatgaaattgtctggcaagattggatgggtctccttgaacagtatgtctaagaagttgttcgagtttgactcaaacatctttcgctgttttaaggaccactttttcaaggttctggctactgatgtcgtggctgatagcatgccattgatgcttaacagggacggggagccctacttcctattctattggcaatttgatcccaccgggtttaagtctgatcctctcgcttccttagatggtattatgggtgactttgcttggaggccacttgtgaagcaggtcagacctgcaaatgggaccgtgccatcgtctactgctgctctatctgttggagaagggggccaacctgctagtgaggttggtcttgttgttgttactactgatgtcacccccaacactttttcctctattttggcaaagaggaaaagggataatgttgtcaagcagatcgaggtcgtacccgaatcaaataaacattaa

SEQ ID NO: 3297 - DNA, 3330 bp, Glycine max
  Peptide Sequence Number=SeqID_120075
atggatcctggtcgctatgctctgcatcaaggctgggataataacagcgtaattgtggctcttgagggatacagcaccgtccatgaccccaacttccgggttggcggttcctatgatgagagaaggtttatagatgaaagatatccaagggatgccgtttaccagagaaataatttcccccgtgacattttggatagggaggcttatctgccgccaggacctcctgttggccactggagtcaaaccaaacggagaggttatgatgaagattatccacttgacagggaatctagacgttttcagaggccccatcatgaatcatatgatcagattgatggtttcagggatcgtgagattgacacctatccagaatatgaaaggtttcgggatggctatactggcattgaaaactatggtgatcgaggatatgataaacctgccaggtttgtaggacatgaccgtgatgattatgcatatgatgatgattatgactacaagtcccgagcatcctctcatcatcgtagggaggatagccatgagagggatcatgatcatggtcgacatagttatgattctgattatgaaagaagtagtagaagagatagtaattggaggcgacgcaaatcacgtgatcgggaacgagttaagagtggtcatagtcgggaaagagatctgagtccgcataggagacatgagcgttctcattcacattcacattctcgttctcgatcttgttcacgttctcgatccccgtctcattcccattcccggtctcaatctcgtggatatgatgaccatccaagatctaggtccccccgaggtcgaagccatggtcgaagttatagggaagatagctatactgacagtcgatatgacaaaagtgaaagacgtagggatcgtgatgataaacgtcagtgggagcattattctgtggccccatctgcaactgttgttgtgaaaggtctttcacagaagacaactgaagaagatctataccaaatccttgctgaatgtggtcccctccgtcatgttcgtgttataaaggagagaaattctggtgtctctcgtggatttgcattcattgattttccttctgtgggagctgcccaaggaatgatggacaaactaggagatgatggtcttgttgtggatggcagaaaacttttctttgaatatagtagtaagccaacaggaggtcctggtccagatggagctatgaaatcaggtcataattataagagcatgatggttccatccgattggatgtgcactatatgtggctacataaattttgcacgccggacttcctgctatcagtgtaatgagccacgaactgatgatgcccctgcagcagatatttcattgtctaattcagcagctataggaaagaaaggttcagaagcaggtccaactcatgtgttggttgtccgtggattggatgaaaatgcggatgaggaaatgctccgctatgagttttccaaacatgctccgattaaggatctgcgtcttgtgagagacaagtttactcatgtctcaaggggatttgcatttgtacacttttattcggtggaggatgctaccaaagctcttgaggcaacgaatggaactatgcttgaaaagaatgggcagattctaagagtggcgtatgcaaaaagtatcctgggccctggatcaggaacatcaggaacttcccaatcaagcagtcttgcagctgctgctatcgaggctgcgacatttgcccaacagtatgattctgtgggatgggctccaaaagaatacaacccagatgccaaacaatctactggtccagagcaaactggtgcagaagttggtgctccacaatcaggctttgtttgggatgaagcatcgggttattactatgatgctgcttctgggttttactatgatggaaatactggtctttactatgatggtaataatgggatttggtattcatatgaccaccaaactcagcagtacataccttgcactgatcaaaatcagaataaagcatctaatgagtctgaaccttctaaggtatctgatggttctggaagtaaaaaggtcatttctgcaccagctactgctgttgcaccggttgagaagccagcttcattggcagatgctgtccaggctgcagcaactgctgctttagctgcagagaagaaagagaaagaaaaatcaaaggaaataaaacttgcctcaaaaagcagtatactggcaaacaagaaaaaaatgaacaatgtgttgacaatgtggaaacaaaggagccatgaggggcaggctactcgagtggctctggaagacaatcagccttctgtttcagctgatgataggtcatattcttctggacattatgcaaagaataagttaaaaaatgagactatggtaagggaaagtaatgcttctaatccaggaagtcacacaactcttgcccagagtgctgctattgattctcaggcacagccacagcctgttagtaatagccttggaggcactgtgatgggggttataaggggctcaggaagaggggttgttaaagcagatacttattcaggttctacatctgttgcatcatctatgccaagtttatctacagcaaatgttgatgcacagacagttgctactccctttagaacagatgtatctgccctgggttcatatacacaatctgtgattgttggaagtggtcgaagaaggttttcagaaatgcctcattctgcttcaactcacaaggaacaacctcaaacaacttaccgggaccgtgcagctgagaggaggagtttatatggctcatcatcttcagttggaaatgatttagctgaccttgaaattggcgattcaaatcgagattttgcatcaaggaagggtgatcccatgccattccctcctggggttggtggaggacgcatagttggagatgccaaccttgatacttttgaggtgattacggcagacaaagcaattgatgaaaacaatgttggtaatcggatgcttcgcaacatgggctggcaagaaggattgagcttgatactttttgttgccgcctcttgcaataagttccagtattccaaattccccctttacagggatatgttgtcagtttcgacctcaagaattggatgggatacccctggaaatttgggactaggaaaggatgggagtggaatgatagagcctgtcctggcacaagccaccgaaaatagggcaggacttgggagtcaacagaagaagttggatcctagccttgaggtgcaagcaggggacagttacaagatgcttattcataaaaaagcacttgccaggtttcgggagatgtcagagagttaa

SEQ ID NO: 3298 - DNA, 225 bp, Glycine max
  Peptide Sequence Number=SeqID_120076
atgatagtggcttgtcccttatcaagtgattcatgttcgaatcctaattggtccttgacgttggaagggaaatacccaccttgtgtacgctcaagccagaaacaagacctagcctccaggaacgtcgcttgcgaggtgcgaactgagataactcagagggaggcgacgtttcgagacgaggcgccaccggtgaggaagacacggttgcgacgtttctgtgaataa

SEQ ID NO: 3299 - DNA, 936 bp, Glycine max
  Peptide Sequence Number=SeqID_120077
atggccttctctcctgtaccaactgctctggattgcttgccagttgaagaaagctacaacactgaggccaatgctttttttgattcaaggtttgggtctgggaaaaggcagaaaattgaaaatctccttgatgctaaaagcttactttttgctgaaccttggtacaagactgttaataacttgcacctgtggaatgcctctttcattgatgttgtattaatatccagtccaatgggtattatggggttgccctttcttactcgaacgaagggtttctcagctaagatatatgtaactgaagcatcggcaagaataggccagctaatgatggaggatcttgtatcaatgcatgcggaattcaggcagttttatggaccaggggaatcgaatttcccttcatggctgaggcatgaagagcttgaagtccttccttctgaattaagagagttaatcttgggaaaagatggagttgagttgggtggttggatgcctttgtacagtgcagctgatgtgaaggatttcatgctaaagattcacactgttaattatgctgaggaagtttgcttcaatggtacattggttataaaggcattcagctctgacttcttatccttgggtgatactcaagatggtgagaatggggataattactctgtttcaactgctgataagttactgcctattagtaatgaatatttatgtctgtttatattgactttcatgttggttattgctgaaagttctcaagatttggctggattcaaccataactctgttgagtattcagaagaaaaggaaaagctggttttcatatgctcacatgctatggaacatatcaaacaaggcggttcagttcttattccttttgatcgacttggaactattttgcttcttttggaggaaatgacagcatcacttgaagcttcagatacaaag

SEQ ID NO: 3300 - DNA, 249 bp, Glycine max
  Peptide Sequence Number=SeqID_120078
aaattgttcgatgaaggatctgatgaatttcataaggcagccaatttagccgttagttgcatcaatgatcataagaagtactgtcaaaaggttctttgcaatgccatggaacatgttggaactgatgaggatgccctcacacgtgtgattgtcaccagggctgagaaggacctgaaggagatcaaagagatgtattacaagagaaacattgttcaccttgagcatgtagcagccaaggaaacttcttga

SEQ ID NO: 3301 - DNA, 138 bp, Glycine max
  Peptide Sequence Number=SeqID_120079
atggagatggtggctgcgagttgcgacaccgtgtttgtgcatgtgaacgagggcacgatggcagttgcgtggagagcttggaaaagagaaggaggtaggttttctgatgtagaagagagatcaacgacatcattttaa

SEQ ID NO: 3302 - DNA, 309 bp, Glycine max
  Peptide Sequence Number=SeqID_120080
atggctacgctgattgctccttccaaccaccctccagtggaagatacagaatctctccggaaggctgtcaaagcaatgtaccgttggatattggaacatgtacatgtcgaacgtgaggctttgttggccaatatagcccttaagagtgctgacaaaaactaccaagtgattgtggaaatttcttgtgtcctttcacctgaagagctttttgttgtgagacgtgcttaccacaacaaatacaagcgttccttggaggaagatgtggctgctaataccagtggccatcttcgccaggcaactcaatgttga

SEQ ID NO: 3303 - DNA, 558 bp, Glycine max
  Peptide Sequence Number=SeqID_120081
atgagattaaatctgtatggagttgcgatgaagataaaagccccggctgtaacatcctcctttattgctttgatcccgaaaaaggataatcctcaatctttgtcagattatggaccaatttcgttgattgtgagtatgcacaagatcatttcaaagttattagcgttacgggtgaaaaaggaagtgggtgagaacaattgtgtgttctggagctacgtctatttggttaatggtagtcctatggcggagtttggagtcgagcggggtttgaaacaaggtgatcctttgtcaccttttctctttctgatggcggtggagggtctttgtgggttagtgaagaaggcggagttggttgatgtttttaagggcttgctagaagaacatttggcaatcaaaggcatcgtaaggagttttgagcttatgtctgagctgaagggatccctattggggctaggtggaagaataactttgataaatgcagtgctatctagtctacctgtatacatgttttctgttacgacgtgctgtttgttggtgcttatggcttactcaaaataa

SEQ ID NO: 3304 - DNA, 487 bp, Glycine max
  Peptide Sequence Number=SeqID_120082
ctacattggtgttttttatactattttgggtcatgccatggcccttggcagtgggctcaggttttgtatgtatgctgagattatggttggtgttctgaggtttggtccagtcaacttgttctggagtactcgctatgacaaagcaatgacattgtttttagcatgcctcaaggattttgcagactttgccaaatccaaggatcaagagaataacataccacctgagaaatgtttcaaactgccttacaagattgagaatgacaaggtggaaaactattccatcacccaaagcttcaataagcaggaaaattggactaaatctctcaagtacactctttgcaatttgaaatgggctctctattggtttgttggaaatactaacttccagcctctttcagcaatggtatcttcgcatgctgaagtgccggcggttgggcctctgtacacgaagcgtggtgttgatgccaaatctgaatctcgaaactga

SEQ ID NO: 3305 - DNA, 741 bp, Glycine max
  Peptide Sequence Number=SeqID_120083
atgctacagaccgaggacctcattgtagagacgaatgccatgaaaattccaattattgttgtggaacgcgtttggtacgaattggtttcccgcgctttagtggtgatgcagttcaacaatggatctaccaatgtgaaacattttcgggtgaaattggttgtaatacacttcgaagggaaggcactacagtggcatacctcctttgtgaagactcttccagaaagtaaccttcctaagtggactaaatttacaaacatattgatcgatcgttttggtgaagtatgtgatgacccaatggctgaacttatgcaattaagacagaagggcaaagaacctgaactaattttggatagagcaactgtcaagaaaggtaacagggctgtcaaaggtgttggtcaagtggaaacaccaattaatcgaagatgctacttggaagggacacggaatcatgaagtgatacaaatcatcatgacagcatgcaacaaacaccttgcccattttgatcgaagccaccatcagaatgaatatctcatgatgaatattgatgctgcgattttccagcagctcactaaatttggaataggttgttgcattagagacgatcatggcacttttatctctgcaaaaactactcattttgaaggacttcctgaacctagagaagcagaggcaaatgggtcttcttcatggattactttgggctcaagaacttggagtccaacagaatatgtttcaacttga

SEQ ID NO: 3306 - DNA, 353 bp, Glycine max
  Peptide Sequence Number=SeqID_120084
gaagaagagagattgaagcagtaattgaagaaaccgagagacagaatgctgaagtaaatgctgaactgagggaactagagttaaaatcaagtcgctttaacgaattggaggagcggtattggcatgagttcaacaattttcagtttcaattaatttctcatcaggaggagagagatgcaattttggccaagattgaagtttcacaagcacatttagaattattgaagcgtacaaatgtgctcaatgatgccttccccatttctcatgatggagagtttggaacaattaacaattttcgacttggaagacttcctaaaattcctattaagctttggagacaatttggtaattga

SEQ ID NO: 3307 - DNA, 372 bp, Glycine max
  Peptide Sequence Number=SeqID_120085
atggcaatgcgatgtggaggtggtattggggggtggtgtttgagtgtagaagtggtgtttgagtgcaacggcgctgtttggggatgtagtggtcatggaggtttgggggagaggcatctaggtttgctaggaaagaaggaaagttctcgaacaaaccctccatcgccggcggcgccagtgccatttccggtaaaccgcgacgccattggtacaggttcaccccctccacacacccagattccaccctctcagtctcagcgtctccctaccgaacaaggtcatcctctaccttctatcagcggcggctcgttccaattttttcgttccggtgccacatcagcaatccttgaaggtttgtccttcactggatga

SEQ ID NO: 3308 - DNA, 273 bp, Glycine max
  Peptide Sequence Number=SeqID_120086
atggacgtgggatcgtggagttcttctccctcgaagatgaagttccgattctcctccaagatcgcctcatctgcagaaagaattctcaagaaaacagaggacgaacagttctctatggtccaccccctccgacatgatggtcgccgacctcagcctcggtcctcagtctttcatggcttggtggtgtcacacgccctcaacggcgacgaagaagccgcgagagttggctgcagggctacgactggttcacgagactttgttggcattgataag

SEQ ID NO: 3309 - DNA, 738 bp, Glycine max
  misc_feature (529)..(529): n is a, c, g, or t
  Peptide Sequence Number=SeqID_120087
atggcagcttcagagaaaactctaacaaacaaatgcacaacaaatgaaggttggactgtagttttaccccgtcgcagcagacaaagaagaaaagctaccaaatctggagttttggaggaaaaacaagagccatggactccaacagattctcagactgacccaagcaaagaagcaacattggtgcagaaaatggaaagatgtataaataggattgagagatctgaattctatcatactttcagggatcaaattcaaacatctgttgttgattacttcaatagagttttgggctcagagataaagatgcaaatggtcatttatgaggtatttgatcctattctttctgcaactgagtctcgggttttggaagctcttggctgttctgtcatgtccataaatgagcatgggaggcgagaggctctaaagccaacaatgttcttcatgcctcactgtgaagcagagctatataacaacctgttgcaagcaaattggaaactgaatctcttaaaaaacatggtattatttgggnacagctttgaaacatatgagcagcacgtgtcactgtgtaagaactcacctattcttaactcgatggggcatattttggctgctcaaggattcacaaatgaatttagaatccaaacagtttcagatgattattataatgcattccatgattcaagttggcattttttcagccctctccttgagacagagctgcctattatcaattcttga

SEQ ID NO: 3310 - DNA, 288 bp, Glycine max
  Peptide Sequence Number=SeqID_120088
atgagattttcaaatcaagattcaagtaaaatttcccttaagcttggtaaagtcgaagagaatggcatagagaaggaatttgatcccagaaagaaggctgcgttgccgaaatgttatcatcatttggaaggccatcatcgagccaatttgatggatcatgccaatttgtgtaagtacattgcacaatttacaggaggctttgatacggagaacatagaagcttttgaagaactaaggagctgcatccatgctccaccaggtgaagacaataaccagaaacatagttga

SEQ ID NO: 3311 - DNA, 324 bp, Glycine max
  Peptide Sequence Number=SeqID_120089
atgggaggtcacatcgccgagtctcagcttcatctactctcgcttgcacgtcctagcttccgattgcttttcttccaacctcatttctgcattccagtttcacaatctaaccacgatcctgcattttcattctccgatgtacagaggttgtcacctgtgttggttgaaaaagctcaccactttgtcgacagtggtaccaccatgtcggagaaaccaatgccggtggcggaaaattccaaggaattgggcacgctggagcctcccaatgtatcgttcaatactcttctcgaagaattgagcatgtttttaattttatcttggtag

SEQ ID NO: 3312 - DNA, 292 bp, Glycine max
  Peptide Sequence Number=SeqID_120090
atggcatttgcacatgaaccattgcatcttcttttgctattatccttatcaagatgttgtttctcatcaactaacaccatttcatctggtaagcctcagagactggtttccaaactcattcaccctggctcagttcaccatccccactacaagccaaatgaaacggcaaaagaccgaatggaacttgatattcaacactcagctgcacgtttagccaacatacaagcaaggatagaaggttctttggtctctaataatgactacaaagctagagtttctccctccttaactg

SEQ ID NO: 3313 - DNA, 252 bp, Glycine max
  Peptide Sequence Number=SeqID_120091
atggcggtttctgccatcgacgacaacaatggaggaagaagaagcaacgtgaaggagaaacgtacctcgaggaagaagctaagtgtcgaagatgaagcagaaatgcgaagaagaaccacacccacagtcctatgcagaaacgcgaagaacaatgaaggaattgaaacgccaagaagcagaaacgccaagagcagtgaagaagatggaatcacggcgacgcacaagaagaagattgaagaagcagatgaatga

SEQ ID NO: 3314 - DNA, 387 bp, Glycine max
  Peptide Sequence Number=SeqID_120092
atggggcatttgctgattttgcccttcgttgatgacactcaacataagcaaatgcttgttgaaatttcatgggcctcccttcaaaactttttggatatcaacatgcttgtgtatgacaaagatactttctcaacggatgattttatgggcgaggctgaaattgacatccaacctctagtttcagctgcaaaggcatatgaaaaatcttcaatcaatgagtccatgcagcttggaaaatgggtagcaagtggcgacaacactcttgttaaagatagtatcatctcccttgaagaggggaaggtcaaacaggagatctcagtgagacttcaacatgttgaaagaggagtgttagagattgaactcgaatgtgttcctctaactcaatag

SEQ ID NO: 3315 - DNA, 744 bp, Glycine max
  Peptide Sequence Number=SeqID_120093
atgtttggagtcaattgtggcttcaataaaatagaattcattgttactactctatcacctcacggacttgagcatttgacagtccactctcttctagactatgacaatcgaagttggaggctcgacttattgcaacaaatcttcaacaacattgacatccaacaaatccagaatattcacattctaaactctaatgaagttgatgcaaggacttggaagcttacaacatctggaaactacatgattagttcaacttatcttcacattgatgactcattatttaatgatgcaaatgtcaaaattgaaggcaattggaagcagatttggtctctaccgattcaactaaagataaatcaccttatttggaggattcaacgtgattgtctctcatcaagagttaggctccaatcaaagggagtgcaattcccttcaacgtgtcattcttgtcataacaatctagaatacaattggcacattttctttggttgtgaaaatatagtttctatttgggttgtagctggcttttggatggaaatccagcctctagcgcatcaagctaaagctcaaacagctcggacgaatggctcttcgaatccaatagaagcggaagcatggagcttattgcatgctcttacatggataaatgatcagaattctcaaaatattgatgtcgagatggttgctaaagttatagtggacaaagtatacaataactccactggtaaatctgttttacaacaataa

SEQ ID NO: 3316 - DNA, 435 bp, Glycine max
  Peptide Sequence Number=SeqID_120094
atggtggttctggaaagtgaatctaattatgaggtgataagaggtggtagattgaaaacaaagcaaccaaataacagtttttctcaagatgacattgttttcatcaaggaagtgactaatgtgaaagaggacaaagttaggattatttttaagggtattggtccacaaccgttcttgaaaaatatattcaaaatggtgaaggattctaatacaaacccaattgtgtcacggggtgaagctagctcttctgaaagggaagagataaaaataatggttcctgaaggtgaattcaatcatgaggtaataggaggtggtagattgaaagcaaagcaatcaaacaatgttggttctcaagatgacattgttttcatcaaggaagcgactaatgtgaaaggtgacaaaactatgattatttttaaagggattgatctataa

SEQ ID NO: 3317 - DNA, 354 bp, Glycine max
  Peptide Sequence Number=SeqID_120095
atgaatatgttttcttcttcctcccgcacagcttcttcattcttctcttcttcttcgccgccagtcttcttcttcttcttcgtcgccatcgccgccattgttgtcgtgtttaggaggaaggtgtgggtcttcgcgtttgtggtgtgggtcttcgcgtttgggcttcttcttcgcatttctgcttcttcttcgcatttatgcttcttcttcgaggtaagtttgtcgttcgcgttttggtttttgccggcgatggcgaaaaacgctgtcgggaagttgctgggttgtttagtgatccgtaagcatttttcggatcaagttgatccggaagatgcttacggatcaagtgatccgtaa

SEQ ID NO: 3318 - DNA, 1314 bp, Glycine max
  Peptide Sequence Number=SeqID_120096
atgaaatgtaaaatatgcagttcaatacaacaacatattttgtttgccttttgcagcaatgctggacatctactagacattcttgaaaaggtggcaatagatgatattttggtggttctatcggtcgcaaatatatgtggcatagtgtgtgaaagactactagcaaggtgcactgagatgatacttaaatctgatgctgatatcaccactcttgaaaaggcactgcctcaacatttggtgaagcaaatcacagataaacgaatagaactggacctgtacatgcccgaaaacttcaattttcctgacaaacatgtcaacagaatacacagggcactggattcggacgatgtggaactggtaagattgcttttgaaagagggacacacaactcttgatgatgcttatgcactccactatgctgttgcatactgtgatgtgaagaccaccactgagcttcttgatcttggtcttgctgatgtgaaccacaaaaactataggggctatagtgtgctgcatgttgctgcaatgaggaaggagcctaagattatagtttctctcttgactaagggggcacagccttctgatctcactttggatggaagaaaagcccttcagatttcgaaacgtctcaccaaagctgtggattattataagtccacagaggaaggaaaagtttcatgcagtgacaggttgtgcatagagatattggagcaagctgagagaagggagcctttacttggagaggcatctctttctcttgctatggcaggggatgatttgcgcatgaaactgttgtacctagaaaatagaggtattttctcacattacatattcttcattggactggcgaaagtgttgtttcccatggaagcaaaggttattatggatatttctcaaattgatggcacatctgagtttccatcaacagacatgtactgtccaaatattagtgatcaccagaggacaactgtggacttaaacgatgcacctttcagaatgaaggaagaacatctagttaggttgagagcactgtctagaactgtggagttggggaaacgcttcttccctcgatgctcagaagtgttgaacaagatcatggatgctgatgacctaactcagcttacatgtatgggtgatgacagtcccgaagatcgactaaggaagcgaagaaggtatgtggagctccaagaagttctgaataaggtcttcaatgaggacaaggaggagtttgataggtctgccatgtcatcatcatcctcttctacatcaattggagtagtgagacctaatgccaatctagccatgaagaactag

SEQ ID NO: 3319 - DNA, 1431 bp, Glycine max
  Peptide Sequence Number=SeqID_120097
atggttaattggagaagaaagaaaaatatgttaagaggcttgagggttggtgaagcttgggtggaggagccggtgagggtcaaggaggaggaggaaatcaaagaagcagtgtgggattgtggaagcttgaagagcccagggtccgatggtttcaacttcaagtttatcaaatccttttggatccttttgaagaatgatgtgtatcgctctgcgaaggaatttcataggaatgaagtacttccaagaggagttaattccacttttatcatccttatccctaaggtgattgatccactaagtctaaagaaatttagaccaatatccttggtgggcttgatgtacaaaattttagctaaaagattggctaaagtccttcctaagatcattgatgagtgtcaaagtgctttcttgagtgagagatcattgttacatagtgccttagtagcaaatgaagtagtggaggaagtgaaaagaaggaaggggaaatgtgtgatcttcaaagttgattatgagaaggcatatgactcagtgaattgggaattccttttatacatgatgaggaggttggggttttgtactaaatgggtgaattggatcaaagaatgcttggcatctggttttgcttctattcttgtcaatgagagtccaactagtgaattcaaaatggagaaggaccttagacaaggtgattcattagctccctttcttttcacaatggtggcggagggatttagtgtccttatgagagaggcgatggaaaagaacatgttcaaaggggtgttggtgggagaaaaaaaggtggagttggtgtccggacttaaggttaactttgcaaaaaagcaattttgtagctataggtgtggtgggaagctaaatggaaatggaatatattccatagcaaagaagctctttggtgaaagttcttggactctaagtatgatggttggaggaaccttaggagggaagaggatgtacttaaattcgaagaaaaggaggttcttgttagagatatgggacaatggggtgttgctggatggttctaatcttgttaaaggagaagtagattcttggaggtgggagggggatgcctggggcttgttctcggtgtcatctgcgtatagggtgattcatagtagagggagaggaagtacatgtgatgatagattggccagaggctctggaatgtgctctatctgtggatcacacatggaaacggtccaacacctgttctttacttgtcctaagattgatagtgtatggaagcattgcagcaaatggtttaacactctcactgtctttccggaaaatgtagatatgaacttccaacatttaccaggggagttccgtctaaaacatcatattcagtgctggaaagtgatttggagtgcgatagtatggtgcttgtggaggacacgtaatcactgtgtttag

SEQ ID NO: 3320 - DNA, 294 bp, Glycine max
  Peptide Sequence Number=SeqID_120098
atggagaaaagcaaagctcagcttgaagaagagaaatggcatgtctcgccagcactgtgggcgagtcccacgtggcctgtatcgccagtcctgatggcggttccaacgtggaggtgtgtcgccaatgcaaaaggcgacactctcctctctccctcctacgtggcctataacgccactggcactggcgggttcacccttgccgccaatggctatggcgggttcacccttgttgtcagtggcagtggcggattccacccacataacagaccccctccgttaattcttttaaaatag

SEQ ID NO: 3321 - DNA, 723 bp, Glycine max
  Peptide Sequence Number=SeqID_120099
atgccggatgttcaagcccttgttaatgattttgtgaatctgcttaagaaacgtagaattgaagggtctcaagccacagcaaagcagacagcagtgttgctacgctcggtgatttcacagcagcgggtgccacacacaaaccaggccacagttctgattaatgcagtaagggcggtgggggagcaaattattgatgttaatcctattgagttagctgtgggaaatatcgtgaggcgtgttttgcacattataagggaggaggatctttcccttgtgacagatgctgtggctggttttgggatgtttgctggaagtgatgatgaggatgatgttgagcgagatgattatcctgctttatccgcggcttctgttgcagctgctgcaagaagcacctcgcgtccaccgtcattgcaaactcttcttgaggatgtgactgattcagctgttgttccaccaacaccttcatcaggcggtgactctgaagggataagtagaactcttgaaaaaggttcaagtggtcggaagttgaagcatgatgtcattgaagcagtcaatgaactcatccaagacataacctcttgccatgaacaaatagcagagcaggcagtagaacatattcatcaaaagttcgtttcaccagaactacttgagatatattgtttatctcttgctactttaaagatcttgaaaacatgccatacaagatcccaaaagccagattga

SEQ ID NO: 3322 - DNA, 285 bp, Glycine max
  Peptide Sequence Number=SeqID_120100
atgatcgaaagttttcaacaacaacaacaaatgtcagttctagagttgtacgtagaaaaggatgttgctggtggttctatgtttcatgttgcaaattctgttacgtcatgtggacgtaatgtatctcatcatgagtcggaactgccaagaaatataagcaatttacatgttgatgaagatgatgatgatgatgatgatgatgattatcttacatctaactcatacgttgacgagtctttcgatgaagatgatagtgatgatggattatctcatacagacgatgaa

SEQ ID NO: 3323 - DNA, 654 bp, Glycine max
  Peptide Sequence Number=SeqID_120101
atgtttagagatctaatccagtctgaaaagggtgaggtaatattaacactaggtagttcaaaaacagtgttggaatttctttgtgctgcaaaggagaaaaagagatcatttaaggtcgttgttgctgaaggtgccccaagatatcagggacaagtccttgcaaaagaattggctgctagaggcatacagaccacagtaattgctgattctgcgacttttgctatgatttcccaagtgaatatggttatagttggagctcatgctgtcatggctaacggtggagtaattgccccgatagggttacatatggttgcacttgcagctcaaaggcatgctgttccttttgttgtacttgctgggagtcacaagttgtgccctttgtatccacacaatcctcaagtcctactgactgagctgagatccccatctgagcttcttgactttggggaattctcagatttgatggattctgcaactggttctggttctcttcatgttgttaacccagcatttgattatgtgccaccaaaccttgttagtctctttattactgacactggagggcataacccgtcatatatgtaccggctcatagctgattactactccgctgatgatttggtagtgaaacaaagacctactacagggagttga

SEQ ID NO: 3324 - DNA, 333 bp, Glycine max
  Peptide Sequence Number=SeqID_120102
atggatgagcagttccccatgcaacattcaggttcatttgacaacacttacaccaatgcttatggggtttctgaaacacaacatcaatcacatgctcttttccagcatggatggtttacatatataggtcctgttctggccaagattgttgctcttttcacatcactcttatccttcaagtccacaatgaaagagaacactattccaagatattctagtgcaaggaaactgacatcagaaatggatgctaggccaacaccaaaaagttcgtcacttcatatacagatgatgggttattattcttcaccgagtcaagtgataagagggaattaa

SEQ ID NO: 3325 - DNA, 426 bp, Glycine max
  Peptide Sequence Number=SeqID_120103
atgtggtaccatgtcactgaaaaaccaccatgggtgcttaggagtatataccaagacacaccacacaatggatatgtcaggtcactctcattaagtaaaatcacaaggtcaccagacagagtcactctattttgcgagaatgcttcaaccatatgggatcaacataggcttaaaggagcactcaaaccaagttccttgtcgcaacatgcccttttgcgggcgtgcgaggcgaggctcacgggtgtgctttccaaaggaggaaagatgcgcggagtcgccaccaacgcttatttgtggaaaacgtcgaaaaaaaccaaaggaaaccggtcaaaaagaaaattccaagttcgggagttgtatttacgcttgaggaaggtattagcacctctcacgtttgtctcaaaggacaacaacctcattttttga

SEQ ID NO: 3326 - DNA, 435 bp, Glycine max
  Peptide Sequence Number=SeqID_120104
atggctcttcctagttacataatagatttagatagaattcttttttgctccattcagggagtcacagacttagacactgtttgctgtttggctcttggcatgggttggggatgggtaagtgggctcgagtacatggacttgcccgcaggacttgcggcccgtggaccagtccgtttgacccgcgggatccgcggggcaggagtggaccaatttattaggtccataagagaagatttggaaatgttgctgaagggctcgcttagcgagtcacattgggtaagcgaggttcatccgcttagcgaaaaggacagctcactcagcgagagcgaaaccctagataatgttgagtcagagagcagcgtgcttagcgcacagtcagtctgcccagtgatgatttcgtctcttctcgcgcttagcgcgttcaagcccgcttaa

SEQ ID NO: 3327 - DNA, 252 bp, Glycine max
  Peptide Sequence Number=SeqID_120105
atggatgggacaattaaggacaatgttcatgatattgaaaatgcgagaaaatatttgcaagttgttggtgagaaatttaagaggtttgataaggttgaaaaagctcattatcttactttattgagaaagaccacttatgatggagtaagaggtattcgtgagcatgttatggaaatggtgaagcagtacaataaactgaaaatccatgaatgcaaagctaggagagaactttcttatttggcaggtgtttga

SEQ ID NO: 3328 - DNA, 777 bp, Glycine max
  Peptide Sequence Number=SeqID_120106
atggaaggcaagagagagaggtgtacagtacaggtcacagtattagcattggcctgggcgctcttagttctttcctccttcactagcgtaaccgaaaagtcactaacagagcatttcatttttcagaacgcaatggaatgcatcgccaagatgacgaaagacaacgggagcatggagagcctccgctacttcctgagtcgtcgaacgctgctggagatgctccaagacagaggctacgacgtcgttcagcacgcaaacctctctccctccctcgccgagttccgctcccgcttcggccaaaaccccaaccctcaaaccctcgccttctgcgtttcgcatctctcaaatccctccaacacggtacaagttgtgtttgcgggaaccgatgatataagaaaaggaacggtgaatgagatatgcacccagattgcggacaagggacgcttgaaagggctgatacttgttgtgcagagtaagatgacttcgtttgcgaaaaaagacttggagagcttgccatttaaagttgagattatcagaattgatgatttgctggtcaatatcacaaagcatgtgctgcagccaaagtatgagatactcactgatgatgagaagaaagcactgctcaccaagcataatttggatgagaagcagctccctcacatgttgaagactgatgccatagctagttactatgggctggagaaagggcaagttgtgaaaatcactcacaggggtccagtggttgattttcatgtttcttatcgctgtgtcgtgtaa

SEQ ID NO: 3329 - DNA, 279 bp, Glycine max
  Peptide Sequence Number=SeqID_120107
atgactggtgtttatcttgagaaaaatgtttattgtgaaaagaggaagaataagaaggttgcagtagctggtgtctcgctaagagaggcatatgcgcttagcgagcaacatccgctaagcgaggcatcggctcgcttaatgagtgaggagaatctggaagagaatctatcacgcatgcacgcactcagcgcgctatcagctcgtccagcgagtcatttgtctattcttgcgcccagcgcgcctaactcgctaagccaaaaatcactaactcacacttag

SEQ ID NO: 3330 - DNA, 288 bp, Glycine max
  Peptide Sequence Number=SeqID_120108
atgactgaagcacgtcaaaagggggtacgaaaagtaaatgaaaacgagaataaaagtacacgaaacaaatggggaccaccacggcaaaataggggaggagtttgccatccagctcacccaggcgagccaggttgcttcctccagaagcaaccgccttctggaggaagaatctggaaggcccaactttcgaagaagttacggaaactcacagattgtgtaacaatacttccttttgatttccgccacattacggaatttcacggatcgcataaccatgcttccttttga

SEQ ID NO: 3331 - DNA, 612 bp, Glycine max
  Peptide Sequence Number=SeqID_120109
atgaagggtgtccctaggataacttcatttttaagatcttcgattgtggttggtttggcaaaagtgttttctaatctcttgagtgtagaagcaaagcttcatgatgaatcaagattgattcaaagatgttttgatgataacaaagatgatgacaaaggtgatgacaaaaagctcgaagactcaagaggaaagttgaagaacacttcaagattcaagaggaaagttgaattcaagaatcaagaatcaagattcaaggatcaagcttccaagaatcaagatcaagattcaagactcaagattcaagaatcaagagaagacttaaccaagataagtatgaaaaggtgttttcaaaaactaagtagcacatggatttttctcaaaacatgtttaccaaagagtttttactctctgagggtacatctacttgggttgttgactgagaacaagagagggtacatctcttgtggatcagttctagtggagggtacatccactaggttcaaagaaaacaagggagggtacatcccttgtggatctttgcttgtaaaaggatttttacaaggttggaaaagaaatctcaaggaccgcaggtcgcttggggactggatgtag

SEQ ID NO: 3332 - DNA, 843 bp, Glycine max
  Peptide Sequence Number=SeqID_120110
atgccgtttgaccctcctctttttcttcataatgtcttgttctgggagggttttgtgcgctccaatggaggtatgatgcttttgtcggaggtctgccctattagggagagttccaatgatgacctatcccactgtcacaacggctctaacaccactagtgaccatgtttcaagtgtccctgctggtgacgttgtcgctgccaatggcatgacttgtcatgatgctattgatgtgaaggtcatagacccttgtcccttcattcatcctccttctcttcttcctagaaagcttaataaggcaaaaaaaagagtaccccttataacccttccaggttattcctgggttcatgaagaagtcggatcctacgcaaatagtttcttgacttatgagtcaattatcatctttcttaaaagtgtcgagtgttgtcatgtcgatcgtcttgatgggatgatcatcaagtcttgcctagtgagtgaacatgtctttatctgtgcttctctaggtgagattcatttcatgtatatgtactccaccctcttattgaatcttcacctcattgtcccttttgacaagtttgaggttgatgctccatgtcgcgtgagctgtggaagcttcgagactccacctgacggcaccattagcgttagggatttgttaggcttcattgtcagggcagcactagtgtgggattttcgacctccaacgtgtgaagtcgtggcgacaatgcacttccttgctgccgccagatccaaaagaccttcaacaacatcaagcacccaaggtgagttattagtgagtgaacaaggaacaccttcttcttcttcttcttcttactactactag

SEQ ID NO: 3333 - DNA, 945 bp, Glycine max
  Peptide Sequence Number=SeqID_120111
atggattgttttcagctagctaacataatatggggtgaaggaggtgagagtgttgatcatattgtgccatatccagaggtaaatgaagatgttagcaacataaaagagtggaatcaagaagctgctgcgactaagctcaccaagctgaagaggccagaggctaaaactgattttcatgaaagaaagctaggaagcagttccaaccttgataatagtggagaactactaacctcaggatatggaacaaatgcatggcctgacttgtctttatccacttcagctaacattgatcagggttccctgggtactgaagtatctaaaaatttaagtgaacttagcaaattcagttcatcaagaggtgaagaaactacacaacatgaaaaggatgctgaaattttccaaactgctcatgaaggtaaagagcaaggtgattttgttgattatggatgggtcaacataggaagttttgatgaccttgatcaaatttttagcaatgatgaccctatatttggccatgcaagtcttgataattctaatgagctttggtcctctaaagatgtgagtaaaaatgcagcacctttaccattggacacaccaagttcatcaggtgctttaaggaacagaactgagcctttggaaatcaaagaagaatatgctcaatgtagtgatgaatcattggacctcaacaatgagaagattgggggtcctgcatcccaggttatagaaaatgcatgcacaatcacagctaaagtgggaaatgatggagttagaagtaagcctccaggaaaggaacagcaggagatagggtactcacggcgacagcaggaggtgagatgggaaagaagatttgctgcaatgaaccacggattaagcaatcatagaatggtgaggatcaacgaaggggggagagactcgcggcacaagggaagggaaggaggccaatag

SEQ ID NO: 3334 - DNA, 495 bp, Glycine max
  Peptide Sequence Number=SeqID_120112
atgactagttgggcaggatctcctaatgactggcgatcaacctcaggatattatgttctaattggaggcaatcttatttcttggaaaagcaagaagcaaaatgttgtggctagatctactgcggaggctgagtatcgtgctatggctgttactacatattatcattttatccatgagaagatcacttccggagaaaacaccacttcgtttgtgaactccaatgatcagctgacagatatcttcaccaagtctctccaagtagaactaatgagggcgagccctggtgcagcggtaaagttgtgccttggtgacttgttggtcatgggttcgaatccggaaactgtctctttgcatatgcaaggcaatagcagactacaagaaaagaccaaggaggagggcatggaagagcatgagaatgctctacaaggaatggaaggacctataacaagggataggagcaaatggatacatgaggaacttgcccgaaaagcttaa

SEQ ID NO: 3335 - DNA, 162 bp, Glycine max
  Peptide Sequence Number=SeqID_120113
atgcctgctcttactgacaccagtagttatttcgtcaatgctactgacgaaacaccctccacgtcaaccgaaaaactaataatactgataacatgcatgcatgaaactgtttcccaggattctacagtgatagttgcacttgcttatgatccgaatggctga

SEQ ID NO: 3336 - DNA, 540 bp, Glycine max
  Peptide Sequence Number=SeqID_120114
atgtacatcaatccacaagagagtttagagagaaaaataaatcttcttgagaatgagttgagttcttttagtgagaaagagtatattattaatggcatattggatcttgggcccaatccagatcattgggctgaacagaacaaggatcaattgctggatccaagccatatggaaagcgtatgctactacatcggtgcctacctcgccaacgatgtagaaaatccaggttacaggatcggtgcctcagctaccaccgttgtagaaactaagactagtgccgcggatggtgacgaagccatagagaatggtgaccttgatgttgttgaaggtcttttggatctggcggcagcaaggaagtgcattgtcgccacgacttcacacgttggaggtcgaaaatcccacactagtgctgccctgacaatgaagcctaacaaatccctaacgctaatggtgccgtcaggtggagtctcgaagcttccacagctcacgcgacctaaactccaaaggtcaccttttgttgttcttatgaaagtagtttaa

SEQ ID NO: 3337 - DNA, 350 bp, Glycine max
  Peptide Sequence Number=SeqID_120115
ctctggaggctcttgtaaactacagaatcagtggtcttccggtaatcgatgaggtctggaatctggttggagttgtatctgattatgacttgttagctattgattcgatatcagagggaaaggaagacatagcaacagtgacagaaaatgttagaggaacagttaaaggggtgaaaattggagagtggaggaagcaattaggtgtccatattcaagtcagcatcactacattcaatgagttacaaaaactgcttagtaagactaatggccaagttgtcggtgacttgatgactccaactccacttgttgttcatgaatcaactagtcttgaggaagctgctaggtactga

SEQ ID NO: 3338 - DNA, 852 bp, Glycine max
  Peptide Sequence Number=SeqID_120116
atgatggtagctacagtttttggaaagctaagagagtatgagttagagcttgggagactaaaggatgaaaaagaaattgacaaaaagaagaagggattaaccttaaagaaaagcacttcacatcatgaagctagtgatgaagaccctttaaaaaatttggataatgaaaatatgaatttccttgttaagaagttttgcaagggaagagacaaagggaacattcaaaagaatagcaccaagaactgtgacttcactcccaccacttacacatgctttgagtgtgcgaagcaaggccacataaaactacacaaggcatatatgactggagacaaatcaaaatttgtctctctaagggcaaaacaaaatggtttggttacctatggtgacaacaacaaagggaggactctaggttatggtaatgtaggaaattttgaaagttctagcaatcttgagggaactagaccattgataatggagaagcaaaatgttgatacaagtcaacaatctacaatggagctacccaaggaatggagaacctctagggacttatcacttgacaacataataggtgatataaacaaagggatatgtggcttttgtatctcgaacacctcttttctcgccttcacgatgcattcaccactatttcccgcattcttcacaatgatgatggcgcaagtttggttctattttgggatctctcatcttcacaacaatgtttctcgccagctttgctgccaacgtgtggttcaagtacacaaaagtgtcttttttgtcattgttgctttgcatcttcacactgtggaacttccacccaacattgtaacctcttctgtagatctcggagtttga

SEQ ID NO: 3339 - DNA, 558 bp, Glycine max
  Peptide Sequence Number=SeqID_120117
atgtgtcataccaaatctctacatgtttatcgtcagctagcaccgaggccctgctccgattgttacttatgtggactgagtagaggcgttgtaattttaacacttgatgaccaaaagcaaccttgtggtttgaaagcacgtgttggaccaaagaggtggttggacaatgctatttggagcttgtccagtcacactataagaggaatgcctaattctcttagttatttgttagatgaaaaaaacgcatctagtttatggctcaagttgaagaaactcttcatgacaaaatccatctataacaagttgatgttaaaacgacgtctctttggtctccgaatgattaaaggtatgcctctaaaggagcacttgcacgagttaaactctatccttatggagcttcattacattgatgtcaagataaaagataaagatcttgcaatgattttgttagcttgtctccctccttcatatgataattttgtgagttctctaagtgttggaaaagactccatcacacttgaagaagtcaagtccaatctctattcaagagagctttga

SEQ ID NO: 3340 - DNA, 303 bp, Glycine max
  Peptide Sequence Number=SeqID_120118
atggtggagagtgaagaagcagaggagatgagaacaagagtcaaagacattgcagagaaagctagaagagctgtggaaaaagaaacagactcacaaatagccattacattgctcactactggatgtcctacttaccatccatgctttagtttaactcaagagatactgaagttcctggagcttggaggtagcatttcatggcatcatgccttaagagaaggaaatcaagtggctgattgtttggctaagtttggtttgtcctatctgacaagactcaagaagatcgtgaatagtccaatatga

SEQ ID NO: 3341 - DNA, 1014 bp, Glycine max
  Peptide Sequence Number=SeqID_120119
atgaacagcctaaagacaactactgatgatgtagttactgataccgagagttttctaggcgagtcccatgatacatcagttttgatggactatgttcatcatgtggcaatgacagtttggaatggaaagttgtcctcccatggaaggaaggccgagaaatttggcaggcctgctgtagagattgaaagcttagtggctgccacaggattaagtcctttgatcacatgttccttggacactggtgatcggggacttatatatacttttgtggagaggtggcataaggaaactagtagttttcatctttcggtaggagatgtgactatcaccctagatgatgtggcatcgttgctacatttgcccattatagttcagaagaagcaagagctgagacagaacaatgtcatggggcatatgtttggctatcctggttgtgagacatttatcgtagcaaatcattttccttctattgcttcttttattgctgctaaagattatgatgagaggaaaccacatgcttgctattggaagtctgggaaggcgttgccagtgtcggcgtatcataagcgtttggatagattgacgtctgatgttatcattcctccacaccctgctattccatctctatgtatagaagatattgatgatagatggattcagttttctgaataccttccaccgtcccgcacagctagggatcctcctagacatccactcgtggtgcatgatgacacatttgttgaaccaattcttcatcagcagccggtggccacaatagctatggacgaagcaccaatagatgcacttgctgatgtagagcagcctcgacatgcactggaggcttgccaaacaatagcagaaaggttggaacggttgatcaacctaaaggttgtcattgaaggaacagaggcatacactgtcaccaaagagtgtctaaggatcacaaaaggtgtgattgcggaatggaatgtatatgttcgatcgagacgaaggcggcgtatggaagacgcatga

SEQ ID NO: 3342 - DNA, 378 bp, Glycine max
  Peptide Sequence Number=SeqID_120120
atgaagctttgcttctacacctctagtgaaagtgaagaaaagaaaggggaagaatctaatgaagaaatctacccccaagaagaaggacaacctttaatggttaaggaggagtgtaaggaggtaagtgtctcctccaagaggttagctaagaaggaaagccattttgaaataaagacaaatattaaagaagtttcccctcttagacaacctccacatcttctcctttgtaaaaagacacttgttagcattgccacacctcttaggcttaaggttattcctcaagtaaaggagttattggataagggtttagttcgtaagatcttaaatccttgtgctttgttggtgtccaaaataggaataatcaacatgaaaatatag

SEQ ID NO: 3343 - DNA, 258 bp, Glycine max
  Peptide Sequence Number=SeqID_120121
atgactcaattcaaagtcagattcaagtttaatataaacttttggtttcctatgatacattccaaacttaataagagaaagagaaatataaacctgctctactcaatggtggtctttctttgcaaggaagaatatggtgtgctcttgggcaatgactgggctgcaactcatgaatttggccacaacttttgtatctcaaatgaaggtgacgatgacgatgatgataatggcgtcattgatgtggccccagcggcatag

SEQ ID NO: 3344 - DNA, 396 bp, Glycine max
  Peptide Sequence Number=SeqID_120122
atggtgtgttttggtgggaaatttggatctgagtgttttggcctttccctttttctgtttttgtttagcgtgggacgagaaagtcgtcagcacacaggatttgagttggcaatcaaagggaaaggaccacttcaagtcgtggtttcctttctttccttatttggttgtgaatattccgtattgtttggatatttgtctgatccgaagacccttctctcaacaatgagtgacccttctttcttaggagaccccaccgttccttcttctgaaggcaaggatagaaattctcatcctgggtcaaggtttatggtgagttgggattttggctcaaggcatgtagaacggccggacatgatgtatgccaaggtgttggtttggccagtggttcagggataa

SEQ ID NO: 3345 - DNA, 1257 bp, Glycine max
  Peptide Sequence Number=SeqID_120123
atggggggtgaacttatcaagataggggtgaggaagcaactcggcggcaagctcctccacgttttgttgaaaaatggtttctggggattccggggattctatggcttccgtaaaatttctgaaaaccttggaaatcttcctcaagaagcctctgggcagcaagcacctccctttttccctataaataggggaaaggagggtcgaagtccttccgtaacgctttcgaggcgtttccgtgagcaaatctgtgaagattttcctccgttcttcaccgttcttcatcctttcttcgttcttcaaccgggttggctggacacgctttttggagaagtcattattgaatctttggagacctcgacaagggaagaggagctaagacaggcagttgctagtgatcaagtacctgatgaagtgaggcttgaagctgtcaaacctgcatatgaaaaagagctacagaaggcaaagtttgataccagatctgtcattaaagtgtcattgcaagggtctgatgttgctactaattcaaactttattaaaacagaccctggagttgcacctttgcactctcatccagtcgcaattgatgatgaacttgttgctaatgctctgctttctcaacctatgccagaagtagacatctcaagactggaaagcatctatggagctactgagtctgtgtcctttgatacaataaagactaaacctaagctagtgcctgtttcaaacggaaacgttagactttaccatggcttcaggggatacaaattgtctgaagggaaaacaagcaaccaatcatggagagagaagatggatataggcacccaatgcttaaacccagagatgcaaaagattgagcttcaaaagttaaatctagttaaactatggaaaggtgtgcaagggattgatcatttctcttattcatctattgagacccatagagaagaaaagttccatgctctatccaattacattggaagagcaagtcatataagggaatttacctctcctccaaacctcctcaacaacatcatcttcgaacacacaccatttgagaggaaggtctaccctccaagtgctatagtctggagaagaagggagggcaaggcaagcttccttcagatgactacaatgactaaatgtgcatctacctttcatgcaaacttctacaaggacaaggagaatatgattgaagatgatgaagatgcacccccaacatgctatgttaaagcaagaccaaacaggctcttcaaacattaa

SEQ ID NO: 3346 - DNA, 327 bp, Glycine max
  Peptide Sequence Number=SeqID_120124
atggctgaagacatttttgtcttcaaaatgcgtgcagattaccgtataggggtgcagatgaccacattggtctctgcgtgtcatcgggctcgcttgtctctggctgatgaaagcgaaattgagacttttttgcggtcttggccggaagacttcgacaacttcgggaagggtatctccgcatgctactggacccttaagtctgacggtagaaatgacactttttcacggtctcggccagaagacgctgacatcttcgggaaagacgctgacatatccgggaaaggtgcagatgacgacgttagtcactgcatgctaccggacccttga

SEQ ID NO: 3347 - DNA, 1452 bp, Glycine max
  Peptide Sequence Number=SeqID_120125
atgggaagcagaatgagccttttgatgttgttccttgttctttgccatggcgtggcattaacaatgggtttgtggaggacagaggtggaagagagagaagagggacatccaaggccagacaaattgttcatgatgctgaaatccaagcgcgtggcccaaaccgacgctggggagatgcgagtgttggaaagctatggtggtaggattttggagaggcgcttgaacattggtttcatcaacatggaaccaaggtccctcttcattcctcagtacatcgactccactttgatcatattcctgcgttcaggggaagcaaagttgggattcatatataaagacaaactggcggaaaggcatttgaagatgggagatgtatatcaaattccagctggttctgcattctatctagtgaacatagaggaggctcagaagcttcacattatctgcagcattgacccctctgagagcttgggaatcgatattttccagtccttctatcttggaggaggagcccatccagcctcagtactttctggattcgagcctcaaatccttgaaactgcttttaacgcatcaggagaagagttgcgaaaaatgttcactaggcaacacgagggtccaattgtgcatgtgggggattcacatgccacaagcatatggaccaagttccttcaacttaaggaggaagacaaactgcagcacctgagggagatggtgcaacaagaacaagaagaagaggaggaggaatttgttgctgaagaagagaaacaaacaagttggtcgtggaggaagctcttggaatctgtatttggggatgagatcaagaacacaagagagaaggttacaaaaaaatcccctcactcttgcaacctctatgacagaaagccagatttcaaaaacagttatggttggagcgttgctctagacggctctgagtattctccactcaaaagttctggcgttggcatttatcatgtcaatctctcagcgggatcaatgatggcaccccatgtgaatccaagggcaacagagtatggaatagtgctaaaaggatcaggcagaatccaaatagtgtttccaaacggaagcaacgcaatggacgcccacatcaaagaaggggacgtgttcttcattccaaggtactttgccttctgccaaatagcatcaaggggtgaaccacttgagttctttggcttcaccacctcggctcaaaagaacaggccacaatttctggttggtgccacgtcactcatgaggaccatggtggggcccgagcttgcggctgcatttggtgtgagcgaggagaccatgaatcgcgtggctagggcacaacatgaagctgtgattctaccaactccatgggctgcacatgcacatgatcacaaggtcaaggaggaagtggtggtggatatttttcaaaagcttgcaaggaatgagattatgggcttttga

SEQ ID NO: 3348 - DNA, 246 bp, Glycine max
  Peptide Sequence Number=SeqID_120126
atgtggggagtcgagttgaatcttttgctctcattcacaaagattttctataaggacataaggccaaccaacaaaaaacccatcattagccttgtcaagagtgtcttgagtcttttccattattatctctgttatctgaatcatgggtattccattcgttcatcgtcaagccacatgaattacagccagctctctttcactttcacatacaccacaagctcacgaatccatcaatcttctaattaa

SEQ ID NO: 3349 - DNA, 825 bp, Glycine max
  Peptide Sequence Number=SeqID_120127
atggagagtgacacaaacaccacattttctcactcctcaaatactaccccttcttcccctccccaacaagttcaagttgtcatgatcccttgtgctgcttgcaagattctgaggcgaagatgtgctgagaaatgtgtcttggcaccttatttccctcccactgaacctgccaagtttaccactgcacaccgagtcttcggtgccagcaacatcatcaagttcttgcagtcaatgatgatttcagacacaaacagtgatgtggtaacaaacgttgcgctattgagtggtaaaaataactgttccacccgtcagaagacctcaccaacatccttctatatatgcatattgttccgtgtccccggggacaaattaatagatgataagactagtctccaacgtatggagtacctaattttacacgatcccatcaaacttcaacagagacgacaaattaatgaacttccagagtctcaaagagctgatgcagtggccagcatggtttatgaggctggtgcaagaataagagacccagtgtacggatgtgcaggtgcaatttgccacctccaaaagcaagtcaatgaacttcaagcacagttagcaaaggcacaagctgaggttgtaaacatgcaattccaacaagcgaatctcgtggctctaatttgcatggaaatggcacaaacacaaactccacaggaatcaccacaacaatctgtggacaacttcatttcaagcccttcacacagcagcggctatcaaaacaatctcaatttctttgaggagaacaccaataacctaaactctttgtgggagcctctttggacatga

SEQ ID NO: 3350 - DNA, 285 bp, Glycine max
  Peptide Sequence Number=SeqID_120128
atgacggaactgaaatggtataatcacattctgtcaagtgtgtgcgcactcgcatgtgcggcatggtctacgcgcggaacttcttgttgccttatgctggtgccaagtggccaaggtttcgacataacagttgggaaaaacggtttgtttcaaaaaactatatgtatgcatgtctgtgtgatctgcatgtttgcgcaagatctaataggtggggcaaggttggtggagctcgttgaacacacaggaaaagataaacttgttataatcaaagtcttttgccattaa

SEQ ID NO: 3351 - DNA, 201 bp, Glycine max
  Peptide Sequence Number=SeqID_120129
atggttttgtatattgactgggctattgctgcttaccgtgagattgcacaagttgctagatttgggagtggcggaagaattgctttgggatgctttcatttgttgagtaaagtgtccagattagatatcatgcagttgatgctgatgctgcttagccatttcatttataaggctttcactttcatcaacccttataattga

SEQ ID NO: 3352 - DNA, 825 bp, Glycine max
  Peptide Sequence Number=SeqID_120130
atggttaagggcaagaatgggatccacttagaccatacgaaacttgtagatgttgcaataggtgtgggaagcatggtgataaagttagtggctgtaggatatagggaagaaagggaaaatgaaataggagagaatcatttttgggtggctgttgctgcagggcagagaagttttccatctctgatttgtttgctttcattgtcagttgctatacagtggagtggattcattaaacgctcatatgataaaggcaaaacttggacagaaagagaacagcttccttctggtatattaggacctataaaaaataagttgaaagctggaactcctgcctggggtgcgtgggtggaggtaacaacagattttggtaggtcatggagcaagcatggcccaatttacattgaaaatgaacctctgagtgtgattcaaccggtaccttatcagactgcagatgggaagctgcgcgtcttattacgatcctttgatggcattggtagagtatgtatgtcagaatcatctgatggtggcaagacttggggatatgcaaaacctactcagctccccaacccaaattcaggtattgatggggttaagcttagagatggccagttattgcttgcttataatactgtatcaaggagtgtgcttaaagtggcactctctaaggatgatggcgattcctggtgcgaggttctcacattggaggatacatcgggaatggaattctcatatcctgctgtaatccaggatagtgatgggcgaatacatatcacctatacatataataggacacaaattaagcatgtcgttcttcggccaagttga

SEQ ID NO: 3353 - DNA, 918 bp, Glycine max
  Peptide Sequence Number=SeqID_120131
atgcatgagaagaagtgggttatcggaactgaagtgatgcgcggcaacatttgggaaacacaatggttgacagtgagcataaccgtaacagtcaccgccatttccatctctgcatacgtattaaagagaaaatggaatcatctgaactcgaaaatcgaggagctggaagcatctctcaagtcttgctccgacaaatgcgcctccgaaaggcaaggccgaattagggctcaactggccttgagaaaacaagtaacacagtcgcaacctaaatctcaaaacctaaacctcacttcttatcccatgataccaattggtgtcgtccactcatgcttctccaccaggaacgggaccccgaggcaaccgttactcgtcccacttgctagggcctgtttggttttcaacacaacgcgcgttccgccggcgtctctggagggtttagcggagtattctcattgctggattctctatgtgtttcatttaaatacggatctcgagaagctctggaagcatccgtctaaatcagggttcaaggccaaggtgagggttccgagactgaagggtggaagaaagggattgtttgccacacgatcgccacatcgtccatgccccattggactcacagttgcaaagttcaactcaacccctccccccaagtatggattcagtgtggtagaggctgtactgggaaatatgattttgctctctggcgtggatctggttgatggaactcccgtgctcgatatcaagccttacctaccatattgtgacagcatccaagaagctgcagtgccaaattggttgatggaggataacttgctttctgtagcttctattagcttttcggatcactttacttcagcactcgaagattgctggataatggcgaatggatgcaccccatcagtcctcactgtataa

SEQ ID NO: 3354 - DNA, 1209 bp, Glycine max
  Peptide Sequence Number=SeqID_120132
atgtctttgttccttacctctgtacatttggtgttcatactctctagtatcattcagagagcttactccttctctgggccaaactctacaaattcaggtgccgatagcttaggcaataaaaacagcagctacgtaaaagggcctgttgtggaggaattcacttttcctgaaagatcaactcccttcaacagctgtcatgcttctaccattgttgaggttgttgggaagggtcattttttggttgcctatttcggtggctcatctgagggggcaccagatgtaaaaatatggttgcagacttataagagtggcagatggaaatcacctataattgctgatgaagagccaaatgttcctatgtggaaccctgtactgttcaaacttccatccaatgagttactgctgttctacaaaataggcctagatgttcaaaagtggagtggattcatgaaacgctcatatgataaaggaattacttggacagaaagagaacaacttccttctggtatattaggacctatcaagaataagcctctcttgctggaaaatggtgacttactatgtggatcttctgttgaaagctggaactcctggggagcatgggcagaggttacgacagattttggcggggcatggagaaagtatggcccgatttacattgagaataagccccatggtgtgattcagccagtaccataccagactgcaaaggggacactgcgtgttttgcttagatccttcaccggcctcggaaggatttacatgtcagaatcctttgatggtggcaaaagttgggggtatgcaaagcctacacaactccccaacccaaactcaggtattgatggggttaaactgaaagatggccgtctattgcttgcttataatacaatttcaaggggtgtgcttaaacttgccctctctgaggatgatggtgattcctggcatgaggcacttacattggaggatacattgggaatggaattctcatatcctgctgttattcaagcaagtgatgggcgagtacatgtcacttatacatataaaaggacacaaattaagcccatgagactattgtgtctttttcaacatgtcagaaagattcccacaaaatttcctgcactcctactattgcttcatgcttcatgctgcacctcaattcggaatgcaatggggtgcactaggaagcaattgtgggagtacaaaaagtaa

SEQ ID NO: 3355 - DNA, 435 bp, Glycine max
  Peptide Sequence Number=SeqID_120133
atgaatgttgagcagtttcaattacaccaatcagaaagattaacaaatcatcaattaggtggctctacctccgagaagatttctgaatcacattctaagtataatccaatggtagtcagttcagctgctgatgaaaccatgctgttgcaaagaaaggatggcaagattacagctggtactacgaatgctaaaggtaaagggtcaactccaactattgcaagtgataagctggggaaggctgttgatgctggtgctcatttgtcaaaccaaccccgagtttcccatttaatggagtccatcgagaaagattatgtctttgtcaattcccatttcgcatcattggaggctttctctgactactttgaagcatctgtgcaagatagttcctcgcacaggatttctctgtttccttcaaagaggactaatatggagtaa

SEQ ID NO: 3356 - DNA, 3111 bp, Glycine max
  Peptide Sequence Number=SeqID_120134
atgagagccggactaagcaccatccagcaaaccctaacgccggaggcggccagtgttctcaaccactctatcgcggaggccggccggagaaaccacggccaaaccacgccgctccacgtggcggcgacgctcctcgcctctccctcgggcttccttcgccaagcctgcataaaatcgcaccccaattcctcccacccccttcagtgcagagccttggagctatgcttcagcgtggcgctggagcgattgcctacttcgcagaacacgagctcttccatggagccgccaatctccaatgccttgatggctgccctgaagcgggcccaggcccaccagcgccgcggctaccctgagcaacagcagcagccactcctcgcggtgaaagtggagctggaacagctaatcatatccattctcgacgaccccagcgtgagcagggtcatgagagaagccagtttctcaagccccgccgtcaaagccaccatcgaacagtccctcaacgccgtcccctccaccgttaattccggattgggattccggccaagcgcggtggctccggtgaattccgccccggggcggaatttgtatctgaacccgcgcctgcaacaacagcagcagcaggggagtactgcacaacacaggggcgacgaagttaaacgaattttggatattttgctgaggacgaagaagaggaacccgatcttggtgggggaatcggagcctgaggcggcgatcaaggaggtgataaagaagattgagaacaaggaattgggagaaggggctttcgcgaatgctcacgtgattcatctggaaaaggagcttccgagtgataaggcgcagatacctgcgaggttgaaggagttgggggatttgattgagaccaggatcgggaattctgggtgtggaggggttttcgttgacttgggtgacttgaagtggctggtggagcagcctgtggggtttgggattggcggtggtttgggtaacatgcagcaactgaccctcgccgaggctggcagggcggcggtggctgagatggggaggttggtcagcaagttcggcgagggtggcgctggaaggctttggttgttaggtactgctacttgtgagacttatttgaggtgtcaggtttatcatcctaccatggaaaatgattgggatcttcaggcagtgccaattaccaccagagcatccctccctggaatctttcccaggcttgggaccaatggttttcttggtacttcgctcgagtctttgtccccgttaaagaccttgtccactacaacaatccctccactgaggcgtgcctctgagaacgtagatcctgctgcagtatcaatttgttgcccacaatgtatgcagagctgcgagcaagaagtggcagaaatgttgaaagaaactgagaaatcagatactgagctcaaatcagaggcagctaaaccgtcccttccacagtggttacagaatgctaaaactaataaagataacggcaaagtaatggatcaggctcagaaccaagaagtgaatgtgaagaagaggactcaagaaatacagaagaaatggcatgattcctgtttgagtttacatcctaaatttcatcagctaaatgtgagcacagagagacttgttccaacttctttgtcaatgactggcctatacaatatgaatttgctggggcgccaattccaacccaaaataccactgaataaaaatcttggaacctctttgcaattgagctcaaatccaacgccaatccacccatcagagcatgtggtcagcccacagcaaattccggtaacaaccgacctggtccttgggcaaacaaagccagctgatgccactccagaagaaacacacaaagaaggcattaatgacttcttgagctgcctctcttccgagtcacaagacaagttcgatgaattacagagcaaaaagctacttgatgcagactctttcaagaagctcctgaaaggcctgacagaaaaggtatggtggcagcaggatgcagcatccgcagtggccaccacagtgacccagtgcaaactcggcaatggaaaaagacgctccaagggtgacacatggttactgttcgtgggtcctgatagaattggcaagaagaaaatggcagcagctctttctgagctggtatctgggtccaccaacccaataataatacctctggcgcaacgccgtgcggatggagactctgatgcccctcatctgcgtggaaaaacagcacttgatcgaatagcagaggccatcagaaggaacccactttctgtcatcgtgcttgaggacattgatgaagccaacattcttcttcgtgggagcataagaagagccatggaacaaggccggttcccggattctcatggccgtgaaatcagtctcggaaatgtcatgtttatcctcactgctaattggttgccagaagacttcaggtgcctctcaaacgggtctccactggacgaagaaaagcttgaaaatttagcaaaaggagggtggcagttacgcatatcagtgggtaagagagcatcaaaacgaagacccagttggctatccgatgaagacaggtccttgaagccccgtaaagaggtgaattcaggtctatcgtttgatcttaatgaagctgctgatgatgcagaggacggcaggggagatggttccctcaattcaagcgacttcacagtggaacatgaagacaacaatcatgatgtaggagggtcactctcagcagtaccgcgggagctgttggattctgtagacgatgccattgtcttcaagcccttgaatttcgatctcctacgccggaatttctcgtcatccatcattaagaggttctctgctgtggttgggaatggggtgtcaattgaagtgcagggagaggctcttgacaagatcaccagcggagtgtggttaggccaaaccaccattgatgaatggatggacaaagcgttggttcccagtttccaccaactgaaaaagaatttgaattcaaccacacatgaccataactcttcgatgctgtttaggctcgaagatgatggctactccgatcgctggggctcccaagagtggttacctgctactgtgagagtggtgggggaatag

SEQ ID NO: 3357 - DNA, 147 bp, Glycine max
  Peptide Sequence Number=SeqID_120135
atgaagccgaggctctaccaaatcgcaattgtgatcaacctctacatcattccccatttggtgttcttcgtgctaccatcgcacacaaacttccagactaaagagctacgtaggtctgaattcctcatcacacctgaggatacgtag

SEQ ID NO: 3358 - DNA, 216 bp, Glycine max
  Peptide Sequence Number=SeqID_120136
atgacggtgatggaagtggtaatattggtgatgtcggtggtgatggtgacgcaccgtgataatgattgtagtggcgatgacaaatgtggtattgatggtagtgacaatgatggtgatagttactgtgtaaatggtggtggtgatgaaagaggtgatattagtagtgatgacggtaatagtgacattgatggtagtgatgatagcggtgttttttaa

SEQ ID NO: 3359 - DNA, 165 bp, Glycine max
  Peptide Sequence Number=SeqID_120137
atgaatgatttggtggataaaggcatcgtcattgtgccagccgacgaggtggagagccttgccaggcgtggagatgggacagtggtcaatgtgtttgattgcggtggtcgactaaccaggaaagggattgtggacaaaggaattttggtaataatcttgatgtga

SEQ ID NO: 3360 - DNA, 673 bp, Glycine max
  Peptide Sequence Number=SeqID_120138
atggctaagtgtttctcatcccttctctcttggtttctgatttttttgtttgtgctgctacacacacaaacggggtatggttcaaatgcaacatcaaagtcggaagcgatcatcaacttgagagtaggggtacccctgaaaaatggtttcccccaatttgtgaatgtagtttgggactctcatgaaaagaagtacaacgtatctggatattgcatagacgttttctatgccgttgtaaacattttacctttcaaggtttctctagatattcaaccttttgaggttgaatcacgtgacaattctggagctggatcatacgattcacttctccaacaaatcccagcaaagtacgatgttgtggtaggggatataacaatcctggccaaccgttcaaacatggtagatttcacactgccatatacaggatctggatttaaaatgctagtaacagttcaacatgggaggcaacaaaccatgtggatttttgtgaaacccttcagctgggatctttggttgagcatagtcatcatctctaccttcataggggtctccatactcgtcatggaaagaaatgtaaatgctcctactgatcaggagggtttgccaaatcgaaaaaagcttagccctgcgacaatcttatggtttccaatttcacaagcaattcttcctgaaa

SEQ ID NO: 3361 - DNA, 240 bp, Glycine max
  Peptide Sequence Number=SeqID_120139
atggcgagcaccaaagttcagagggttatgactcagcccattaaagcacgcattcagatttggctatttgagcaaaaggatttgaggattgaaggccgaatcattggttttgatgaatacatgaatttggttcttgatgatgctgaagaagtgaacatcaagaagaagagcagaaaaacattagggaggatccttcttaaaggagataacataactttaatgatgaacacggggaaatga

SEQ ID NO: 3362 - DNA, 247 bp, Glycine max
  Peptide Sequence Number=SeqID_120140
atgaggtctttcaacaaactcatttacaaaaggatactggtcaatttgtcgatgctagatctagacaaacacatgaagaatttgaggctagactatctgaagttgtttgatgctgcatcaggcgttggtgaatcacaactcactcctttagaccctcctgaagaacaaagacttaggagtcgatgttgggttgcaactgcgggaccaaagcgtaaaggacgcctttatggtactggagaccttgctt

SEQ ID NO: 3363 - DNA, 447 bp, Glycine max
  Peptide Sequence Number=SeqID_120141
atggccggaacaaattttgaggggctctgtgggggcagtaacagcgagcttaagctccgaagagaggaaatggaccaatcgcgagtagacggtttgattctgaaggatgaattgaggaccgaaacaaacatgttagccatcatcggcaagtaccaagaagaattaaatctagccacgacccacgagcacaaagtggcggacgaatacgcccgagtgtacgcggaaaaggagactagaggaagggtgattgactcgttacatcaagaagcaatgatgtggatggaccagtttgctcttactttaaacaagagtcaagaacttcaccgattactagcaaaggccaaagctatggcaaacacctactccgcccccaaggagatccacaggctcctccgctattgtcaacacatgatagacttgatgacccatataattaggagtcattag

SEQ ID NO: 3364 - DNA, 138 bp, Glycine max
  Peptide Sequence Number=SeqID_120142
atggagtttgctgaactagaaaatcttgaagaggcaatgcttcagtttgccattgaagcatccttgagacatggaatgaggcaaaggtgccaactttgtggggatttttttgttgaccatgatattagtatgaagtag

SEQ ID NO: 3365 - DNA, 339 bp, Glycine max
  Peptide Sequence Number=SeqID_120143
atgcagatacaaactcttccacttccatgctctcctccgaaaccaatcaccaccatttcaccaccgccgccgtcgaaattagcacggaggagccactcaatggcgccggaaaagatagagattttcaagtcactagagggatgggcctcgcagcagcccctcagcttcctccccaaacactgcaagagagatctagaggcaacaaatcttcttgatggagctttagaggtgacagatctgttcatagatctctctggtgttcctgctcgtgtttgttgccataattggaaccagcacggcctcgaagacgacaatctcgtagggcttttaccagaatag

SEQ ID NO: 3366 - DNA, 201 bp, Glycine max
  Peptide Sequence Number=SeqID_120144
atggatgacattcgtgagaatgtctctgtgttgacactgcttgctgaggtcttgtgcttgctggatatgattaatgtaatttccatcaacatgtttctaatcaatttgaacctttataggctgacaaagccattgcagaaattgaggcaaagtgtggccaaaaaattgaagaatgcaaagaagaacaaaggtagcagttga

SEQ ID NO: 3367 - DNA, 285 bp, Glycine max
  Peptide Sequence Number=SeqID_120145
atggagctaccggacgagtactttgtggtgctggtgggagacatgattacggaggaagcgcttcctacttaccagaccacgatgaacaacctcgatggggtgagagatgagtacggagcatgccaaagcccgtgggccgtgtggacccgggcctggtccgtggaagaaaacaggcacggggatttgctcaaaacctatatgtatctttctggccgtgttgatatggagagggtcgagaagactattcattacctcattgcttcaggctgggtgagcactgagtag

SEQ ID NO: 3368 - DNA, 363 bp, Glycine max
  Peptide Sequence Number=SeqID_120146
atgggggagacacatgaagtaccccgagactgcactctagctaacttcgagcctcaccttggatatgccattaagggtcaggcattttgtggcatacccatgccaaacacttcggggggccctcagtatcacccacaaccacaacccttgcattttgcattggaaagactgcctcctaccatgttggaaagggagaaatttgatcatatagaggaaaggctgagggctattgaaggaggggaaaattatgtctttgctgacatggcagagttgtgcctagtacccgacgtggtcgttcctccaaagttcaaggtaccagattttgataagtacaaggggactacttgccccaaaatcacctaa

SEQ ID NO: 3369 - DNA, 306 bp, Glycine max
  Peptide Sequence Number=SeqID_120147
atgatcattttcatatgtaacaccctctatgacgacggtggtagtcatgtttgtggcgatgacactggtggcatcagtgatcatattggtggcgacgatgatagttatggcgacgatcacgacgatggtgatagtggttgtcatgttggtggtgatgacagtgatcatgacggttattatgaccatggtagtagagacaacaacaacaacggtcatgttggtggtgacgacgatgattgtgacggcaatcatggtggtggtgatggtggtgattgtgattgtggtgacgattttgacataaattaa

SEQ ID NO: 3370 - DNA, 804 bp, Glycine max
  Peptide Sequence Number=SeqID_120148
atggaacaggagtacgatgttgtggtaggggatgtaacaattcttgccaaccgttcgaatttcgtagacttcacgctgccatatacaggttcgggagttaaaatgttggtaccagctcaacatgggaggaaacaaaccatgtggatttttgtgaaacccttcagcttggatctttggttgagcatagtcatcatctctaccttcataggggtctccatactcatcatggaaagaaatgtagatgcacttcctcatcatgaggattctccaaatcgaacaaagcttagccctgcaaccatcttatggtttccaatttcccaagccattcttcccgaaagacaagtagtcgtcaagaactgctcgagatttgtgttgatggtatggcttctattggcgttcgtgctcatgcaaagttacactgcaaacttgacttctatattgaccttggaacagttaagacccagttttccgggaaaaggggattattatgttggatatcaaactggatctttcgttaaagatgtgttggttaagcaatttaactttctcccatccaagctgaggccatatagcaacagtgctgagtattataatgctttaaaatctggaagtcaaggtggtggtgttgcagctatattcgatgatgtgccttaccttaaagtatttcttcaagaatacggatccaaatcctcttacatcttggctggccagacatttagagatgatggctttggttttgtaagtgcctcctctctatttctcattcttgaacaatccacggtagcctttgcctttggtgtgtaa

SEQ ID NO: 3371 - DNA, 171 bp, Glycine max
  Peptide Sequence Number=SeqID_120149
atgggatcttcgttagcgatgggatgttcatttcggtttgatgtttgtgtttgtggttgttgtgaaggtggcgtaaagagggatgaaggatggttttgttggtcaaaggaggcgatagttgtagttgtggacatgagggttgtggagacaatggttgtggttaaggaataa

SEQ ID NO: 3372 - DNA, 117 bp, Glycine max
  Peptide Sequence Number=SeqID_120150
atggtggtgcttgtgggatatgagtggaaatactatgaggtgggagggataagtggcaaagttagctacggaacaatgtacacatgtgagcgaacagtgtgcaaccccacacattaa

SEQ ID NO: 3373 - DNA, 141 bp, Glycine max
  Peptide Sequence Number=SeqID_120151
gcattccctttaaactccaatctcacggcttacttttcgagagccatcttgaaggtgactgaaagtgatttaatgaaagaaattgaggaaaaatactttgggaagaatgatgtgttagaacaaatctcttttaacctgtga

SEQ ID NO: 3374 - DNA, 423 bp, Glycine max
  Peptide Sequence Number=SeqID_120152
atgaaaatatctgcctatatgtttgatgcgaaatatattggggataatgagatagatctggggcacatgaagctaaactacgcgttcattgaagattatttgacagttgtcgagaaggacgattttgttaaaaaatatccggaatttgaagagaaacgaatacttcgtgacggaagagaattttatattgctaataatctttccaaattagtatttgataatggaacaatagatcccaattcgtgtattactaatggggcaccgctattgaaaaagaagacatccaaaaactactttctaaaagtggagtttatacttgaccagagtaatcagatttcaaatattgtcgtttcagacattgaggaggatgacattaggcagcaagttatacaatcgataaagcgttgcgggcaagttttataa

SEQ ID NO: 3375 - DNA, 409 bp, Glycine max
  Peptide Sequence Number=SeqID_120153
gctcagggccattaaaggaggtgaagattatgcctttgctaacctagaagagttattcctagtacccaatatcatcacccctcccaagttcaaggtgttggactttgacaagtacaaggggactacttgccccgtgaaccatctaaagatgtattgtcggaagatgggagcatacgcaaaagatgagaaattgctgatgcattccttccaaggaagtcttactgggggcagtgtcagtataatggctttggataggatgcaattactgaacatatgcaaaaagggggcacggacctttcaaagaatacgcccaaaggtggagggatctggcagcccaagtggcacccccaatgatggaaagggagatgataatcgtaatggtagacacattaccagtattctactatga

SEQ ID NO: 3376 - DNA, 381 bp, Glycine max
  Peptide Sequence Number=SeqID_120154
atgttgtttgggtcgtgtttgggggatttggatggaggtggcgagcgtggagttgtgcatgatgatgtggtggtggctaggtcgctgttgttgtgtgcgcacagaggtggatctgggtggtcatggtgcgcacgcgcgatgactgggcttggacgcgagttgctgcatctctatcacaccaccttcctcgacacagttgattccacttgtgttgttgataatcttgttgatgattttgttgttgttatcattgggttgggtcgtggtggtcgacgacaatggtgcattggaatggttggcggtggtggcaaggtggtggttgtttccattggagaaagggaagaaggcaaaaaagggaagaaagtgatgatgtggcactga

SEQ ID NO: 3377 - DNA, 1137 bp, Glycine max
  Peptide Sequence Number=SeqID_120155
atgcagatacaaaccctcccacttgcatccccggctccaagaatcacccggcaccactttccgcggccaccgaaatgcgcagttaccgccacaccgccgccattgaaggagaggagaaaccactcaatgccgccggaaaagatagagattttcaagtccctggagggatgggcctcacagcgggtcttaccgctgctgaagcccgtggagcaatgctggcagccccagaagttcctccctgactcgaccctacccttcgatgagttcatcgaagcggtgaggtcgcttcgccaccgcaccaaggagctatctgacgagtacttcttagtgctggtgggtgacatggtcacggaagaagcgcttcccacttaccagaccataatgagtggcctggatggggtgggagacaagtgcggatcaaacccaagcccgtgggccgtgtggacccgggcctggtccgcggaggaaaacagacacggggatttgctcagaacttatttgtatctttctggtcgtgttgacatgaagatgatcgagaggactatccacaacctcatagcagctggcatggaccctggtttcgagaacaacccgtatttggggtttgtgtatacttcattccaagagcgagcgacgttcgtgtcccacggcaacacagctcggcttgcgaaggagggtggtgatccagtgctggcgtgcatatgcgggaccatcgcagcggacgagaagcggcacgagaatgcgtactcaagaatcgtcgagaagcttctagaagtggatcccaccggggcaatgttggccataggaaccacgatggagaagaagatcacgatgccggcgcaccttatgtacgatggggaggaccccaggctattcgagcactactccacggtggcgcagcgaatgggcgtttacacggccaaagactacgcggacatcttggagtttctgatcggacggtggagattggagaagctggaaggtttgacggctgagggaaagagggcgcaggattttgtgtgtgggttagcaccgaggattaggaagttgcaagagcgtgctgatgagcgagcgcgtaagatgaagcctcatggagttaagtttagctggatcttcaataaagagctgcatttgtga

SEQ ID NO: 3378 - DNA, 213 bp, Glycine max
  Peptide Sequence Number=SeqID_120156
atgccaagcacctcacaaggaccaaagaaaggtcgcatgtcatcaagcaaaggtccccggacgaaattagggtactcttccttcttcagatactcttccttcttcctagcagctagtgcctcaatcatcttcttgttgcaggaactgctacaatcttctttgcagcttacaagtccacctctttttcaagcattgttgtcctatgtagaatag

SEQ ID NO: 3379 - DNA, 336 bp, Glycine max
  Peptide Sequence Number=SeqID_120157
atgcaacagggacaggcagatattctcatagctaggttccctgaccctaactatggtgtcagaacgataacatttacaaagtctctttttctagggtttttcaaaggaagcgcaaaacatataatggtggttccaaagtcagaaaagatgcaaagacaagctgaaactaacaaggagcaagaatataatcacggttacctcaaggaaaaccacgaaggtcagactgggacttcgttctcaactgaaaccgcaaggcaagtttggaagattccgcttcggttgaagggttcctctcggtgtggggtttcaacggagaacaacggtggttcatggtga

SEQ ID NO: 3380 - DNA, 432 bp, Glycine max
  Peptide Sequence Number=SeqID_120158
atggatcgaagttggatgaaatcatcatgcattagtgatgagtatcaaaatgaggttgatgaactcctgcaatttactaaacgtaatacaccatatttgcgtggaaaatttttctgtccatgtgttaactatggaaatgggagacaccaatcaataaatgatattagatcacatcttatatgtgaggggatcattcccacttacacaaaatggatatggtatggcgaattgcctgacatgccacaagtccctcacattaagtcagttgatgaagatgtcggacatcgtatagaagacatgattcgcgaccttggccaagatggttttcaacaggcacatagtgctttgtatgacaaaatagaaaatgattcaaagaagcctttgtattcggggtgcacaactttcacaaggttgtcagcggttttagctttg

SEQ ID NO: 3381 - DNA, 193 bp, Glycine max
  Peptide Sequence Number=SeqID_120159
atggagactgtagatcccttcgtgaagttctctcatgacctcgccatcaaggatggcatagtagctggccttccgtttgagggccataatttcctcagcatctatggtgagagtttgaagcatctcctagatgatggtcttgaggtgtccgaccttcttggtgctagccagcttggagaccaggtctgctcgg

SEQ ID NO: 3382 - DNA, 165 bp, Glycine max
  Peptide Sequence Number=SeqID_120160
atgatgtatgcacctgacttgactctcagatggaatgtgggaaccatacagagtttgtcgagaccacccgattgtgcacgtaactgcccccctcccataggtgatcagcctgggagtgtttttactgaggcagcttcatgtagcttccttgagaagcctcattaa

SEQ ID NO: 3383 - DNA, 297 bp, Glycine max
  Peptide Sequence Number=SeqID_120161
atggagtcaggtgacatgcggggataccatatggttatccgtacctttcgtcaaccaggggcaaacgagcccgttgacgtgcagagactaacatcgtcttctgcaccttttgccatccagggacagcgagtcaggtggcaggtagagataccttatagtcatccgcacctttcgtcaaccgaggtgaacaaattcgacggtatcaggatgatgttgggggttccaacagtaggcggtgccttcttgtggaagcaacccagctcgcctgggcaagctgagctcacctgggcgagttga

SEQ ID NO: 3384 - DNA, 246 bp, Glycine max
  Peptide Sequence Number=SeqID_120162
atgcatgttgcccctcattgcaccagtctgggatcctattgggtgagaacttctaatctgcccccaggttcgcttgaggtttatgcatggtgcctttcattgccccagtgtagggctctgaggttgatgcaatcctaccccgtaagggcattggatagaagactccaagtagattgggcaagagatccaagggaaggccctagggttctcatgagccttagggtagatttcgagcccatgggctaa

SEQ ID NO: 3385 - DNA, 369 bp, Glycine max
  Peptide Sequence Number=SeqID_120163
atgcactaccaattcaacgagggcgcgttcgccctgtttccggctggctggcaggacaccagcatgaatattctgcgcgatgaagccaccgggctggcgctgatcgtcagtcgtgggccaatcgctgaaggcagcgattttgagcaggagtttcatcgtcagtgggatacgttgcgcagccagatgggccatgtagagcagagcgaatttacacgcgtgctggcgggagccgacaacacgttgcgcgccatcgaagtggaaacggcttttgatcgcaacgggcaggcactgtggcaacgtcagctggcaccatgcggccttttgatgaagaagacggggcacgctggcatgccttcaaacagagcctga

SEQ ID NO: 3386 - DNA, 231 bp, Glycine max
  Peptide Sequence Number=SeqID_120164
ataacccttaataagccgggtgtcaaaacggccagaggcatttcagttggcgatagcaaggtgcagttggaaagtaagtatggaagtggcgcggtggatgatagtgataatcaatactggctctattatgacggtgatggaaaacgtattttattccaaattgagcgcggcaaagcgctgcttgtgcaaaccgagcggtgtctttttaggtacaaggaaattgaggtgtga

SEQ ID NO: 3387 - DNA, 789 bp, Glycine max
  Peptide Sequence Number=SeqID_120165
atgacggtaccaatcctgtccggccagaatggtgcgtatccctctgcgcaattgccggtggccatcgactacccggcggcgctggcgttgcgccagatggcactggtacaggatgagctgccaaaatacctgctggcgccggaagtgagcgccctgctccactacgttccggatcttcaccgcaaaatgctgctggccaccctctggaacactggcgcgcgcattaatgaggcgctggcgctgacaagaggtgacttctcactggcaccgccttggcctttcgtgcaactggccaccctcaaacagcgaacggagaaagcggccagaacggctggccggtcgccggccggtagccaggcccatcgcctggttccgctttcagacaaccagtacgtcagccagctgcagatgatggtggccaccctgaaaataccgcttgaaagacgaaacaagcgtaccggcagaaccgagaaagcccgcatctggaacatcaccgaccggacggtacggacctggattggcgaagcggttgaagcggccgccaccgacggggtgacattctcagtgccggtgactccgcatacgtttcgccacagttacgcgatgcatatgctgtacgcgggcataccgctcaaggtactgcagagtttaatgggacataagtcagttagctcaaccgaggtgtatacgaaggtgtttgcgcttgatgttgcggcgcgccatcgggtgcagttcgccatgccggaaactgaggcagtagctttgatgaaacaactgccccgggtgtga

SEQ ID NO: 3388 - DNA, 1181 bp, Glycine max
  Peptide Sequence Number=SeqID_120166
ttttgaaagaaaacatcattgagaagcttaagagtgattatgatttcatccttgttgatactggcccacatttggatgcttttctaaaaaatgctatagcagcagcagatctgcttctaaccccccttcctcctgcaactgttgactttcattcgtccttaaaatttgttgcaagcttgcctgctttaatcgaaagcatagaagctgagggacaaaaatacatgcttgatgttgtattaccccggctggatggttttgaacggtgtggagaaacatttgataccgtaatctcagctaacccagcgacgtatgatggtagcgctgaagcattaaaaagctccagaattgccgccgaagattttgcgaagggtgtgtttgatcgtgcaacggttgagccgtctacttctggattacaggttcagtattttactctgaagacggggcgaaaagttaaatttgccttgatgaccgttcctgcggcggaggtaggggtaatggacggcgaaaaaattgagattcttgatggttccaggagacgcgcagcggcaattgaagttcattctgcccttaatgttatggtgacatcggataaactcactgctgaagaagcaagacagcttgccaaagacattcagactgcgaaagaacataatatccgtgagattggcctacgcttgctttctcttaaggagtcaggtctaaatcagaaagaaatagcagagcaggaaggtctctctcaggccaaagtcactcgtgccatacaggctgcgactgtgccgcaagaactcatctctatgttcccggtacaatatgagttgtctttttctgactataagaacctttctgagcttaatgatcgtcttagagaaaataagattgaatactcgcagctcgttgaacaaatatccttgcagcttgacagcttagtagctgatgaccaacttctcgaggatgaaaagaaatcggctattcttaaactgattgctaaaggtgctgcttcattaattgcggagccccctaaagaaaaaacaattgtttcctcgttatgggattttgctgataaagacaagtatgcgcgtaagcgtgttaaaggaagaagctatatttacgaattcaaccgcctaccaaagaatcttcagaatgacatcgaagaggcgattcaggacgttttgaaacgtcat

SEQ ID NO: 3389 - DNA, 141 bp, Glycine max
  Peptide Sequence Number=SeqID_120167
atgagtgacaaagaaaaatgcttgtgcattgctggttatgggaaagagttttctgcctctgccctgttttcttggtatagggttgttcatgatatttggaaattgaattgcttggatattgtggaagctaggaggggctga

SEQ ID NO: 3390 - DNA, 351 bp, Glycine max
  Peptide Sequence Number=SeqID_120168
atgaagaacgcgttcgacaagaaggtgcgctcgtgcaagttccatgagggggaccttgtgctgaaaaaggtgtcccacgctgttaaagataatcgagggaagtgggccccgaactacgaagggcctttcgttgtaaaaagggattttttcggaggggctctggtgctcaccaacatgaatggcgaggagctaccttcacccgttgtcgcaacctgcccttcggcgggagggcgacgcgtgactcgcgggtgcgtgttcctagaaaggaatacgcgcggagtcgccacccacgtttatttgaggaaaacgtcagaaaaaccgaaaaagacgtggtctacacactttaagtga

SEQ ID NO: 3391 - DNA, 405 bp, Glycine max
  Peptide Sequence Number=SeqID_120169
atgaaaaggagtaaaaggtttgtggaggctgaggatgaggatagtgttgtgcataagaagaaaactgctgacaaaaaaagtattgatggcaagaaaaatgaggtgagaggtgaaagtaatcaagaaaaagagaaacaaataatggtcaagaataaagaattgaaggaccaagaaaaagaaaaagaagtagaaaatgaaaaaaatgaaaaagaagaaaaaataataagaatgcaaagaagagtaggagtgaaaaagctgtggatgaagggcaaggaccatgaagcacttgaagggcccatgaccagaggcatgcttaaaaaggcccaacacagtgatgaggacacaactaagggcaaggaccatgaagcacttgaagggcccatgactagagacaaacttaaatag

SEQ ID NO: 3392 - DNA, 435 bp, Glycine max
  Peptide Sequence Number=SeqID_120170
atggcagccaccagtgggttgtgggttgtgggtagccgaggatgtgatgacccgcctcgtcgctatgatatcactactctaaaccaccctagctctcccagactagcatctggctcgcctaggccatgtaatggcttcgtgcctaagcaaccagctcgcctaggcgagctcattccttcaaagctaagcattagctcgcctgggcactaccgaatcgcgactgtgatcatcccctacatcgttctcttgttctatgtccctcgtgcaacagcaaggaaagtggatgaccataatttgtctctgtgtgccaacggacttgattgtctctggaaggttaggaaagcagatgaccatgatttgtctccgcgtgccaacagacttgattgtctctggaaggcaaaggagactttaatagtctcggtcgaaagacactga

SEQ ID NO: 3393 - DNA, 666 bp, Glycine max
  Peptide Sequence Number=SeqID_120171
atgtctctagacctgtataagacaaaggaccagaagaactactttaagtcaaaagacaagaaagtacttatgagcacatcggaagacctagatgacatgttgttcgatgaagagacatatgaaaaagcaaaattttgcttgatggctgatacaacatcagaagaatcttattcaaatttagatgtggtggctcatcaagatatcaatctcttaattgaacctgatcaagacagtaaaaactatgataccttgaaagaaaaggaatcacaacttctactggaaaatgaaaaggtctcaaaagaacatgatacattgatgaaaagttttaagatctttggagacaagattcaatcactgcaactagagctaaaacaattaaatgttctttatgatcatgttaaagaagaaaggtctaatctatgtaaagagtgttcacaaccacaccctgattatgacaagttggaaataaataaacttaatctatgggttgaatgtgaaagttacaagaaaactctaaagtttataaatgataagcttgaaaagaatgataatcccaagggacaatctcaagatgaggcaaaactttatcaagagattcaatccttaagggagaatgtttccaaattttttggaagcattgagaatcattacaaactattaagataa

SEQ ID NO: 3394 - DNA, 204 bp, Glycine max
  Peptide Sequence Number=SeqID_120172
atgggctcagaaatctaccctgaggttcatgagaaccctagggccttcttcagcagctctagcccaatcctcttggagcttcttgctgatggctctagtgactggtcccttcctagggaggattgcatcacaggggcccctggggatgatagaggagctctggaggttgacgacatggctaacatattgaatttcttcacttga

SEQ ID NO: 3395 - DNA, 684 bp, Glycine max
  Peptide Sequence Number=SeqID_120173
atggagaagatgaatatgcacataataacagaggggacccttaaggcatggctatttattggaaaaagccattttagggcatgggaagctcacccaggcgagctaatgcttagctttgaaggaatgagctcgcctaggcgagctggttgcttaggcacgaagccattacatggcctaggcgagccagatgctagtctgggagagctagggtctagaaaaatccaaaaacagacctttttgcccccttccttgagtagtgatatcatagcgacgaggcgggtcatcacatcctcggctacccacaacccacaacccactggtggctgccatgagacatcatcgcttgtcaccggaccaccgcacagagaggaacactttaattggagtggaatcttcaaaatccacctcaaggatttgatagagagcggagctctcaacccttcttttgtggtttcttcgagagctctgcattggaccaacaaacttgaacgcataagagttagtttcataaaccaaagttcacgacagggtgacctcgacacttactgcctagttttcctaagtgtgagtgccatgcggacacgcttaggctacttcctgatgaatggcaccgcattgcatttgagagttgagttaggttcatgcatgattctgtgcataattgatgaattgtcaaaaagttga

SEQ ID NO: 3396 - DNA, 654 bp, Glycine max
  Peptide Sequence Number=SeqID_120174
atggagttcaaagataaaagaatgaaggctacgtttgagattctgaataatatcaggattctaaaactgcaagcgtgggagatgaagttcttgtcaaagattattcagcttaggaagactgaggagatatggctaaagaaatttctagctgaagagttgcagactgatgtagtagaaaagcttccatggggtagttctgataaggcaattgaattagtagatggatatttctcttgggacttatcttccattaatacaacagtgaaaaacataaatctcgcaatttttcatggtatgagggttgctgtatgtgctactgttgggtcagacaagtctagtttactttcttgtataataggggaagtaccaaagatatcgggaacgctgaagatatgtggaaccaaggcttatgtttctcaatcaccatggacacaggggaaaagcataagttttcagattgcaagcaactattggatgactgtggcaacacctgtttcatcaactgcagaacctgatatgagaagttttacacttatggttgcttcaacagaccaaagcgcactggatatgaaaattgcaaatatattatgggcaattaccctcaatctagttcaactcttgggaaatgttgagatgtctcaagctgcatggcag

SEQ ID NO: 3397 - DNA, 3915 bp, Glycine max
  Peptide Sequence Number=SeqID_120175
atggctaagcttgcttctcttgaagagccccttttgaatggtgactctaaagtacagaacaattctgatcccagtaagactaaaggaaataactattcaattgctggagttttcagcattcttactttctcatggatcagtccaataataaccctaggcaatgagaagacattagagcatgaggacctcccacttcttgctactgatgacagtgcctatggggtttttccaacttttagaaacaaactagagtcagagtgcggtagtgttaggaatgtgaccactcttaaactcgtgaaggtgttattcttgtcaacatggcaaggaattcttttgtcaggtttatttgcattactatacacgtgtgcttcttatgttggaccctttcttattgaaatctttgttcaatacctcaatggggaacaaaagtttaaaaatgaaggctatgttttggctatggcatttgttgctgcaaagcttgtggaatgtctttcacagaggcactggatgtttaggttccagcaagttggggttaggatgcaatcaaagttggtcgcaatgatctatgctaaaggtttgactctttcatgtcaatccaaggaggttcgcagcactggggaaatcatcaacttaatgactgttgatgcagaaaggattggtgaattttgttggtacatgcatgatccatggatgtgtgttttgcaagttgctttggctttgttaattctatatagaagtgtaggggttgcttcaatagctgctcttgctgccactgtaattgtgatgttgctaaactttcccgtgtcatcattgcaagaaaagttccaaggcaaggtaatggagttcaaagataaaagaatgaaggctacgtctgagattctgaagaatatcaggattctaaaactgcaagcgtgggagatgaagttcttgtcaaagattattcagcttaggaagactgaggagatatggctaaagaaatttctagctagtacagcaattattaaatttctcttccataacgccccaacttttattgctgtggttacatttggtgcttgtgctcttattggaatcccacttgaatctgggaaggtcttatctgcacttgcaacattcagaattcttcaaatgcccatttacggtcttcctgacacaatttcaatgattgcacaaactaaagtttcccttgaaaggattgcatcatttcttcgtctagaagagttgcagaccgatgtagtagaaaagcttccatggggtagttctgataaggcaattgaattagtagatggatatttctcttgggatttatcttcccctaatacaacactgaaaaacataaatctcacaatttttcatggtatgagggttgctgtatgtggtactgttgggtcaggcaagtctagcttactttcttgtataataggggaagtaccaaagatatcgggaacgctgaagatatgtggaaccaaggcttatgtttctcaatcgccatggatacagggtggcaagatagaagataacatattatttggtaaagagatggacaggggaaagtataagaaggtgctagaagcatgttccttgacaaaagaccttgagattctaccatttggtgatcagactattattggagagaagggaatcaatttgagtggtggacagaagcaaagagtgcaaatagcccgtgctctataccaggatgctgatgtatatctgtttgatgatcccttcagtgctgtggatgctcatacaggatcccatctctttaaggagtgcatgcttggtcttttaaaatcaaaaactgtgatatacattactcatcaagtagaattcttacctgatgctgatctaatattggtcatgagagaaggaagcataactcaatcaggaaaatacaatgacattctcaagacaggcactgatttaatggaacttgtaggtgcacacagagaagctttgtcttcaattaagtccttagagagaaagccaacatttaaaatatcaagtacatccgaggaggacccaaattcattaagtgattttgaacttgagaaaaatgtggaaaacacaaatgatcaaattgataagtcaaatgacacagttgagccccaaggacaacttgttcaagaagaagaacgagaaaagggtagagttgggtttaaagtatactggaaatacatcacaacagcttatggaggtactcttgtacccttcatattactttcacagacactcaccatcagttttcagattgcaagcaattattggatgactgtggcaacacctgtttcagcaactgcagaacctgatattagaagctttacacttatggttgtctatgttgctttggcagttggaagttccattttcacctttgccagagcatttcttgctgcgatagctggatacaaaacagccactgtgctcttcaataaaatgcatttgagtgtttttcgagcaccaatatcattttttgatgccacccccagtggtcgaatccttaatagagcttcaacagaccaaagcacactggatatgtacattgcagatatattatgggcagttaccctcaatctggttactctcttcggaaatatttttgtgatgtctcaagctgcatggcaggtgtttatagtattgattccagtcatggcagcatgcatatggtaccagcgatactattctgcatcagcaagagaattggcacgattagttggtacatgccaagctccagttatacaacatttttcggaaactatctctggatcaacaaccataagaagttttgagcaagaatcaagatttaatgacataaatatgaaaatgatagacagatattcccaacccaaattatacagtgctactgcaatcgaatggctgaatttcagattggatattttatctactctcacatttgcctgctgtttggttttcttgatatcttttccaagttcaatgactgctcctggaattgcgggattggctgtgacatatggacttaatctaaatgctgtacaaactaaagtaatctggttttcttgcaatttggagaacaaaattatatctgttgaaagaatgctccaatacacatccctcccaagtgaagctcctcttgtaataaaagataaccaaccagattattcttggccatcatttggagaagttcatatccgggatttacaggttcaatatgctcctcacttgcctattgttttacgaggtcttacttgcacttttactgctggagcaaaaactggtattgtgggaagaacaggaagtggaaaatcaactcttgtgcaaacacttttccgacttattgaacctgttgctggacaaatattgatagatagcattaacatctctttcattggaattcatgatttgcggtcccgactgagcattattcctcaagatccaacaatgtttgaagggacaataagaaccaacctggatccactggaagagtacacagatgaacagatttgggaggatttccaggctctatatatgtgccaacttggagatgaagtaaggaaaaaagaagggaagcttgactccgtagttacagagaatggagaaaattggagtatgggccaaaggcaattggtctgcctcggccgtgttctacttaagaaaagcaagatcttggtgcttgatgaagctactgcatcagttgatacagccacagataatattattcagcaaacagttaagcaacatttttccgaatgcacagtcattaccattgctcataggataacttcaatccttgatagtgacatggttttgtttttaaatcaagggttgattgaggaatatgattcaccaaagaaactgcttaagaacaagtcttcatctctagctcaactagttgaagaatacacaaggaggtcaaattctggttttggaaattaa

SEQ ID NO: 3398 - DNA, 423 bp, Glycine max
  Peptide Sequence Number=SeqID_120176
atgtccgctttgcagatgtcccatgttgatttggagcaagggaatgggaatcatcgccggtcggttgttggaagtgatgtgagtggtgaagggagcttgtgcttctctgatgttgatgatggttcttgctattcccgtttctactcaacaaacggtggttcatatgatgattacagctttgcttgtgtttctgatgctgaggttgggggtgttccacattctgggagagcttcttctgcttctgagtgttctgtggaggtggaagctagaagtgggaaaaggattgtaggatttgtcacatgggtttggagagtgatagagtttggtgcccccattgaattgggatgttcttgtaaggatgatttggctgctgctcacaagcactgtgctgaggcctggttcaagattaagggaaataggtga

SEQ ID NO: 3399 - DNA, 363 bp, Glycine max
  Peptide Sequence Number=SeqID_120177
atgaaagagaccggaaccactccaactccattggagttgtttcgtcgcatgcaccaacgtaaggacaacacatgggtggataggagatcacaacttttaaatgaggcatttacacacacattgaaacaattgaccgaacgagcattggcacaaggaaaacctccaccaagaaggccttgctatcatgactcatcttcatcaatagagtgggtaaaaaaacaagagtttgatgaattgagaaaaaagatggaaggagttataaatggaagagatgggcttcaaaccaaagttgcaaatattgagaggcttcttgagcagaacaatgcattgatacgacaattgatggaaagcatgaatcgttag

SEQ ID NO: 3400 - DNA, 219 bp, Glycine max
  Peptide Sequence Number=SeqID_120178
atgcattgttgtcatctccatttgaccatgcaatggaaagttgacaaggatggaggagggaaggggttcgagtgtgtatctgtttcttcctttggacatgcgattgaggtggtagcagtagtagttgacaatgttgctactgagaacaaaatcataatgaagagtggcttttctcgacattgtgtcgatttgagtggagacaggaaaatgcatgcttaa

SEQ ID NO: 3401 - DNA, 261 bp, Glycine max
  Peptide Sequence Number=SeqID_120179
atgaagcacggacacgccgctgaagtgccgcgtcccgcatcagaggcgcaccggacacgcaaacgggtacgactacagtgcgacgcagtgttcgctgcatccgccgtcaccggacacggttggacgcaggaagcgcacgattggacgcggcccaccaagtggacatgcgcaggaatcgcattagagcgagattcgaatgaaggagctgcggcggcagagagatacgccgagcacggcggcggcggcggcggcgggttgtaa

SEQ ID NO: 3402 - DNA, 1338 bp, Glycine max
  Peptide Sequence Number=SeqID_120180
atgatggcagtcaaagatcagaataaaggaaaagcttttaagagtcatccaacaattcaacttgctaggcatctagcagagataacttctcaaattcctccatgtgtttcatcacatgcaatatctcatcctactgatcctcctgctaggacatctgatgtgatacctccaccttcaatactaggggtacactctccatgtacttcacaaccaacaaatccagatgcagaatgtagccttgacatggcctcagagaagacaacttctgttcgcaaaaagtttgttaggcagcaggtggcagagaaagatccgaataaaggaaaagcttccaagagtcatccaacgaaacaccgtactgcatatctatcacagatgacttctcaaaatccaccatgtgcatcacgaccaactaattcaatggaaggggcacacctacctgctaggatatctgatgtatcacttccaccttcagtggaaggggtacactcaccatgtacatcacaaccaatgaattcagatgcaggacgtactgatagatcttttgctgcattagagacacaaagaaatgatgccaagccaattttatatcttgatgagcaaggattcttaccttctcgctctgctgctaatgggattggggatatcctcaagaggaattttactgatccctggccatcatggaaaaagataccaattagcacaagaaactcttggtttgaagagtttttggaaaacttctctgtttctccaccggattacaattgggctaaaaagaattttgaaatgcgaggttcagtattgatgaaaaattatctaaacaaggctcgaaccacaatggataaaccacattggattaaagatgttgtctgggagagattgtgcgagcattggacatctgaaggattcaaaaagaagagtacccaagcaaaaacaaatcgggcatctaattatggagcatctcacactggtggctctattagcgcttcacagcatagagctaatatgatgaaagagactggaactgctcctactccattggagttgtttcgtcgcacacaccaacgtaaggacaacacatgggtggataggagatcacaacatgaggcatttgcacgcacattgaaacatatgaccaaaagagcattggcagaaggaaaaccttcaccaagtgaattagatgtgtggtgcgatgtagctagatcaaagaaaggaaaagtatatggacttggaatgaaatctacagttatggcaacaaaagaaggtgaagatgacagtcaagatgaaggtgaagatgacagtgaatatgaagatgacgaggagtcactaagtgaaccatag

SEQ ID NO: 3403 - DNA, 159 bp, Glycine max
  Peptide Sequence Number=SeqID_120181
atgaatgaaattagaaatgaaagagataagcttcaaagtaaagttgcaaatatggagaggcttgccgagcataacaatgcattgattcaagaattgatggaaagtatgaacaaatcatctacaatagacgaaattcaagatgaggatgggattgtctag

SEQ ID NO: 3404 - DNA, 141 bp, Glycine max
  Peptide Sequence Number=SeqID_120182
atgaggagtgatgacaagagagtgcttgaacttgtaaataagcgggtaaccatacttgagtttttagaggatgatggcacaagaatggagatcgacgttccacatgttgattcgaccattggatggctagtggaaccatga

SEQ ID NO: 3405 - DNA, 894 bp, Glycine max
  Peptide Sequence Number=SeqID_120183
atggccaaagagattatgaaaacacatgacatcatcttttccaataggcctcaaatacttgttgccaaagttgcttacaatgccaaagacattgccttctctccctgtggaagctattggaggcaactaagaaagatgtgcaaagaagagctattagcctccaagcgcgtgcaatgtttcaggtccataagggaagaggaggtatcagcattgatcaaaacaatatctcaaagtgtagggtttgttgtgaatctcagtgagaagatttactcactcacatatggaataacagcaagagcagcacttggtgagaagtgcatacaccagcaagagtttatatgcatcattgaggaagcagtgcacctttctggaggactttgtcttgctgatctctatccttccattacatggcttcaaatgttcagtgttgtgaaggctaaatctgaaaaactgttcaggaagattgatggcatattggacaacatcattgaagatcacaaaaataggagaagattaggacaattgtttgatactgatcaaaaggatttggttgatgttcttcttggctttcaacagcctaacaaggacattcccctggatccaccattgactgatgacaatgttaaagcagtcatcctggtgtcactagattcaatttctcattattcttcttcaatgtgtcatcctggttttgctggaactgaaacatcatcagcagttgtggaatgggccatgtcagaaatggtgaaaaatccaaaggtgatgaaaaaagcacaagctgaggtgagaagggtgtacaatagtaagggtcatgtggatgagactgacttggaccaattgacatactttagaaacaatgaggctacaccctcctgcaccaatgttgctacctag

SEQ ID NO: 3406 - DNA, 378 bp, Glycine max
  Peptide Sequence Number=SeqID_120184
atgaaccattttgcaccttgggcagtctatggtggtgggagattaacacacggcgcatactttgttcctcgactcctcctcggcaagaacgaggagccttctgatctcctccaccctggttgccgcatgctgccaccggtgacagagaatacacagagtgagagaggaggcatatatagctcgaagacgagggtgaggacgaggtggaggctgtcagagtcctcgactttgttgccatgggagtcaatgacaaagaacggtggaggcatggatgacgaaggcggtggagttggcgccattagagttgtcggtggtgatagtggaggtggaggtggatttgctggtggaagctcacagcagaatgttctggcgagatga

SEQ ID NO: 3407 - DNA, 147 bp, Glycine max
  Peptide Sequence Number=SeqID_120185
atgagagggagtgcacaccctcagttcaatgtaggtccgtcattggcttccatggccatggggaaggagaaaggtaaggaaaacatggagaatgaaaaccttatccatggtattggtgggagcgaggaccctaagagaaaggcatag

SEQ ID NO: 3408 - DNA, 402 bp, Glycine max
  Peptide Sequence Number=SeqID_120186
atgttgtgcttggaatgtcatccaattcccgaagctgttgagaatgaggatgatttagatgatgtacttgttgctggccatgaggaagatgttggtggtggagagaaagagatgttggtggtggtgaagagagatgctggtgctggtgagcagagagatgctggtgctggtgaagagacagatgttggtggtggcgaggaggaaaaggttggtaatcctaataatgaagatgacaatgatgagtggtttacagatttctctagtatgaggaaggaagtcgaagttgaaacagatgatcatcactcagaggagctcaaaaacctcattagtagtgatgatgaatatgaggatgttgacaaagtttatcctcgatataatgaaagtagtcgagttggagaatag

SEQ ID NO: 3409 - DNA, 213 bp, Glycine max
  Peptide Sequence Number=SeqID_120187
atgtcatcagatataggggaacatcaacatcatgatccaggacaacattatttgtcgagtcattttttctatgatcgactcttccagttggtccctgattttttgcgtcagctgctccaggtcttcaggagccatggacgaagacgtgcaggaggtccttggagccagtccaaagtattgtttgatcgtgacacaggctccaacagcacgtag

SEQ ID NO: 3410 - DNA, 297 bp, Glycine max
  Peptide Sequence Number=SeqID_120188
atgatgatgcaacgactcatgcaaaatgtgaggctggaatgtgataacggacaaatgcaggaacgatatgttcattatgatgctgaagagatgtttatgcgatgcatgatatggatcgtgttacttgcgcatttgggggcgaaatgccccatgtgtgcaattaagaagacgatatggatcttccgacttccctcgacaaaagacgagacccacatacaacgcatgtgtgacggcataatgcagatgcgcaaaagcgcaacagggggatttacacagcatggcaatatcctcaaataa

SEQ ID NO: 3411 - DNA, 282 bp, Glycine max
  Peptide Sequence Number=SeqID_120189
atgccgccacacaatgcgtctcataaccactacatgcaagtaaaaggggtatctttaggcttttcatctctggtaatcgattacacagccttggtaatcgattaccagaggccaaactcgaattacacagcttcaggacatgaaaacctgaaaaaggcactgtgtaatcgattacacagactggtaatcgattaccagaggcctccacaatcttccagttccctttttaagcctggtaatcgattacaccccttggtaatcgattaccagaagctctcctag

SEQ ID NO: 3412 - DNA, 348 bp, Glycine max
  Peptide Sequence Number=SeqID_120190
gttaaaaagaggctaagtcatgaagagctaaaagtgacagttgagctcaactcatcagtggggctcagcgcacaactggcgctaagctcaaatccacttactcgcgctaagcgcaagggtggcactaagtgcaacgtcgcggaattagggaaacaatccagagagtcaccatcacacatagaagttagagcacaccacaatgcctattttgggaaaagagctatggaggcaacaagaagagcagcttttgcagagataccaaggttttgtaattatagagagattagtgagttacagagttattgtgagatgctgagaagaggaggagggatcccccttcttgtgtaa

SEQ ID NO: 3413 - DNA, 363 bp, Glycine max
  Peptide Sequence Number=SeqID_120191
atgtcattaaaatttccatattatcctgaacttgtaaaggtcttctactgcaatttaaaaattcaggatggcattattatttctgaggtgcatggtattcctatggtcattgatcaatcactgttcttttctttaactaatttacccagtcaaggtgtaccttttgagggcaccattgttgatgactggaaatttgattattcgagtcatgatgctcgtcgtatggtctgcaatgatcaagctgaaatgaccggtagattgctggccgggattttgcttcctcggtcttcaaatttagcacaagcctctgaggaggatttgattattatgtgggcttttcttaccggtcgtcagatcgactag

SEQ ID NO: 3414 - DNA, 375 bp, Glycine max
  Peptide Sequence Number=SeqID_120192
atgaaccacttcttccggaaagttcccggaagaggtttttccgggagtcttccggaagaagtgttcttccggaagacgtttggttacttccgaaagaacccttcttccggaaactttccggaaaatgttcttccggaacttccggaagaacccctaacgggtcttccggaagtctccgtcgtcagcctcctttccccattttttccggcgtcctctcctctcgtcttctaccctaaggttactatcctaagcaaaggggagttagggagactaacctcgttcgcggagaagaagaagacgaggttcgcgcttgccttgccggagaagaagaagcagttcgcggagaagggagaacaagcttcgcggaaggaatga

SEQ ID NO: 3415 - DNA, 1503 bp, Glycine max
  Peptide Sequence Number=SeqID_120193
atggatttaggtcaccaaaatattccctcacttgcaatcctacccttcttcctcttcatgttcacagtgtttagcttattttggagaacaaaaaccaagccttcaaactccaagttaccaccaggaccaccaaaactaccccttataggaaacttgcatcagcttggtgcaatgcctcatcatggcctaacaaaactttcacaccaatatggacctctcatgcacataaaacttggtgcactttccaccatagtggtgtcttcccctgaaatggccaaggaagtactgaagacacatgacatcatttttgcaaataggccttatcttcttgcagcagatgtcatatcttatggctccaagggcatgagtttttctccttatggaagttattggaggcagatgagaaagatttgcacctttgagctgctaactccgaagcgtgtcgaatcatttcaagcgattagggaagaggaggcatcaaatcttgttagagagataggtttgggtgaagggtcatccatcaatctcactaggatgatcaattctttctcctacggcttaacatcacgcgtggccttcgggggaaagtccaaagatcaagaagctttcattgatgttatgaaagatgtcttgaaggttattgctggtttctccctagctgacttgtatcctattaaagggcttcaagttttgacagggttgagatccaaagttgagaagttacatcaagaagttgataggatccttgagaaaattgtgagagaccacagggacacaagttcagaaacaaaggaaacccttgaaaaaactggagaggatctagttgatgtgctactaaagcttcagaggcagaacaaccttgagcatcctctatctgacaacgatatcttcagtgctggaagtggtacttcagctaaaacctcagagtgggcaatgtcagaacttgtaaaaaatccaagggtgatggagaaagcacaagctgaggtaagaagagtctttggtgaaaaggggcatgtagatgaagctaacctccatgaactcagctacttaaagtcagtaatcaaagaaacgctgcgtctacacattcctgttccatttttactaccaagggaatgcagtgaaagatgtgaaattaacgggtatgaaataccagccaagagcaaggttattatcaatggttgggctattggaagggatccaaaccattggactgatgctaagaagttttgtccagaaaggttccttgatagctcagttgattacaaaggtgcagattttcagtttattccatttggtgctggaaggaggatgtgtccaggaagtgcatttggcattgctaatgttgaactcttgctagcgaatttgctcttccattttgattggaacatgcctaatgggaaaaagcctgaagaacttgacatgagtgaatcatttggcttgtcagttagaagaaaacatgatttgtatttgattcctagcatctgtctctcatttggtaattaa

SEQ ID NO: 3416 - DNA, 906 bp, Glycine max
  Peptide Sequence Number=SeqID_120194
atggccccggaccccgaatccgaaaccgggttgggtccgaggctgaagctgagcaacatgagcatccccgagttgatttccgagttgcgcgattcgttcctgagtcgcgacttcgaccgagttgaggaggtcctggtggcgcgggatgcgaggctgacgaaggagcttgaggagaagaagcgggaaatcgggtccctcagagaaagaatagatttcgagaggttggagaagatcaatgccgagttggaactgaagaggctcagggaaaaagaaaaagggtgtggggagaagttggtgaagagtgataataataataataataataataataatgggtttggtttgggtggtgggattgttgtgaagagtgaaaaaaagtgtatggatgaggagggtgttgttgaagtggtagaaggtggaaagattggggttttgagagagaaggaaagaggggttgatgggttggagaatgagaaggggaagaaagttgttggaatcaataactctgtgtctctgaatagaaatggtggtggtattggtgcttcagggggagaattgggattgaaacctgttattgttatagtagacagtgatgatgagtgtaattcacaagcaacattgaacaaaaaagagactacttcatgtattaatattatagatgatgaacatagaagttcatcatcaggagcaccccagaaaaatcttctaacaggactggctgaacgcattggaaatctcaaaagaaaatttgtttcttcgcgcgaattggatgcaaatatcaatgccttggatgacttcgatagtgattcttcctgttctggttccagttctagttcctcttctggtccatatgataaggatctaccaacaaaccataagaaattgagagctgatgcaaccagtcct

SEQ ID NO: 3417 - DNA, 1497 bp, Glycine max
  Peptide Sequence Number=SeqID_120195
atggatcttcaaaccctctacttcacatccattttatccattttcatttttatgtttttggggcacaaaataattacaaagaaacctgcctcaactccaaatttaccaccagggccttggaagatacctatcatagggaacatacacaacgttgttggctcacttccccatcatcggctaagagatttatcagcaaaatatggacccttgatgcatctgaagcttggagaggtttccaccattgtggtttcatccccagagtatgctaaagaggtgttaagcacccatgatcttatcttttcatcaagacctccaatactagcttcaaagataatgtcttatgattctatgggtatgtcttttgcaccttatggtgattactggagacggctaagaaagatttgtgcatcggagctattaagctcaaaacgagtccaatctttccaaccaatccgaggggaagagctcaccaacttcatcaaaaggattgcttcaaaagaagggtcacccatcaatctcaccaaagaagtgcttttaacagtatctacaattgtttcaaggacagcccttggcaacaagtgtagggaccataaaaaattcatatcagctgtaagggaagccacagaggctgctggaggttttgacttgggagatttgtacccttctgctgaatggcttcaacacatctcagggctgaagcctaagcttgagaagtatcatcaacaagccgaccggataatgcaaaacatcgtcaatgaacatagagaggctaagtcaagtgccacacacggccagggtgaagaagtggcggatgatcttgtagacgtgctcatgaaggaggagtttggcttaagcgacaatagtatcaaggctgtgattttggatatgtttggaggtggaactcagacatcatctactaccataacatgggcaatggcagagatgataaaaaatccaagagtaatgaaaaaggtacatgctgaggtaagagaggtatttggtggtaaagtaggacaccccgatgaaagtgacatggagaatctaaaatatttgaaatctgttgtgaaagagacattgagactgcaccctcctggtccccttttgcttccaagacagtgtggacaagcttgtgagatcaatggttattacatacctatcaaaagcaaggtcataatcaatgcatgggcaattggaagagatccaaatcattggagtgaagctgagagattttatcctgagaggttcattggaagttctgttgactaccaaggcaatagttttgagtacataccatttggtgctggaagaagaatatgccctggcctcacatttgggttgaccaatgttgagtttccacttgcattgctaatgtattattttgattggaaacttcccaatgaaatgaagaatgaagatttggacatgactgaggcttttggagtatcagctcgtagaaaagatgatttgtgcctcattcctatcactttccatctttag

SEQ ID NO: 3418 - DNA, 246 bp, Glycine max
  Peptide Sequence Number=SeqID_120196
atggcacactacaggcaagataaagtgtcaagtgatgaattgaagttgaaggatccacgatgtcggatacaatgtcctgacatcctgctcgagaatactggaagtgctgtacaatgcaagataaaaatttttcagaagaagatagatctcctccagcatcaagaacttgcagcccagaatcgtacacggctatataatcatggaggctgcacgagttctggaccaagtccgggattgaagagttag

SEQ ID NO: 3419 - DNA, 570 bp, Glycine max
  Peptide Sequence Number=SeqID_120197
atgatctatgtgaagaaaggggtttactatgaaaatgtgagggtagagaagaccagatggaatgtgatgatcattggtgatgatttgttgggggtgaaacaagttgtatttggaaggaatttcatagctggagatatgggttttcgcaacacaatcggtccacagaagcatcaagcagtggcactaatgacaagctcagatcaagtagtttactatagatgtcacattgatgcatatcagaacactctctatgctcattccaactgccaattctatagagaatgcaacatctatggcactattgatttcattttcgggaattttgcggttgtcatccaaaactgcaacattaggccaaagctacctatgcatgaccagatcaacacaatcacagctcaggaaaaaactgaccctaacatgaacactggaatctccattcaacattgcaacatttcaccctttggaaacttgagttctgtcgagacataccttggaagaccctggaagaactactcaaccacactgtacatgagatcaaggatggatggccttgtgagccccagaggctag

SEQ ID NO: 3420 - DNA, 657 bp, Glycine max
  Peptide Sequence Number=SeqID_120198
gacatttttggtgctggaggtgagacatcagcaacaaccatagattgggcaatggctgaaatgatgaagaatccaaaagtaatgaagaaagcagaagctgaggtgagagaggtcttcaatatgaaagtcagggttgatgagaattgcatcaatgaaatcaaatatttgaaactagttgttaaagagaccctgagattactccctccaattcctcttttgcttccaagagaatgtggtcaaacatgtgagatacatggttatctcataccagccaaaagcaaggtcatagtcaatgcttgggcaattggaagagatccaaactattggactgaaccagagaggatttatccggagagattcattgatagcactattgactacaaacagagtaattttgagtacattccttttggtgttggaagaaggatatgcccaggaagcacatttgcttcaagaattattgaactggcccttgcaaagttgttgtatcactttgattggaagtttccaaatggaatgataagtaatccttgtggcgtctaccctgacttatcttccttcaccggaagtggcgtctatcctgacttatcttccttcaccggaagtggcgtcatccaaatctctgtaacatgtatcaagcgatccgctcctagtcag

SEQ ID NO: 3421 - DNA, 222 bp, Glycine max
  Peptide Sequence Number=SeqID_120199
atgggtgtgaattggattggggagggagtgagaggggaagtcttatataagggggaagtgaggaagcgccctagagccagaacattcatggaaaataggaaaattttccgggaaaaaataatattggaaaggaagggctgctactggtcttacggaggccacatcagagaccttaaggagagatttgcaacttcttttattgaagacattacaacatcttag

SEQ ID NO: 3422 - DNA, 369 bp, Glycine max
  Peptide Sequence Number=SeqID_120200
atgtggattcaacatgctgctagcttatttttcatgagtttctttgtgaaattatctatggcaccaaagcagaagattagaatcaagcttagatcttactgggtgcccttgatagaggattcctgcaagcagatattagatgcagcaaggaataccaatgcaaaaacgatgggacctgtgccattaccaaccaagaagcgaatctactgtgttcttaaatccccacacgtacataaggatgctcggttccatttcgagatcagaacacaccagcgtctcattgatattctataccctacagctcaaacaatagattctctgatgcaactagatcttcctgctggtgttgatgtggaggtcaagctctag

SEQ ID NO: 3423 - DNA, 108 bp, Glycine max
  Peptide Sequence Number=SeqID_120201
atgggtggtaaagaagacaaatcttacccagtgtggataagaaccagaatgaagagaaaacatggatacgaaggccgaatcggagagcataacattgttgaaccatga

SEQ ID NO: 3424 - DNA, 324 bp, Glycine max
  Peptide Sequence Number=SeqID_120202
atgggcccaaaatctaccctaaggctcatgagagccctagggctttctcttgcatctctgacccaatcttcttggagtcttctatccaatgcccttgtggggtccttgaaacttcaaaagtgttgtgggagatctttgccattagtctccatccaaaatgtgatcacgtgtccgttagttagacaagtcaatgatacacacacgaagccatatcgactatctgagatgatgacaatgaggatagcaatcgaattcctgcagcccgggggatccactagttctagagcggccgccaccgcggtggagctccaattcgccctatag

SEQ ID NO: 3425 - DNA, 144 bp, Glycine max
  Peptide Sequence Number=SeqID_120203
atggaacagaatcagcaaaagcttcgaaaggctgtcttggacgtgtcaaacgaaattggaagatattataatgagttggagttagaaaagatacttggtgctattgaagaggtggaacaagctaaatgccaatctttattctag

SEQ ID NO: 3426 - DNA, 159 bp, Glycine max
  Peptide Sequence Number=SeqID_120204
gcgcagggcgagacaccacaacaaccaggggatggctggcagggggcaacagacgcaccgtcgccacctccaaggcccctttgctcatctacaaaagctggagcattgcctacgaccagtgatcgactagcaggtgaccaagtccaaagccaaaggtaa

SEQ ID NO: 3427 - DNA, 681 bp, Glycine max
  Peptide Sequence Number=SeqID_120205
atggctgagaagacaaagaaaagactggaagaagctgcccagtctggaaacactgagggcgtcattgaccctccatctcccatcagaagccacgtgaagtggaagatggcccgcacgaaaaaaactggacaaatgacgtttgaggcaccaaaggaaatagctgatagaattattctttggaagagcaggcgtcacagggatctttcgtccgccatggacattaggatgtcctcactgctaccattggacgaccagagcatcctggccgtgttcgtgttgctggagccgggacttgcactacctccagagccagagattggtcccctaggtcctcgtgtcagcacaaaggagagttgtgttgctctctcagggaacgattcagggacgagtgactcagaaaactgcgggctatacattgaagaaaatctttcccgcctggttgccctaggaagactttatgagggatccacaacagttcacaacatccctttgttgcatggccaagtcaaggtttgtgttgaggaggttaaagatgcagaggctctcgttcctgtacccactgacgatgttacactattagaaaatatgctttctacatcggtttttcaaccgatgttgaaagtaccgacgttgatagtattatcgttaacatcggtttttcaaaaaccgatgttaacgtaa

SEQ ID NO: 3428 - DNA, 288 bp, Glycine max
  Peptide Sequence Number=SeqID_120206
atgatagcacgttcacacaacccttactccccctatcttttggcatatgatgatggaggcggtggtggtggatcaaagcaagtacggatgaaggagacatcttcttcaactctggtaatccttgattccatagcatcgaaccgcatgttgtcgcaacgtgccctttcgcgggcgagcgaaggcgaggctcacgggtgcgctttccgaaggaggaaaggtgcgcggagttgccaccaacgtttatttgtggaaaacgtcggaaaaaccgaaggaaaccggtcaaaatga

SEQ ID NO: 3429 - DNA, 1149 bp, Glycine max
  Peptide Sequence Number=SeqID_120207
gtcgactctagaggatcccacaggactacacgtcctcgccattagaggactacacgtccgcaccttgagagggctacacgccctcgccgtcagaggactacacgtcctcgccttcagaggactacacgtcctcaccttcagaggaattcacgtcctcaccttcagaggactacacgtcctcgcattcagagggctgtacgacctcgccaacagagggcaacacgccctaacctttagaggactacaagcccttaccttcagaggactacacgccctcaccttcagaggactacacgtcctccccatcagagggctacacgggctcaaccttagaggactacacgtcctcaccatcagaggactacacgtcctcgccttcagaggactacacgtcctcgcctttagaggactacacgtcctccccatcagagggctaaacgccctcacctttagaggactacacaggactacacgtcctcaccttgagagggctacacgccctcaccttcagaggactacacgtcctcgccatcacagggcaacacgtcctcaccttcagaggatttcacgtcctcaccttaatagggctgtacgacctcgccatcagagggcaagacgactacacgtcctccccatcagagggctacacgccctcacccttagaggactacatgtcctcgccatcagaggacttcacgtcctcgccttcggaggactacacgtcctcgccatcggaggactacacgtccacaccttcagaggactactcgtccacgccttcaaagggctgtacgacctcgccatcagagggctagaggccctaacctttagaggactacacgtcctcaccatcataggactacaagtcctcaccttcagaggactacacgcccttgccatcagagggctacacgccttccccattagaggactacgcgtcctccccttcacaagactacatgtcctcaccatcaaagggctacacgccctaacctttagaagactacacgccctctccttcagaggacttcacgtcctcaccttcagagggctacaagccttcacctttagaggactacacgtccttgcatttagggggctgcacgccctcaccttcagaggacttcatgtcctcgccatcagagggca

SEQ ID NO: 3430 - DNA, 497 bp, Glycine max
  Peptide Sequence Number=SeqID_120208
atggcgcgcacaaattatggtcattctgcgcctttccatccaggctcaatcgtgtccgatggcacgcagagacaaattatggtcattctgcgcccttttgtcatccagaggcaatcgtgcccgatgacatcgagtcgagtgataaacgcgcagagacaaattatggtcattctgcgccctttgtcattcaggagcagcgagtcgagtgataaacgcgtagagacaaattatggagcagcgagtccagtgataaacgcgcaaagacaaattatggtcattctgcgccctttgtcattcagaagcagcgagtcgagtgataaacgcgcagagacaaattatggtcattctacgccctttgtcattcagaagcagcgagtcaagtggtgggcagagacaaattatggcccgatcgtgtccgatggagtgcagagacaaattatagtcattctgcgccttgtgtcaaccaagaggaacgaattcggtagtatcaggatgat

SEQ ID NO: 3431 - DNA, 198 bp, Glycine max
  Peptide Sequence Number=SeqID_120209
atggtgagcgaaatgaccataatttgtctctacatgtcatcgggcccgccgcctctagatgaaaaaaggcgtagaatgaccataatttgtctctgcgtgccatcagacacgattgtgtctgaacaacaaaagggtcagtatgacaaagattgtggggtggccgacaaaagcgaggttcttgctcctacgtatccttaa

SEQ ID NO: 3432 - DNA, 132 bp, Glycine max
  Peptide Sequence Number=SeqID_120210
atggcgccaaaaacgtgttcgctggttctggcaagtgtaccggatcgcacaagtagtataaaacggtgtataaactatctgtgcaaaaagaaagaaaatcacgtgagagaaatgatgtgtaaaaacaagtag

SEQ ID NO: 3433 - DNA, 246 bp, Glycine max
  Peptide Sequence Number=SeqID_120211
atggatcacatcgccgcacaacccttcgtcgccgttgctcgcgccaagggaatgagcgaaacacgggtgttatggcggcatgtcaccggcaatgctctgttaccgacattaaacattgccggcctgctgttgggagaactgatcgccggggccttaattaccgaaaccgtttttggccgcagcgggctcggccaacttacgcagcaggcggtgaataatcaggatattgccattcttcaggccgtg

SEQ ID NO: 3434 - DNA, 906 bp, Glycine max
  Peptide Sequence Number=SeqID_120212
atgaatacgctgttgtacctcgccgtagtgctgatttggggcaccacctggattgcgatcaccctgcaacaggaaggcccggtggccattcccgtctcgatcgcttaccgcttcgccatttccgccgcggtgatgttcgccgtgctgttgctaacacgccgcctgcgccgcctcgccccgcgcgatcatctgttctgcgtgctgcagggctgctgcgtgttcggcttcaacttcttctgcttctaccacgcggcggcctacatcagcagcgggctggaatcggtgatcttctcgatggcgccccaacctgctgccggcggcgctgctgggtttgaccggcatcgtggcgctgttttggcaagatctggccgccacccgcatggcgccggagctgctcaaaggcatcggcctgagcgcgctcggcacctacggcttctcgctgggcaacatgatcagcacgcgccatcagcgccgcgggctggatatcttttccaccaacacctacgccatgacctacggcgcgctgctgatggcgctgatcgccctggcgcagggcgcatcgttccagatcgaattcagcagccgctatatcggctccctgctgtacctggcgattttcgggtcggtgatcgccttcgccgcctacttcagcctgctcggccgcatcggcgccggcgcggcggcctacagcaccctgttgttcccgctggtggcgctgaccatctcaacgatctacgaaggctatcagtggcacttcaacgccgtgctgggcctgtgcctgatcctgctgggcaacctggtgatgttcgccaagccggggctgaaatggcgacggccaggtatctcaaaacaaaactcaaccctttgaagccattggcgaatatcgttatcatcaggttttgttga

SEQ ID NO: 3435 - DNA, 273 bp, Glycine max
  Peptide Sequence Number=SeqID_120213
atgcgtttacaaggcaatgcccaattaattgatgatcaagaaactactaaatttgcaaagtggattctagatattggagatggagttattgggaatcaaaatgatggatatgctactattgaaattcctgagtacctactgattactgaatataatgaccccattgatgctatagtcaaatcaacatttccatatttatatcaacatcacagtaatcctgatttcttcaaatctagagcaatattaacttccaccaatgaaacaattgaagag

SEQ ID NO: 3436 - DNA, 963 bp, Glycine max
  Peptide Sequence Number=SeqID_120214
cgtcgttttctcagccacttcattcccgaccaccaatacgacccgccgttctccccttccccaaaaccctactacaaatcaaagaagaaccacgcggagaagaagaaaaagaacaattccgaaaacggtgatccgaacaaaaacggagccccgaaactccctttcaagtcgaaccttccgttcgacttcagatactcttattcggagtccgacccttccgttgggcccatcagcttccgcgaatcgcccaagttctccccctttgggccgggccggatcgaccggaaatggaccggtgtttccgctccggttcagggtgaaccggaccgggagagggtcgaggaggagcggaaccggattctcggagaaccgcttagtgaggtggaggggggagtcacacacaacatgttgggtgacatccataaccattggaaaaaggctgaagctgtgaggattaaatgcttgggtgtgccaactcttgacatggacaatgtttgcttccacctcgaggacaagtctggtgggaaagttatctaccgcaacattaatatactgcttctgtacagaggacgaaattatgataccaagaactgtccagttatccctctcatgctgtggaagccttatgcacccatatatcctaggcttgtgaagaatgtaattgagggtttgacgtatgaggaaacaaaagaaatgagaaaaagtgggttgaattcagatcctctcctgaaactcactagaaatggtgtttatgtgaatgtggtggagagggtgagggaggcttttaagactcaggaggttgtgaaactggactgtatccatgtgggaactagcgactgcaaaaagattggagtgaagctaagggatttagtgccatgtgtccctatcttgtttaaggatgagcagataatcctctggagaggaaatttcaaggaagagcaaccttcagattcacaatgttag

SEQ ID NO: 3437 - DNA, 1221 bp, Glycine max
  Peptide Sequence Number=SeqID_120215
tcaaggtcaagagcctaggaatcgccagtctgaaagagttaggacagttgatgggtcagctccagcgacaagcctttcgcaaagcttatggtaagatctgcgacctaaccatggccgagttaacacccacggtggaagagtttgaagagatcctgggatgccctttggaaggaaggaaaccatatctcttctcgagattctatccctccttagctagaatttctaaaatagtcaaaatctcggcacaggaattggaccgcaggaagcgagtcgaaaatggggtggttagggtaccaaggaaatgtttggaagcaaaggcgagagtcttggcaagtcaaggcgaatgggccccgttcattgacatcttggcacttttgatcttcggggtggtcccctttccaaatgtggatgggttggtggaccgggcagtgattgatgcttttctcgccttttacgaccgcaaggaaagcccggttgtcgctatcttagccgatctatatgacacattcgaccgaagatgtgagaagaacaatgcaaggatcgtttgctgtatgccggctctctacgtatggggttgcatcaattacaatcccgtcctcgctataagacaacttggttatcctatgagaggggcgccatcagaggaaggcctcataccttttattgtacgaggtttcaatagcaccaacacgggggtgcttcagagggtccacaaggcatgcaacgggcccatcggcggttacaataggtggttgaaagcctacgcacaagatctgaattggctcccgagtttgaggacccctaaggggatggagattgaaactccggaagaagacgaagagaccaagagggcccgtagggaagaacatggccggaacaaattccgaggggctctgtggggcagtaacagcgagcttaagctccgaagagaagaaagggaccaatcgcgagtagacagtttgatcttgaaggatgaattgaaggtttgcctaaggtccaagaggagcttgtctcagcggttaagcgagaccgaaaccaacatgttagccatcattagcaagtaccaagaagaattaaatctagccacggccaacgagcacaaagtagcagacgaatatgcccgagtgtacgcggaaaaggaggctagaagaagggtgatggactcgttacatcaagaagcaacgatgtggatggaccggtttgctcttactttgaacggga

SEQ ID NO: 3438 - DNA, 102 bp, Glycine max
  Peptide Sequence Number=SeqID_120216
atgaaggacgaaaatacatctccaactaacacaaggcaagatgtctcgtatcgccacgaccaagagttgttgcatcaaaacgtggcaatcatgagaatttaa

SEQ ID NO: 3439 - DNA, 234 bp, Glycine max
  Peptide Sequence Number=SeqID_120217
atgacttactttggagtcattgaagaaatctgggagcttaattatgttaaattggttgtgtgtgtttttaagtgtaagtgggttgatagcaatatcggtgtgcaaactgatgattttggatttactttggtagatctaaataagttagcttatcaggatgtgtctttcatcatggtagaacaagctaagcaagtgttttatgttcaagatccttgtgatgaaaggtggttttga

SEQ ID NO: 3440 - DNA, 390 bp, Glycine max
  Peptide Sequence Number=SeqID_120218
atggcattagcgcgtgacttttgtaaggaaacaacccatggggcattttggtttagaataggtagcaaaatacctttggcaatttacactttgggtatgatagcaaaatacttggatgtattagaaataccaggatgtgcacgtatgcaattttcgatagccaaagtgcttagagtatgcatgaaatggccccgaggaagcttgcctcaaagaggtccaggaaggacaaggcagccgaaggaactagttccgctccggagtatgacaatcaccgctttaggagcgctgtacaccagcagcgcttcgaggccatcaagggatggtcgtttctccgggagcgacgcgtctagctcagggacgacgagtatactgatttccaggaggaaatag

SEQ ID NO: 3441 - DNA, 936 bp, Glycine max
  Peptide Sequence Number=SeqID_120219
atgaacgcggcgcgggcgaaacccaggcgtgcggcagcggcgcctgcgccgcagtggcctgcggcattcagcagggcattctggcggagaaagtgcgcgtcgatctgcccggcggcacgctgcatatcgcctggaaaggggccgaccgacagcgcggttttgctggacgatcaggcggtgagcgcctggctgcgtcacaaccccgatttctttattcgcaatgcgcgccaggttgagcaaatgatggtgccgcatccggtgcgcggcagcgtatcgctggtggaatggcatatggcgcgtcagcgcaaccacatccagcagctggaagaggagattacgctgctgatggagcaggcaaccgccaatcatcagctgttcgatcgcctgctggcgttgcagagccatctcgcggcggccgatagcctgcaggagatgctgacgcgcctgcatcgctgggcgcgcgagcttggcctggcgggcgctaatgtgcggctgttcagcgaccgctggcgcatcggcgcaccctccgatttcacccagcttggtctgtcacgccaggcgtttgagccgctgcgcatccagcgctttggcaaaagccgtcggatcggtggcgatgtcgctgatgggcgagcagggcgatctcggcgtactgctcttcagcagccgcgacaaccagcactatcaggcgggcatgggcacgctgctgctgcagcatctggcacaaatgctgcccgacctgctgtctcgctgggtggagcgcgcatgagcagcgccagcccgctgttgccggccgttgagggctttctgcgctatctgaaagtcgaacgccagctcagcccgctgacgcaaaagaattaccagcgccagctgcaggcgcttatcgccatggcggatgacatgcacattaccgcgtggtcgcagctggaaccggcacag

SEQ ID NO: 3442 - DNA, 219 bp, Glycine max
  Peptide Sequence Number=SeqID_120220
atgcctaaatcatctccaaacatgcatgtgaaccaagaagtatcaacaagagtcaagtcaaggctattgtgcaagcaatcaatggggcaaaacacaccgaataaaatagatgatgatggctcaaaatctcaccaaggagaaaaacagggatttcaattcacaaaatgccaagaaactcctatttcaaaaacaattacccattacctgtacataaactag

SEQ ID NO: 3443 - DNA, 363 bp, Glycine max
  Peptide Sequence Number=SeqID_120221
atgatgaaggtctatgggaaaacattcctacaggctgagtgcgaaagtaatgctttgtttaatgtgatcatggccacagatccgacgtctcccccgcagtccgatggtcaatcagaggcgacttccaagaggagtagaacaacgacacggttgagaacattgacattaagaaccgtggatcagcccagaccggcagtttatgtggatcccgctaccgggagagcatcgggaccgatgcgtgaaaagttccacagctacctaggcgtagtggcgcgagaaaaggttcccattatccacaataattggaaagacgtacctgaaacgctaaaagacatagtgtggaatgacattctattgatttga

SEQ ID NO: 3444 - DNA, 336 bp, Glycine max
  Peptide Sequence Number=SeqID_120222
atgtccaagatcgatcaaataatgttacgctttcgccctatcgcccccaaacccctcccctccgccgccgccctttccgacgctttctcctcggaaaacaccggcgtctccaagcggaaggataacactggcagcaagcggtgcagtcgagggatccgccggaggagaaacgcgcctcctcctcctcctcctccgcctccggcggtgactctcccgctgctaccggaaactccagatccgaagaaaactacctccgaactaaagaacaagaacgtaccggtgtggctgagcttcgaaaacagcttcaagaaccgcggcggtactgcttctgagaag

SEQ ID NO: 3445 - DNA, 495 bp, Glycine max
  Peptide Sequence Number=SeqID_120223
atgccggacagcgccgcgacctcgcggatatccagttctttcatgattgacttaaacctcgctttaagttgcacactcgtcgacagagtagcattgacgcataaaaggaagaataaattgaagatgattgttgctgtgcaaattttgctgacgggcctcggcgccacgttagtcatggatttatggtcgctctttcagaagcatatactcaagattgcgccgctgaactatgcgctggtcggtcgctgggcgttatggctttcgctagggaaagtgcggcataacaccatcgccgcaacccctccgctagagggggagcgttttatcggctggttatgtcattatctgatcggtatcgcttttgcggcggtgccgcttgtgttgagcggcgccgattggttttatgcccccactctggcgacagcgctgctcccgcatttggttttggcgtcgcggcctcacggactccccgaccatggctggcgcgttcgctga

SEQ ID NO: 3446 - DNA, 930 bp, Glycine max
  Peptide Sequence Number=SeqID_120224
atgaccaacccgatcaccatcaccaccgctccctgctgctggggtgtcgacgacgtcaagaacccgcatcttccccattgggaaagggtgctggacgaagcgaaagcagccggtttcggcggtctggaactcggcccctacggttatctgccgctcgacctcaggcgcgtttcgcaggcgctggatgaacgaggcctcaagatcgtcgccggcaccatcttcgacgatctggtctcacccggaaatcgcgacaatctgctacgccagactgaggagatctgcgcgctgataacgcgcctgccaaagccggaaacccatgcgggccaacgtttttccgccccctatctgacggtgatggactggggccatgacgagcgtgattatgccgccggacattctgaccgcgcgccacgtctcgataaaaccgcctggcggggcatggtcgagaacatccgggccatcgcaacgctcgcccgggacaaatatggcgtgcgcgccaccttacatccccatgccggcggctacatcgagtttgccgatgagttgcagcagatcgttgaggacattcccgcagatcttgcgggtctctgcctcgataccggccatatggcctattccggcatggaccccgtcgccacgttgcgccgctattgggatcgcgtcgactacattcatttcaaggatatcgacgccgcggtctttcaggaggtgatggcggagcgcatccgcttcttcgaggcctgcgccaagggcgtgatgtgtccgatcggccgcggctcgattgactatccagccatccgcagcctcctgaccgaacttggttatggcggctatattaccatcgaacaggaacgcgatccgcgtaatactggcagcattctcgatgatctggcagccagcagggcatttcttgcaaaaagcggcttctga

SEQ ID NO: 3447 - DNA, 182 bp, Glycine max
  Peptide Sequence Number=SeqID_120225
atggcgaaagaagttcttccggtagcttctctagaagaaggttcttccggtagaagaaaagttctttcggagaagctaccgaaagaacctcttccggtagctttaccgaaagaactttctttcggtagaatgttttgttatatcggaagaaggttcttccggaaaagctactggaagaactt

SEQ ID NO: 3448 - DNA, 586 bp, Glycine max
  Peptide Sequence Number=SeqID_120226
atggcgccagttctgatggcgccacgtggccaaggaagcgccattcccagcagcgttttcgcttttgctgagctggctttggaagcgccagcagcagtggcgacttcaggaagcatcagtcaatacagcgttttcacttttgatgctttggaagcgtcattggtacctgcgatttgcatggaaacgccaatggtgatggcgtttgaaggaaaatatattgccttgcaaatttgtgacgacgaagacattgaaacaatgttggaaagttttaaacaacaagacgaaatgtcagttctggaattgtacatagaaaaggatgtggctagtggttcaatgtttcattctgccaattcgcttacatcatgtggaaattatttatctaatgatgagacacaaccggcaacaaatatgagtaatttacatattgaagaagacgatgatgatgatgatgatgatgattatcttgtgtctaactcatacgttaaagagtctttagacgaagatgacagtgttgacggtatatctgacacagacgatgaagtcaccaacattcctcaactagtaagaattgttcacccaacagaag

SEQ ID NO: 3449 - DNA, 180 bp, Glycine max
  Peptide Sequence Number=SeqID_120227
atggcaccagggaagcttcacggcaacgcaacaatggcatatggcatgcgcggaggaagaagaaacgaagacaagaagaaagaagggcaattttgccatttcataaaattgttgagtgcaccagaaacattgttgggtgcacctagcatgtcccttcttaaaatattgaaattgatttaa

SEQ ID NO: 3450 - DNA, 147 bp, Glycine max
  Peptide Sequence Number=SeqID_120228
atggttgaataccgtgccaaatccaagacagagatgaatcgaggtactcggagacgggcacgaatggacactaggcccgtgatcaacagatcgttgtcccgcgtccggctccagacgatcgagaagcgctactgggaggcaccctag

SEQ ID NO: 3451 - DNA, 786 bp, Glycine max
  Peptide Sequence Number=SeqID_120229
ggactacacgtgctcgccttcagaggactacacggcctcaccttcagagggctactcgccctcaccttaaaaggactacacgtcctcgcctttagagggctacacaccctcgcctttagaggtgtacacgccctcgcctttagaggactacatgtcctcaccttcagaggactacacgtcctaaccttcagagggcaacacgcccgcaccataaaggcctacacgccctcgccatcagagggcaataaaccctcaccttcagaggactactcgtccctgccttcacaggactacatgtcctcaccttcagaggactacacgtccctgccttcagagggctacacgtcctcaccttcagatgactacattggactacatgtcctcgccttcggaggactacgcgccctcgctttcgtggggctacacgcccttcccttcagaggactacacgtccttgccttaagagggctacacactcttgcctttagaggagtacacgtcatcgccttcagaggactacatgtcctcaccttcagaggattacacgtgctcaccttcagagggctacacaccgtcaccttcagaagactacacgtcctcaccttcagagggctacacgtccttgccttcagagggctacacgcccttaccttcggaggtgtacacgtcctcgcctttgtagggctacacgcccttgcctttagagggctacacaccctcgcctttagaggggtacacgtcttcgcctttgtagggctacacgccctcaccttcaaaggactacac

SEQ ID NO: 3452 - DNA, 978 bp, Glycine max
  misc_feature (130)..(130): n is a, c, g, or t
  Peptide Sequence Number=SeqID_120230
atggtcgttgtgatcgtgcgtggccagcacggcgtcgagctgggtgatggcgaacgggtcgagtacgaatggggtggtgcgcaggttcggctgcagtttccgcaccccggccatgcgctgcatttggtgnccggttttcatcagcgggttgccgtggctctgcttgccggtgccacaccaaaaatcgacgcacaggttggcgccttcttcagacttgagccagatgccggtgcagcccagccaccacatggcgaaggtgccgggcgcgactttctcctgctctatctcttcgttcagccaagtgccccattcgggaaaggtgttcaatatccaggactcgcgggtgatgtcgttgactttactcatgggtctttcctcgttggtggtgatgaccaatgcaccgctgctgctggggctggttacactgctgggttacacgttgctgcgcaaaagcgcggcggtcatcatcaaaggcaccatcaagaccattatcggtttcatgttattgcaggccggctccggcatcctgaccggcacgttcaaacccgttgtggcgaagttgtccgaggtatacggcatcaacggggcgatttcggacacctatgcttcgatgatggccaccatcgaacgtatgggggacgcctacagctgggtcggctacgcggtattgctggcattggcgctgaacattctctacgtactgctgcggcgtattaccgggattcgtaccatcatgctcaccggccacatcatgtttcagcaggtcgggctgatcgcggtatttttctacattctgggttacggcatgtggacgacggtattgtgcagcgcgctattggcttcactgtactggggcatcacctccaacatgatgttcaagccgacgcaggcggtaacggaaaacagcggcttctcgatcgggcatcaacagcagttcgcttcgtggctggcctacaaggccgcaccgtatctcggtaa

SEQ ID NO: 3453 - DNA, 167 bp, Glycine max
  Peptide Sequence Number=SeqID_120231
atgcgatgaactcgctaagcgagcatgctgcgctaagcgagttcatctatactcattgtatagaggcgttctctgaagaactagctaagcgcgattaccgcgctaagcgagttcatcctttgaggatgaatatttatcctcttgttgaactacctgtggctaagtga

SEQ ID NO: 3454 - DNA, 321 bp, Glycine max
  Peptide Sequence Number=SeqID_120232
atgaggattcttttttataggccaaggttcaaaaagtctaaggttgtgtttcaatggggtcttttatcgtgggaacccaatcttgatatctggggtgaaacaaatttgggtgtcaaggtgtcgatttcgggtcgagcttccatattgttccataaggcacgtgtgacaatgatgattcgaaaacaacgtgcaaaattagtcatggctacagccaggtgggcactcaagcatcccgtttatggcattgtgatactacggttgggaatttacacaaacagacccaacatttccaaaaaattatgcacctatggtcctctatga

SEQ ID NO: 3455 - DNA, 807 bp, Glycine max
  Peptide Sequence Number=SeqID_120233
ctcgcgaaggacggcgcccgtgcgttctacgaaggggcgctcgccgagcgaatcgccgcgttcgcgcgcgaaggcggcggcgcgctgacggaagccgacctgcgcgcgtaccggccggaatgggtcgagccgatcggcaagcgcttcggccgccacacgattcacgagattccgccgaacgggcagggtatcgccgcgctgatcgcgctgggcatcgccgagcatgcgggcgtgaccgaatggccggtcgactcggtcgattcgcagcatctgcagatcgaggcgatgaagcttgcgttcgcggacgtctatcgctacgtcgccgatccgcgcgcgatggaggtcacgcccgaacagatgctcgacgatgcgtatctcgccgaacgcgcgaagctgatcgatcgcgcgcgggcgacgcacttcgccgccggccgtccgcattcgggcggcacgatctacctgtcggcggccgacgagcgcgggatgatggtgagcttcatccagtcgaactacatgggcttcggttcggggctcgtcgtccccggcacgggcattgcgctgcagaaccgcgggcacggcttctcgatggacccggcttcgccgaacgtcgtcgcgggcggcaagcggccgttccacacgatcatcccggcgttcgtcaccgaggaagccaatggccgcaccgaggcggtgatgagcttcggcgtgatgggcggcgacatgcagccgcagggccacctgcagaccatcgtgagaaggctcgactaccaccagaacccgcaggccgcgtgttgcgcgccgcgctggaag

SEQ ID NO: 3456 - DNA, 150 bp, Glycine max
  Peptide Sequence Number=SeqID_120234
atgaaccccaacgggtgcagagaaacgcgaggaactggaaccagagaggtggcacgcaaaccgaggcaggatttcaacatccaaaaagctccaaaattcctcctcatttctactccaaattgcaaggagaagccattttcggagtcttga

SEQ ID NO: 3457 - DNA, 567 bp, Glycine max
  Peptide Sequence Number=SeqID_120235
gctaagcgcgagtctgccgcgatggcatctaagaaaaggaaggctccttctacaccttcccaagtcagatatgatcagtctaggttcacatctcaagaagcttgggagagatatactgatataattgtgcctaggaaactattaccagagagaaatgtagtagtatattacactgagtttgatgagttcaaggaggaactcaagagaagacactgggatgaggagttgactgattttgctgactgcagcatagatgttgccattgtgaaggaattttatgcgaacctctatgaccccgaggataaatcacctaagggattcgagctaaacgctgatggtcagcctttgaagatattaaggaagaacataaccaatttagctcagacatggagcattctttccttctctaacttgattcctacctcccacacatttgatgtcacattagatagagccaagttaatttatggcatcattatgaagatgcatatgaatgtgggctctatgcaaggccagaggaatccaatcagattcaagatccctgaagagcctgagcattgccattaa

SEQ ID NO: 3458 - DNA, 234 bp, Glycine max
  Peptide Sequence Number=SeqID_120236
atgacggacatcactgacgacatagcggaggaaatctccttccagggcttcgaagatgactgtaaattgctagggaaccttctcaacgacattctccagagggaggctggctccaccttcgttgacaagctcgaaaaaattcgagtcctttcacagtctttggttttgttcggttgtggagaaaatgggcgaaggttgaaacatgacatgcgtaatgcatttagactttcatga

SEQ ID NO: 3459 - DNA, 780 bp, Glycine max
  Peptide Sequence Number=SeqID_120237
atgcccttaccttcagaggactgcacctcctcaccttcagaggactgcccgtcctcacctttagagggctgcacgccctcgccttcgaagggtgacacaggactacacgtcctcgccaccagaggacttcacgtcctcaccttcagagggctacacgccttcgcctttagagggctgcacaccctcgccttcagagggctgcacgcccgcaccttcaaaaggcaacacgtcctcaacattagtgggctacacgcccacgcctttagaggactacacgtcctcgccttcacaagacttcacgtcctcaccatcagagggctgcacgccctcaccttcagaggactgcacgtcctcaccttcagaggattgcacgtcctcacctttagagggctgcacgccctcgcctttagagggctacacgtcctcacctccaaagggctgcatgccctcgcctgtagaggactacacgtcctcacctccaaagggctgcatgccctcgcctgtagaggactacacgtcctcgccttcagaggattgcacaccctcgccttcagagggcgacacgtcctcaactttagtgggctacacgcccacgcctttaaaggactacacgtcctcgccatcagaggactacatgtcctcgccttcagaggacttcacgtcctcaccttcagagggctacacgccttcgccttcgtaggacttcatgtcctaaactttacagggctacatgccctcacctttagaggtctacacgtcctcattttcagaggacttcac

SEQ ID NO: 3460 - DNA, 1899 bp, Glycine max
  Peptide Sequence Number=SeqID_120238
atggacatgcgtcagccggatacggtgaagggcgcactggcctatacgccaggtgtgatgattggaaatcgcggtgcctccaccgcctatgatgcagtgaacatccgtggtttcagctcggtaggtaccaatatgtatctggatggcctgaaactgcaggacgataactattcgatttatcagatagacccttacttccttgagcgagcggaagtactgcgcggaccgtcttcggtattgtacggcaaaagcaaccctggtggggtggtcgcgctggtcagtaagcggccgacaacagagacgctgcgcgaagttcaattcaaaatggggacagataatctgttccagaccggttttgacttcagtgacgctttggatgatgcgggggtttactcatatcgtctgacgggggttgcgcgcgatgaagatcagcagcaggttggcgagaaaagtaaacgttatgctattgctccttccttcagttggcgacctgatgatcgcacttctttgactttcctcagcagcttccaggatgatcctagcgttggcttctatggctggttgccgaaagaaggtacggtgcaaaatggtatcaacggtaagttaccgaccagtttcaacgatggtgagcctggctataacaacatttcccgcaagcagcaaatggtcggatatgcctttgagcatagttttgatgatgtttggaccgtgcgccaaaacctgcgttattcgaaaatggatgtggactaccgttctatttacggcctaggcattgatccagataattcagctgagctgaagcgtggcgtgatgaattccaaagagcatatgtccagctttgcggtcgacacacaggcacaggctaaatttgcgaccgggcaagttgaccatatcttgttgatgggtgtggattatatgcgtatgcgcaatgatgttgtttatcaatatggcagtgcatccaatctgaatgtcatcgctccacagtacggcaatcggagctataccattaccggtggtgccagtcaggttaaccgtcaggagcagaccggcctgtatgtgcaagatcaggctgaatggaacaactgggttctgacgatgggggggcgctatgattggagcgataccaatagcaccaatcgcctgaaccagaattccgtctctaagcagcaggataaccaatttaccggccgtgctggcttgaactatgttttcgaaaacggcatcgcgccttatgtcagctacagcgaatcgtttgagccaacctcaggcactgatttctcaggcaatacatttgctgcctctaaaggcaagcagtatgaggctggggttaaatacgcacctaaggatcgtccgatcaccgccagtgtggcgctttaccagttgactaaaaccaacaataaagtggctgacttagaacatccgttctttagcgtccagggtggggaggtccgttctcgtgggattgagttggaggcgaaagcggccttgtcggctaacctcaatctgttgggctcttacacctacacggatgctgaatatactaaagatacttcgctacaggggaatacaccttccgctatccctaaacacatggcttctctgtgggcggattacaccttccatgaaactgcgattagcggtttgaccttgggttcaggcgttcgctatgttggctccagctatggtgacgaggccaatacgtttaaagtgaaggattacacggtgtttgatgccgcgataaaatatgatctggcgcgtttcaatttgcctggttcttcgattggcatcaatgtgaacaacctgtttgataaggaatatgtctccagctgttttgctacttatggctgctactggggcgcagaacgccaggtggtcgccaccgcaaccttccgtttctaa

SEQ ID NO: 3461 - DNA, 258 bp, Glycine max
  Peptide Sequence Number=SeqID_120239
acttatcaaggtaatcctagtggcgtctacccagacttatcttccttaaccggaggtggcgtctacccagacttatcttccttcactggaagtggcgtctaccctgacttatcttccttcaccggaagtggcgtcatccaaatcttcgtaacctgtatcaagcgatccgctcctactcaggttcacatcaatgccggtgtcggccgacacacaacttcggttgagctagtacgaaaaaacctaatcgacgtacattga

SEQ ID NO: 3462 - DNA, 411 bp, Glycine max
  Peptide Sequence Number=SeqID_120240
cagatgccactttactccaagttcttgaaggatatgttaacaaggaaacataagtatattcaccaggaaaacatcatagtggaaggaaattgtagtgctgtgattcaaaagatccttccacccaagcatatagaccctgggagtgtaactattccttgttcaatgggagaagtcactgtgggaaaggctcttattgacctaggagccatagaactcgctaagcgcacctactgcgctaagcaagtttatcatttgaggatgaacactcatcctcttgctgaaatacctgtggctaagcgagccctgcttgctaagctcccatacttagtgtattttgtgaattgtatggtgccgctaagcgcagcctatgaggagctgagcgcatatccttgcggcagacatttggcttag

SEQ ID NO: 3463 - DNA, 240 bp, Glycine max
  Peptide Sequence Number=SeqID_120241
atggcccttcgctcagcaaacatgcacaactcatccttcttccagattcttcctcgtgctcaactgaggagttttgcgctcagcggatggctcgctaagccgacaggttggcttagtgagaggaatcagaaggactttcccaggcttgtagtgaggcttggctacaaaaattcattggtttttctaggattcaaaggcttagattcgaagagagcacaaatcctagacttatccatgtga

SEQ ID NO: 3464 - DNA, 768 bp, Glycine max
  Peptide Sequence Number=SeqID_120242
atggataatatcttgggaagaaacattgtgccaggaaggaaggtggagatctaccacactgagctggatgatcttaagactaaattggagaggcgtaacttccataaacgcctcagcaatttggttgatggaagcatagacttggctttggtgaaggagttctatgcaaacttatacaggtctgagggtccttcaccaaagcaagtcagggtcagaggccacctagtgaagattgatgttgacagcctcaacacattcttagagacacctgtggtgttggcagatggtgagactttgcccacatactccaaatattgcaggctgcctatagattacagagagattgaggctgccttatgcataccaggccgagggttcatcttgaacattgaaggccatcctgggaagattcttaggaagtatttgactactctagctcaggtgtggagtgttctctcatactcaaacctggcccccacatcacatatctctgatctgacagtggacagagctaggctaatctttggcctagtctctcgcatggacatgaatctactatccgaggggctaggagggcgagggcgagaccagttgagctttcttccacatttgcagctcctactccaacatccactccgacagctccttctatcccagctcatacagattctcagtgctttgaagccatgcttcagagcattcattagggacaaatcattttattacagagtttacaggtggtggcacctccaggatctattcctttag

SEQ ID NO: 3465 - DNA, 172 bp, Glycine max
  Peptide Sequence Number=SeqID_120243
gaggtttctggactatggaaagctaaatcctttgttggatcttccctataggtacctgattggaaactggtctgattctaaagtccttgatagaatctgtgaatgtggcttgatcaggactaggctaggctatcatgaggaatcaggtctagcagtccaggagacaacatag

SEQ ID NO: 3466 - DNA, 319 bp, Glycine max
  Peptide Sequence Number=SeqID_120244
atggtcgctggggagaatgttgctaagcagcaacgtcatctagatctacgtgagggtggtgatgctggtgcgcatgattcgcacccgtctccttgctacgctccgggcaaagtcctacctcggaacgcacagcaactggctgatagcctcctcgtcgaagccagaggcctcactcctccgctgggaaaactcacaacgctggccttcttccaagatcaatggatgccccagaaactggttgatggcatcctcatcgaaaggaacccattggcccctcacccaggagcacttgtctctgactccctcttctgtaggccaa

SEQ ID NO: 3467 - DNA, 829 bp, Glycine max
  Peptide Sequence Number=SeqID_120245
gtgtacacgccctcgccttcagaggactacatgtcctgcccttcagaggactacacgctacacgccttcgccttcacagggctagatgccctcaccttcagaggactacatgtcctcgccttcagaggactacgcgccctcgctttcgtggggcttcacgccctcccttttagaggattacacttcctcaccttcacagggcttcacgccctcacctttagaagactgcacgcccttgccttcagaggactacatatcctccccttcagaggagtacatttcctcacctttcgaggactacacgtccttgccttcagatggctacacaccatcaccttcagagggctacacgtcctcgccttcagaggactacacttcctcgccttcaaaggactacacgtcctcaccttcagaggactacacgtcctcaccttcagagcactacacgccctcaccttcagagggctacacgccctcaccttcagaggactatacgtcctccccttcagagggctacacatccttgcattcagagggctacacaccctcacctcagaggactacacagggctacacgccctctccttaaaaggactacacgtcttcgactttagagggcttcacaccctcgcctttagaggtgtacacgccctcgccttcagaggactacatgtcctgaccttcagaggactacacgtcctgaccttcagagggcaacacgccctcacgttaaaaggactacacggcctcaccttcaaagggctacacaccatcaccttcagaggaatacacgtcctcgccttccgaggacaccacgcacctcgctttc

SEQ ID NO: 3468 - DNA, 450 bp, Glycine max
  Peptide Sequence Number=SeqID_120246
gtcgactctagaggatcccacccagtgcggccgcaaccggtgcgcgcaggcgcaggcggtgcaggaacagggcgagtacggcctcgtacaggcgcgtaccgtggccgaaacgcagcagcagttcaccactggcacgcacgtgttccagcagcgaacggcgttccagtaccggtgacggcagcaggctgccgaagcgctgcgagcggccccacaaccagcccagcagggccagcagcagtggcgcccacagtggccagccctggtagaacatgcgcgaccacagcgacggcgggcggctggcgtagatcagccagaccgcacccttgccgtagttcggatcgagcagatagcgggtcaggtcgcggtgcgacgcgtcgtgcaggccgtcgctggccttgccccctgccgatgccaggcgcgctgccggtgagtccacctcgctgcgcatga

SEQ ID NO: 3469 - DNA, 973 bp, Glycine max
  Peptide Sequence Number=SeqID_120247
atggctcagaaaaagctttccgagaagagatctaggagggacgccgcggctgaagggactagtgccgctcccgagtttgatagccactgtttcaggagcgccgagcatcagcagcgtttcgaggccatcaaaggatggtcgttccaccgagagagacgcgtccaactcaggaatgatgagtacaccgactttcaggaagagatagctcgccagcgttggacgtcgttggtcactcccatggctaagtttgacccagatatagtcctagaattttatgctaatgcttggcccacagaagagggagtgcgggacatgcgatcatggccagttcctggggacccgctagtgctggaggaaggccaggagtgtgagtttagtcagaggaggaacagggccgatgggtttgacgaagaggccattgcccagctgttatgcataccaggtcaggatttcgcccagactgctgcagggtggcgggtgaggatcatgcacaccagtataaccaccttgacccaaatatgtatgacgttgctgcttagcaatgtcctgcccagtgatcataactccgaccttcctctgccaaagtgtcagttggtgtatgccatcctgacacggatgagcgtccatgtggctcagttgattgctgatgccatctatttatttgcaggtatgtcacccaccaggcaccctctagacccggataagtctaacagggccctagggtttccaaaattgatcacgggcctctgccagtcattcggggttcccgtcacacctagtaaggtgatccggccgccgatcacccgagccttcattgagaagtattgcacgcctaggcaggcgcagggtgatgcaccgcaggccgcacatgcaccaccaccacctcatcaggctgatcctgctgagtcattaggcatggagcagtatctacaacacttggttcgccaacaggcggccaaccacacaggggcag

SEQ ID NO: 3470 - DNA, 429 bp, Glycine max
  Peptide Sequence Number=SeqID_120248
ccggaggtagggtccagcggctggaagagcaccgcacgtcgcgtggtgtccgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggctttggcggaaatcagcggggaaagaagaccctgtttga

SEQ ID NO: 3471 - DNA, 653 bp, Glycine max
  Peptide Sequence Number=SeqID_120249
ggtggacccttgggtacttgtacctatcaccttgagaggactacatgtcctcgccatcagaggactgcatgtcctcaacttgagaggactacatgtcctcgccttgagaggactacacgtcctcaccttcagagggctgcacgccctcacctctagaggactacatgtcctcgccttgagagggctacacgccctcaccttgggactacacgtcctcaccatcagagggctgcacgcccttacctccagaggactacatgtcctcgccttgagagggctacacgccctcaccttgggactacacgtcctcaccatcagagggctgcacgccctcacctccagaggactacatgtcctcgccttgagagggctacacgccctcaccttgggactacacgtcctcgccatcagagggctgcacgccctcacctctagaggactacatgtcctcgccttgagggggctacacgccctcaccttgggtactagttaccctcaccagggctacacgccctcaccttgggtactagttaccctcaccgttgagaggactacacgtcctcgccttgagaggactacacgtcctcaccatcagagggttgcacgccctcacctccaaagaactacatgtcctcgccttgagaggactacac

SEQ ID NO: 3472 - DNA, 318 bp, Glycine max
  Peptide Sequence Number=SeqID_120250
atggatgacgcacccgtgagcctcgcctcgctcacccgcaaaaggcgggttcctaagattcctcaagcttttcttcaagttgctctgctagggtttccaagcattagagagaaggagaagggattggagcctcaattttactatctccaagagaggggaaattctctatccttagacattatttcacaaattccaacggtgttcatttttcaaaatgagttgcgaaggaacaaggccaaattggttgctaaagaatacaaccaagaggaaggtattgactatgatgagacctatgcccctgtggttggaagctattag

SEQ ID NO: 3473 - DNA, 408 bp, Glycine max
  Peptide Sequence Number=SeqID_120251
atgccgttgaaggtcaagcagttggtggtgtgccctcagttcctcccacaaccacaacccttgcattttgtggcgggaagaatccctcttactatggcggagaagggaaagttggatcatataaaggaaaggcttagagcctttgaaggaggtggaagttatgttttcgctaacacaacggaattgtgcttagtgcctaacatcaccatccctctgaagttcaaggtgtccgacttcaataagtacaaggggactacttgccccaagaaccacctgaagatgtactgtaggaaaatgggggcatacacaaaagatgaaaagctgttgatctacaaaacttgtgctaaagggagcatgaatctttcaaagggtacgcccaaaggtggatggatatggcagctccagtag

SEQ ID NO: 3474 - DNA, 183 bp, Glycine max
  Peptide Sequence Number=SeqID_120252
atggagattacgtggaatatctacaaactcttggcatcgtcttcacctcatggcattgggctttgtcctcgtttcatggtagttcccccccccccccccgaattaggaagttcttgtaatatcagttttagcctagggacgtatggcaagtttgtggcaaattatgctgggatggattcctag

SEQ ID NO: 3475 - DNA, 879 bp, Glycine max
  Peptide Sequence Number=SeqID_120253
atgcccggttggcggcgcgtttcgctcagcgcgtacggcgaggcggggaagtgcttctccgtggggagtgtgctcgaaggcctcgaggccgtccgcaagcgccctggcatgtacatcgggtcgaacgggtcgcccgggctcatgcactgcctctgggagatcatcgacaacggcgtcgacgaggccctcggcggcttcgcccggcgggtcgaggtcaccctgcaccccgacgactccgtcgaggtctacgacgacggtcgcggcatccccaccgacaaggagcccaagaccgggctccccggcgtcgaggtcgtggcgaccaagctccacgcgggcggcaagttcggtggcggctcgtacgtcgccaccggtggtctgcacggcgtcggcctgtccgtcgtcaacgcgctgtcgagccggatggacatcgacgtcgaccgctcgccggcccgccaggggttgagcttccgccgcggcgtccccggggtcttcgcgggcgagggtccgtcggcccccttcgagccgcagtcgggcctgacccgcaagggcgcccgcgtggccaagggcaagtccggcacccggatccagttctggcccgaccgccagatcttcaccaaggacgccgagttcgtcctcgacggcctcatcggccgcgctcgccagacctcgttcatcgtgcccggcctcgagctcgtcatccgcgaccagcgcgccgccgacaagtccgagtggaccgaggagaagttccgccacgacggcggcatcggcgagttctgcgactacctcgccaccggcgacccggtcaccgacgtcctgcggctgcagggcagcgacgtgttcaccgagaccgtcccgctgctcgacgacaggggcacatga

SEQ ID NO: 3476 - DNA, 966 bp, Glycine max
  Peptide Sequence Number=SeqID_120254
atggaaccagaatattgggacaagaatcctttcaaggcaaccgccaaagtattccccccgggatttcattataggccaacagccacaaacaaaaccagaaaattctatgaattcattctaatagatacaaacttcgtatctattaaacatttcaaggaccccaaagatccaaatctaaacacccactccacaatccagatcctaaaggtgatgcagccacgacattatggctcaaacttaaaccaacccaaaaaattttctgcaccttttgaccctgcaggatataattattgggattacattgacgcctggaccaatgtgttctggcatcaaaatagtaaattcaagcattcatggctaatttacttcaaaaataacaccgtgtataattttccaaattggttcctccaatggtggaactacttcggaccaattccacagatatttccagaagaagtccaacagggattccaacaattcagcaagctcttcaacagcaaggaatcaagaattccgacagacttaaaatacttttccagttttgccatgtcatggattttttcatggcaatacagatatggaaaaaccgaaaatagcaagcagtatccaccgttgcagagacacgcctttgtaaaatggtggtcacaattcgatacctcaaatgctgctccagaacaagtcaagaactggtttcagagcaaccctgagtttctcaaacctgctgatccagagacatctttgtttctgaatcagaagtctcaacttgcagcattcttggcaagctcaaaatctaaagaaagtcttgctcagaatcttaaggaagttctccaactacttcaacaggaagaagaagaagaaccccccaagaaggaagccgaatcatccgaaaataatgatgaccaagaagatgatccattctaccagaatgaggatgactgttttggtatatcgttagacgatgattag

SEQ ID NO: 3477 - DNA, 219 bp, Glycine max
  Peptide Sequence Number=SeqID_120255
ggtgacaaggcacaagtaatacagacactgctttttgtagctggtattaacacacttctccaagcactttttggaacaagacttcctgctgtagttggaggttcatttgcatatgtaattccaattgctcatattattagtgactcctcattgcaacgaatcaatgatcctcatgaaatgacttgtagggtcccatggttttgtgcatcatggtactag

SEQ ID NO: 3478 - DNA, 549 bp, Glycine max
  Peptide Sequence Number=SeqID_120256
atggataagagcttgaaggtaggagaagatgagtggagggagagggagagggagagagggggacacgaattttatgcctcaaatgagcccatgagtccaaaatctaccctaaggctcatgaaaatcctagggcattctcctacacctctagcccaatcttcttggaattttctatctaatgcccttgggagatgtcccataaacaaatctggtcatgggtatgaaggagaaatatatgttcatgatgaggatattgttgtttattatttttgtggcaaagtaggacatatgatgtccaagtgcagggacttacctaaaaagggtgtgtccaatgcattcagaactaacaagagaggacccaagaagatttgggtacctaaggacaagattattcctgttgcagatgtccttgacaatagacaagacacaccgatcatggtacctagacaatggtttctcacgacacatgacatgagaaaggtgtatgttcaatggccgacccctatgcatggtggaactataactttcaaagggaataaaaagggctaa

SEQ ID NO: 3479 - DNA, 291 bp, Glycine max
  Peptide Sequence Number=SeqID_120257
atggtgtccatgtgttacctttgcccgagttgcagaaatagtagacaagggatccacattatatatgcagcatgtggtgctagtggggctctgtatacactgatttgttgtgtcattggttgtgggtggctatactcatgcttttaccgctccaagatgagacagcagtatggtttaaaggggaatggttgtacggattgcctgcttcattgctgttgcgagtcctgcaccctcagtcaagagtatcgtgagcttaagcaacgtggatttgacatgattattggtatgtaa

SEQ ID NO: 3480 - DNA, 601 bp, Glycine max
  Peptide Sequence Number=SeqID_120258
gttggtggaaaatagcacggtggccggatttgctcaggctgatgcaaattttgttcagtctcagcggaatagggagcttgtattctatcggctcttccccgagaagatcgataagggtcgtgctgccgacgcaattgactggatcgtggatcggcttcgagacggtaatcgagtggcgactccgcgcgatctaattaatgcggttgatgcggcacgcacttatcagttggaagattttaatagagagccgtctgcctcgatggatggtccgttgctctacgaggactcgatcagaaagtctgtaagaaaaatatccaaggacaatctcgagactcgaatctatgcggagtatcctgatctgcggagtgcgatcgaaaagtttaggggcgggaaggcggatcacaacgaggtgactctcgcggctctcctgggaaagggttgggcgaatatattgagtcagttgcttcgaattggtttcatgtacaagcgaacgcgttctggcgttgatatgtggactattccattcttcttcagttttggtttggatgtgacgcgaggggccgcatttgaaatggcgggatcgaatgatgacgaagattaa

SEQ ID NO: 3481 - DNA, 231 bp, Glycine max
  Peptide Sequence Number=SeqID_120259
atgaaagccaacaaaacaagaaaggaattgaaagtctcggattcgaaaacttaccggttgaagaacgaagaatggatgaagaatggcggaaaaccttcacagatttgctcatggaaacgtctcagaagcgttgcggaagcccctcgacttggattttcttcacggaaacaacttttttcacccaaaacaactgaaatgcatagcataggggttagggaccccatggaatag

SEQ ID NO: 3482 - DNA, 876 bp, Glycine max
  Peptide Sequence Number=SeqID_120260
atgggaaggcaaagaacaggtcgaaactacccgaaaagtggtaagaacatttggcgcccatcatggggccaaagtggaatttcctttggccataagatatatggtagcgaccaagagcttgacactacagtcaactaccatggaagagagttcaacaatataagggtcttccaaatttctttgaagggatttgctctatcatggtggcaccaactcccttctcggatgatcgatatacaagctgacaatgagtctctacgagacttcatgggaagattttcacaaattgcagtcatgatccatgaccttgaacttggggtagcccttcacgccatgatagcagcactcaagcctggaatggaagaattgtttgagtaccgagataaggacaatgtggtaacaacaatcaacattaagtcggagaaggtgaacaaagacaacaagaaaacccaaaccccccaaggagcagttcgaggagtcatcaacactattactggtggtttcacttgtggaggttgcatgaaatcggccaggaatgtcaccttcgagcactcaaaagatgatcctatggtgatatcaattgttattgctagttggacagtccaaaaaacacttatcgaccagggaagtggagctgatattttgtatcagtctatgtccttcaatggtgattttccaccatggagatgcatgggaagacaaaggagaagaggagaggggaggcaccattcactagggaataagccatggaacaaggagcttcaccaccaagaatgtgccttggataagaagcttgaagaggatgctttaatggaggaaaataaagagagaaggggggaacacgaaattgaaggaataaaagagggagagaagtga

SEQ ID NO: 3483 - DNA, 477 bp, Glycine max
  Peptide Sequence Number=SeqID_120261
atgaagcaacaaggtcggcaaagcaagagttgtagaggagtaggaagtgtgaacattggagagcatgtagtttgcgttaaagttggtgatgttgaggacgccagaggactgttggagcaagaaaaggtggcggtagagttccatgtccatcattctctggtgcacgatgcattcatgaaagaacccagatccactcgactcagggaacccatatctgcttcttcggcatcaactttgtctagtcagtccttcaatggccttgttgattccaacaactatgccaaaggtaaaacatccaccgagtcagcatactttgtaaacctccacacgcgcttgcatggccattccatcgagtcaaatctgcttgtgttgctgctaggaggagaatttggaggctttaaaatcatgatgctggaagagatgtgtgagtgtgagagatgcggggaaggatgttggttttgcactttagatggatga

SEQ ID NO: 3484 - DNA, 363 bp, Glycine max
  Peptide Sequence Number=SeqID_120262
atggaatcatgcaatgtgaagaacaagtcaagtggaaaaagaaagatgtctagtgaggacacaagaagttacttcgcatggaacttggaaatggagcatgtgctagctgatgtgcttagagatcaaagaaatttgggcaataaaggtgatggaaattggaaagcaatagcatacagtactgcagctcaaagtttgtcgaagcattttggagttcacctcatggcagataatgttaagaactgttttaagctttggagaacatggtatgaaattgatagagctactggactcggagcaaaaaatgcattagatgcagatgatatcatgagcaaagaaacaaatgaagaggaaacaattcatagt

SEQ ID NO: 3485 - DNA, 243 bp, Glycine max
  Peptide Sequence Number=SeqID_120263
atggatgccaagcacctcacaaggaccaaagaaaggtcgcatgtcatcaagcaaaggtccccggacgaaattagggtcatggcaaaagacaaggttgatacctcaaagccctacaccgggtcaatgaggggcactgtgcatgagcctcaagcgaacctaggggcagatcaaaagtacttacccatcgatgtttttaaacagaaatgggggggaaaaaccctgggatttcaatggatcgattaa

SEQ ID NO: 3486 - DNA, 117 bp, Glycine max
  Peptide Sequence Number=SeqID_120264
atgggggaggcaaaggttggaagttacatggaagttactaaaacttccatcaacggttggaagttacatggaagttacatggaagttactaaaacttccatcaacggcaatttttaa

SEQ ID NO: 3487 - DNA, 138 bp, Glycine max
  Peptide Sequence Number=SeqID_120265
atggagcttacaccacttcttgacctagcaagaaacttgaggaatcacttaggagttggtggaattactgtagtgaacagaatgctagtttacctcatcacctacattttcacttctaggtcaagtaatcacgctcag

SEQ ID NO: 3488 - DNA, 396 bp, Glycine max
  Peptide Sequence Number=SeqID_120266
atgaaaggactgcaaaaagcccgcgacgcaagaaataacggcgtttgtaccgtgccttacatcggtccaattcaacacaaacgcgtcattgctgcgcctggtgtgtggagtgagtggattgagttattaaactcctttgctaacgaaaattcccctaacgtctataccgtcaattttaatccttcatcgaatatggagtcatcttttgatgtggagataaaatacccggaacatagtggaatgaaaaccattaacacaatgggaccaggatcatacacaataaaagccacaggaatcggaaatacttacatcaggagaaatagcaggttagttgaacgaagccaccatatcttggtggctcaagcacttgagatatatttacaactcattatatga

SEQ ID NO: 3489 - DNA, 213 bp, Glycine max
  Peptide Sequence Number=SeqID_120267
atgggtcgtaggcaacgcactaacttttttgtggatgagctgaggggctttggaggtggcaacggtgcgtctgttgcccgctgccagccatccccaggttactgtggtgtcttgccctacgcctgcctgggggcgcagtacttcttgatgaaagcccggttaatggggggcctaatgaccttgttgggggcgacgggcactctgtggaactga

SEQ ID NO: 3490 - DNA, 219 bp, Glycine max
  Peptide Sequence Number=SeqID_120268
atggagaactttgttgctgaaaaggagaaactgttgcatgctcatggcatgggttatgctgcaatgaagcggaggcattgggaggaagaagttcagtatgagcagaagtttgatgaggaactcgccaacctcatggaaaagtactccccgttggagaagttcaatgaaaatcgtcctgttggtggtagacatgcatactcctcagtgagtactcattag

SEQ ID NO: 3491 - DNA, 2394 bp, Glycine max
  Peptide Sequence Number=SeqID_120269
atgcttggacgcgatttcaagacatggggttccgtcatcaggagtttgtgtttagaagcaagacacagtgaagccttgtcccttttccaccactgcttaaagggttatgaagctttcaaaccagatcacactgtccttgctgcaatttttcaagtcttgttctgcccttttggggtagaactctgcatagttatgttgttaaacaaggccacgtttcttgccatgttaccaataaagggttgctcaacatggtctaacaaatgtgatgatgatgtgatgagggtgtttaggatgatgcatttgagcggagaggctatgccaaattctgttaccgttgcctgtgtccttcctgtttgtgctcatttgggtgacctggatgctggaaagtgtgtgcatggttatattatcaagtctggttttggacaagacatgcttggtggaaatgctcttgtgtcaatgtatgcaaagtgtgggctggtgtctcacgatgcatatgctgtctttgataatattgctcacaaagatgttgtttcgtggaatgcaatgatcgcgggcttggctgaaaatgggttagtggaggatgcggtcttgctgttcagttcaatggtgaaaggacctacacggccgaattatgcgaccgttgcaaatattcttcctctttgtgcttcatatgataagagtgttgtgtaccgttgtggaaggcagatccattcttatgtgctgcagtggcctgaattgtcagctgatgtttctgtccgtaatgctttgattagcttctacctaaaagttggacagacgagggaagcagaagttttgttttggaccacggatgcaagggatttggtcacttggaatgctatttttgcaggatatacatcaaatggtgaatggttaaaagcactgtacctgtttggtagtttagtatctctagagacattattgccagattctgtgactatggtcagcatacttccagcttgtgtgcaattgaaaaacttgaaggcagagaaactaatccatgcgtatattttcagacatcctttccttttttatgatacagctgttgtaaatgctttagttagtttctatgcaaaatgtggctatacagaagaagcatatcatactttttctatgatatccaggaaagatttgatttcatggaattctatatttgatgtctttggagagaagaggcatcattctagatttctcagcttgttagactgtatgcttaaactcggaactatgcctgactcagttacaatattgaccataatccgtttgtgtgcctctcttttgagaatagaaaaggttaaagaaatacatagctattcaattagaactggatctttattaagtgatgctgcaccaacagttgggaatgcaatacttgatgcatattccaaatgtggaaacatggagtatgctaacaaaatgtttcagaatctatcagaaaaaaggaacctggtcacatgcaattcactgatatctggttatgtaggtttaggatcacatcatgatgcacatatgatatttagtgggatgtcagagactgaccttaccacacggaatctcatggttcgagtatatgcagaaaatgattgtcctgaacaagctcttggattgtgctatgagttacaagctcgagggatgaagtccgacacagtgactatcatgagcctccttccagtatgcacgggtcgtgcatataagatatttcaattgagtgctgagaaggatctggttatgtttactgctatgattggtgggtatgctatgcatggcatgagtgaagaggcactttggattttttctcatatgctcaagtcggggatccagccagatcatattatctttacttccatattatctgcttgcagtcatgctggccgagtagatgaaggactgaagatattttattcaacagagaaacttcatggtatgaaaccaactgtggaacagtatgcttgtgtggtggatctcctagctcgaggtggtcgcattagtgaagcatactctcttttgaccagtttgccaattgaatctaatgctaatcttttggggacattgcttggtgcctgcaaaacccatcatgaagtagaattggggcgtattgtagcaaaccaactcttcaaaattgaagctgacgatataggaaactacattgtattatcaaatttgtacgcagcagatgctagattggatggggtaatgaaagttagaagaatgatgaggaacaaagatttgaaaaaaccagctggatgcagctggattgaagttgagagaacaaataacatttttgtggttggagactgttcccacccccaaagaagcattatttacagtacactacaaacattggatcaacaagttaaagaacccgcagagttttag

SEQ ID NO: 3492 - DNA, 1419 bp, Glycine max
  Peptide Sequence Number=SeqID_120270
tctctccctccgaaccttcattctccgctgcgccgactcatcgtcaccccccgagaccgccccttacgccgccgccgtgctcctccgcttccccatcgccggcgaccccttcccctacaacgccgtcatccgccacgtggcactccacgctccctccctcgccttcaccctcttctcccacatgcaccgaaccaatgtccccttcgaccacttcacaccctcattctcaaactcgggtttcactccaacgtctatgtccaaaacgcgcttattagctcgtacggcacctccgggtccctccacgtgtccctcaaactgttcaacgaaatgccccaccgagatttgttctcttggtcctctttaatctcttgtttcgccaaacacggattccccgatgaatcccttgcgctttttcagcaaatgcagcttctcgagagtgatatcttacccgatggggttgtcatgttgagtgtgatatccgcggtttcgagcttaggtgccttggaattgggtatctgggttcacgcttttatttcaaggatcgggcttaaccttactgttccattgggttctgcacttattgacatgaatgttgtcacgtggaccacgctgattaacgggcttgccgtgcatggacgtggtagggaggctttggaggcgttttatgtcatggtggagtctggtttgaagcctgatcgcgttgcgtttatgggtgctttggtggcttgtagtcatggtgggctcgtggaggagggacgacatgtttttagtagcatgcggagtgagtatggtgttgaactggcacttgagcattatggttgtgtggttgatcttcttggccgcgctggcttggtgcttgaagctttcgagtttgtggatggtatgcgtgttaggccaaattcggttatttggaggaccttgcttggggcgtgtgtgaatcacaatcatcttgtgctggctgagaaggccaaggagaggatcaaggagttagaccctcatcatgatggtgattatgtgcttttgtcgattgcttatggtggagttggtaactgggttaagaaggagggtgtgaggaattcaatgagggagagtagaattgtcaaggagcctggccttagtttggttcacattgatcaagtggctcatgagtttgaatcgggagataattctcatccgcaatggaaggagattacaagttttttaggttcggttattgacactgtgaaacttggaggttacaccgtacccctactacttccattgtgctgcatgacattcaagaggaagagaaggagcattgtctgggctatcacagtgagaaattggcagtggcttttgttcttctttatcatagggatagaaagaccattagggtcattaagaagcttaggatatgttatgactgccatagtttcatga

SEQ ID NO: 3493 - DNA, 1596 bp, Glycine max
  Peptide Sequence Number=SeqID_120271
atgagtttgaaaagaggaggtgggagacctgtaactgtggctaacaatgatatgtccaaagggaaaagcatatctgaacctcagccaaaagttgagcagttgactcagggtattgctgatactaagctaaactcagaacaagatgatggtgagtgggaggtatatgcaaggaaatccaagaacaaggctggaagcagtgctgcaaaaccatggggccccccggtccataattctaatcctagggcatgggggaatgctgaaatggttcaaaagccaggcatccggagtcatggtggagttggaagatcttctggaaatccctggcagacaccaaatgctaactttaggagaccagctggcagaggaaatggaaggcctcaattaggaacaagtggatatgaaagcaactatgtgactccaaatcctgtaattcggcctccactcgagcatggctggaactggcaatccagacctggtgcaatgcagtccaatgtaagggatgaaatttcaccagaggaccttcaaaagaattatggtgttgatgatgatggggaggaggaggaatctgatgatttggaagatactgatgatgatctgatgagtgatgacgatgattctgatgctagtcaaaagagtcatgagacacgtaagaaaagcaaatggtataagaagttctttgagattttggatggcttgactgttgaacagataaacgaaccagaaagacagtggcattgtccagcttgccaaggtggtcctggagctattgattggtacagaggactgcagcccttggtgacacatgccaaaacaaagggatcaaaaagggtgaagattcacagggagcttgctatacttttggatgaggaattacgcagaaggggtacttcagtaattccagctggggaagtatttggaaagtggaaaggtttgaaagaagaagaaaaggaccatgagatagtttggcctccaatggttgtcattcagaatacaaagcttgaacaggatgaaaatgataagtggataggtatgggtaaccaagaacttcttgattattttagcacatatgctgctgcaaaagcacggcactcttatggcccacagggtcatcgtgggatgagtgttttgatatttgaagcctcagctagtggctatctagaggcagagcgtctccacaagcattttgcagagcaaggaactgataaagatgcttggttcaatcgccctattttatatctacctggggggaatcgccagctctatggatacatggctacaaaagaagatctggactttttcaacaggcattcccaaggtaaatctagactcaaatatgacataatgtcatatcaggagatggttgtacaccaaattcggcaaatgaatgaagacaaccaacagctgctctattttaaggacaaggctgtgaaaggtgcaaaacacacaaaagctcttgaagaatctattggtataatgtctgagaagctgcggaagacaatggaggaaaatcgcattgtgaggaggagaactaaaatgcaacatgaagagaccaaagaagaggtaatactaacatcaaacagactacatggctattaa

SEQ ID NO: 3494 - DNA, 426 bp, Glycine max
  Peptide Sequence Number=SeqID_120272
atgtctaacttggtagaaaattgtactcacatcataatctttgttgttccttgtccccaactacctccacatggctctgttattactctgaggacacgtattagcatcatcattaccagcactattgctgagttggctgctatcaagcaaaggcttgttcatgacacagattatggtgacagcaacgtaatccgtgagaatatcgacttagattctcttcctaacaggagcagatcttgctttaggctaaaagaaattcactttgggatgttcatctacagcaagattgtcaaacatactaaaatgaccagatggaactctttcaaacctgcacttgaccgtggaaaagtcaccttcttagcttgtttttgggtggccggtggagatccgatagcgaagtccaaggcattttcaccgcaaaagtaa

SEQ ID NO: 3495 - DNA, 1338 bp, Glycine max
  Peptide Sequence Number=SeqID_120273
atggccatagatgttgcagatgggatgataaaaaaaggcatggccgttaaagctgttgatttggcttacacttttggctttgaagagaaatattctcctcggacagctctgacttcatttctgcagaagtctgaagaaacttggaagaaagccaaacaagacgcacgcgattttcctagtgcgctggtagcacatgaaaaatatttagctgctttgaaatctgtagtcaactgtttggaaggtcacaagattgactttgtaaaacttcttcctgggtggcaacttaagaataagattacgaacttggagaaagatattggtgatgccaataaaaaaattgaagagaagtcaatgctcaagagaaaagtggataaaaacaattcttctaacaagatgaagattccagaggctaaacgaacaaggttcactgggaaagatgcatctgtgctatcaccttccctcgctatcttgcaagagcaaaggattgttagtcacatggatggcaatagctcatatgatggttcattgtcggcacttttactggatggtagatcctatggcaattacccgaataattatcttgctgccgcatccatttcagattctttggccgaaaaatatcttggaagtacagtggcaagtggggctaatatgcttggaggagctatgggtggttcatattctgggtatcagggggatatgataagagacaatgttgggacagtgctaaatagcaacagtcatctgtatagatatcatggtattggggaaggggcattatctcatgataggccagttgggcagagttttgtgggacaatctgcatcaacattgaataatttgtatgggaaaacatccacagaaggttttgctggtgtgccagagcatctctctattggtgcttctagtcgcagtggaggttctgatttgtatggctttgctgatgcttcctctgttgtggaatgttgcagacgtcaggaggaccaatggttggtgctacgctgtgccattacaggaattgaggttgcggtggtggtagccagcaatatctgttgcgaggcgacggtagatgtagtcagcggtagctgttgcatgttaaagttgacaattccggcgacaatgagatggattgtatatgcaaatattaagcttggagtcaccgatagctccatcagaaagcttgtcaagcttgtcctttaccctatcgtgattgttgctgtcgttgtcgttgtcgctcctcctttaccctcactccagctctggcaacaacaccagtttcaacgtcacctcattgttgatttgatcaacgactactggccaacctctcgctattcatga

SEQ ID NO: 3496 - DNA, 219 bp, Glycine max
  Peptide Sequence Number=SeqID_120274
atgagggaagagttcttgaagaggaagaaatggaggtttaaagagaaggtcaatcggcctattgggataaagtggtatctccaattgccactcaattctcaagctagtgatcaaaccttagtctctggtttaaggacacaaatatggaaccacttgtaccaatcactttcggttgctgagatactccagagtcagattgatttgtgccagagcagttga

SEQ ID NO: 3497 - DNA, 255 bp, Glycine max
  Peptide Sequence Number=SeqID_120275
atgaagacctatggcagctggatccatgcactatttgctaaatggagcaatcgcgctaagcggaccctgtgggctcagcgcgcatccaccgctaagcgcagcttcaacacgcttagcgtgacaagggaatctagaagagcacaaggatcaaggttgcgcgctaagcgcgagatcaactcgttaagcaagacgtttgtcttttgccaggctcagcgcacaactggcgccaagcctaaatccacttactcacgctaa

SEQ ID NO: 3498 - DNA, 810 bp, Glycine max
  Peptide Sequence Number=SeqID_120276
atggaagaaacacccgaacacgtctcatactgtccgttgtcgctgccgccggaagacgaaaacaacagcggcgccaaattggcgaaatcggtgaacgaactcaacgacctcgccgttgcaatacaagccttcaagaacaggtatgacgaattgcagaaacacctcgaattcatcgaacaagccatccacacgagaaccaaggagctccgagcattaggcgccaattctgcgcaaggaaccgccgaaaacggcgtcgttcaattggattcaaatccgaagccagaagtaacccaggcggaagagagagaagaagaagaagaagaagacgagcttcttacgctttgcaaaacgatgaatagccggggcctgcgtaaatacgtgttaacgcgtctgtccgaaacggcgtcgcttcgggaacaggggagcaaagcctacacgaaggactcgccgatgattcccgcgaggcaggtttcggtgctggttttggagtactatctgctctctggctgcgttgggaatgaggtggacttggaggcttcgctgaagagggaggtggattccgcggcggttgcgtggaggaagaggatctttgttgaagggggtttgctgaaggcagctgaggttgatgccaggggtttgattcttttcatcgccatcttcgggatccccactgttttcaaggatgaggatatatacagcttggttagtgctagcaatggtagagaattttccgatgccctgctcaagtctcagcccctgcttaagagggtttctggtaaatgcaatagtcatagtgatgggtatgcataa

SEQ ID NO: 3499 - DNA, 345 bp, Glycine max
  Peptide Sequence Number=SeqID_120277
atggtagtgtcataccctaattttgtccggaaaccttcatttgccaacatttggattcttgccaaccgaattgagctgcttaacaccaattgccatgcaatccatacggttttgcaacgtttcggaaggaaatgtgcaagatattcaaaagaagggaaaaatggtcacttttgggacatttttcagcccctgggcccactagaagacttaggagtcaagaaaccagctcacctgggcgtgggaagggtgaaggaaaagggtcccttaggttccccaaggtccagaggtctagagagaagagaaaggaagaagaaagaagagaaaacaaggctgaaacgctactaa

SEQ ID NO: 3500 - DNA, 522 bp, Glycine max
  Peptide Sequence Number=SeqID_120278
atggctaagaaatgttgggttggttggttaagggacctcacactttatgacaaggttaatgaggcgtatgtttttggtggaatggggttgagcaggctgaagtatctaggaggattgaagtgcacaggtttaccactacacgcatgggaccttgagagtttctctaaggttgtggcagcttttggaatgctgttaggatcaacgagtttttctaccaagtacgcatggttgaggaggtggggtatcaagaaaggaagtctagtgaaagctagcatctctgagtgttctatggatgatggtgagtgggtactgggtaggtggtggcacggtggtcggcgatattgtttcggtgacagaaacgggtctatcacaaaggcaacttctgaatttgggaagagaatgtcaacaccaactttctcgagttacaagttgaggaatggtattattgttcttttggggtgtagaaataaaaaagggaggtgcaagaagcaattgccaatgaagaatagcatggacatctag

SEQ ID NO: 3501 - DNA, 208 bp, Glycine max
  Peptide Sequence Number=SeqID_120279
atgggttctccatctgcctccactactccttctcctcctccttctcctccttcttctcctcgtcctccccctatttcggacgcatcggcttcgacgtctgccgtgaagcggacacgcaaagcctcacgtttacgatcgttgtccacaagaccacctagtgttgagagaccagtggtgcatgttgatcctgctaccgggaaggctgacg

SEQ ID NO: 3502 - DNA, 339 bp, Glycine max
  Peptide Sequence Number=SeqID_120280
atgtctacagattgtagggccatcaacaacataactgtgaagtataggcaccccattcctaggcttgatgatatgcttgatgaattgcatggtgcaaatatattttccaaaattgatctaaaaagtggttattaccaaataaggatgagagaaggtgatgagtggaaaaccgctttcaagaccaagtttgggttgacatctaaggcaagttctgatgtagctccatgtggagcttgtaggccttggatcttcttcatcaatggattcatttgcttcttgaggtctgattgcagcggaatggagaaggagaaatatgaatggagacgccacttcaagtag

SEQ ID NO: 3503 - DNA, 300 bp, Glycine max
  Peptide Sequence Number=SeqID_120281
aagtttccgttagaagccatcgcatccctcactcagtattatgaccagtcgctaagatgcttcacgtttggggattttcagttggcaccaaccgtagaagagtttgaagggatcttgggatgcccgctaggaggaaggaagccatatctgttttctgggttatacccctccatggcaagagtagcaaaggtggtcaagatctcggtgcaagaattggaccaagtgaaacaaaatagaaatggggtggttgggataccaaggaagcacttggaagagaaagcaaaagctttggctggttaa

SEQ ID NO: 3504 - DNA, 174 bp, Glycine max
  Peptide Sequence Number=SeqID_120282
atggtccatgacatcttcgtcaaggtgaaactggaagtaatagggacatcgacagtcctaaatgtgtttggcagtagacgaagcagcgataggaaaatgcaaggatcacgcatgagagaacatgaaaacaaaaggtatgcagtttgtagaacaacaagtatgttgaacgcataa

SEQ ID NO: 3505 - DNA, 115 bp, Glycine max
  Peptide Sequence Number=SeqID_120283
atggacgctcatccgcgtcaggatggcgtacaccagctgacacttcgggtggtcatattggtgcgcatgattcgcactcgcctccctgcagcagtctgggcaaaatcctgccctg

SEQ ID NO: 3506 - DNA, 645 bp, Glycine max
  Peptide Sequence Number=SeqID_120284
atgaccaccctgacccagatatggatgacgttgctcctcagcaacatcctgcccaacgatcataattccgacctccccctaccgaagtgtcagctggtgtacgccatcctgacgcggatgagcgtccatgtggctcagttaatcgctgatgccatttatatttttgtaggtatggcgcctaccaggcaccctttggatccaaataagtccaacagggccctgggatttcccgcactgatcacaggactctgccagtcgttcggagtccccgttgcacctaccaaggtgattcggccgcctatcacctgggcttttattgagaagtactgtacccagagacaggctcagggtgatgctccacaagccgcaggcgcgccaccaccacctcatcaggctggccaggctggggcatttgacatggagcagtatttacggcatttggttcgccagcaggcagccaaccaccgggcacatgtgcagacccatgattatcagttcaggacagaggtcgcatgtcccggagattggcccgaggcccaagcagaagaggcgcccccagaggctcccggtgatggagaggaggcccacgaagacgaggagatggccgatttgcttgacttcttgggagggagtggagatacatga

SEQ ID NO: 3507 - DNA, 438 bp, Glycine max
  Peptide Sequence Number=SeqID_120285
atgacatttctcaaggattgtgattttgagttaaagtaccacccagggaaagccaacatagtggccaatgctcttagtaggaattccctacacatgtctagcttgatggtgcaagagatgaatttgatagaagattttaaggacttgaatttgaatatgtctttgaatgcactaagcatgagggaacaacttctaaaacaagaattggagtcattggtgaaccaagaagaggaatcccataatggtaagttcactatatatctagggataaccaagatgaatcaagatttaaagatgatgtataggtggctaggggtgaagaaagatatggtttactttgtatctaggtgtttagtatgccagagagttaagattgaacataagaaacctttaggtttgttgcaacctttagaagttcctgagtggaaatgggaatga

SEQ ID NO: 3508 - DNA, 393 bp, Glycine max
  Peptide Sequence Number=SeqID_120286
atgggctcagaaatctaccatgaggttcatgagaaccctaaggccttcttcaacaactctagcctaatcctcttggagcctcttgctcatggctctaatgactggtcccttcctagggaggattgcatcataacttgtctagacaaaaaatgtattgtcagaaagaaagtcaatctttataggagtgtgcttacatgcacttcggtggtgaaacttcgtgagccatgcatcaaactttatagcaataattttttgctaaggaatgcacaggttgaagttggcctcatcaaccatagattgggttatttcattgaaaaagatcctctcattcttgtcgaatacacaagcgaaagtgattgctcttgcgctcgcacaatgaaggagtacaagtga

SEQ ID NO: 3509 - DNA, 231 bp, Glycine max
  Peptide Sequence Number=SeqID_120287
atgaggagggtgcaaggactttggaaggtacaaaggaaggaggggcgtgagggtgaagaaggacttcgcaaggcttttgtcacacttctggggtttgggaggtgtcaggttgggcggaatgagataggtgaaagagccaatgaggtgttagaaaggttggggaaggaaagtggcctcataagggtaatttggtctttaccaaattgcttggaaggtgtaggattcaaataa

SEQ ID NO: 3510 - DNA, 198 bp, Glycine max
  Peptide Sequence Number=SeqID_120288
atgactcaaactaatgaacatgattacctgacagtttccggaagaacttcttccagaagaagcagtgtgcactactggaagaagttcccggaagaagttcttccggaagctgacacaccttattatggaagaacttcttccggaataagtagcattaacttccggaagaagtttccggaagaagtttttactgaataa

SEQ ID NO: 3511 - DNA, 171 bp, Glycine max
  Peptide Sequence Number=SeqID_120289
atgtggttctccacagctttctttttgatttgtaactatggaacacctaatgccggatttaaacccttgcaagtctcaatttccttagctaagccaacttttcccatgcccttattgttgggttacaagtgcgaggtgaagtcccacatcgagcaaaagtggaaaagttga

SEQ ID NO: 3512 - DNA, 1119 bp, Glycine max
  Peptide Sequence Number=SeqID_120290
atggcaagcattagtcgaatgggaatggggtttggtgttcaacaaccaaacccttcttcttctgatgataataattcccagcacaacggtggcatgagcatgagtatgaggattccgtgcaccgagttgtacgttcggtacgtgcaatccgaggggaaggtgaagattctcggggttcctgaggaggaagaggtggtggagggggtgaaaaagaagaaaaagggtggtgcctttaaagggttgaggattaaggtgaagaacccttctcttaggaggttggttagcggtgcctttgctggggcggtttcacggaccactgtggcgcccttggagacgataaggactcatttgatggtggggggtagtggcaattccactggggaggtgttcaggaatatcatgaagactgatgggtggaagggcttgtttaggggtaatttcgttaatgtgattcgggttgctcctggcaaggccattgagctatttgcttatgatactgttaacaagaacctctcgccaaagccaggggagcagcccaaactccctattccagcatcattgatagcaggtgcttgtgctggagttagttcaactatatgcacttatcctctagagttactaaagactcgactaactatccagaggggtgtttatgatggtcttgtagatgcattcctgaaaatagttagagaggaaggtgcaggagaactttacagaggccttactccgagtctgattggagtaattccatattctgccaccaattactttgcctatgacaccttgaggaaagcatacagaaaaattttcaagaaagagaagattggcaacattgaaacccttttgataggatcagcagctggtgctatttcaagtagtgctacctttccgctcgaagtggctcgcaaacacatgcaagtgggagcccttagtggaagacaagtatacaaaaatgtgattcatgcccttgcaagcattcttgaacaagaaggaatccaaggattgtataaagggttgggacctagctgcatgaagttggtgccagctgcaggaatttctttcatgtgctatgaagcatgcaagaggatactagtagaggacgacgatgatgaggagtga

SEQ ID NO: 3513 - DNA, 693 bp, Glycine max
  Peptide Sequence Number=SeqID_120291
atggtttgtattctaaggtacctagatcttgagagatatcgaagatctccatatactgatcattgtgatgcaatggtttgtattctaagtctgttgagtgtttctttcactgaagtaattttcagaaactctcaatctctgactaggacatatttcttgaataaaagcgaaacacctgcatttgtctatgctcccagtcttaaggctgccaccagaatcttagctcgtcaacttgttaggttacgtcaacagataaccaatttgcagggaagtcgtgctcagatcaggggtgtagcaactcacacacaggcattatatgcaagcacttcaatctctacaggaatgaagggtgcaactaaagcaatggtggcaatgaataagcaaatggcaccggcaaaacaggttaaagtgatcaaagaattccaaaagcaatcagcgcagttggacatgacgattgagatgatgtcagaatctattgatgaaactctagacaaagatgaagctgaggaagaaacagaagagctcactaaccaggttcttgatgagattggagtggatattgcatcccagttatcttctgctcccaaagggcgtattgcttcaaggaatactgaaaatgttgctccaagaccagcagaatcccaagatgtcgaagaacttgaaaagagattggcttctcttcgaagaatttaa

SEQ ID NO: 3514 - DNA, 309 bp, Glycine max
  Peptide Sequence Number=SeqID_120292
atggagggttttgtggtggtgactgcaaggatgataccagagagatggggggtggttggagaccataaagggagaaggaggctctgcggtcaagtaagagggaaatggctgttgcaaccagaggatttctttcaagacattggcatcagcataggttgggtgtcactaaaggtttgtttcatttctctttcattcactcttgtaggaattgaaagagagatagcatcacttcagatggaggaaaaaaaattggtggcagagattaaaagagaagcaaaaacaggaaatgaggtatgttttgtaatttaa

SEQ ID NO: 3515 - DNA, 274 bp, Glycine max
  Peptide Sequence Number=SeqID_120293
atgtctacaggaggatacggaaatgaagaaaccgcatcagggcttattggccatggaagccctggaacgaatggtgttggaagtggaaaacgtggaaatggaaaagcagcacgtggaaatggaaaagaaggacgtggaaatggaaaaccaaatgggaatggaagaatgggagggatgatttgtagtggtggtactcatgagttgtcttgcactagttggaacaacaacattgttgatcactgcaaccaaacagaacaaaagcataagattaaag

SEQ ID NO: 3516 - DNA, 375 bp, Glycine max
  Peptide Sequence Number=SeqID_120294
atgactcatcttataatcagaaaaacatataatgggtttgcattttctccatgtggaatcggacgagtcaagcctaaagaggaagatcctgaagggttagaaggcaacaaaggcatggtagatggtgtaattggcatgaatggaagagagggtaaaggaggcaatttggggagaggtggaaaccctggaagtgaaaatgctggtgtaattggttgtgggaaagatggtattggaggcagtgttggtgacaaagggttgggaacaaaatttgggtttgggaatagtggcgcaaatgaagcttgttttcatctaaaaataagcgacttgcaaatgaaaattggatgttgctggggagtagcgcaagaccaaggatga

SEQ ID NO: 3517 - DNA, 396 bp, Glycine max
  Peptide Sequence Number=SeqID_120295
atggaatctgctgctgctctagcgaaggatctaagacactggcaagaagttgtggacttctatcgaagggcatctgaattgtatatggagtgtgggagaccccaacctgcatcagacgctcttgcaaagggagcccgtgctctggaagatagtatgtctgaagaagctattcagttatatacagatgcttgtacaattcttgaagatgatggaagagaacaaatggcctttgatctttatcgtgctgccactaatgtttatataaaacttgaaaaatatacagatgcagcatctttcatgttgagattgggcttggcagctgacaagtgtaatgctaccaatagccagtgcaagggacttgaaaggaaaagaattggttataggttggccttctga

SEQ ID NO: 3518 - DNA, 444 bp, Glycine max
  Peptide Sequence Number=SeqID_120296
atggacgatgaggacgaaaaacgcaatggtgacgacatcattttggtcgatgaaaaacgaaacgacgacgatgccattacggttgtcgtcgaaacttcaaagcaaccatcgatgacgaagatagtagccaatgatgacgatatgtgcgatagagtagatgaaaatgctacggtgactgtcaatgggaacaaagctatggtgactgtcggcgggaacacaaggaaagaaagccaaaagaaaaaaaaaacaaggaaagaaagcactttggggaacaactatggaagtttgggagaagaagaccaaccgccaacatttgggaaagagtcgcataaatgttgcatgaagattgaagaaaacattgcaaatatccctatttttagagtgtgggaagatcaaaagccaataaaatgttacataacaaatatgtctcaagttgacaattaa

SEQ ID NO: 3519 - DNA, 285 bp, Glycine max
  Peptide Sequence Number=SeqID_120297
atggtggaccccaccaccaccaccaccaccaactcaacaacatcatcgacgcgcgctcataggcatgtcggacttcccgacgtgggtctagatcctctcctccgcaaatgccacaatcgcgctcataggcgtcgtccggctacaacggcgtcgttttgttgccttcttctgcttcgttcttccagtgctgctgctctgagacaaaattggaaactcgacaacggtgtcgttttgtcactcttctgtttcgttcttcgagaccacaatgcaaggcttactagctag

SEQ ID NO: 3520 - DNA, 381 bp, Glycine max
  Peptide Sequence Number=SeqID_120298
atggtggaaagtattatggattgtataatagttccacaatacaccatgctgcagactcctaaacaaaatggtgtagccaaaatgcataacgaaacacttaaagtctatcttagtgaggatgcatatgacattggagatattgttgatccaaagagcggtcatgaagttgtgtcttgccctcagttagaaatgtggaagtatacaatgaatgaagaaatgaaatctatgttagttaatggcgtatgggagctagttgaattacctgagaattttaaggcaatcagttgtaaatgggtcttcaagacaaataaggacttaaatggtaacattgagagattcaaggctagactggtaacaaagggttttactcagaaggggtag

SEQ ID NO: 3521 - DNA, 429 bp, Glycine max
  Peptide Sequence Number=SeqID_120299
atgccaaattgtaaacctagagatattctaattgtcaaaggtaacatattcaacaaagaccaatgtcctaagaaagagattgagcgagtagagatgaacaacaaacctttggggagtgctctaggcaacctcatttatgctcaggtttgtactagacccgatattgctttcatagttggtgttctttgtagataccaatcgaaccttgagaatgatcattggataactgctaagaaggtgatgaggagatcgacttttggatacatctttatgatggttgggggtgcaatatcttggaaaagacttcgcattgtggactttattgctaggccactaaagattttctattataacagcattgctgcattttatacaaataataataagacttctagaggatttaagtttgaagttgaacctgactgttag

SEQ ID NO: 3522 - DNA, 2085 bp, Glycine max
  Peptide Sequence Number=SeqID_120300
atggttttgattttttcctttgagcaggttacccagttttctccttcaattcttaaatctgagggagtgcctgtgtatcgcacagttcagcattctggggaattcgttattacctttccaagggcatatcatgctggcttcaattgtggcttcaactgtgcagaggcagtgaatgtggctcctattgattggttaatgcatggacaaagtgctgtcgagctttacaggttacaatgccgcaagacatccctgtcacatgacaagctgttgtttgggtcagcactggaatctgtacgagcccttgcagagctagctcttggaaaggaaactccaaaaaatttgaaatggggaagtgtctgtgggaaagatggagatcttaccaaggcagttagggcaaggataaagatggaagaagaaaggctggactgtcttccaactcatcttaagttgctgaagatgaacagtaactttgatttgtacaaggaaagagaatgcttctcttgcttctatgacttgcacctatctgctgtgggttgtgagtgctcccctgacagatattcatgtcttaagcatgctaatttgttctgctcgtgcgaaatggagaaaagatttgttctgcttcgatatactataagtgaactgaataaattgctagaagcattagaaggagattcacatgctattgaggtgtgggcaaataaaaacttcggaatggtttctgccaatgccaatgaggtttgcatagataaaccagatcttgagaaagacatgtacagaaccaagaattgtgaagaaatggaaagctcaactggctgtgtcagaaccaaggataggtcaaatttaaacgcacctagcagtcctaatagtcatattactacagagatagtgcagtttgagtctcaccctgtaacatgtgcagcatatgacagtatagatagtcggcatgacaataataatgataaaaatttgatcacagacagcaaagataaagtggatcaggctggttctctggatttgaatctagatgttatctctggtgaaaatgaaaatcatttgctgcatattgctgataaccatcataataaaggtgtttcagtagaggaaaaagtatgctgttcagaagccaaaaaggaagaagacatcatggaactttgtggtgagggtaacttatcaaacttgttttctgttctaaagacagatttttcatcttgttcaaggggtgttcgcaattattgtacatttgatggtggaaaaattgagaaggatctgcaagtggattcagattcaggaaagcagcacagcaatctatttgaaagggaagtcatagtcaccacacatactagtacatctttgatggacgaaagctgcttagtgcaaatgtttggtacttctgtcaagcttgtaagtttgggatctgttgtttatggaaagctctggtgtagtaagcacacactatatccaaaaggattcaagactcaagttaatttctttagcattgttgatccaaaaagaatctgtagctatatctctgaagtcattgatgctggatttcttggacctcttttcaaggttaccatggaagaatgtccaagtgaggctttcacagatacctcagcagataattgctgggaatcagttctgaagagattacatcatgaaatcatgaggcaaaagagtctaggtgaactagaacttcctccgtttgagctcctgaaaagcattaacggtcatagaatgtttggcttcaaattgccatctattattcaggccattgaagctcaagatcctagtcatctgtgtgtagagtactggaatcacaaagttgccccttccggcagtgttgttgataacttcccatttggttccagtagctctttaggtaatatcaataccaaaatttttggtatcgatttgattaagcaggaaaaggataacatccttgaagagatgaaatcaatactgcaaggggcaagtcccgatgagttaaggacaatgcataagttaataatctctgatgcacagtgctgtgagtggagagtggcattgatagcactgatggatgggatccgaaatgcttgtcaataa

SEQ ID NO: 3523 - DNA, 534 bp, Glycine max
  Peptide Sequence Number=SeqID_120301
atgggggtttgggagggtgatgtttgggtttggaggtgggagtggaggagggaatggttcatgtgggaaagggacatggtgaataggtggtcgatgatgctaaatggagtgagcttaaggaggtattcagaggatgagtgggtgcctaatgtttcgcttgcaaatgtcttgtctaaggtgcggaagcttaagatccctcccaaggctgcatttatgatatggaggctgcttcaaaataaactgcctacagctgataacttgggcaaaaggaatgtgatacactatggaaatggagtttcatatgattgggtttggaagtggctcttcaatccaatcctagcacattttcttcaacatgattttcgtgatgcatatggaatggatagaaatgcttggtcggtggtttgggggggcagttgtgtggaatgtgtgtggagaatgagaaataaatgtgtgttccaaggggtaggggtagatctgggtaatacctggagggaaagtggtattagtggagggtacgaagttgatgcatgg

SEQ ID NO: 3524 - DNA, 486 bp, Glycine max
  Peptide Sequence Number=SeqID_120302
atggccagcttcctcttccacccttctgtcgccccccgcatcctcaccatgagttccttccccgtcaccctaaaaaactccacctcctcgttggtgaaaaatggctcaacgagtacatggaagaaagctccaaacattaggactcctgccatgtcatcaagtctggcatttccgacatcgatacctactactctgccgccctcaacaccacctcctctagcaagttcgttgaagttaaacgagttcagaggggtgttgtacgcaatgaggaacatgagttggttgctgctcatggtacttctgtacagactcgtctactgctatggtgactcctcggacttcgtgttgggagggtgcaagtacaaaggttgcatgttcttgggatcaccattcatgatgtcaatggtgaggctacaacaacaggtgacggcggagatcggacacataatcgagaacacaagttttggatgtcgaaggtggccatga

SEQ ID NO: 3525 - DNA, 234 bp, Glycine max
  Peptide Sequence Number=SeqID_120303
atgacatacggtggtgatgatgatgacaacaatgacaataacgatcactttgatggcaacggtcacaatgatgatggtgagagcaatgatgatagtggtcatgaaggtggtagtgatggacatgaaagtgcaccacttctctcttcacagataaatgaggtattcccgcttggatttgtcttcccgcctaaatcagagcatcaaagcaagcgtcttcttccacaagctgaatga

SEQ ID NO: 3526 - DNA, 531 bp, Glycine max
  Peptide Sequence Number=SeqID_120304
atgagcagcaaccaactcatgttcctcattgcgtacaacacccctctgaactcgtttaacttcaacgaacttgctagaggaggtggtgttgagggcggcagagtagtaggtatcgatgtcggaaatgccagacttgatgacatggcaggagtcctaatgtttggagctttcttccatgtactcgttgagccatttttcaccaacgaggaggtttctaaggttgaaaaggattgttgggagcaaggggttgacaagaagctgaactttagggtgacggggaaggaactcatggtgaggatgcggggggcgacagaagggtggaagaggaagctggccatgatggtggaggtatttgaggtggcggtcgatggtgcattcgacggtggtggcacgatgtggtcgacgatgatgactatggctctagcatcagatggagatggtgcagcaacattcatgtctgaattgggaaagaatgtcatgtccatcatcaagctgctcaagccaaatcgcatcaaccacgcttctccataa

SEQ ID NO: 3527 - DNA, 1098 bp, Glycine max
  Peptide Sequence Number=SeqID_120305
atggagcagttgaaattggctgcagattctgaagccaaagaggataagtctttggggcacaagccaaaaaataacaatgcgcttgagtcttctgacagtctgagaaataaaaagatatcagctcgatgggatccggttgaagcaagtcggcctataattgaagaagcacctgttttttatccgactattgaagaatttgatgacacactcagttacatagcaaagatacgacccctagctgaaccccatggcatctgtaggattgttccccctgcttgctgggctccaccctgtcctcttaaggagaaagatctatgggaaaatactgagtttcccacccgtattcaacaaattgatttgcttcaaaatagggaacctatgaggaaaaaaagtagtggaaggaagcgaaaacgtagaaagcactccaaaacaggcacatgtaggaggaagcctgccaatgcagcttctgaagctaagaatgcttctgagtctgaagagaaatttggattccaatcagggtcagacttcacacttaaagactttcagctatatgctgatttttttaaggaatgctactttgggttgagagatactaatggagacagaatagtgagtgacaataaccatcaaaagatatgggagccctctgaggaggaaattgaaggtgaatactggcgaataattgagcaaccaactgatgaggttgaggtgtattatggagctgacttggaaactggagcacttggaagtggttttcctaaggcttcatccttaactaagagtgaatcagatcaatatgcccagtctggctggaatctgaacaattttgcccgactgccaggttctgtactaagttatgaaggaagtgacatatcaggagttctagtgccatggctgtatgttggcatgtgtttttcatcattttgctggcatgttgaggaccatcacctctattcactaaactatttgcactggggggacccaaaagtatggtatggagtacctggaagccatgctgcagccttggaaaaagtaatgaggaagcacttgcctgacttatttgaggaacaaccaaatctactcaatgatctggtataa

SEQ ID NO: 3528 - DNA, 450 bp, Glycine max
  Peptide Sequence Number=SeqID_120306
atggaagcatgttcagtggtaagagatctattacaacaaatgatagaccatggtcgggttgaggtcaacaatgaggggaagggggaacaacatatatgcatgcagtcggcatataaggaaggtcctaaaaagcctcaacccttggtaatacacttcaccagggacacggttccccaaaggccccgacagcactcggcagtatcgggcgttagacctattccttttccttacaagaatagtcgcgcagttccgtggaggtacgccccttcgggcggcaagaaggaagaagctaccaacatcggctcactatcggccaaagtaaccaacatcacttggttgaatagcataacccgcagtggtcgcgtgttcgcaccccccagcctgccaacgcagcccacaaacgctaaagggaaatcaaagatgaccgaaggacaaaccatcaaggtgtag

SEQ ID NO: 3529 - DNA, 273 bp, Glycine max
  Peptide Sequence Number=SeqID_120307
atgtcacatctaatatctttggcgcttaacacgaggcccctattatgcagagagagagtagggaccataaacacgttctgtaacatatcttcagagaagtacaatatgccagtgtcgtctagtgctcagagcaaaatttcagcatataaatcgaaagaagggcattgtaacatgtcttcacacaaagcttgtaggccttggatcttcttcatcaatggagtcctttgcttcttgaagatcaatggcagcagaatggagaaggaggaaaggtaa

SEQ ID NO: 3530 - DNA, 378 bp, Glycine max
  Peptide Sequence Number=SeqID_120308
atggggttatcggcaatgaaaataggtggagacggcatgatcgagcatgcgtggcttcattatagagcttccatgggaagctaccatggggagcgacataggaaggggaggaggaacgtcggagtgtggtgtgaactaaggaggaggcatgtgaggacgagacggaggaggatactggctggagtgttgttggctaatgagatcgagtttgaagagcatggaggcgtggaacaagtcaagatggaggtgagttccatggagaacggaatacatggaagcttgggttgcggtgaggttggcttgggctgcggcgaggttggccatgacggcttcgaggcgatccaggttggcggcggaagctgcggcatctgtcattga

SEQ ID NO: 3531 - DNA, 243 bp, Glycine max
  Peptide Sequence Number=SeqID_120309
atggttctatattcaacttttgtggatgacttctcaacagtaggttgcttcttgcatgaccatgatataggatttgaaccaaaaatagactatataagctccagtagacttgttgttcgtcctgtcccctacccaactcgagtcacaaaatgcttgaaatgctgtgagagacgattcacggcaaatgagatatcaggccatgtgagtgagaggtattgtagagaccctaccatgcgtttataa

SEQ ID NO: 3532 - DNA, 546 bp, Glycine max
  Peptide Sequence Number=SeqID_120310
atggcaagaatagccaaggtagtcagaatctcgacgcaagagttggatcgagtaaaacaaaacagaaatgggatagtcggaatactgaggaagcacttggaggagaaagcaagggctttggtggatcaaggtgaatcagcttcgttcattgatgtcttggtgctattggtatttggagtcgtcttttttccaaatgtggatggattagtagatctagcagtgatcgacgccttccttgcttaccaccatagcaaagaaagcctgttcgttgctgtattggccgatgcctatgacacaattgaccgaagatgcgagaagagtggcacaaggattgtctattgcacacccgctttttataagaacctggaagaagatgatctgtataggtgcgctgagcaagagtcaaactcactaaccgcaccgcttacacctccagcgtattttcatgagggattggggtacggtaacctagttgttggtatgtatgtcttaatgcagttctggtcaagtttagtccaacaagagggatctgaggacgacgcttga

SEQ ID NO: 3533 - DNA, 483 bp, Glycine max
  Peptide Sequence Number=SeqID_120311
atggtgggttacacaccttcaagttttacagatttggtcttcgccagcgaaaggatcaaagtgggtttgaaaagaggcaaatttaatcatcctgcttggacgactgagaaaactggggcaaatgaagaaggtgagaatgaaggagaaacccatgctgcgaactgtctttcctacatggaaaatcccccaccagctcaacaacatcattactcagccgatatcaacccttctcattacccaccacccagccatccacaaaggccatccctaaatcaaccacaaagcctgtctaccgcacttcgaatgacgaacaccacctttagcacaaaccaaaacaccaaccaagaaatgaattttgcagcgaaaaatcctgtagaattcaccccaatttcggtgtcctatgttgacttgatcccatatctactcgttaattcaatggtagccataaccccagccaaggttcctcaacctccatttctttga

SEQ ID NO: 3534 - DNA, 390 bp, Glycine max
  Peptide Sequence Number=SeqID_120312
atgactaatgcaaattgtccgcaagagtcattgcattcagtctcaaacgggaatctaaggtttgacactgcacaaactcttgtgtcaaggttccttcaagtttcttcttttttcgaggacgagggtgagagccctgtcgagtctgatgaaacaaaagtccaaagttggagctgtgtgaacaaacaaattatgtcacatagaaagtgggaatataattcagggtcgaacacgtacaagagaaaacgacttggtactgctacaaggaaaggattattacttattagcaccacgactaagatgccaagccaaccatttatttcaccaaaagacactagagagctccatgttgtgaattgtgatgggtttggttgtaggcttgtagctagctag

SEQ ID NO: 3535 - DNA, 282 bp, Glycine max
  Peptide Sequence Number=SeqID_120313
atggcacagaccaaccgatactttcgctgggggagatcggcattgcgatcactgagcagaatgttgctaagtagcaacgtcatctatatttgtgtaagagtggtcatgttggtgcgcatgatccgcactcgtcactttgcagtggcacgggtgaaatcttgcccttgtatgcacagtagctacgcgatagcctcctcttctggttgtgctcgcatagttggtcgccctccattatcagggggtggcccaggaattgataaaaggaaactactggccccttaa

SEQ ID NO: 3536 - DNA, 684 bp, Glycine max
  Peptide Sequence Number=SeqID_120314
atgaaaaagagtttacatcaattactcagtaagaatccccaactgagggttttagcctttgatggcaaggaagctctttttacaccgaagaagaggaatcaagagaaattgcttgcttacaaaggagtgggaatgtctcctccacctctaggaatctcactaatctccctaaaagatgaaaacttggccctttgctctgctatatgctctctgaaattcacactctttaggcctctcagtagtgaaccgcttaaaaagggtttcctgatctcgacgtcgcgcttagcgcgatttgatattgatgaagaagcccctcaacgtcgaagcccgacaacatctacatgtagacaatgggcagctgcagttgttgaccatgtggattatgctgctgacgagttgaagttggcctctcatgggaggaaagtggagaaatttggaaggcctgcacttaagaagtggcacaagaaaactagtagtttccatctaccggtaggagaggtgactataaccctcgatgatgtggcatccttgttacatctgcccattataggtgtcttccataccttcgacgctcttgatgtagaccaagtcgtagagttgttagttaagttgattgaagttgctacacaagaagcaaaagatgagagtgagcaatgcagaggggcatatgttcgcctaacctag

SEQ ID NO: 3537 - DNA, 156 bp, Glycine max
  Peptide Sequence Number=SeqID_120315
atgaagtctttgaaagacatggagccatctcctaaccaattgctccccatgtatgttagatacgtgatcatcacatgcacagaccacaagtgcaacaatgcaaggtgcaatgggatgatatggcaagcgatcaggaatacaaaggatggaaagtga

SEQ ID NO: 3538 - DNA, 345 bp, Glycine max
  Peptide Sequence Number=SeqID_120316
atgacagctcgcccgggcgagctaagccttagttatgaagcaatgagctggcccaggcgagctgatttcttaatattgaagtcttttggtggcccaggcgagccagaggctagcctaggcgaactagggtccaggaaaaccaaggaaaagacccttttgccctcctttcttggtatctcttgccttcatgatcgaaacactaaatggttccttgctttgcactgtaactggtgttttaacaccggtatgaaaggcggctcgtggtggccaccaatggttgtgggtgatggaggaggagtttctaaggtgggtgatggaggaggagtttcaaaggagattttctaa

SEQ ID NO: 3539 - DNA, 2235 bp, Glycine max
  Peptide Sequence Number=SeqID_120317
atgaaggccgtgcccctaccctttcaggaatttagagggaacggggttttagattttgcttctgttgctgctgtttcagattcgttgttactcccgcagcaagagcagtttctgcaaaggtggaacccccaaagggaaaacttttgctatgtgggcattgagcccgccgtttctggtttggacctcaaaaggaaaacaagcagccctcccacatcctcctctacactgtcttcctcacgcgccagcagcggcggctgcggaggctggggctccgcggatagcaccaccggtgcggccacggccacggtggccgagaaggagaacaacccacctcaaggagggttagaggttgttggacaggcaagatgtggactgggaatggaggattgggagagtgtgttgtctgagtcaccaggtgaagatcattccattctcaagttgattatgggggacattgaggacccatctgtgggtttgaccaagcttttgcagggtggaagtgcctctcaggatgttgaattgaatgggcttggagtgggttttggtttggtgaatcaaagttctgtgcttgaccccattcctagtgtcaactttgtgagcagcagcattgacccttctggtcctgggaattgtgctgatttccctttcaattcccacagtaatgttagccctaatgttcccagtgttggttctggtctgaatccaaaccctacaggattccctacttcagctagcaatctctcacaagtttcactccctcagggtgtgtttcagccacagcaacaacagcatcaaccaatagaacctctggatgagaagctacaggttctcaatccccagttcattttgtaccaaaatcagtctcagtttatgccaaacccgggtttagttttgcctttgacatatgcccagctgcaagaacatcatcagcttctccctcagcctccggcgaaacgcctgaattgtggcccaaattatcaggttccaaagacaccctttttggattctggtcaagagctgttacttcggaggcagcaacagcagctccaactgcttcctcaccatctgctgcagaggccatccatggtggtggcaccaaagcagaaaatggtgaactccggcagcgaagacttggcgacccatcagcttcaacaggctataactgaacagcttttcaaagctgcagagctgatcgatgccggtaatctggaactcgcgcatgggatattggcgcggctcaatcaccaactttctcccattgggaagccttttcagagggctgctttttatttcaaagaggccttgcaattacttctccatccaaatgccaacaacagttctttcaccttctcacccactggccttttgctcaagattggtgcttacaagtcattctcagaaatctcaccagttctgcagttcgccaatttcacttgtaaccaagcactgcttgaagctgtggaagggtttgatcgcattcacataatagattttgatattgggcttggtggacagtggtcttctttcatgcaagagttagcactcaggaatggcagtgcacctgaactcaagatcactgcatttgtgtcaccctcccaccatgatgaaattgagctcagtttctctcaggagagtttgaagcaatatgctggggagttacacatgtcctttgagcttgagattctgagccttgaatctttaaattctgcttcctggccccagccacttcgtgactgtgaagctgtagtggttaacatgcctattggctctttctcaaattacccatcatatctacctttggtccttcgctttgtgaagcagctcatgccaaaaattgtggttacattggatagaagttgtgatcgaactgatgcaccatttcctcagcatctgatttttgcacttcagtcttattcagggctgcttgagtcacttgatgcggttaatgttcacccagatgtccttcagatgattgagaagtattatcttcagccatcaatggagaagcttgtcttgggtcgacatggtttgcaggaaagagcacttccttggaaaaaccttctcttgtcatctgggttttcaccattgacctttagtaactttacagaatcccaggcagagtgtttggtgcagaggactcctagtaaggggttccatgttgagaagaggcagtcttcccttgttctttgctggcaaaggaaggatctcatctcagtttcaacttggagatgctaa

SEQ ID NO: 3540 - DNA, 393 bp, Glycine max
  Peptide Sequence Number=SeqID_120318
atggtagttgcgctcagctcaccatttgggctgagcacgcatccaagcgcaacttcagtgcgttgtgcgcttagcgcgacagaagaatctggcagtgcatcaatatcaaggccgcgcgctaagcgcgagatcagtgcgctaagcgcagcgattgttgtaggatgtacaatctgtggtggagctcatgaatctggatgttgtacccctaatgaagatcaaattgcacatgaagttaattatatggggaatcagcccagaggcaatttcaatacaagtgaatttccaggatttcaaaacaaccagcagtatcaacagcagagacagtggcaaaatcaccctagtaaccaattcaacagagaccagggtggttcatctacaagaccccaacagtag

SEQ ID NO: 3541 - DNA, 903 bp, Glycine max
  Peptide Sequence Number=SeqID_120319
atggtgaagaagggtgtggatgaccatgttttgtcttcgcgtgccatcggacttgattgtctttggagagcaaagaaggacatcggccttgattgtctctggatagcaaaaatggtgcggatgaccaaacttgattgtctctgtatagcaaaaatggtgcggttaaccatggtttgtcttcgcgtgccatcgaacttgattgtctctggatggaaaagaagacttgattatctctggatggcaaagaaggtctggatgaccttgttttgtctccgtgtgccatcggatttgttgactctggatagcataaagggtgcaaatgaccatgttgcggatgacaatgttttgtcttcgcaggccatcggacttgattgtctctggataggaaaatggggtgcggattcccatgtttggtctttgcgtgccatcggacttgattgtctctggaagggaaagaaggataggaaaaagggtgcgaatgaccatgtttgtctcctcatggcatcggacatgattgtctttggattgcaaagaggtacggatgacaatgttttgtctccgcgtgccatcggacttgattgtatttggatagcaaaaagggtgcggatgaccaattttgcaacctacccttcagcgggagggcgacgcggggctcacgggtgcatcttccaagggtggaaggcgcgcggagtcgccaccaacgtttatttgaggaaaacgtcagaaaaaccgaaattgtgtggtctacgaactttaatcgtgaaaggttcaggagttatttttacgcacggggaaggtattagcaccccacacgtccgtcacaagggacgacagcctttaatcaaggtgtttcccttgctcctacgtatcctcaattgcgatgaggaaatcagacctacgtag

SEQ ID NO: 3542 - DNA, 483 bp, Glycine max
  Peptide Sequence Number=SeqID_120320
atggtcatccgcaccctttttggtatccaaagaaaatcaagtctgatggcacacaaagacaaaacatggtcatctgcatcctttttgctatccagagatatcaagtctgatggcacacagagacaaaacatggtcatccgcaccctttttgttatccagagacaatcaagtacggtggcacgtggagacaaacatggtcattcgcaccattttagcgatccagagacaatcaagtttgacggcatgcagagacaaaacatggtcatccatgccttcttcgccatccagagacaatcaagtccgatggcacgtggagacaacatgacaatcaagtccgatggcatgcaaagacaaaacatggtcatccgcaccctttttggtatccaaagacaatcaagtctggtggcacgcggagacaaaacatggtatccacacccgttttgctatccagagacaatcaagtctgatgacatgcagagataa

SEQ ID NO: 3543 - DNA, 642 bp, Glycine max
  Peptide Sequence Number=SeqID_120321
atggcatgcggagaaaaacaaggtcgatggcacgcagagaaaaaacatggtcatccataccttctttgccatctagagacaatcaagcccgatggcacgcgaagacaaatcatggttaaccgcaccctttttgccatacagagaaaatcaagcccgatgacacgcagagacaaagcatggtcatccaaaccccttttgctatccaaagacaatcaagtccgatggcacgctgagacaaaacatggtcatccgtaccctttttgctatccagagataatcaaggccgatggcctacggagacaaaacatggtcatccgcaccttttttgctatccaaagacaatcaagatcgatggtacgtagagccaaaacatggtcatccgtaccttctttgccatccagagacaatcatgtccgatggcgcgtggagaaaaacatggtcatccgcaccatttttgctataccgagacagtcaagtccgatgcaatctggcccacctgggccttccagaaggttcctccagaaggctgttgcttctggaggaagcaaccctgctcgcctgggcgagctgggcggcaagcatctcccctattttgctataaataggggaggaagtgagaaggaaaaggggtcagccccttag

SEQ ID NO: 3544 - DNA, 195 bp, Glycine max
  Peptide Sequence Number=SeqID_120322
atggagccagatgtaaccaaagtgcgtgtgaaggcctgcttcttcctacaccgtgtagctgtagcggtagctattgatctaagaacatcctttgtggttgcaaagtcgagagtgatcgctacatacaaatacatcgtacaccgacccctcttctcccaactcaaaaagcatagtctcggagtccatcatgagtag

SEQ ID NO: 3545 - DNA, 246 bp, Glycine max
  Peptide Sequence Number=SeqID_120323
atggtgatgcaatgctaccccccaagggcattagatagaagactccaagaagattggaccagagaggcaagagaaggccctagggttctcatgagccttaggccggaagggagcattttcttgctacaccccattgccacatcatatagtcacactttgtgcatgtctttcatgttttacatgcctcatgacacctatgttggatcaagtggcctcagaataattaagaagcgggagatgaattaa

SEQ ID NO: 3546 - DNA, 676 bp, Glycine max
  Peptide Sequence Number=SeqID_120324
agaaaagtataaaaagccgtaccatggtaacgacgcctcgtttggagttggagccgcgaaacgaccccggattgagggaggagagtcggagcttgtggccggagaagaggctataggcgctgttgattccagtgtaaggagcgacgaagttggaggagagagaggtcctgacggaggaggtggaggagttcatggctctgataggggttgcgctgttgtggcaacctccatggtgagtagtgagccactgcgtgagtggagaataaacggagataggaggaaggcacgggttttaactggatggcattgggctgggcttattggattacggcccagccatattttgacggttgttattggtcccaaccagattgctattgcccctaccactattcaaaattccaaatttaccctcacccacaatatacgatggaattatgattctgctgcattagaagggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 3547 - DNA, 651 bp, Glycine max
  Peptide Sequence Number=SeqID_120325
atggtgaaagttggaacctcttacgtgccgatcaacgtctcattttcgccaaaagttggcgcagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatggatttcggtgtttagatccttcgtccagacgtgtctatatctctcgaaatgtgatttttgacgaagagcaatttcctgcacactccattatcacaggtcctgccaactgcgtctcctcctcaggtaagtctccaggtctgttcttcactcctccttcacatattttctcctcatcctctgattttcctcctcccccagcaactatcaagcttatcgataccgtcgacctcgagggggggcccggtaccagcttttgttccctttag

SEQ ID NO: 3548 - DNA, 393 bp, Glycine max
  Peptide Sequence Number=SeqID_120326
atggtcagggctagagaggatgcacattcatgcttggaaatgcgcaaggcaagaccttcttacaaatgttatgagaattgtcttgcagaaagagggagtgtaagggaattatgttatgcagatttgaatctttcgttgctcaagaatctcatgcatgttagtgcctatgtgaatagtgattggaatgccacctttggcattgctttgaacagtttctggcagaatagaaatgaggtgggtttttttggaaccgcttcatctgtgggaagtatcgtgacccatgtaaaagccttgacatttaatgttttaaggactccttcctacaggcaatcaccagaagttggggagttcaagctgaactgcgacagagcgataactaatggtggagaatag

SEQ ID NO: 3549 - DNA, 216 bp, Glycine max
  Peptide Sequence Number=SeqID_120327
atgggaaaggaggaaggttctggtggggaaaagaagaggggtggggaagtgggaaaggcaacatggggaagggtgaaggttctaatgggaaagtgggaaagacaacacgagaagggtgaaggttcgtggggaaaagaagagggtgggaaagtgagaaagacaacatggggaagagtgaaggttgtagagcagagctacagaggaagaaaggtctag

SEQ ID NO: 3550 - DNA, 1039 bp, Glycine max
  Peptide Sequence Number=SeqID_120328
atgttttcgggtatagagaaaatctatcatctctatatttaccaactgaattttttagtaggtctaaaggcgcttgctgaaaaccagatggaaattgggaagaaaaaatatctgaaaacagattctgatattaatcccaaccagaaatttattaacaatcaggtgttgatcaaactagaggaaaaccctgagaggctattctttacagggcaacataaagaattgaaatgggatttacatgatgatctattggtaaaaactttccagagaattacagcagggaaacgttaccaggatttcatgaaagtagaagaatattcttttgaagaggaccagaagtttatcggaaaattatttttgcgctatatcgctgaaaatgaagattttcatgattaccttggagacaaggaactcacctggtctgatgatattcacatttccaattcaatggttcaaaagacaattggatttctgaaagaagatgaagaaagcagaacattaatcaaaatgatcaaggatgaagatgataaggcttttgcagctaaacttctaagagatactttgaacaattgggaaaataatgaaaagaaactaagtgaaagattggaaaactgggatttggaaagagtttctttaatggataaagttattttgtctaccgctatatcggaacttgataattttccttttacaccttcaagagttattatcaatgaatatattgaaattgctaaagtatttgctacagacagatccaatatcttcattaacggaattttagataaatattgctttggtttagtttcttgtaaaaaagaaaacaaagaggctcaaactgctgaatctgtagcaacagattcctctgctgctgcaacaactcccgctgattctgcggtagctcctgcaacaacagaagcggcaactccggctcaatctaaccaaccttcaacttcacttgctttatctgaaagcaacttcgattttggaaatatcaaaaaaggagataaagtagagcatgtttatgaagtaaccaatacag

SEQ ID NO: 3551 - DNA, 3711 bp, Glycine max
  Peptide Sequence Number=SeqID_120329
ggcgaggacgagggcgagggcgaggacgagggcgagggcggccggctaaaattccggtgccaccgtcaacaactactcaaaaatcaccaccgaaattgaacccggaacctagcaatgctagtcatgaagttactgttgaagactatgtgagctctgaggatgatgaatctgaagaaaccccaattccttcagctaacctaccgaactgcaatgtaccagagaaacctaaagaggagacgaacggaaataaggtaccaagaaagctatggactgatgtaattagtggaaatcgtaagcctgagaatgggatggctcttgagttttttgcttcaaagattgtggaaggaaagccgattgctgaaattgaacctgaagacatcattggtgagcttaaatattgggaatctgctttgattatgtatgtcatagggagagatcttagtatgaattctgttaagcaattcatggaaaagaattggagttttgtgaaattgccagatctgttctataatgatgaaggatacttcattatgcgtttccagtcttcccaggacaaggatgaaattttatcgaagggtccttacacaattatgaacatgactatgctccttagagattggtcccctgagtttaatctaaagagagacatgctgagaacaatccctatctggattaagcttcctcaattacctttatacctttggggtgcaaaaaccatggggaaaattggtagtatactgggaaaaccgatagttacagatgaatgcaaagctcaaaggctgagaatctcttatgctagaatgttagtggagattgatatcacccaagaaatgccaaaggaagtcactattgctgataatgaagggcatgagttaattcaagctgtggagtatgaatggaaaccgaagtactgtggaaagtgtaaaaagtttggacatgtgtgtgaaaaacctaaagtcagaaaagagaaagtttgggtaccaaaacctactctgaaaagtaatgagcaagaggaaagggggcctagcaataaggagacacagatgatcaacactactaatactgaggacctggtttcagagtggactacagtacagaaggcaggaaaaaagacagttactgatacaggtacaatgcagaaagctggaaagaagataattactgatacaggagaaagtgccatgatgatttcttggaacattaggggactaaataaggttggtaagacgatagagatcagttcccgtctcaagagtctcaaccccactattattgttcttcttgaaactcgagtaagaaagaataaagctcttactgttagaaataaactcaatctgaatatgaagtatctggataactatgataagcatgaaaatgggagaatctggtttatttgggatgatagcaaagttatgatcaagcacatttgtagtacttctcagctgattcactgtggtgtctataatcccaatggtgatttcttgcattggtgcacggctatttatgctcttaatcacttagatgatagaaggaagctttggaaagatatcgaagatctcagagttcagcaggctgatccttggtgtcttttgggcgatttcaacaatgttctaaaggctgaagatagaattggtggcagagatgtaattgagtctgaatatgttgatctgagagagatgatgtctagagttggtttgtatgaaatggatacttgtggagatttctttacttggaccaacaaacaagctgataataccatatactctaggattgacagatttttgggtaatctcaattggctgcaaatgcatattgattccactttaaaaattttggctcctagtgtttcagaccatgcccttatgtttctcagttgtaaagatcaaagtagcaggctcaggggtagatttaagtacagaaacagtctggctaggttgaatggtttccatgatgaagttaagaagaattggaacttgggtgtacatggtaatcctatgtataaactttggactaagctcagtagacttcaatctgttctgaaaaacctcagcagtcctctaaatggcctaagggagaaaattgatgaagctagaagaaacttgcagcaagctcatgaagatctatgcagagatagattcaatgtggataacattaacagggtaaaggacaggacttctgagcttcttcaactcaatgagttggaggacagtgatttgagacaaaaggctaaaattaattggattcgtcagggggatggtaataacaactactttcatgctactatcaaaggtagatataagaataatgctatcagatctctgattaaagaggatgggagctgcataacttctcatgaggatatcgaggaagaagttttaaagttctacagtgctcttttgggttctcgtgagagcaatctggctggtctgaacattcctgccattaggaatggcaatactctaaatcaatttcaaagagatatgctcattggccctgtttcgaatgctgagattgatacagctataaaaggtatggatgtgaataaaactccaggaattgatggctatggtgtgggttttttcaaagatgcttggagcatagttggtagtgatgtgagagaagctatcctagactttttccttcgtaataggcttcataaaggtttcaatagttctgtggtggctcttattcccaagcataaggaagctaagatgattaaagattttaggcctatttcttgctgttctactgtttacaagattatttctaaagtgttaactaatagattgagtaaagttattgacactttagtgggaaagaatcaagctgcctttgttccaggtcagcaacttcataatcatgttctgctggcttttgagcttcttaggggctatgagaggaaacatggtactcctaaatgtatgttgcagattgatattcaaaaggcgtatgatacggtgcattgggatgctttggagcatatcttaagagagcttggttttcctgatcagtttatcaagtggatcatgatcgcagtcagatctgtcacctatgtctttaatatcaatggcaggttcactagaagattagaggctaggagaggaattagacaaggggatcctatctcccccttgctgttcatcctggttatggagtatctcaacagaattctaagccaactggataaatttcctaactttaattatcattctaaatgtgagaagatgaagataactaatttgtgttttgcggatgaccttctccttttttccaggggtgatatcggttcagtgcagattatgcttgacaagctcaacactttcctccgttctatgggccttcatgtgaatccttcaaagtgcaacatatactgcggatctgttgatattaatgtcaaagagcaattattgttgatttctggttttaaagaaggaaaaatgccctttaggtatcttggtattcctttatccagcaagaaactcaacataaagcattatcaagttcttatagataaaattgttggtcggattactcattggagtgctggtcttctctcttatgctggtaatagcaacatttctagtaagtctccaattgcttgggaaaaagtctgcagtccgaagattaatggtgaagagtcactcttggattatgagcaacatgatgaagttgaggcccctgttgctgcaataccagtccagaatgcaggat

SEQ ID NO: 3552 - DNA, 183 bp, Glycine max
  Peptide Sequence Number=SeqID_120330
atgccttcgttcaagatagctaatgagaaattgagtattcatgatggtgaatctaactatcaactaaattctgttaagggaaaccacagcaagggacaaagcaagatcgatcctaggtttaagctgatgatgtggtcgccgcaccacaattgggccccaacattggtgatgatgataaattga

SEQ ID NO: 3553 - DNA, 237 bp, Glycine max
  Peptide Sequence Number=SeqID_120331
atggcttggagcgcgcattttcctgcaatttcggcaacacgaaaatgtgacccctacttcaatattccattattaataggttcttcgctatgcgaaggtatgagggagggatgttgtacgcagccttacccttgcatatgcaaagaggctgtttccggattcgaacccatgtccaacaagtcaccgaggcacaactttaccgccgcaccagggttcgccctctttttttttatgtaa

SEQ ID NO: 3554 - DNA, 401 bp, Glycine max
  Peptide Sequence Number=SeqID_120332
atggatgaggatgtggtgcagtcggtgtcggtggtgttggcggattcgacgatggagttggagcggccgggggaggtgaagaagaatcgttgggaggcaaaagcggtgaccaagtcggcagggttgatgacgtggcgggtggtgatggatggttgtgattgtgatgaacgggttgtagcggctgaggttgtttctttttcttgttggcggcgtgtttgtgtttggcatagttggttatgtgaagaagggaaaaaggaagaagaaagctatgtgcttggtgggggattcggtgggcatttgggttcgtacgatttcaacggtgacgggacagccgtagaacactgtagtattaaaattggacccactgtcttcgatgatcaactcttgctttcgtctaaggc

SEQ ID NO: 3555 - DNA, 3834 bp, Glycine max
  Peptide Sequence Number=SeqID_120333
atgacttctcaacatataaattcaggtagatacacaatattcaattccaaactaatagagcacgtctcgcatgacactgatgacgaacttgatataacacagggagacattgttatagattattcatttgacgacatagcaactgaggattttgctcataccgattatgatgacaatcttgaagctccatatgacaatgaaaataccggtgcaggttacaaagatattggagatcctatttggcaatgcaagcaatgtaaagcgaagatgtggtatgatgagaggattaacaaagataaacagacaaaaaatccaaagttttcattatgttgtggtgatggtaaaatacaactcccaatactacatgatgctcacaagcaactactctttgacagtagagactcacaagcaaagaaattccaacaaaacatacgtttatacaacctaatgtttgcattcacatctcccggtatcaaagtagacacatcctataatacgggaagaggtcctcctacattgcgcatacatggtcaatcgcatcaccttattggaagtctcctacctatgccggataactcaccaaagtttgcacaactatatatttatgacacaaagaacgaagtcaacaataggctttcacaataccctataaaaaataatgttggtgaagacattataattggtatcaaaaatatgctagatacccacaatccatatgcacaaaaattcagaatggcaagggataaactagattcttctgtagtgtgtgacctgaaactaaaactcattagtgacaggcaaactgatggcagattatataatttaccaaatgcttctgaagtggctgctttaattgttggtgacgagcatacaacaaataacagagatatcatcattgagaagcaaacaggcatgctgcaaagaataaatgaacttcatcctgcatatttacctttgcaatatcctcttttgtacccacacggtgaagatggctacagaccaaacattcttcataagcatcattcgcatagccatgctacaaagaggaacaaagttaccatgcgtgagtatttttgttacaagatgcaatcaagggataatgaagcacaaacaatacttcattcaagaagattgtttcaccaatgggttgttgatgggtattgtatgattgagtctcaaaaactaaactatgttagacaacatcaacaagaactccgagttgacaatcagagatatatggaacaattgtattttgatgggatggcaatttgtgcccatgttggatttcctgatctattcttgacattaacgtgtaatccagcatggccagaaatacaacgacaagttgcaaagtcaaatcttacagctcatgattgccctgatgttgtgtcacgggtattcaaaataaaactaaaccaattgatgcatgatcttaagagtggacatgtatttggtcccattcttgcatttgtttacaccattgagtggcaaaaaaaaggattgcctcatgctcatatcttaatctttttgcatctttcaaataagtatccaaatccagaagacattgacaacataatttctgctgaaataccaaataaggacacagatccaaaattgtatcaaattgtctccaaccacatgatgcatggtccatgtggaatagctaataaaagggcaccatgtatggccaatgacaagtgtttcaggtatgtgtcggctcctgaaacatgttggaagatttttgcattcccaatgcatgggcgtgcaccggcagttgaacgtctttatttccaccttgaaaatcaacagtctgtttattggaaagatagtcaagaaattggcacagtactggctaagagtacaatcaaagaatcaatgttcacagcttggatggattctaataagatataccatcatggacgagatcttacttatgctgaatatgtgtccaaatttgtttatgatgcacgaaaaagatgttggaaaccaaggaaacaaggaaatactattggcaggctgatttgggtgcccccttccagtggagagttgttctacatgaggatgatgctttcctctgctaaaggatcacaatgttatgaagatattagaacagtagaaaatgttgtctatcatacatttagagaagcatgctttgcaaaaggttttctaggaagtgatcaagaatttgttggtgcctacgagaagcaaacacttggggaactccacactatcttaagaaacaaagaaaaaatgcatctttgtttgacggaaattgaaaacctcttgcaagccaacaggaaaagcctacgagattttccttcgatgccatacccactaggatatgccgccaagacgcaccaaaataatctcatctacaatgaattagcttacgacagggagatattggccgccgaatttgacaaatgctaccagtcgctaacagatgagcaggcttctatttttaataagattatgcatgtggttgcaactcaatcaggtggagtttattttttatatggatatggtggcacaggcaagacatttgtgtggaaaactttatcatctgctatacgctctactagcggaattgttttaacagtagcttcaagtgggattgcctctatactattgcctggtggtagaacaacacattctaaatttgctattcctgtccctgcaacaaaaaattcaacatgcaatatccatcaagggagtgatttggctgaattgtttcatatcacaaaactcatcatatgggatgaagctccaatgtgtcacagatacagtattgaggcccttgacaaaagtttacaggacatcatgcacaacaacaatccttttggaggaaaggtcaatgttttttgtggtgatttccgtcaaattctacctgttgtgccaagaggtaatcgttctgacattgtctatgcaactttaaattcatcttacatttggaaccattgtcaaattctaaagctgactaaaaatatgcggttgcaatcaaatcctactgaccattccaacttggatgaactaaaacaattttttgagtggttgctagacataggtgatggtaaacttgcagagcctaatgatggttatggtgaaatcaccatcccagatgagtttcttatcaaggactttcaagatcctatccaggaaattgttgaagcaacatattcagacttattacacaactacaacaatggcgatttcttgcaaaaaagagttgtccttgcctctacaaaagatgttgttgataaaataaatgactatgtcctgtctttgattcctggtgaggagaaagagtattgtagtgttgattctgttgacaaatcagatgaactactcagtcctgcatttggagtactaacagctgaatttctaaactcattgaagacatcagggataccaaatcacaagctcataatcaaggttggtacgccaatcatcctactacgaaatctggaccaagctgatgggttatgcaacggaactaggcttattgttacaagacttggttcaagtgttgttgaagcagagattattgctggacctaacataggtcatagaacttacataccaagaatgaatctttctccttctgattcaccatggccattcaagctaattagaagacaatttccattcatggtttcatttgcaatgacaattaacaaatctcagggacaatcattggcacatgttggattgtatttgccaaccccagttttttctcacggccagaaattagatccgtcagatgttcacatggcatatctcacggtcctaatttctcttgcatggtacaacacttattggactcttacaccgtag

SEQ ID NO: 3556 - DNA, 336 bp, Glycine max
  Peptide Sequence Number=SeqID_120334
atggctcattctgatgacgctaatgcacggatgaggaacttttccgacaacaagggagagaaagggaaaaacatagttttaaaaactattttctgtattcaaacttttaatagggtctgttcctgcatggatgccgtcagaagaactggcgacatagttgttagggtgcatgttgatgccgtcactgaagatgacgagatgcatgatccgccaatgcagttggcgagaagcgctgagctgtttgatattgcaagaaattgtggccaatgcaactacaactatggtctcattgcaagacagtgttacagtacgtgcacccctacttggttacactga

SEQ ID NO: 3557 - DNA, 1005 bp, Glycine max
  Peptide Sequence Number=SeqID_120335
atgatgttgatggaccatacgggtacaaagattggggcaactctatggcaagaattgttccctgaatttgagcccaagttgggttgtggtggtgcatatgttattcagaacgtgaaggttgttgatactcattctgactacaaaattcctcctaatgttcatgccattacttcatttgctgatataatttcaggcgttgcaaaacctgatactttagttgatattgtgggtgttattgctgaagtgattgaatgcaaaacagttaatccagcatacaaagtgactgtcaagttgagagacaacagtcatgttgagatcatcatgactgtgtgggaggaatatgctcttcagctggatgatgctattgagaaaaaccattttgtgcaaaagccattggttgttatgctaactcttgctaagatcaaagaacccaaggacaagtatcccctcagtgtacagaatataaagcatggttcgaagttgtatgtgaatggtgacaaaaacgaaattcaacagttccatgatagtttacgtgtgtcattttatattggcggtctagatgatgagggtggtgtttctcaatcacagtctacccagaattgccaacataagtttttgcataatgctcaaatagtgagctttggtgaaataaagactctgcgacaggactgttactgtttgactgtgggcactgtcgatgaagtgatgattgatacaccatggagttatgacagttgtccatgctgtactatcacttttgatctattaaaaataggtgccgcctgtcgttcgtgccagaatcatgttactcacactattccaaggtataagttagttgtcaagatggaacagaatagggagaaggcgaacttccatttttgggatgttgtatgtgtcaaaatatttggtaaaactgcagatgaatgtcgtcaagagttgattgcgagtggtgatgagatcaaggtgttccctgcgtgtgtttatcaattgttgggtaaaacttag

SEQ ID NO: 3558 - DNA, 378 bp, Glycine max
  Peptide Sequence Number=SeqID_120336
atggcagaatcgaatctccacaccgtcttccagatcccgcaagaatattcctcctcttcctacataggggctcttagtgcaacaaggctgccaatgacgcatataagttcttactttcgtaaacccaacgtgatcttgtctgaaaaatccaaaaattatacaaagtttccatcttttgatgatttggagcaaaatcccgattctgggtatttgtgtatttgtgccatgagacattttatggggttgagttttaggaataccatgttcttgagagtggtgttttggttgttgatatgtcttcaaatttcttctccaacccagtggatgggtcaaaatttggggttatctctgttggactggcctagtgattcgcaatga

SEQ ID NO: 3559 - DNA, 234 bp, Glycine max
  Peptide Sequence Number=SeqID_120337
atggcaacggaaaagacagttttgggcgggagtgagaagcgctggcattgcgacacgtcggccctggcaatgccacgtaggcattgtcagggccttgtttgtatcatgatagatgatttaccaatggggatggcgaaaacgatgctgagctggagggtgcacgttggtgccgccactggagatggcgagatgcatgatccgccaatgcagttggcgagaagcgctgaacgttga

SEQ ID NO: 3560 - DNA, 1446 bp, Glycine max
  Peptide Sequence Number=SeqID_120338
atggtgagtcaatctgagaaggttgtggcacatgatgaggaaaatgatgtaaatgtgcttgaaaaagagccacgttctggtgcaagaaagactaggtctgctagtaggaagctgaacacaggaaaaaaaactgtgctttcatggatgattgaaactggaacaatacggcaacgtgagaaggttcattatatggatcacaaaaatgaacgtgcactactgagtggtgaaatctttggagacggaattctgtgtgattgttgttttcaagttgtgtccatttcacagtttgaagcccattcaaggaggcaaataatctctgatgatacagtactggagaatatgtctgaggaatctgatccactgaagaatatgttcgaagagaggagaggacgttctctcttgcaatgcatggaagaagcatggaatagacaagataaatcttctgttggtaaattctataacgaagttcgtgttagggggagtgactataacgatgttacttgtagtctctgtgggaaacgtggagaccttatttgttgcgacacttgcccatcaactttccatcaaagctgcttggatatacaaacacttccatcaggtgactggaactgtatctattgctgttgcaaattttgtgggttgtataagcaaatggacagctttcagttatcctcatgccgtctatgcgagcaaagatatcaccaatcctgtcttgaggccactggagccaatacttctcattctagacactcatccttatgtggaaacgggtgtaaagagttatatgagagacttgaaaagcttcttcgggttaaacataatatagaagatggattttcttggtcttttatttgccggtcagatgttgattctaacgccacgcagatagaaccccgtgtggttgaatgtaatgccaaaatcgctgttgcgttatctgtaatgtatgagggcttcaggccatgcattgatgatggaagtgagattaatctgatccacagtgttatgtataattgtggatcaaacttccctcgcctggattgtaagagatttattactgcaattctagagagaggtgatgagattaccagcgttgcatcaatcaggattcatgggaaccaactagcagagatgccatttgttacaacccgctctgtttataggcatgaaggaatgttcagccggcttctaaacgccattgaatcggcactcagctttctaaatgttgagttattagtcataccatctgtcaaagaattaagagaaatttggattcgttcctttgggtttgagccacttgatttgagaagcaagaaaatgatgaagggcatgaatctgttggtattccgtggcaccgaaatgttacagaaaaagataccaaagcgtaattttcctgatgagaatttgaagtcatatagccgtcaaacaagggattggctatttatttaa

SEQ ID NO: 3561 - DNA, 201 bp, Glycine max
  Peptide Sequence Number=SeqID_120339
atgagtcttggttgtgactacggactagtccgatggtctggtgggcaaattaatggtgaactcaaaaacaaatacgtaggagtgggttgttttactgacaatacggtagagagtgagatggggatatatgttgttgcaaccggtggtggtgagaagaatttatataaaagaccaagggaaaaaggtgggggacgttcatga

SEQ ID NO: 3562 - DNA, 473 bp, Glycine max
  Peptide Sequence Number=SeqID_120340
gtttgtttaaatatgcatttgctcaagaaggattttgctctgctccttcggaatcgaaatcaaagcctctttattggaaagtcgacaatcccactctctctcctatccaccttcaagatttgcctggattcacacgcagtgtctataagagtaatcatgctttgatatcaccagaaagtcatgtatatggccctttgcctgattggatcaacacgttaggcacatatttaatttcaccagaaatgggttcacactttgtaatgtacctagccaagttgaaagtttgccatgaaactgaattttctggtacacttatgagatatcctttgcctcttttccagaaaattcaaaatcaggactacccctgcctgattgttatgtgtagatttatctttgtgctccaaggtgctgtcaccctcactaatgctactggtgttagccaactactgaaggtttggttaatgtgtttttaa

SEQ ID NO: 3563 - DNA, 162 bp, Glycine max
  Peptide Sequence Number=SeqID_120341
atgtgggaaagttatgagaggcttggagcgtccccaaatttcaaatgtgaaggatcattcgtgtggtattgctcttgctctgatgaagagagtgggtcagcacttcagatgtttttgtataacgagttaggcttaaaggatgctgataacgattacggttag

SEQ ID NO: 3564 - DNA, 582 bp, Glycine max
  Peptide Sequence Number=SeqID_120342
atggaaatactggagagcctttattcttacaattccctccgtccaaaactaatagaaccaaagggacagcttctatcaattgatggcaaaacagaggaggaggtttgtaggagtttagagagagtgctccgtactatgcggataactacctcagaacccaaggatgtggcttttgttgttgatggctgggcacttgagattgcacttacccactatcgtaaagctttcactgagctggcagttttgtcaaggactgctatatgttgtcgtgtgacaccatcacaaaaagcacagggtttgttaagtatttgtctgcaatatctctgggctgcttatgacaattcaggcgaatcactaaatactgcggatcatgctgcatttgacaaccatacatcatatatgggaagtataaatggacccaagttacctctggtgtttgaagtgcagcagatgccacatgatttaactacagaaggatgtccaaagaacaattttcaaaacagttgtatattcaataagaaatcagctacagtgatcaaagtactcggtagatatccaccaaagagagaagttcttcagtag

SEQ ID NO: 3565 - DNA, 273 bp, Glycine max
  Peptide Sequence Number=SeqID_120343
atgaagtcagcaaacacaactgcggatggtacaaataatccagcaactcctaagtggattgaagtcaagagccatgttcaaagcggagggtatgagtgtggctactacgtgatgcattggatgtggaacatcgtcagtgggggtttaaagaattattggagcatgtggtttcttgatggaacggcgttagacaacgaaacaattacaacgattcgccagaaatgggcagcatattttcttaaagttcaaagcaatcaatgtacaaagtcttag

SEQ ID NO: 3566 - DNA, 768 bp, Glycine max
  Peptide Sequence Number=SeqID_120344
atggttggactaggtcgtagccttgagcaattctgggaagatgcggatatggcagtgatcgatgatgcctaccgccgcgctgcacgtatctttagcccagctattgcccattcgtatgttgatcatctggcgagtcaggtagctcatcgcaatgatgatcccgaaggctttatcgaggcaattgtcgaagcgcgtgtcacagttgctggtttaggactggtgatggaagcgcatgcttatttcgataccgaggctgaaaagcttgcgatgaattggttgtcaaaatataacaaacagatcaaaatgttaagtgatgatcgtagggagtcctatcgccagattatcgaaatgagtattgagccacaggatgttgagttattaaagcctgaagcccgttatgaagcgactaaggtgaacgaaagtggaaatgtgaaagttcttcctgtctggaatgaccacttgttgtgtggactagatggaaaatacccagcagagcttaatggctgggagcggatagtcgttgagactgaatccggtagatctggattctgctactggtatcgcaacccgcagcagccaggacaatcttcgcttggtatagcttatgaaaaggctgggcaatatgggattgttcgtcctgattttctattctttgccgaacaggatggttctatcgctgtcgacttagttgatccacatggactgcatttgagtgatgcacttgctaagttacaggggttggcacagtacgccgcaaaccatatgaat

SEQ ID NO: 3567 - DNA, 201 bp, Glycine max
  Peptide Sequence Number=SeqID_120345
atgacagttccatatatgactaggtctaagactagaaggataaaaaaagttttgcaaggccttataatggagatcaactctactcaaggtgaactagaggttacaccacattggtcgaaagtagatgttagtggaagaataatgcctagtggaagttcactacttgtacttcaagggtttcttagtttagcctataagtag

SEQ ID NO: 3568 - DNA, 264 bp, Glycine max
  Peptide Sequence Number=SeqID_120346
aagttgcatgagagggttaggaaccaaatagagaatcaaacaaaggtgtatgcaactaaaggcaatagagaaataaaggagctaattcttaatgaaggggactgggtttcgctctatcttaggaaggaaagattccctactaagaggaaatccaagcttagccctagaggtggagctgatactggggaggagggaccaaaagatttgaggtcaaatcctcttcaagggggagaggatgatgccatcctccctaggaagggataa

SEQ ID NO: 3569 - DNA, 336 bp, Glycine max
  Peptide Sequence Number=SeqID_120347
atggtggctgtgggtgatggagaaagtgcttggaaatttagaaatggcattggaagaaagaaagaagaagaaatgatgtttttcctaagctacacgaaagcaaaggcttcctccagaagcttcattaagaggcttctagcacactccagacatcttctcaaagattccaatggtcagatcatggacaagtgtcttgtgaagttgcagaccaaatttcgagaagatccaacggttaatgaaggctgggcagcgtttttaccgaggcagcttcatgtagctttctctagaagcttcattaagaggcttcctccagaagcttcctcgtggcttctttga

SEQ ID NO: 3570 - DNA, 147 bp, Glycine max
  Peptide Sequence Number=SeqID_120348
atggcttggtctacatcaagagcattgaaggtatggaaggcacctgtaaggggcaaattgtatatgccagcaaaaggaggaacaacaataatgataataaagaaagctcaggctactgacgggacaagtgaggctactgcagtgtga

SEQ ID NO: 3571 - DNA, 588 bp, Glycine max
  Peptide Sequence Number=SeqID_120349
atggccgacggtcgcggacgaccacgtaaatatgcccgcggggaaatgcaatacaggaaactgtggttaccggagaacctgctgatggaattacgcgtggcggcacgcgtccgtcggtataccaccaacgacgaaatcatcagccggttaattacgtcgatgcagttttctccgcggcgtcacgtgattaaaaccgacgagggacagcggctggttgcgctggccaggatgttcgatgagtttattcagtcccgtctggatattatccgggaaaaatgcaggaataatgaagacaaaaatacagataaaaaaacgttcactccgggaaaaagcaaggccttcagcagcagctttccggagaatctgcgccgggacatggaaatcagcgcgcggtttaaccgccgcagcgtgaacatggaaatacaggtgcgcctgctggattcgctcaattacttaacggaacagcagctgccggagaatgaggaggtaagacggctgcgcgaactggctattttatttgacgagttcattctggaaaaggtcgtggtagcggagaacccgatagcgggaaaagagaccgggtcgtaa

SEQ ID NO: 3572 - DNA, 537 bp, Glycine max
  Peptide Sequence Number=SeqID_120350
atggttctttcatcatctcaagatccttttgaagttgatgtatttccctccaaaagattcaaacataccagtttccacaacagatgcccgaatgctggaacggtagaagatctagagggacaagatgctcaaagtcatagtgagtcttccctatcgaaaggaatgtcaattctggagccaataattgaagaaaatgccattgaggtggattggactcttgtccatttttcgaatcttgaaaatgaacaaaaccctctagctattgaagagcaacttggatttgaagctcttgctgatgtttctattcccatttcagttgtcgaaaccaatgagctgatagttgaccaaactattgtcgaagaatcaccgatggtggatacaaagaatcttcaaagggagacaaatccattggatcctgatccttttgctttaatcgatgtttggtcttctgattcgatgtcattaaagcttttgaatctagtcacaacaagccattcacacattttgatgaagttgtggctaagttttgaagactag

SEQ ID NO: 3573 - DNA, 110 bp, Glycine max
  Peptide Sequence Number=SeqID_120351
atggatacctcaaagccctacattggggcaatgaaaggcaccatgcataaacctcaagcgaacctaggggctgattataagttctcacccaataggttccctgctacaag

SEQ ID NO: 3574 - DNA, 147 bp, Glycine max
  Peptide Sequence Number=SeqID_120352
atgacaccaggacacgcatcagatcctctgcctgatggtcatgccccacagccccgagtcgtccctcaggccccgaaaacggatatccctcatgtgccggagccaggagcatcgtcgacatctgtggaggagcttagacatgcagtg

SEQ ID NO: 3575 - DNA, 382 bp, Glycine max
  Peptide Sequence Number=SeqID_120353
tggcgtctcctctctctcttccttctccattccgctgccatttatcttccaagaagcaaaggaatccattgatgaagaagatcctaggcctacaagctccaatggagcttgcatcatggcgtctcctctctctcttcctctctccattccgctgccattcatcttccaagaagcaaaggaatccattgatgaagaagatcctaggcctacaagctccaatggagcttacatcaagaagggagacacaaaagaattctggcggaagaagaagttcaaagagattcacaataatggttctacagaaatgcttgaaaagttgttgttggaaaatcaaagccttgcttttatagactcttcaagtctagtcaagaaaacttcttag

SEQ ID NO: 3576 - DNA, 294 bp, Glycine max
  Peptide Sequence Number=SeqID_120354
atggaaggtactcatcatctccatcaccatcaccaagggcatcaacaacaacagcaacaaagggttcttcctcagaatatgaacgtggatgtgaccgatagatttcctcaatggagcatccaagaaacaaaggagtttctggtgatccgtgaagagctggatcagactttcatggagactaagaggaacaagcagttgtgggaagtgatatctaaccgaatgaaggaaaagggttaccatagaagtgcagagcagtgcaagtgcaagtggaaaaaccttgttacccgctataag

SEQ ID NO: 3577 - DNA, 171 bp, Glycine max
  Peptide Sequence Number=SeqID_120355
atgcagctttccgccattactataagcgaaacatcacgtggtagggacagcatggcatttcgccagtgggattggcgaaacaggcatggcatttcgccattggggttggcaaaacaagcacccatcacgtcatggcagcagtgggttttgccggtggtattggcgaaatag

SEQ ID NO: 3578 - DNA, 279 bp, Glycine max
  Peptide Sequence Number=SeqID_120356
atgagaatcctgaaaactggccaaatacaggctaaaggcccaagtggagaaggacgaaggcccaacttctatttgggttccttgttgaaccaatctcagacttatcaaggtaatccttgtggcatctaccctgacttatcttccttcaccggaagtggcgtctaccctgacttatcttccttcaccggaagtggcgtcatccaaatctctataacctgtatcaagcgatctgctcctagtcaggttcacatcatctggtatcagagcttcggctcttga

SEQ ID NO: 3579 - DNA, 342 bp, Glycine max
  Peptide Sequence Number=SeqID_120357
agaattcaagggactaaccgcctaagaattctttgtcctaacacattggagggtacatcctttgtggcacaagtagagggtacatctgcttgggtttttatactgagaacaagagagggtacatctcttgtggatcagttcaagtggagggtacatccacttggttgttcaaagagaacaagggagggtacatcccttttagatctttggcttgtaaaggattttacaaggttgaaagaaatctcaagaaccgttggttgcttgggggctggatgtaggcacgggttgttgtcgaaccagtatgaatcttgtgtttgtcttcttcttctctacactctttaa

SEQ ID NO: 3580 - DNA, 231 bp, Glycine max
  Peptide Sequence Number=SeqID_120358
atggagcctggcaccaatgagagaagggtcattggaagggtcaactgtaagggtggtcttgcacctacttggatccattcttttgttgttacagaagtcaaagaagttccagggatgggatttgaaatttcgcaactaggctcatctgttgctacatcgcttattgatggagaatcgaagctgaagcatgtacttcttctagaaattaaggttgtcaacttgtctatgtaa

SEQ ID NO: 3581 - DNA, 321 bp, Glycine max
  Peptide Sequence Number=SeqID_120359
atgtctttgctggttgagaccatgaggtcgaaactggaagataccaggcaaaaattggttgcatctgataataaggttcgccaattggagacccaagtacatgaaaaaaagcttaccattggaaatgaaatgaagaaagtagaacttgaacgacaagaaacaagaagattaaggaaagagattgagagcaacaagagttccactcttgccaacttcttgggatatatgtgtggaactagacctagattcttaatatttatatatctgcttgattactcgacctatcatcgtcacatgcatatatacatgtctactacatga

SEQ ID NO: 3582 - DNA, 264 bp, Glycine max
  Peptide Sequence Number=SeqID_120360
atgaagaaaaaaacaactaagaatagaggaattgatgggagaaggatggatgtgtctatgcctatgtataatgtttcatttatctgggatggagttgcaatgtgctcatgtggactggacggtattgaacttgaggcacaagggaccataaccattcctcaggttttaaacctattagggttttcattatcccctaatgggccaaactggtttttgctcattaagctcatatcaattttctggcagtctaacgggctcacttaa

SEQ ID NO: 3583 - DNA, 204 bp, Glycine max
  Peptide Sequence Number=SeqID_120361
atgtatatcgggatagagggtgtctcagtccacaacgtccctttgggcaataatcaattgaagggaacagaggggccgatgaaacttgtggataggccgcatcctcatgtcgattccctatacctgatgacattgatcaccccacagtcttttcctcaggtcgttgcaggtgttgtgggatgctaccgtgtttggggtgtataa

SEQ ID NO: 3584 - DNA, 546 bp, Glycine max
  Peptide Sequence Number=SeqID_120362
atgtctgccgcatggtctgcattgaccaggcgaattctgatgcctcgttcttctaatctcgctcaagcctctgaggaggacttgattctgatgtgggctttcttaaccggtcgtccaatcgactgggcccatttgatttgttactgcatgcataaggcattgtggtctggtgcacctctcccttaccctcagcttgtgactttatttcttcgacattttgaaattcctttggatttggagccttttctgctagttaaacgctcctttgctattggtgccggtgcagtaacctcctttggctaccgtaaggacatggatgggcaatggttgaagaaggacgcgcaacctccgcaagacgaatgtactccctctcctccgcctcaacgagatgattcctcagccctcatgaatgaagttctttcggaattacgaggccttcacacctatgttggtgaacgttttgattccttggatggtcgaatagatctattaatgctcgctttgaaggaatggatacctgcatcactcagcttgaagaggatgtga

SEQ ID NO: 3585 - DNA, 258 bp, Glycine max
  Peptide Sequence Number=SeqID_120363
atgtcgctgcatgttctttatctttatgcgttttctggatttcccccagggatttcccgtctactgtatctctcgttacaatctttcaaagaaatgaacgggcgggatcgtcttgagctaccttctggggtggggacaaaacatggacagcagaaaccaatcaaggaacggatgcaagtggggatggggtcacgaccgactgatcgttgccctttctctgcgctagataagcagagaacgtcgctgcaaggcagcccc

SEQ ID NO: 3586 - DNA, 261 bp, Glycine max
  Peptide Sequence Number=SeqID_120364
atgaacttcacagtacaactcaagttggaaaaggaaagacaacataagttagaagaagaagaagaaatcaagaggttgaggaaggaactcattcctaaagctcaaccaatgccttattttgacagaccatttgtcccaaggaggtcaatgaagcatccaaccatacctagagaacccaagttccacataccccaacataagaagatcaagtgtttggtgtcaaggaatgacatgaacccctactcctcctatctcaactaa

SEQ ID NO: 3587 - DNA, 576 bp, Glycine max
  Peptide Sequence Number=SeqID_120365
atggcacccttaccagacacgtgccaaggccagaataatgagtcaaatcgaagaagtacaggaacaaatgaaggccaatatggaggcaccatgaaggaacaaatgacaatgatggtggaagcaatgatgatcatgaggaagatgatggaggataacgctgctagagttgttgttgctagtactgttactgagatggacccgattcactcggccggtttcaatcaaattcagaacaatcattccttcccaccatatgggttgcctcctaattatacactgcccattgttgtatacacttctggtgagaatatcagcaattctacacccgtactcattaagaatcaacaacctcaatctgatcatgcacatgtctctcaacccatgtgggtttatccacgatataccacagaagggcaggcattttctggcatccctgtgctaaatgctcccggaatatctcaatgtcacccgttatcacaacccttacattttgaagggggagaggggccttccacagtacttgagaatgaaaggattgagcgtatggaggagaggctatgcaccattgaagtatga

SEQ ID NO: 3588 - DNA, 156 bp, Glycine max
  Peptide Sequence Number=SeqID_120366
atggagggtctaaggcgtatctcccgatggtcgactgaaggcttattaccgattagcctttttgctactaaagagacttctggaactccggctgacttgtttgctttgctctacgctgggaagacgacggtgcgatttcatctgttggaggcgtaa

SEQ ID NO: 3589 - DNA, 228 bp, Glycine max
  Peptide Sequence Number=SeqID_120367
atgaatacttcagaacaaacagcaaatatgtcaagtcaaaagacagttgcacaatatgagaatgatcaaacatgtagaaacatgattcatctcctctcctcactccaagatccttctaagcatcagaagtctaaagaggtaaagaataccaagattctctctcccacggccaagatcaagtgtggtgttgtgagaaaatctcacttggaaagtgaggattggacgtag

SEQ ID NO: 3590 - DNA, 207 bp, Glycine max
  Peptide Sequence Number=SeqID_120368
atggaagctctcgacaaagtcgaatggtcaaaacttttcacaggatgtccgattcgcaaacaaaactcatctagacgctcgaaattgaacaacggaagctctcgacaaattcgaatgtgtcctaaaatttcactcggatgtccgatacggggacataatatatcgagacgctcgaaattgaacaacggaagctctcgaaaaatttga

SEQ ID NO: 3591 - DNA, 450 bp, Glycine max
  Peptide Sequence Number=SeqID_120369
atggttgaaccatgttttggtttgaactttgaacaaccttctgctggtactaccacaaacaatagttgtgactttgcggttgctgaaattctcaaagatcgacagtcgtggtatcatgattgtcgatgcatggatgtgttgagtataggacccactggaaatgggggcaccataggcctcatgtatatgcagatatgtgagagatcattgacatactcaattggaggcccaacagggcctccttgtactacttttgtaagagttgaaatgcttcgcagtggttttctaattagactgtgtgagtgtggtggatccataattcatattgttggtcataatgatttatatctctggagtgtacttgaagtactcaggccactgtcactgatgggtactgatggtgtggaagatgtgactatagccataaactcatctccaaacaaattgtga

SEQ ID NO: 3592 - DNA, 336 bp, Glycine max
  Peptide Sequence Number=SeqID_120370
atgtctagtccccaagaaacccgcttgggagttccactatctcacaaatcctttacaccttctgaaacacacaaggacaaccctttctttgtgctcagatgctttacaacaagagactcagagtctcttagccctcttttagaaattaaggttgttgtcctagcccttgttgtggtggagtttcatgtccttgtggttgtgaaggagcttttgtcccttgctgtgatggactttgagtatgatatggagagagtgctaattggtggaattggagatgaatcattaacactccatgtacctcttttcttttccaattgtctcatttgcaaattctaa

SEQ ID NO: 3593 - DNA, 136 bp, Glycine max
  Peptide Sequence Number=SeqID_120371
atgcagaactatcaacatgcaaagagatttgattctgcaaaagctaggatcaacagaaaacgttcaggctctaattttatgactgcctatgaggattgtcaatctccaactaatcagcctgtaatcaacactgaag

SEQ ID NO: 3594 - DNA, 1584 bp, Glycine max
  Peptide Sequence Number=SeqID_120372
atggcagctatttctaggctaaaggctaaaattctatctattctgctgagtttgtgtgaagcagaaagcatttcttatcttgatgaagtagccagctcagtacgaagtttagatttggctaaatctgttgcattagaggtttttgacttgttgaagaaagcctttggaagagatcctgggcatctcactgctgacagaagtttcccaatggggtttgtacagctcaatgcaatgcgtctagctgacatcttctctgatgattcaaactttcgatcttacatgatactttgttttactaaagtcctgacagcaataatttcgctctcccatggagattttttatcctgttggtgttcatctaatctctcagagacggaggaggatgcaagtattgaatatgatatatttgctgcagttggatggattttggataatacttcaccggatgtaagaaatgctacaaatttggaattcaacctaatccctaacagcatgcctaaggcttcttatgcacatcataggacatcattatttgtcaagttctttgcaaatcttcactgttttgttcccaacatatgcgaagagcaggagaggaacctttttgttctcaaggtcatggagtgcttgcaaatggatctatctaatttgctgcctgggttttcttttgcttctgatgctcctaaagctgccattgctagcaagaacctccgatcgttgttaagtcatgcagaatctctgattcctaacttcttaaatgtggaggatgtgcaacttttaagagtgttttttggcgaattacaatcactatttacatctactggatttggggaaaatcaagtccaagatagcaaatttgatgagtcattatcttgggataagctttctaaattcaacatgaatgaacattatcaggaggcacagagtgcagggggatgcccgccatctttaactggaaaagaacatgccagtcttaataagaagggtggtaacttcaaggaaggaatgtctgagaattctgcatttccagacatggaccaacataataccagagctgaagaaacaaatcaaggcaagggcctaaataagcaaaatcaggtagatgataaaggcatacctggtaaaactgcatccggaggagctagagaaatggacaaggatgctcagaatgttgaaacaagtggttcagatagtagttctgcaaaaggaaagaatgttgttgataatatggataatggagagctttcaaaatcaaatgagcgtcttaaaagaactgcagttgaggaaaatccagaggatgaaaagattgaactttcacaaaggagaaaacgaaaacgaacaataatgaatgataaacaggtgatgctgattgagagggcactcaaagatgagcctgatatgcagcgaaatgcagcttcacttcaatcatgggctgataaattaagtgggcatggttccgaggttacatcttcacagcttaaaaattggtatgcctctatatgtagcttatcatcatatagtttgtcaagttgttgcttgtttctcttgttatacatatcagatgacatagtcgaacatctagtatga

SEQ ID NO: 3595 - DNA, 744 bp, Glycine max
  Peptide Sequence Number=SeqID_120373
atggatccatcactgtcatttactcgtctgagccggtcaccaaatcaaatcatcagctctgataccaattgttgggaaattcgaggggtctggggtgccctcattatgcagaagagataccagggacctgactatttgttggcttttttaattacccttggttgctcagtatttatcctatatccggcaggagcagacatgagtccttacagtagaggaagggaaaatacagtttggggagttctcctaatggttggctatcttgggtttgatggctttacaagcacattccaagataagttgtttagaggctatgacatggagatacataatcagatattttacacaacattgtgctcttgtattcttagcctgacaggtcttatcttacaaggacatttaataccagctgtagaatttgtttataaccatcatgattgtttctttgacatagcattgctttctactgttgccacagttagtcaattttttatttcatacacaattcgcaccttcggtgctttgacatttgcaaccataatgacgacaagacagttggtgagcattatgctgtcatgtgtgtggtttgcccatcctcttagctgggaacagtggattggagctgtcattgtctttggctccctttatggaaaaagcttctcgaggaaaatgcctcaaaagacaacctcctccataacacttgttcaaaagggggatccaaataatttgaaggacaatccgtga

SEQ ID NO: 3596 - DNA, 225 bp, Glycine max
  Peptide Sequence Number=SeqID_120374
atggtgaggggattgctcaacaagctcgtctgtcgctccctctacgtcgccggaaaatggcagcacaaccaactccgctgcctcaacatccacgagtaccaggtatgtttgttgacttatcgatggagagatcttaatctgttttcctcgttcttctctatgcgtatgtttatcattctctctttgttggacttgtgcattatggagaatgcgagaataagctag

SEQ ID NO: 3597 - DNA, 381 bp, Glycine max
  Peptide Sequence Number=SeqID_120375
gaaaagatcatgagagtgccgtatggagcagaaaaggagtatttcaagcattcactgtttcttgttttctgcaaccgcatcacaacatctgctgtttctgcttgttctttgctggcaagtaaaaaagcaatggacccagtagctcccatttataagtattgccttatctcggtatcaaacatactaactacaacttgccagtatgaggccctcaaatatgttagttttcctgttcaaacccttgccaaatgtgcaaaaacgataccagttatgtccaataatctttacctcaagtgtaagtctcttccacatgatagtctctccctcaagcagaagtcattttcaatctatgagaatccaatggtggcccttagagcttag

SEQ ID NO: 3598 - DNA, 465 bp, Glycine max
  Peptide Sequence Number=SeqID_120376
atggtggttgttggaggagaggctttgggggataggcttgtggcagagatgagaatctttagatatcttattggtactcctaaccttggtctttgctttaaaagagggaaaggtttcatattctcaagtttctgtggtgctgactatgctagagacaaacttgaaagaaagaacactaatggaagttatcacttcactggtggaaatttagtaacttggatatgtaagaaacaaggatcaactgcattgtgcactgctgaagaaaaatacatatcaactgcaagttgttgtgctcaacttatttggataaagaagcagctagaagattacaaaatctgtgagagaagcattcctatctttaattataacaaagctaccattagcctctctaaaaatcctacattgcactcaagggaaaaacatatagaaattgatgcaatcctatcccgcaaaggcattaggtag

SEQ ID NO: 3599 - DNA, 798 bp, Glycine max
  Peptide Sequence Number=SeqID_120377
atgcagagttgtgatgagttgaggcagaagctcttggccaccacactggaactggagatcatggagaacgtgaagagggaactgatgaatctgctgaagatggcataccaggagagagacgaagcaagacaagagcttcaaaaactcgttaaaaaactaacaccccccgctttgttcgaagtcccttccatgatgatgattcatgcaccaaccaaagcaaactctagcatcacagaatccaacagcacctcgcacgtttcctcctccgtagattcccttctcgattcagtttctcctcccgaattctccaacatgaacaacatcaatgtcgactcccacaacttgggtggttacctcaaacaaccttcggttcaaaacaacctgtgtgtctctcaaaagcgcacctgtgatgttggggacgaggtgattgaatacattgctaaaggaaaagtgttgcctcaaaagggtaatctcctcaaagctgtgatggacgcgggtcctttgcttcagacactccttgttgcggggccacttcccacgtggcgaaacccccctcctttgcagaacataaagattccacctctcaatgttcaagactttgcttccaataataataatgtgaatacattgaattcacttaaaaaaccaatgcttgcaccctctcattattctacacagcctactacgctcaatgtttctgttgtcaacaattcattccagatgacttcaaatgctacttgcaagaatctcgcaccatcgaggattccacagagccatcagcatcttctacgcaattag

SEQ ID NO: 3600 - DNA, 450 bp, Glycine max
  Peptide Sequence Number=SeqID_120378
atgtcgcgggggtcaggagaccttggggacgtcaggcgagctcctggcagtcaaccaataaaagaacaaagtccacgaagcaaggaagcttgtgtggcggctggccagctatgtatcttgggtggtatctggaaattagcctctggtaatcgattaccattcggtgatagggcactgcctgtggagtggatactacctacacctactccatatcgactagttgagccggttcaagtgatagaggtgtcatcctctaaagaagatcttgaagaggacccagaggagttacctcctgaacctgttgtggatgcccttgacttcccagaggatgatgaggactcattccctaatgttgattctccagaggatgttatgtcagcatctgaagcagactctacagaggagagcggtcctggagggacaacgaataatgacgactcttcatcatag

SEQ ID NO: 3601 - DNA, 303 bp, Glycine max
  Peptide Sequence Number=SeqID_120379
atgaatgttgagtttgccaacaagaaggttatagtatcaaaggttttgggaaccaaggtggtgttctcaagcaactcaatttcaaaggcaattgggtgccttcatgaaggaagcacctatcaagaaggatgggagaaaaactatgactcccatgttgcaagggcactgtacaaggagaatgttgacaaggcagtttattattgtaaatttgttgagaattgtactgaagcacttgtgtgcaacaatatgattttgatgcttgttgaaaacaatgaatatgagccatttagtctcaaggtttag

SEQ ID NO: 3602 - DNA, 255 bp, Glycine max
  Peptide Sequence Number=SeqID_120380
atggggtgtacccatgggcccgaaatctaccctaaggctcataagaaccctagggccttctcttgcatctctggcccaatctacttggagtttttctatccaatgcccttgcggagtaggattgcatcagaactcgacatcccttcgagcataatcttgagggtctttgtggacttcgtcgagctgctgaggaggctctctttcatggacgggagaagcaatgtggcccgcatcttcttgcaagacgggtggtga

SEQ ID NO: 3603 - DNA, 567 bp, Glycine max
  Peptide Sequence Number=SeqID_120381
atgcacttcgaggaaaaaggaagtgttgatgctacaagaaaagtttacgacttaactcttttaacgaagaaggaatacatgaaaataattaagctgacaaacaatggttcagcaacaccatcagagttagtggcagcatcactgtcacatgcctttgcactttttgttgcggtctctgtaggtgcaaacatttctggtggtcatgtaaaccctgctatcactttcggtgcctttgttggtggccacattactctctttagaagcattttgtactggattgctcagttactaggctctgtcgttgcttgcttgctccttaaatttgccactggtggactggaaacatcagcatttgcactgtctcctggggtggaagcagggaacgctctagtgttcgagattgtgatgacttttggtttggtttacacggtgtatgcaactgcagtggacccaaagaagggtgaccttgggataattcctccaattgcaattggtttcatcgttggtgcgaacatcttggcggggggtacatttgacggttcatcttgtcagttggacttgggctaa

SEQ ID NO: 3604 - DNA, 879 bp, Glycine max
  Peptide Sequence Number=SeqID_120382
atggttcaacaggaagtgcgtaaaggtccttggacagaacaggaagacttcaaattggtgtcctttgttggcttgtttggggaccgtagatgggactttatagctaaggtatcaggtttgaaggtggcgggagaaagtaagagttgcagattacggtgggttaattacctacatcctggcctcaaacgtggaaagatgaccccccaggaagaacgccttgtcttggagcttcactcaaaatggggaaatagatcattgaggtggtcaagaattgctcgaaagttaccagggcgcactgacaatgagatcaagaactactggaggactctgatgaggaaaaaggctcaggacaaaaagcgaggagaagctgcatcatcatcatcatctagtgttgattcctcaatatcctcaaacaaccatgcggtggatccacatgcttccaagaaagcaggagaagagagcttttatgacactggaggtcatggtgtgacagcctcaacccaagatcagggtcaaaaaggtgaacaagggttgttctctatggatgatatatggaaggatattgacaatatgtcagaagagaacaacactcttcagccagtttatgaagggaacagtgaagagggttgcaacttctcttgcccaccacaagtgccttctccatcatcatgggaatattcttctgaccctctatgggtgatggatgaggaaactactagcaagtccatgaatagtctatatacagctacatgcgatcaaaatcagatgacatgcacagcatatactgatcaatattggatgaactgtgatgtcgcgtggccaacacaagcttttcttaagttggatataaaaggtgaagggcatggtaaaaactcttaa

SEQ ID NO: 3605 - DNA, 312 bp, Glycine max
  Peptide Sequence Number=SeqID_120383
atgtctcctccacctctagaacctcacaatcactcacagactcatctcaagttctcaagacggcttcttcttcaagctcgattctctataggtggctttgttcgtgcttgcacgcttagcgcaattctgaaccgcttagcactcattagtggatttcggctaagcgcgtgcttttcttactcagcggatggactgaagcggtgcgcttcgttggatgacccttcacttagcgcaaatgcacagctcatccttctttcagattcttcctcgcgctcagccgaggagtgttgcgctcagcggatggcttgctaa

SEQ ID NO: 3606 - DNA, 213 bp, Glycine max
  Peptide Sequence Number=SeqID_120384
atggcaatcgaaattgtggttcttgatgatactattgattgtgtatacgggcaaaatggtcgcaatgtggttcgtctgagacagattagagctcttccacctttttattggggtttgtcacaacctaccctttggcgggagggcaacgtggggctcacgagtgcgtcttccaagggaggaaggcgcgcggagtcgccaccaacgtttatttga

SEQ ID NO: 3607 - DNA, 363 bp, Glycine max
  Peptide Sequence Number=SeqID_120385
atggctagagggtgccacacacatttctatgttttctgcactctgacaccgaacaaccataagatctgcatcgtcgctagaatcaacctcagcaacggatgcgtgccgagagaagtaaagcaaaggaatgacaaacatagacatcaaagggatcttcaagttcagatggccatggaggttactcaaatccttttaaatgcacaagcaatggatgacacattaaggaaacaagccgaggaaagcttgaaacaatttcaggaacacaatcttccaagtttcttattttctcttgttggggaattggcaaatgacgacaagcctgcaaagagtcagaagctagcagaactgaacatatgtggttag

SEQ ID NO: 3608 - DNA, 267 bp, Glycine max
  Peptide Sequence Number=SeqID_120386
atggaggttcatcgatttcacatctctctacaaaaccacatctactgcgatattcgtgaagttctctacaaagtccttgagtttcaagccaaattcctaagaaagaccttgacggaggagaacttcgaccgacctcgagggagaaaccgccttagaacgagccagagcaaagtcaatgagtgcgcgagggagggtagagtggtaaggaacttggagagaggtcaagggagaatgagaaccaagaacaactgcaaagaggtacgatag

SEQ ID NO: 3609 - DNA, 132 bp, Glycine max
  Peptide Sequence Number=SeqID_120387
atgttgttgattaaagcacataacatgtttataacttatgtaagtatgttggtgttgtgtgttaatgagggaacctccgataggcacaagaccatcaacaagcatgttgcaatcaaaaccaacagattttaa

SEQ ID NO: 3610 - DNA, 213 bp, Glycine max
  Peptide Sequence Number=SeqID_120388
aagtcacaactggcagcattcttagcaagctcaaaatctaaagaaagtcttgctcagaatctcaaagaagttctccaactacttcaacaggaagtggaagaagaaccttccaagaaggaagctgaatcatcagagactaatgatgaccaagaagatgatccattctaccagaatgaagatgactgttttggtatatcattggacgacgattaa

SEQ ID NO: 3611 - DNA, 812 bp, Glycine max
  Peptide Sequence Number=SeqID_120389
atggcgggccgctttaaaggggcgccccgacaggctctcgcccacgccggacagcagcttgagggcctcggccgcctgcatgctgccgatgatgccaaccaccggcgcaaacacgcccatggtggcgcagttggcctcttcgacgtcgtccgcctcgggaaacaggcagtggtagcacggcgcgtccggatcgcgcaggtcgtagacgctgacctggccgtcgaaacggatggcggcgccagacaccagcggcttgcggtgctgcacacaggcgcggttgatggcgtggcgggtggtgaagttgtcggtgcagtccagcaccaggtcggcctgcgccacggcgtcggacagggcctggccctgcagccgctcgacgcgggcatgcacgcgggtctggggattgaaagccgccagcatgtcgcgcccggactcggccttgggccggcccacgctcgcagtggtgtggaggatctggcgctgcaggttgctgagctcgacgacgtcgtcgtcggccagcgtgatctcgccgacgccagcggtggccaggtagagcgcggcgggcgaacccagcccacccgcccctacgacaagcacacgcgccgccagcagtctttcctgcccttcgatacccagctcgtcgagcaggatgtggcgggcgtagcgcagcagttgctcgtcgttcatttgtccttgctgggctcgactccggtcggcgtgatcttcatgcgctgggcgttgccggcgccgggcttggcgtcggccttggcctgggcgcgggccgagcccttctgcaccggcttgccggccagcag

SEQ ID NO: 3612 - DNA, 391 bp, Glycine max
  Peptide Sequence Number=SeqID_120390
ggagattctgatagatgcttcagtctttggtgcttatgaagtactctatgttcattctccaggtcttcctccatctccaccttcaactccctcagatgcttctggtatagatgatgggccaaatccaggacatgacaacaatggaatgataatgaaacctttaggagtagatgtcccaaagaagaaaaaagaagggaataatggaagaatgattgttatatttgtgctgtcatcatctgctatacttctgaagccagatacgagcagaggtggaggtatggatcatggtggctatgtaaaggttaaatgcatagcttgtggacatcgaaatgaaaggtttgtgctgctgacagccatgctgctagacctttttcctgttttgtatggatag

SEQ ID NO: 3613 - DNA, 207 bp, Glycine max
  Peptide Sequence Number=SeqID_120391
atggttttaatcctggacaagttttcacaacaagtggtattagagtttgattcaccggaaaaatgttttcaaaatttggagattaaagatgagggtcttgatgcattcggaggagataaagctttccaaaacaaaatgtctgatgtagagaggaagatgatcatggatagagcatacaatgccatcatcttgaatcttggagattga

SEQ ID NO: 3614 - DNA, 558 bp, Glycine max
  Peptide Sequence Number=SeqID_120392
atgtcacacttatgcactattattttaccggcaacaattaagggtgttgggacggtgcttacctcagcaacgtctttgaaagtggacattcaaagacggtgcttatctcaacaacgtcttagaatgtctactttcaaagacgatgttgaggtggagtttttaggaggagtaacaaactctagggaagttcccattcagaatgaaagggaaccaacagctaaatcaaaatcagaaagtctcacaaactatatgctagcaaaggatagagagaaaaaacaggccaaacctactcaaagatatggttttgcagagcttattgcatttgctctcaatttagctaaagatattgagcaatatgagccattgacttatgttggagccatgaaaaaaaggatactaggagtagaaccaacaaggttcaaggtcaggcaggttgcaaaaggattcactcataaggagagggtggactacactgaagtattctcatcagtggtcaaacatgcctcaattagagtgattctatccatggttgctcaacaagaactagagctagaataa

SEQ ID NO: 3615 - DNA, 327 bp, Glycine max
  Peptide Sequence Number=SeqID_120393
atgttgataatcattgatcaatataaagagaaggtgaacctagctgctagtcatgggcaaatgctggaagatgaacaggcaaaggtgtcgaccttgcgggttgaaagggaagcgagagaaggggtgatagagttattgcataaagaagccatgaaatggatggatagatttgctctctctctaaatgagagtcaagagcttccaaggttgttagccaaagccaaggcggtgcctgacacatactctgctcccgatgaagttcacagtcttttcaattattgccaacacatggtcgaactaatgacctacataattaggaatagctga

SEQ ID NO: 3616 - DNA, 312 bp, Glycine max
  Peptide Sequence Number=SeqID_120394
atgaatcaaagttccattaggaaggtctttcttgctgaaattgaggaagttgtaaaatgcggtgatgtaaacccttccagtattggttctagagttgtgttttcttctttgattgttggtgcatatccgtatatgcttaataattctcaagatgcaatggctatttgtagacgattaggctatcctgatttgtttttgacggttaattacctgcaatccaaaattgctagagatataaagatataccaacaaaaagaattaaatgcatttgatagaccagacatactagtagggtgtttaacatcaagttga

SEQ ID NO: 3617 - DNA, 426 bp, Glycine max
  Peptide Sequence Number=SeqID_120395
atgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccagtagactctgtagtgaggagagtagaccagatggagagaaggcaaacaattcgaggcagaggaagacccaaaaagactataagagaggttatcaaaaaggatctcgaacttaatgatttggatagaagtatggatagcaaaattcaggcttcaattcgtaaacttatgatgaggaaatattgtgttctgttaaggaaggatgagatttttattactattggaacaagtgtatctactccaaaagatgaaccatggtggtaccatgcctgcaagtgttag

SEQ ID NO: 3618 - DNA, 264 bp, Glycine max
  Peptide Sequence Number=SeqID_120396
atgggtcctgtgagaggattcaagaagaaaagaaagccagagaagaagcatgacaagaatggttctgctgctgcttctgggtcacccgagggagatggtcctgtagattggtgggatgacttgtcaaagagaatgaatgtacattatgtgtgtatgagaaattccaaggaaaaatggtactttcttcttggtgctggaatggttgtacagtctgtttgtttccacatcttcaaggatttccagcacatccatcagaagcaatag

SEQ ID NO: 3619 - DNA, 171 bp, Glycine max
  Peptide Sequence Number=SeqID_120397
atggttcataaaggagggctaaggcctaaggggtgtggaggaggaagaaaagggagtaaactctttgccgccgcactctccatggcgacgccaaacacctccacctctgacggcgccgagagaaaactccacagatataccgaaaaactaacaaaaatcacatatatttaa

SEQ ID NO: 3620 - DNA, 3314 bp, Glycine max
  Peptide Sequence Number=SeqID_120398
atggctcactgttctaacaaggataatgacccaagtgcatctcaattaagttggtggtatgtagatatatcttatcaagaactaaaaaagggaagttacaaagtgatgcgctcagatgaaactttcatttgtccgtactgtcctgagagaaaacaggattataagtacagggaactccttaatcatgcttctggggtgggtcggagtagttcagaaaagagaactgcaaaagagaaggctaatcatctggctttagtgaaatatttggaaaaggatcttgtacatatggatgtcccatcaaaacctgtagataaaggtgccaaattattaagcccaggagaaaccataatgcctcactgttcaaacaaggacactgatataagtgcatctcaaataagttggtggtatgtggatacatcttacgaagaactcaaaaacagaagccacaatgtgaaaacctcagatgtgactttcatctgtccatactgccctaggagaaaacaggattatttgtacagggaactcctagaacatgcttatatggtgggtcggagtagttctgaaaagagaagtgccagagagagggccaatcatctcgctttagtgaaatatttggaaaatgatcttattattatggatggcccgccagaacctgtagataaaggtaccaaattaagcctaggacaaactgtagaggctcaatgctctaacaaggagactgatcagactctctcttgtccatactgccctagaaaaagaaaacgggattatgtgtacagggaacttcttgagcatgcttctggggtgggtcagagtagttcacaaaagagacatgtcagagagaagaccactcatctggctttaatgaaatatttgaaaaatgatctcaagtatatgaatgatccatcaaaatctgtgaatgaatgtaaccccccagttaacaggggggatcagagcagttcacaagagagaagtgtcagagaagacgctactcatctgccttcagtgaaatacttgaaaaaggatcttacaaatgtgagtggtccatcatcaaaacctgtaaatgaaggtgatccccctgttgttaatgaagaagtttttctagttattggttatgctgagattggaaccataacagtaagcccaggagaaactgtaattggttgctgctctaacaaagatagtaatataagttcatctcaaattgtgtggtatgcagaaaatttttatgaagaactcaaaagggggatacacaatgtgaaaacctcagatgagactttcaggtgcccatactgccctaataaaaagataaaccgggattatgcgtacagggaaatccttgaacatgcttcgggggtgggtcagagtaagtctcaaaaaagaagtttcatcgaaaaggccaatcatctggctttagtaaaatatttgaaaagggatcttatgaatgtgggtgctccatgtccatcaaaacctatggatcaaggcaccaaaacaataagcccaggagaaactttaatgggtcaatactctcataaagacaataatataagggaatctcaaataagtgggtggtatgtacataaatcctatgaagcactcaaaaagggaagccacaacgtgaaaacctcagaaatgactttctcttgtccatactgccccaataagaagagaaaacgtgattatctgtacagggaaatccttgaacatgcttccggggtgggtcagagtagctcagaaaagagaagtgccattgaaaaggctaatcatcttgctttaataaaatatttggaaaaagatcttatgattgtggatggtccaccaaaaactgcagatgaaggcagtcctcctttcaattttgagaagcagtttgtgtggccatggactggggttgtggttaatattcctactagactgacagaggacggacgttgtgttggggaaagtggttccaagctgagggatgaataccgaagtaggggatttaatccaagaagagtccgcattctttcaaatttctgtgtccactctggaactgcagttgtggaattcaataaaaattggacagggttagataatgctttagcatttgaaagagcatatgaattagatcatcatgggaaaaaagactggtttgctaatacacagcataagtctggtatttatgcatggattgctcaagctgatgactacaagatgaacaatatcattggggaacaactgcggaagatggtggatatcaaaacaatatctgaacttatggaagaagaagctcggacgcaggataaacttgtgtccaacttgaataacactcttcaggtcaagaagaagcgattaaaggaaatggaagtaaaatattatgagacttcacgtcgtatggacattgtaatgggggaaatagataagctcactcaaggtcacaatcaagagatgaagaaaatacagtcaagtgcaactcaacacttccagaatatttttaatggtcatgaaaggcttaagttgcaactagaatctcagaaaagagagcttgagttgcggagaattgaattggaaaaacgtgaggcacgtaacgaaagtgaaagaaaaaagttggaagaagagattatggagaatgcattgaaaaatagctctcttgacatggctgttctggagcaacagaaagctggtgaaaatgttttgaaactggctgcagatcaaaagcggcaaaaagaacaatttcatgctaaaataatcctgcttgaaagacaactggaagtgaaacaaaaactagaattggagattcaacaactgaaaggaaaattaaatgtcatggcgcacatagaagatgatggggactcagaagttttgaataaggtggatgctttacataaggatttaagagaaaaggaacagtcactacgagacttggattccctgaaccaaacactgattattaaagagcgtcagagcaatgatgagctacaggaagctcgaaaagaattgattaatggcattaaagagatatcttgtcgtgctaatgttggtgtgaagagaatgggggagcttgatattagaccattccttgaagctatgaagataaaatataataatgaggatgcagaagatagagcttcagaactgtgttcgttgtgggaagagtatataagggacccagactggcatccatttaaaattaccataattgaagggaaacatcaggaaatcatagatgatgaagatgaaaagttgaagggactgaaaaatgagatgggtgaaggagtctacaaagctgtggtgacagctttgacagagataaatacatataatccaagtgggcg

SEQ ID NO: 3621 - DNA, 3393 bp, Glycine max
  Peptide Sequence Number=SeqID_120399
atgatgttcccgcaattcggagcgacggcggaatccctgaacaaggcgtcgacggcggtgtttcggatcggcaccgacgcgcacctctacgacgatcccgaagacgtgaacatcgcccctctcctcgacagcaagttcgattccgagaagtgtgaagctctcaagcgccttctcgctctcatcgctcagggctttgacgtctccaacttcttccctcaggttgttaaaaatgttgcgtctcagtccttggaagtgaagaagctggtctacttgtacctcctgcattacgctgaaaagcgtccaaatgaggcgttattgtcgattaattacttccagaaggacctcggggacacaaatccgttggtgagggcatgggcgcttcgtgccatggctgggatccgccttcatgtaattgcgcctcttgttattgttgctgtgcaaaaatgtgcgagagatccttctgtctatgttagaaaatgtgcagctaatgctcttcccaagcttcatgatttgcggatggaggaacatgcttctgcaattgaagagattgttggactacttttaaatgaccattccccaggagttgttggagctgctgcatctgcatttacttcagtttgccctgacaatttttcattgattggaagaaattacagacggttgtgtgagattcttcctgatgtggaagagtggggtcaaataattctaattgggatccttctgcggtatgtaatagcaaggcatgggcttgttaaagaatccatcatgttttctttgtacaataaagacatcaacaatttagaggaagatgagtcctacattacttcaaaagaagatgccggctattccattgataagactgtatctgaattagctactatggtcttccagtgttacattgaaggtccagatgagtacttatcacgctcaagttctacaaatagggttgctcctaaattagatgtatcacaatatacatcttgcagtaatgatgttgtgaagattctgctgcagtgtacatcaccgttgctatggagtaataacagtgcagttgttcttgcagctgctggtgtacactggataatggcttctaaggagcacatcactagaattgttaaaccactcttgtttgtcctgcgatcatcgtctgcctcaagatatgtggtattgtgcaatatccaagtgtttgctaaagctatcccatctctctttgctccacactaccaagattttttcatatgctcttcagattcctatcagataaaggcgttgaagctggatatactttcttctattgctacggattcatccatttcagtcatttataaagagtttcaggattatatcggagatccagataggagatttgctgctgacacagttgctgccattggtctatgtgctcagcgacttccaaaaatggcaactttatgcttggaaggattgttgactctggttagacaagattttttttgtggtgaaattagatccttggatggagaagagggtgtgctaattcaggcaattatattcatcaaatcaattataaaattagaaccatccagttatgagaaggttataattcagttagtccgtagcttggataaaatcaaggttccagctgcccgtgcaatgattatttggatactggggaaatattgttctttgggtgacataattccaaggatgttgagtacagtacttaagtatcttgccctgtgttttacttcagaagcattagaagctaagcttcagattcttaatacaactgcaaaggtcttactgtgcatcaagggagaagatattttgactgtgagaaaaatttggacttatataattgaattggctgagtgtgaccttaactatgatattcgtgaccgttcacgtttcttaaagaaacttctctctagtaatttggagtctcaacatggggaagaagaaaatagtgaatcacaaaaaagagaccaatcccatatactttctgaatgcatatttggtggacagacaaaagccgtgacagttccatctgaacccattgattaccggttttatcttcccgggtctctttcacagttagtattccatgcagctccaggctatgagcctctcccaaaaccctgtagcctgccatacactgatcttgatcagtatgatggagcttctaagagtgattcagatgaggaggataatactggcacatctggttctttggatgaggaaagtgcttctgattatagttctgaacaatctattactgcttcaggcgaagtcactggcagtgatgaatctgtttctggcaatgaaggagaagataatgctgatccattgattcaaatttcagacactgtcaatgtctgtgaaaatcagaatggtggggctccctctggcgcagctggttttcgggacttgatgtcaacaaagtctcttgagtcttggttagatgaaccagccaggtcatctaaaggaagtgagatagagcaaagccgagttcgtagatcttcagcaagaataaccattggaaatattggaggccgggttaaacctaaatgctactctctcttagatcctgtaaatggaaatgggttaaaggtgaattattcattttcatctgagacttcaagcatatcctcgcaccttgtatgtttggaagtattatttgaaaattgttctctggagcccatgttcgatatagtcttaatagaagaagattatagcaaaagctctgattctactgatcaaacatcatcaccaactgaaaataccttaaaatttcatgttgataaaccagcattggtttccatggaggagatcccttctctggagcctggtcagacagcaaaccgaactctgctagttcgtttccatcaccaccttttgccactgaaactggctttattttgcaatgacaagaaattccttgtcaagttaaagcctgacataggatactttgtaaaaccacttcccctcagtattgaagatttcaaagataaggaatcacgccttccagggatgtttgaatatgtgagaagttgcacctttaacgatcacattctagagctgaacaaggacagcaactctttgacagaggacaagttccttgtgatatgtgaaacgttagcactgaagatgctgagcaatgcaaatctttctctggtatctgtggatatgccggttgctgccaaccttgatgatgcatctggtttgtgtttgcgtttcagcagtgagatcttgagcaattccatgccatgcttaattacagttactgttgaaggtaaatgctccgatccattaattgtttctgtaaaagttaactgtgaagagactgtatttggcttaaatttcttaaatagggttgtcaatttcttagttgagccgtctgttggccacttataa

SEQ ID NO: 3622 - DNA, 186 bp, Glycine max
  Peptide Sequence Number=SeqID_120400
atggaggtgtctattacatatgagctcaaccctgataggctgcatgagctcaaagcatttgatgactcaaaagctggcaacacagaacacattattcctgtcatacacctttcaaaatttggcaaagaactgagttcactccaagaaattgttggtggcagaatacggaaagcatatgagaaatga

SEQ ID NO: 3623 - DNA, 525 bp, Glycine max
  Peptide Sequence Number=SeqID_120401
atggtaaagcgcaacaatatctccaccagctgcaaatgctcggccactgcccttaagaaaattgaaaatactatttttttaggagtgatttggtatgaaggagagaaaaggggaggaggagggaagaggaggaaagaaaagagaagtagaactgacgaatggtttggtaagaaagaagaggaagatatgactctgtggtcgatggcaaaggctccccttatgtatgcaggggatgttcggaagattgatcctagcacatatgatcattggcagtttccttatatcacaagtgtgaatagtgaagatcaggatcttggtaagcaaatgagaagaagcagcaaagaaataaaaacaaccgatactcattcattaggcctcacaagctgcactgagtcaaaggcaagtggtttggctagtggaagtcttaaccaatatcttgaaagaatatgttggaaaaggagtttaggaaacaagcatcttgcccccttctgtgtgcacaagagagaactttacttcacattgtaa

SEQ ID NO: 3624 - DNA, 192 bp, Glycine max
  Peptide Sequence Number=SeqID_120402
atggagttcaaagtctttcttcttgtcattctactactattccaggctttcgcagaagcttcatcaatcactggagtagccaattctcttgagattacaaatgaaggaagtcaaactgtggctctgaataatgaacatatccacctgcacaaaatcatggaactgtattatatgccgaacgcagttaactaa

SEQ ID NO: 3625 - DNA, 399 bp, Glycine max
  Peptide Sequence Number=SeqID_120403
atgagaatcaactcagaggcaattgctggaaaaatgaagcacaaggccaagcagagtggttcaccacagtattcttgtgagtatgatgatttctctagacaaccatttaatgaagatagttataaggataagaagaatgaagatattgatgataatgtcattccctcctcaaccacaggttgccttggtgttagaagggatgctaagaaacatggaaagagagaaggcacactgaagttaaaggagaaagataatattggtcttggagaagaagggaagttgctgaatgatgagaaagtttcaaaggagatggatgagtacaatagagaaaaggaatatgaaaacttaaggaggagatataagaggaaagcaaagaaagcttttcaaaagcaactctag

SEQ ID NO: 3626 - DNA, 138 bp, Glycine max
  Peptide Sequence Number=SeqID_120404
atggtcaggggtgcttcgattctcaaaccttattactatgagccgggcaccagaaggaagtttcgttctttgttatctgttcagagacatctagcaggagaaacaggagactgtgttgttgctaactcaatcatataa

SEQ ID NO: 3627 - DNA, 147 bp, Glycine max
  Peptide Sequence Number=SeqID_120405
atgggactcccacttacagtggaagcttttccctcttatcagctaggctttaggagtgggttcggagtgagtgccgaactggctggatgtgagacacagttatcgttcacaatggaggctctcacgtcttatcagcctgattattaa

SEQ ID NO: 3628 - DNA, 246 bp, Glycine max
  Peptide Sequence Number=SeqID_120406
atggcggtgctcaaaaccgacacaatctcccggaatttcagattctcacttcctcacattttcggcttcccgatggctgggttctcgagtaaaggccccgtgcctctaacccttctcacgttgacagttactaaaagttatttgagtaagttagttgattattcaagctatagttctaaaaagttatttaactatttctggttctgcccggtggcgtggatagtgctgctagtcctcgctttgtga

SEQ ID NO: 3629 - DNA, 630 bp, Glycine max
  Peptide Sequence Number=SeqID_120407
atgatacgcggagataccttacggttatccgcacccctttgtcatccagaggcggcgggcccgatgatacgcggagataccttacggttatctgcacccttgtgtcatccagaggcggcgggcccgatgatacgcggagataccttacggttatccgcacccttttgtcatccagaggcggcgggcccgatgacaagcagagacaaaatttggtcattctgcacccttgtatcatccagaggcggcgggcccgatgatacgcggagataccttacggttatccgtacccttttgtcatccagaggcggcgggcccgatgacaagcagagacaaaatttggcggcgggcccgatgatacgcggagataccttacggttatccgcacccttttgtcatccagaggcggcggtcccgatgacaagcagagacaaaatttggtcattctgcacccttgtgtcatccagaggcgccgggcccgatgatacgcggagataccttacggttatccgcacccttgtgtcatccagaggcggcgggcccgatgatacgcggaaatacccgagtggttattcgtataaacattcttttgctatctgtaagacagaacgcttgatagcatgcagagactga

SEQ ID NO: 3630 - DNA, 468 bp, Glycine max
  Peptide Sequence Number=SeqID_120408
atgggcgcgcgacagcgcaagggcgcggtccaccatttgcggggcctcgcccaggtagttgcgcgggtcggtgaggcgctgcagcgccgcgcggtcgaaatgggccgtgacttcgggcaggcgggccagcgcatcggccagcgtgccgccctcggcgttgacgctgcggcaggcggcatagacgatgtcgtgcgcctgctggcggcccgtgtgcggggccaggcccatcatcacggcctcggccacgatcaggccgtcggtcatgtccaggttgcgggccatgcgttcgggatcgacgatgaggccgccgagcatgaagcgcgcctggtgcagggcgccggccgagagcacgaagctctcgggcagggccacccattcggcgtgccaggggccggtggcgcgctccaggtcctggaccatggcgtccagcatcaggcccgcatgctggcgcacggccttggagcccag

SEQ ID NO: 3631 - DNA, 1521 bp, Glycine max
  Peptide Sequence Number=SeqID_120409
atgggaggagcattcatgatcctccttgaactgctgcccctctccctcatctttctccccatcctcttttacataaccctcgccgcgttctggcgaggcgataaaatctccggcccagccagtccggcaacctatcccctaataggttgtctgatatctttctacaggaacaagcaccgtttgttggattggtacactgagctactagctcagtccccaaccaacaccatagtggttcaaaggcttggtgcacgtagaaccattgtgacagcaaacccacaaaatgttgagtacatgctaaagacaaacttcaacaacttccccaaaggcaagcccttcactgagatcctcggagacttcctcggccaggggatcttcaacgtcgacggagagccgtggctcacgcagcgaagactggcgagccacgagttctccaccaagtccctgagggagtttgtcatgcacacgttggagaaagaagtgtgtgagaggcttgtgcctgtgctagaggcactgtgtggtgagaacaaggtggttgacttgcaagagctgctagggagattctcattcaatgtgatctgcaggttcacactggggactaataggtgctgtttggacccttctgtgcctacttgtccccttgcaagggcttttgatgtggctgcagaggtgtctgctaaacgtggagcagcacctttgttcatgatgtggagggtgaagagatggctcggtgctggatctgagagattgcttaaaaatgctgttggggaagttcagactcatgtcatgagaatgattcaggagaggaagaagcaaaagggtgagagaaacgatgatgatgttgaagatgatctcttgtcaaggcttatatgtgcaggccatgaagaggagataatcagagacatggtgataagtttcatcatggcagggagggacactacttcagcagctgtgacatggttcttttgggtactatcacattattcccatttggaggaaaagatagtggaagaggcaaaaggggtgttggattatgagtcactgaagaatttgagtttcttgaaagcatgtttgtgtgagtccatgaggctgtatccaccagtggcatgggactctaagcatgccactgatgatgatctgttgccagatggcactgtggtcaaagcaggagatagggtcacatattttccctatggaatggggagaatggaagacttgtgggggaaggattggtttcaatttagaccagatcgatggtttgtcgaaccaagaaacattgaaggaataataatgttgaatgacgtttctcctttttcgtttccaatttttcaggctggtccaagggtgtgtctgggcaaggaaatggccttcattcaaatgaagtatgtggtggcttcaattcttagcagattcacatttagaattgttggtccagagaagcctatattcgtgccactgctcacggcacacatggctggcggcttaagagtattggtttgcaaaaggggaaaaaaaagctga

SEQ ID NO: 3632 - DNA, 147 bp, Glycine max
  Peptide Sequence Number=SeqID_120410
atgataggcaccatgcatgagcttcaagagaacctaggagcagacaagaagtcctcacccgataggttgaaaacccaaaagggtggcctaggcaaaagaaccactgctaaactggcgggaagagtaatgcaaacaacacatgcatga

SEQ ID NO: 3633 - DNA, 357 bp, Glycine max
  Peptide Sequence Number=SeqID_120411
atgaaaagagaaaaacatgcctcatatagtagtcatgactcttgcaagagtttaagtgaagaacttagcgactattatagagggcgccataggccacatactaaacatcactcccatagaagagaaaaggataaaaggcctcaagaggttaacattagcctcccatatttccatggaaaagataatgttgaggtctacctagattgggaaatgaaggttgaacaactctttgcttgccatcatattggtgatgagagaacagttccattgtctactattagtcgtgttgtaattatcaagcttatcgataccgtcgacctcgagggggggcccggtaccagcttttgttccctttag

SEQ ID NO: 3634 - DNA, 366 bp, Glycine max
  Peptide Sequence Number=SeqID_120412
atgggatggaaaaagaggaaaaagattcctccaagaagattgttaagaaggaaaatcattttgcaacaaaaggtgatagcaaaagaacactccttcttaaacaatccttctacctttctcctatcaagggaaacctcccttagcactaccacaattcctacatttgataccttacacccaaaggtccacaaacacttacatgaatttggtgatatatttcccaaagagattgatgcaatccacccaaggaggggacccgtcaccagagccatggctaggagactccaagaagattgggctagatatgcaggagagggccctagggttctcatgagccttacgggagattttgggcccatgggctaa

SEQ ID NO: 3635 - DNA, 774 bp, Glycine max
  Peptide Sequence Number=SeqID_120413
atgccttctctcatcgccattgtgaccctcatagccgttgttctgacttccaccgaggcgaggatcccgggcgcctacagcggcggcgcgtgggagaccgcgcacgccacgttctacggcggcagcgacgcgtcggggacaatgggcggcgcgtgcgggtacgggaacctgtacagccagggctacggcgtgaacacggcggcgctgagcacggcgctgttcaacaacgggctgagctgcggtgcctgcttcgagataaagtgcgccaacgaccccagctggtgccacgctggcagcccctccatcttcgtaaccgccacaaacttctgccccccaaactacgctcttccgaacgacaatggaggatggtgcaaccctcctcggcctcacttcgacctggccatgcccatgttcctcaaaatcgctcagtaccgcgccggcatcgtccccgtctcttaccgcagggtgccttgccgtaagcagggagggatgaggttcacgatcaacggtttccgttacttcaacttggttttgatcaccaacgtcgcgggtgcaggggatatcgtgaagacgagcgtgaaagggtcgaagactgggtggatgagcatgagccgcaactggggtcagaactggcaatcaaacgctgttctggttggtcagtcactctccttcagggtcacagccagtgaccgacgcacctccacctcctggaacctcgtacccgccaattggcaatttggtcaaacattcaccggcaaaaatttcaaagtctaa

SEQ ID NO: 3636 - DNA, 606 bp, Glycine max
  Peptide Sequence Number=SeqID_120414
atgaatctgaattctggttggtttcgtgaatcgtgcaattacgcggcaaaaggtgcacgtttgtcaaaaatcctgaaccggtttcagatgaacggttcagacggggacgatgccggcgcggtactgagcgattttgaggaacatgggcatggccaggtcgaagtgaggccgaggagggttgcaccatcctccattgtcgttcggaagagcgtagtttggggggcagaagtttgtggcggttacgaagatggaggggctgccagcgtggcaccagctggggtcgttggcgcactttatctcgaagcaggcaccgcagctcagcccgttgttgaacagcgccgtgctcagcgccgccgtgttcacgccgtagccctggctgtacaggttcccgtacccgcacgcgccgcccattgtccccgacgcgtcgctgccgccgtagaacgtggcgtgcgcggtctcccacgcgccgccgctgtaggcgcccgggatcctcgcctcggtggaagtcagaacaacggctatgagggtcacaatggcgatgagagaaggcatgcagaggaaggaatactcaactcaactgagtcagaggtttgtgttctgagaaag

SEQ ID NO: 3637 - DNA, 339 bp, Glycine max
  Peptide Sequence Number=SeqID_120415
atgagctccggctcctccgttctcgacctcggttgcgcccccggcggctggcagagcttgggtccattacgtaacggcggctccaaagaaggtcaagaattcgcacgatgcttcttcttcggagtgttgaaagttggagggcaccttgctattaaggttctcgagagtgaggatgcaaaaggttcttccttgctagcttacttgtctgcatcatatatgattgatgtgttgttcaattcaattgcttttggttgtgtttctaatgtgttgttgtttggtggaagacatcgtggctcagacctaaagctacaaggccttcgtcaagagagaattatttga

SEQ ID NO: 3638 - DNA, 342 bp, Glycine max
  Peptide Sequence Number=SeqID_120416
atggcgcggcctttgcacaaggttgcgaaaaacaacacgaggttcagactctcccgcccacctgataataattcacgaaaaccaaaacgagcattaaccgaaaaaaaccaattcgcagagaaaggaacagtgaaaattagggttggcgagaggagaatagtggaataccctatgcgaaaatacgaggcgccattgtctatcacaagaggagtgttggaatcgaagaggactcgtgaacgagcgaagtggctcgcggagatgaagagaaccgcttggttaaaccgaaccggtttggttgggtcgacggagaagtgtatcggcgacgaggaagagcatgagtag

SEQ ID NO: 3639 - DNA, 1881 bp, Glycine max
  Peptide Sequence Number=SeqID_120417
atggaatatattcttgattttggatttgaccggatgggtgcaaatggaacagagattgatcatcctgtcctgatcacagaatgtgtatgcaacccggttcaatctcgtagcaaaatggcagaacttctttttgagacttatggagttccatcaattgcttttggtgttgatgtggcattcagctataaatataatcaacagcaaggagtttgtgctaaagattgtcttgctttgtgtcctggattcaacacaacccatgtgattccgtttgtagatggggagcctgtttacgaaggatgctgtcgtactaatgttggtggattccatgtgactgatcatttgaagcaactcctttcacttaaatacccttatcatttggctagatttacatgggaaaaggttgaagacctgaagatggaacattgttacattgcaccagattatgtttccgaagttcggttgtttcagaaaggagccaaggaagctgaagaaaaaaccagatgttggcagctcccttgggttccacccccaattgaggagcctccttccgaggaagagattgcaagaaaggcagcaataaaagagaaacaaggtcaaaggcttcgagaaatggctgaggcaaagaggtcttctaagataaatgaactggaaaatgaattgcatggtttagagtttctttttcatcagcttgaacaagtggaagagagcaaggttctatctttcctggccgaaactggctatggctctaggcaggagatagaatctgcacgtaataaagttatgcaatctttacggaaagcaaaaggtgaaccaaagaatgaacaagatgaaactgaaaaggttgatcctgccgctaatgagaagtattctcttattaacattcctgatgacatgctgacccaagaacagctcaatgaaaagaagaaacagttgtcactcaaatctatggctgaagggaggcagcgattaaaacagaagcgccatgaagaggaattggaacgagagagaaaacaacagctagaggaggagaaacgcctggagaacccagagctttacttggaacaactgcatgctagatacaaagacctttcagagagacttgaccaacaaaagcgacttaagacaaacggaggccattctaatggaaataatctgtccggtggtgttggccgtggtgaaagactaaatgctgctcagagagaacgaatgcgtctcctgacaactgcagcttttgatcgtggtaagggtgaggatacatttggtgccagagatgaagattggcaactatacaaattgatgagcaaagattataatgatgatgatgagggacctgatgaggaagaggcagagctggcctgcatctcttccaggctccaggacttggatccaacatttatacccaagttagaagctggtatctcccaacctgctgagttgccacatgttcgacctctgaccaaagaagattttcagatttttcttggggtcgaaagattcagatgtcctgaactattgtttaatccaaactggattgcggttgatcaggtaggattagatgagatggttggggtttcaataaggaggttaccatacaaggatgaaagcttggaacagagactgactagttccatacttgttactggtggaagttctcttttccccggtatagttgaacgcctggaagctggaattcggatgattagaccttgtggcacacctataaaaatagttagagcactggatccagtaatggatgcatggagaggggctgcttcatttgcctcggacccacagttccatatgcaaactttcagtagactggattattatgaaaaaggtgaagactggcttcgaaattatcaactgcaatatacattgtaa

SEQ ID NO: 3640 - DNA, 714 bp, Glycine max
  Peptide Sequence Number=SeqID_120418
atggctgctccaccggcaagagctcgtgcggattacgattatctcataaaacttctcttgattggcgatagtggtgttggaaagagttgccttcttctacgattctctgatggttctttcacaactagtttcatcacaaccataggcattgattttaagataagaaccattgagcaggatggaaaacggatcaagctccaaatttgggatactgcaggtcaggagcggttccgaacaattacaactgcttactatcgtggtgctatgggcatattgctagtctatgacgttacagacgaatcttcatttaacagtaaagctttctcatttggaataatcatccagcttgtgccaatttcagatatcaggaattggattcgtaacattgagcagcatgcttcagataatgttaacaaaatactggtggggaacaaagctgacatggatgaaagcaaacgggttgtgcctacctccaagggccaagcactggccgatgagtatggcatcaaattctttgaaacaaaaaaatttatattgcagagtgcaaagacagatctaaatgtggaggaagttttcttctctattgcaagagatataaaacaaaggcttgctgacactgactctaaggcagagccagcaggaattaaaatcgacaaccaaaaagatcaggcaacggcaggggaagttgcacaaaagtcagcttgctgtggttga

SEQ ID NO: 3641 - DNA, 207 bp, Glycine max
  Peptide Sequence Number=SeqID_120419
atggtgaaggacatcgaagaaggttgccgcacgcccaaacgcagcgcttgtaggataccggcggcgatggtgtgtcctccggcgccgaagaagaagccggcgatttacccggcgaggaagagggtcccacccaagaaaggttattttgtgccgccggaccttgagctcattttcagagttgcaccaacaagagaagcttttgcttag

SEQ ID NO: 3642 - DNA, 333 bp, Glycine max
  Peptide Sequence Number=SeqID_120420
atgaggcttagctctaacaatgagcttatgtccttcatttttgcgggttggtccaagcatgtgcaagacatcgcattggcaatgactactttttatgtttggacgatatggcactgtagaaacaacaagtgcctcaataacaaagccatctccttcgatgcttattcagctagtatgaactcttttatccaggagtttgtcatcaggaagcaacttggtattattgatcatcctaggagagcagatcacatttctctagtcacttggaaccccttttacatggatgggttaagtacaactctgacagctcgactaatggctttccttgcttag

SEQ ID NO: 3643 - DNA, 162 bp, Glycine max
  Peptide Sequence Number=SeqID_120421
atggaggatgattggatgggttgcaaagttcattggcagcaggacttacactggaaaatgtcaatcttcttcctctggattgtgaagctcgaaaaactccgatgttgctgcagtttggaacttgtggttgcagatgaaaaagaaaattttgcatgctgttaa

SEQ ID NO: 3644 - DNA, 678 bp, Glycine max
  Peptide Sequence Number=SeqID_120422
atggaactctcgcaatgcttggccacacttggtgagtccattgggtcgttgagtctacttgttgctggcaaaaccgatttggaagacaaccaaaggaagttgaaaatgcaagttaaggagcttaggaaatttgttgtggaagcagaagtggaacctaacttttggtttctaccatttgatatggtggatctcatgtggtttggagaactagcgttgaagttcctccaacaagaattccaacgatgtggagcttgtgagaaagaggatatgaagatgctagagggtgaagttggacgctttaaggagttgatttgctcttcaatcaaaagtcttgcggagatttctagtacgaactttgttgctaaagaggttgagaagaataacaactcttgtgatctcgaagcaggaaagtcaaatgggggtaataatacttgcatggtttcgggtttaggtgaagatggaattgaacaaacaattggctcttttctccaactgtcgagaattgttgttgataacttatatggtgatgaaggtgagaaggaaatgaagagccaagttgttcttagtttgagtgcggtgggattctccttgtgtgcatgtatacgggggacgatggaaattgaagaagcaatcaaggaacttgttcaatgggagaatccctctagtgagattaattaa

SEQ ID NO: 3645 - DNA, 369 bp, Glycine max
  Peptide Sequence Number=SeqID_120423
atgaaccaaggaagtagagacaagaatctaatgggcaagaatctctcaaatacgaagcaacccaaaacgccatacacagatccaaacacggttccttgggccttaacatttgctgctctaaatgtggcttgggtgttgctaggtcttgagcacaagttggaggttcggtcaatgatttcttgtggaggagtctggcccaaaataagaagaagaaaatgggtaaatcttggtgagttgttggaatggtatgaagggattggagaaagagggttatggttttgcattggattcgggaacagtaacatgctcctcgaggctgttaagaacatgtttaaggtcttggtcgagaaaattgctcattgggaatga

SEQ ID NO: 3646 - DNA, 309 bp, Glycine max
  Peptide Sequence Number=SeqID_120424
atgaattcaagaagaaggttagccgatgtgtgcggaagtcacaagaaatgttgtgatttacagcttggattctcatcttccttttgtgaactgaaggatatacaacttaatgtatggattggttcacctgttactgttgatcctagtagactgccatttgtcttggaaaaacaaattgtattgcttctttacctgtacatggctgttttgcctagcgctgcattactttggttacttaaaagggatgacaacaaggctactacgagtaatagtcactcagtacttatctcgtcagacaaatacccttag

SEQ ID NO: 3647 - DNA, 669 bp, Glycine max
  Peptide Sequence Number=SeqID_120425
atggtgttctggcatgggtctgatgtggggcacagaccttgcctaatcgtaaggcttgggttagcctgcagtacattgacatctggagatagacctcgatttgctcaggcagtcatatcacaggtagaatatggcgtcttgcacttggttgatgcaggcaacccacaaattacagtgttggtggactgtgaagggttgccaccagtgaggattcccatgcaaataatcagatcttgttcttctcttctgcaagaccactttcctaattgtcttggttgcatgtttgtcattcgactgccggccaatgttcttgttatttcccagacttttattcagactttggagcctgctacgagaaacaagttgaaaatagaaggggagatgtatcagaaagttctttctgactatctgccaaaactgccttcatatcttggaggctgctgtacttgcatgaaatgctccaacattgaccatgggaatatgctgcaaacttatgcaactgggaccagcaggagagatgggttggaggacaccactgacagagacaatgacaatgaggattctccaacattgcatccttccaatgaattagaaggcaacttatatgctaattatgaccagttgttaagaactgctatagtagtatttgatcccagcaatcttcactag

SEQ ID NO: 3648 - DNA, 756 bp, Glycine max
  Peptide Sequence Number=SeqID_120426
tcttccggaagaagtgttcttccggaagacgtttggttacttccggaagaacacttcttccggaaactttccggaaaacgttcttccggaacttccggaagaacccctaacgggtcttccggaagtctccgccgtcagcctctgttccccattttttccggcgtcctctcctctcgttttctaccgtcctctcctctcgttttctaccctaaagttactatcctaaggggagttagggagactaacctcgttcgcggagaagaagaagacgacgttcgcgcttgccttgccggagaagaagaagcagttcgcggagaagaagaagcagttcgcggaaggaatgagcagcaaaaaaggcaaaattgtccattcataaaagttgctgggtgcaccagcaatattgctgggaagctcgcgaagatgaaccaaggaagtagagacaagaatctaatgggcaagaatctctcaaatacgaagcaacccaaaacgccatacacagatccaaacacggttccttgggccttaacatttgctgctctaaatgtggcttgggtgttgctaggtcttgagcacaagttggaggttcggtcaatcatttcttgtgggggagtttggcgcaaaataagaagaagaaaatgggtaaatcttggtgagttgttggaatggtatgaagggattggagaaagtaacatgctcctcgaggctgttaagaacatgtttaaggtcttggtcgagaatattgctcattgggaatga

SEQ ID NO: 3649 - DNA, 459 bp, Glycine max
  Peptide Sequence Number=SeqID_120427
atgagctttccacccaactacccaaatagtccgccatcagtgaaatttacctcagagttatggcatcccaatgtgtaccccgatgggcgagtttgcatatcaattcttcatccacccggtgatgacccaaatggttatgagcttgcaagtgagcgctggacgcctgttcatacacattgcattaacgatagctcacatagtcatagtaggatagagctttccataccatgcactgtcaatgagaagggaaatattagtctactagtagagagtatagtattaagtatcatatcgatgctttctagtcctaatgatgaatctccagcaaatgttgaagctgcgtcctatcttatggctacttatttgcatcccagagaagaaaagatgacaaagcttggcaattgggctagaatgggtagggttttgctcaacccaaccctgccccatcctttaagataa

SEQ ID NO: 3650 - DNA, 381 bp, Glycine max
  Peptide Sequence Number=SeqID_120428
atgggatgtagtatagaatcaaagctggagcacacatcccctggacctggacgcaccattttctcttcctcttttgtctctctatcaattatcatatctacgttacaaaatcctttcacatataccataccatactataaatacaattcaactctgttcgctttctcgcttttctcttctcttctatctctgcttcttcgcaatctcagaacagaacacaacagagcccttcaactctctctgtcgttgatggcgtcacaagcgagcctccttcttcagaagcagctcaaaggtgccccctaccctgcgccctccctcacccgatcaactccctttctctctttccgtcttagcgtggattttccgcacccttttgattga

SEQ ID NO: 3651 - DNA, 176 bp, Glycine max
  Peptide Sequence Number=SeqID_120429
cattacgcatgcccacgttggtgaaagaaacatccaaggtcaaggcttggcaatctcaccccaacacacaagggtactttgacctgctcaccaaggacaggataaggcagtgcggcacaggacaaaatagagcaacaggtcaaggcaagtgcaggccttgtggcctgtgggtgtag

SEQ ID NO: 3652 - DNA, 786 bp, Glycine max
  Peptide Sequence Number=SeqID_120430
ggtgagaatgacacatcacaaaatgaacaaatatttgggcaaggtggtgggaaaagacagtatacattgtttcaaggtcattcagggcctgtttatgcagcctcttttagtcctgtcggggattttatcctttcatcctcagcagactcaacaattcgattatggagcacaaaacttaatgccaatcttgtttgttataagggtcacaattaccctgtctgggatgttcagtttagtcctgtagggcattattttgccagctcgtcacatgacagaactgctaggatttggtccatggacaggatacagcccttaagaataatggcagggcacttgtctgatgttgattgtgtgcaatggcatgccaactgcaactacattgcaactggttccagtgataaaacagttcgactatgggatgtgcagagtggtgagtgtgtccgggttttcgttggtcacagggttatgattttgtctttggcaatgtctcctgatggtcgctatatggcatctggcgatgaagatggcacgatcatgatgtgggacctctctagtggccgctgtctaacacctttgattggccacacatcatgtgtctggtcccttgctttcagttctgaaggttctattatagcatctggatctgctgattgcactgtaaaattgtgggatgtaaatgcgagcaccaaggtttctagggctgaagaaaattttctcgaaggaatcttctttttgcggctggcgctctatcaaaaagtggttaatatatttgagtatgtctactaa

SEQ ID NO: 3653 - DNA, 989 bp, Glycine max
  Peptide Sequence Number=SeqID_120431
atggatgtgattggttttgacgatttgccctgcaccctgagctggcgtgaagtggccgatcgttttgatccccaacagcacattagctactggtggagtaatcgcagtgacggctttgcccacgccacgcataaacacagtggcccgctcaccgcgcaacttttttcgttattgtttaacccggcggcgggtgcccagccgggacgcactggtgcacctgtcgccagacggcgagtgccgcctgaccaaccagggcagcgtcacttcagtggtgctgaacggcgtggcgctgcagcgcggctcgcaggtgcggctgcgccacggcgatacgctgcagattggcgaatatggcctggaagtgccgccgccgatccgctgggtatgcagcaggacgaaagcgtgccggaaccggaagtgctgccacagagtgacagtccgcgtcacgaacgccgcccggacgcgcgcctggcgatcgatccgcaaagcgatgcgcccgtgatgccagccgtgctggcgggcgccgatcaggacaaactgatcgccgcgctgctggaaggcatgggcctgaataatggtcaccagacgccgatcaccgaagagcagatgcgcgtcactggccgcatgctcagcctgttttcgcagggtacggttgccctgctctcttcgcgctccatcctcaagcgcggcgttaaagccgacatgacgatgatccttaacgaagccaacaacccgtttaaaattctgccctccggcaaaaccgtgctgatgcagatgtaccagagccagatgcctggctttatgccgccggaagcagcggtgcgcgatgcgctggtggatttacaggcgcatcagctgggaatgattgccggtattcgcgccatcatcgccgcgatgctgcagtcgtttaatccgcagcgtctggaagaggaagcgcgcaaagacggcgtgctgcctaagatgccgttcagcggcggacgcaaagcggcgct

SEQ ID NO: 3654 - DNA, 507 bp, Glycine max
  Peptide Sequence Number=SeqID_120432
atggaagagaatcgtgaaagaccatgttcgtatgatgaaaattttattaagaaaaacaaaacaattcacttcaatgttctcttaagctttgagagtaactgtaataatgtctttcagcttccagcaaataaaaacaaacaagaggaatttgatgactttgctcatccacacccaccgaatccggctgcatgcttgtttgtgtatatcggagaaattagggtattgaagaggtcgctcatggacggagatggagcgacgacgatcgcggaggcgcagtacgcgacggcgaagacatcggtgtggtgggacatcgagaactgccacgtccccaagggttcggatccgcacgccatcgcgcagaacatcagttctgctctcgttcgcatgaactactgcggccccgtctccatctcctcctacggcgacaccacgcgcatcccagcatctgtacagcacgcgctctccagtaccggaatctccctcaatcacgtcccggccggtcggtaa

SEQ ID NO: 3655 - DNA, 1617 bp, Glycine max
  Peptide Sequence Number=SeqID_120433
atggccaaggaaccttctctatgcctcttgttcctctcttttctcattttctgctcttcagggacttctgtatcttcttcttcatcgtccgttggtacaacattcttccaaaaaagcaagatctccaaatctgagattcgattttctgtatcagattgcaagattttgagcactctgaccaacaccaacctgtcagttgatttcttcttaaacgaaagcctggttgaaaattttgtttcttcaaaatcaaaatcatctctagtttcatggctagaaactcatctcatgaacattattccccaagttgacatcagaagcatcgttgttagatgtggcagtgagtgcttaggccaatatgagatgccttcactcatacctattctcaaatcaattcattcatttctcagcaatcttcaactgagaagggaaataaaagtctccgtggcctttcctctttcattcttagagaatttgaatgcattgtatggaaatgatctccttaggattgttatgtttttgaagaaaatagattcatttatcatgatagaagacatcattggtggagaattgagtactgttcagtctgttatcgaaagagccacccttgctgcttctattcttccctgcaaagatgttcctgtggttctcacaatcaagagccatgatattcccaattcaatggaattatctcaattcagtgaggcagtatccaagtatcttgaagcgatatctcattttacaaacagaatagttgcattgattgcacaagtatacacactcaatgattttttactgctcaaaagagaagagggagaagagatatgtcctttgtccctaagagaaaatccaagcaaagtccacatcagaagaactctacaagacacaaccaacacacctaccacagttttccccacaaatccaaccccaccttcacctgtaatcacacctccagatacaccaaccatcatcacagttccttccaccaatcctgtcacggtttcccccaccaatccagcttcaacacctgtcacagttccttctaccacaccagttgttcccttaccccctacaaatccagccaatccagttaccaatcctgtggcctcttatccaccaccatcatcaggaagtgttcctgtcacaagtgcactgcctcctcctccaagcacaaatgctcaagccatgccagcggggcagagttggtgtgtggcaaagactggagttccacaagcttctcttcaatcagcactggactatgcttgtggaatgtcaggtgtggattgttcacagatacagcaaggtgcgagttgttacaatccaaattcattacaaaaccatgcttcttttgccttcaacagctactaccaaaagaatcctgcgcctacaagctgtgactttggaggcactgccaacatagtgaacaccaatccgagctcgggttcttgcatctacccatcatcttcaggggcaggcgcatccggctctggtactggtagcccagttttagggtcccaaagccctcctgatttaaatacctcgtattcagctggtctgagacctcttattggctgcatggttctggcaatatcattagtcactgtaagactcactacatga

SEQ ID NO: 3656 - DNA, 486 bp, Glycine max
  Peptide Sequence Number=SeqID_120434
atgcagcaacgacattttgacaatcattccaagggaaatatacttgtgggccgaagtgattctgaaacgttgcagttcactctcaatggcaagaatatgttaatcaaaacgcatggattaataatatctattattgacttcactttatctacaataaacacaggtgatagcatactgtatttagatctttcctctgatcctgacctatttaaaggaccgaaaggggacaaacagtcagaaacatatcggaggatgaaggaggtgactgaagattgctgggaaggaagctgtcctaaaacaaacgtgttatggttgatctacttggtagacatactcctcatgaagaaatcatttgaacgtactacaaagcacgagagagatctacgatccttgaagaaacgtcttgacaagtatgattcggccaaggaagcagttcttgaccccttcttcactgatttgttcattgagtcggacccaaaggcttaa

SEQ ID NO: 3657 - DNA, 111 bp, Glycine max
  Peptide Sequence Number=SeqID_120435
atgactggtcttcctatgattttacctagtgagagtgttctagcttaccagtgtgtgatagttaggtggatggttttaaagaatctcgtgctagaagatactgagacataa

SEQ ID NO: 3658 - DNA, 1383 bp, Glycine max
  Peptide Sequence Number=SeqID_120436
atggatgatgattcaaaagagaaggaaaggttgacgtttaacatagcgattatggtggcatccatgatcgccattgcaatggtcaccgtttctgtagttgcacacacagacggtcccaaacaagacgcagggaagaatgtgaagactcttctctccgtttgctccaaaacggaggatccagaaagctgtttccgcatgctgaagcacgttggtgagaaagccacagttttgaaagcggctatcaatgcaaccctcacggaattgttgctggtgattaggccaaaacctcgtcttgacggagcctcacgcttctgcagcaagattcttctcacgaggatagccttatccattgttcataatttctctgagaggcctaatagaagagaagcacgacttatgctagaagaatttccaaggtggttcccagcaacagagagaaaaatgatagagtctaatcaaggagataatggtggtggtgaacaatggccaataaatgtggttgtggctcaatatggaagacgtcatttgtcgaccatagctgactcagtactcaatgcatgtccaaagaataaaacgatagcatgtgttatttatgtgaaaagaggtaagtatgagaagagagtggtgattcctaagggtgtaaaccaagtgttcatgtatggtgatggacctgcgcataccattgtcactgattccaacacaagagaccccaagacactcacaacctcctttcgagcagctactttcgtggtaatggggaaaggattcatctgcaaagacatgggtttcacagccccagctgacattggaggagcaccgacactcctagtcctttctgatcactcagcattcttcaactgcaaaattgatggtaacgaaggaaccttgttggcagtagctcaacgccaattctaccgagactgcgagattcttggccgtgtaactcaaaactcacatatcatagtgaagcctcgaaattcctctgatttggttttaagaagaaatgttgtgagtgcacaatccaggttagacaagcatcagacaacagggttagtgattcaaaactacaccatcacagcacatggacaaaacatgaatactcttaatgctaccacttacttgcgatccccatatagtgagtactcaagaacgatcataatggaatcatttataggagatgtgatacatccaaaaggttggtgtaaatggagtgacaatgccatagagacaagaactgacaagagggtcaagtggaatggatacagtacaatttttgagagagatcaaatggttagttacacagttggtcggtttgtccaaacagaccaatggttgctaaatagaggcattccttacgaaattgggtttcttgtacagaattag

SEQ ID NO: 3659 - DNA, 684 bp, Glycine max
  Peptide Sequence Number=SeqID_120437
atggggcaaaagcatttagtgacagtcttatgtttatgggctttaacatgttcccttcttccatctttctcctttggaattctgagaatcggtttgaagaagagacctctagatattgatagtattaatgctgctagaaaggcaagagaaggtctaagatctggaagatcaatgatgggtgcacatgatcagtatattggtaagtcaaaaggtgaagatctagtacctttgaagaattatatggacgctcaatattttggtgagattggaattggcacacccccacagcccttcactgttgtgtttgatactggtagttccaacctttgggttccatcatcaaagtgctactttactctcgcctgctatacccataattggtacacggcaaagaaatcaaagacacatgccaaaaatggaacatcatgtaaaataagctatggaactggttcaatatctggtttcttcagtcaggataatgttaaagttggcagtgctgttgttaagcatcaggatttcattgaggctacccacgaaggaagtcttacctttctgtcagcaaagtttgatggaatactgggacttggatttcaggagatctcagttgaaaattctgtaccagtatggtgtgttccatctgctcttttgttgtttcatctgtatctgttctccatgttagagtga

SEQ ID NO: 3660 - DNA, 231 bp, Glycine max
  Peptide Sequence Number=SeqID_120438
atgggtggcaaaaacaggcaaaggaaatcttcttttttctcagttttcaacattttcaaatccaacaacaagcaaagaggaggaagcaattacaacactttttatgatgaagggccaaaggtgtcaggaaccaaaatatggcctagtgacgaggacaaaggtcgttggggggtggctgatcctgtcattgacatgagagccacagcttacattgctcaatacaagaagcgc

SEQ ID NO: 3661 - DNA, 177 bp, Glycine max
  Peptide Sequence Number=SeqID_120439
atgagtaataagaaggcgaaaggagggcgtagtgatcatggtcgtggctgtgagatagttcgtgattggccaagcgattacgacaaagggtcttggggggtagcttcgcccaatattgacaagaaagctcgtattttcattgataagcaaaagaaccgtgttcaccatcaaccttga

SEQ ID NO: 3662 - DNA, 204 bp, Glycine max
  Peptide Sequence Number=SeqID_120440
atggaccactttgagtctttgaccctaccatcttccacagggggtatttttggtgttttattctcgttcttcgttctcatcctttaccacaacgtgcgttgctttttcattttgagggtgaggctggcaggcagtgacatggatgatgagttgttgacaacatggcctctcacgcaaagaagttattgtatagtacacgcataa

SEQ ID NO: 3663 - DNA, 147 bp, Glycine max
  Peptide Sequence Number=SeqID_120441
atggagatgggaggagatctccatgaccacatcaacaagttcaatcagctactgtggtggagtctgagtgagagagaaatcattcaaggagacatgatgggtcaagaaaaagatcaaaatcgtaattgcatccgtaacgagatatga

SEQ ID NO: 3664 - DNA, 213 bp, Glycine max
  Peptide Sequence Number=SeqID_120442
atgcccggtttgaaccccgacattgtgcaacatcgattacctctgaatctcgggtgctccccggtcaagcaaaagttgtggaggatgaagcccgagatgtccctagaaatcaaagaagaagtgaaaaagcagttcaacgctagcttcttggtagtagctcgataccctgaatgggtggccaacattgtgctagtccctaagaaggatgggaag

SEQ ID NO: 3665 - DNA, 159 bp, Glycine max
  Peptide Sequence Number=SeqID_120443
atggctcgtgattcacagacgagtaagatggcggcgcagcgtgccctgcagatggagcggtggtgcaagtaccgtaggtggtcagaatggctatactcgtggatgataaagactttcgctagagggagagactaccatgtggaagaaactcacacttga

SEQ ID NO: 3666 - DNA, 618 bp, Glycine max
  Peptide Sequence Number=SeqID_120444
atgtcgcttccgaaattttcctactgcatctctggggaggacgctctcggtgtcctcctccttggcgacgggacggacgccccgtcgccactgcagtacacccctttagtgacggcgacaacctcgtcgccgtatttcaaccgtgtcgcgtacacggtccagctcgaggggattaaggtttcggagaaactcctgcaacttccgaagtcggtgttcgtgcccgaccacaccggagcgggtcagacaatggtggattcgggcacccagttcacttttcttctcgggtcggtctacagttccctgaaagatgagtttttggagcagacgaaaggagtgctgacccgaatcgaggatccgaatttcgtgttcgagggggcgatggacttgtgctaccacgcgccggcgagttttgcggcggtgccggcggtgacgctggtgttctcgggggcggagatgagggtgtcaggggagaggctgttgtatagggtgagtaaagggagtgattgggtgtattgcttcacttttgggaactctgatttgttgggaattgaagcgtatgtgattgggcatcatcatcagcagaacgtgtggatggagttcgatttgctcaagtctagg

SEQ ID NO: 3667 - DNA, 1112 bp, Glycine max
  Peptide Sequence Number=SeqID_120445
atgccggtttgtcccgattgcgacagcggattcgtcgaagagatccaaccttcgaaccgctccgtccaccacgtggaaacccgccgccgtaggttcccgacggggacggcaatgtacatgatcggccacagttctaataactccgactacaacccccgttcctctcgccgtcatcattgccggtacgttaccagccaccggtcaccgcttaatccggtcatcatgctccagagcgagggaacaagccgggaccgtggctccggcttcgaccttttcttcgacgacggagccggttccggtctccgaccactccctccgaggatgtcggagtttctcctcggaacagggtttgaccgtgtcatggaccagctttcccaggtggaatcgaactccggcatgggaagtaacgaccagcataaccacgcgccggcgtcgaagtccgccgtggagttgctcccgtcgatcgagatcgacgagactcacacggcgactgaatcgcactgtgcggtttgcaaggagcccttcgagctttccaccatggcaaaggaaatgccatgcaaacacatataccacgcggaatgcatcttaccgtggctagcaattaaaaactcgtgccccgtgtgccggcacgagttgccgtgcgagaatgtcgcacgtgcgagattggagcgcgtggaagaggaggaggaggaagagaacaacaacaatgtgggattaacgattttgaggttacccggtggagggtttgccgtggggagattaggaagaagagagggtgagagagaggttaacgtgcctcttgtgtacacggaagtggatggtgggttcaacttcaacaacgttgttgtgggtgaaccgaggagggtttcgtggtcggtgtcggagtctagagggagcagaagaggtggcgcgtttaggagaatgtttaacggtttgtttagttgcttgagaggtggtggagttggccctaatcgttcttctaacacttcgagaactacggtgatgaggagtaatagttttagggcttcttctcgtcctaataacgtgggtccctctccaccttcttcgcgtaggacttggtcaatggatgtcaacgagggaaccagaccatg

SEQ ID NO: 3668 - DNA, 1419 bp, Glycine max
  Peptide Sequence Number=SeqID_120446
atggagtctgtggtgtgtgagctagaaggcacgcttgtgaaggacaaggatgcgttctcatacttcatgttggttgcgtttgaagcttcaggttgggttcgtttcgccttgttgctaacactattgcccgtgattcggttccttgacatggttggcatgaacgatgcatctctcaagctaatgatcttcgtggctgtggctggtgttccaaagtccgagattgaatcagtggctagggcagttttgccgaagttctacatggatgatcttgacatggacacatggagggtgttcagcaactacgacaagagggtcgtggtgaccaagacgccaaagattatggtagagaggttcgtgaaggagcatctacgtgctggtgaggtcattgggaccgaactctccttcaataggtttggctttgcgacgggtttcgtccttggtcactccaacaataccatttctgaaagggttgccaactttttcgacaatgaagcgccaactttggttatggatcaattaaatccaccgaattcggcaaaccaaaactttaaccaccagctgctccggccacttccggtgatcttccacgacggccgcctcgtgaagcggccgacgccatccacctccctcctaatcctcctatggattcctgtgggcattgtactagccataatccgcatagccatgggctctattctacccttttgggccattccacacatctcaaggctattcggcggcaaggtcatcgtaaagggaaaaccacccctccctccctccggcggcaattctggtgtgctctacgtctgcacccaccgcaccctaatggatcccgtcgtcctctcctccgtcctccgccgcaaaatccccgccgtcacgtactccatctcacgcctttcagagatcctttcccccatccccaccgtgaggctcacaagatcacgcgacatagacgccgaaaaaatcaaacttgagctatccaaaggtgacctagtagtgtgtcccgaaggaacaacatgtcgtgagcctttccttttaaggttcagtggtctttttgctgaactaaccgaccggatagtgccagtggcaatgaactatagggtagggttcttccatgcaaccaccgcgaggggttggaagggtttggaccccattttcttcttcatgaaccctagaccggtgtacgaggttactttccttaaccagttgccggttgaagctacgtgttcttcggggaagagtccacacgacgtggctaactatgtccagagaatattggcggctacgctagggtttgagtgcaccaactttacgaggaaggataagtatagggtgcttgcggggaatgatggcactgtgtctcctacttattctttctttgatcagatggtgaaggtggtgagaacgttcatacggtga

SEQ ID NO: 3669 - DNA, 245 bp, Glycine max
  Peptide Sequence Number=SeqID_120447
atgtctttgtacccagatctgaactgcaacttcgatctccgattagcgatgccgtatagcaggatctgcgagcgaacctcacccacagccatggatggtgagatcacgagcaaggtgattgagttggtgatattttggtttgaggttcgaatccggaaacagcctctttgcatatgcaagggtaaggctgcgtacaacattcctcccccataccttcgcatagcgaagagcctctggacaatggg

SEQ ID NO: 3670 - DNA, 1014 bp, Glycine max
  Peptide Sequence Number=SeqID_120448
atggaggacgacaaaatagttggatacgttacagcattccttaagaagaaaggcttcacgcaaaccgagaagattttccaagaagaattccaacacaacaaatccaacacttccaattcacttctcgaacccgacattgccaaccacctcctcgccttctctcagtatttctctaccttttctcctctgctgacgtgtcacttcttcaccactctcataaaccctattatgttgctttgcagattggagactggtcctgctaggttccacgacggctacagcagactaagaacatggacttattcttcactcgatttgtacaagcacgagttgctccgcgtactttatcctgtgtttatccactgctttatggatcttgtcgccaaaggacacgttcaagaagctcggaacttcttcaatactttccgcgaagaccatgaaatgatgcacttgcgtgaccttcagaagttggaaggagttctttctcctaaccatcttgaggaaatggaattcgctcactcgcttagaaagagcaaattcaacataaagatatgtgagtattcctatgagcttctgttgcaacatctacacagtacgcaatccaccactatacttggtattatcaatgagcatattaactttcaagtaacccctggacaacctagcttaatttccgatgacccggaagctgttaccctaactggaagcagccaggaagcagcaaacctgataaatcaaaaagaaattcattgggggttgcttgaagactctcttgaagaacggctggagaaggccggggccttgcttttagactctgaaaagggtgaaggggaagcaaaagagggggagaatgatgagactaagaaaagatccattgaaggaggaaagcaaggtggtgcttcagtcaaaaaagtaaaaaaggacaagggtggaagtgcaactgggaaaagtgctaaaccagaagctagcactgtacctgcagctcctcgagttaagccagaactccccttgccc

SEQ ID NO: 3671 - DNA, 195 bp, Glycine max
  Peptide Sequence Number=SeqID_120449
atggtcattctaagatatttgaaaatagggataagtgctccgaagacctatttaaggataactatttttagaagaaatttttggcatgctttgtatagagcatggcatcctacaggccacattacaggcaatggttacacgcaagtgaatagtgaacaagattcgcaagatgcccaaagtcacatcccattttga

SEQ ID NO: 3672 - DNA, 726 bp, Glycine max
  Peptide Sequence Number=SeqID_120450
atgtctggaactgcgagtggagcacgagagcatatggagcaattgcagaaacttcaggagaaggacccagaattttatgagttcttgaaagagcatgacaatgagttgcttcaattcagtgatgatgatgtagatgaagatgtgggtactaacacagaagatggaaatctacagctagatgaggaggttagtgaggatgagattgaagagaaggaacaaaaatcctctaaggaagttataactacttctatggttgatttgtggggcaaatcaattcaagaaagtgggagcttgagtgcggttcgttcactgatgagggctttcaggacagcatgtcactatggtgatgatggggggaatgaatctatggcaaagcttagtgtaataatgtctagcactgtattcaacaaaataatgttgactgtacttactgaaatggatggaatactaagaaatttgttgaagcttcctgcttctggtggaaagaaagagaccataacagatttgatggccacgaagcattggaagagttatggccatttagtaaagtcttaccttggaaacgctctccatgttttgaaccaaatgactgacacagaaatgatatcgtatactttacgtcggctgaaatattctttgttgtttttggctgcttttccttcactccttagaaaatacattaaggtggtccttcatttctggggtactggtggaggtgcccttccg

SEQ ID NO: 3673 - DNA, 169 bp, Glycine max
  Peptide Sequence Number=SeqID_120451
actgaacaagttcagaagtgaaatccgtcaattggttgattcatgggttggcgatggtgaagatgatagcatcgcaaagaaaattgcggtaaaagtcctcaaactccttgaagtcaatgtacccatcgccgtttcatcagcatccccgatacttttcaacaactcgaag

SEQ ID NO: 3674 - DNA, 903 bp, Glycine max
  Peptide Sequence Number=SeqID_120452
atgtctttcggtgggttaagtattgctttgagtcttgtctttgggtgtcttctgctggctctgtgtgctcagctttactatttcttatggtggaagaagagaaggacacagatggatattgagatggatgcaaagggtgcgttttattgggggtgctggaagaccccttgtgccatgcatgttgcaaacaacactggaagagggggtgtgaatagggacatagaaagaacaacaacaagtcgtgagccagagatggagttggatttgctgcacaagccctttggagaagagggtactgttgagtcagagttgatgaggctgcacaatctggctggcccaccaaggtttctcttccccatcaaagaggaaactaaagaagatttggagtctgaagataggagcagaaaggggtcaagaacaaggagtttgagtgatctcatgttgacaattgacaccccctttcttacccctgtggcttcctcgcctttgaagtgttgttctttgcctttggaccctcttcattcttataagcatcaaggattcaaccctctctttgaatcctccgtggaattagagtacaacaggtttagatcttcgccacctccgaaattcaagttcatgagggacgcggaagagaagttgcataggaaattgatggaagaggcgaggagaaaggctgtggataataataatgtccaagaatgtggggttaaagattgttctaatgaaacattggccacagattttagagatgggtcctttcttaagttcattcaaacaacagaacacaaacagcctcaacaatatctaccacagtttccttcaggttcatctcagattctcccattggcatcttctcctacaactttgagaccacttgaaaaggcatccattgtgcattag

SEQ ID NO: 3675 - DNA, 220 bp, Glycine max
  Peptide Sequence Number=SeqID_120453
tctggcttcctctccttcttcactaaccatgaaccatgtacacttgttcccggcttatcgtggattgatggatgtggataaagctcaggctgatagcctgtgtagggaagatttatacaactattttgatagccttatccatgctcagattaaagatggggatattgttgcttcgttaagttatcttgatgagatgtcagacactgatcccatgctatag

SEQ ID NO: 3676 - DNA, 747 bp, Glycine max
  Peptide Sequence Number=SeqID_120454
atggaagacatactgaagcttaccattaagtatgagaagttaggtgaacatgctttcacacaaaactcatcatcaaagtgcttctgtgatcccacaatgatcaagactaaaggtgctccaaagaagcgtgatagttgcaagaagaggtcaagacattgttcaaattgtaatagcacaaaacacaatgctaggatgtgtccacaatgtgatgtgattggtttttcccctcatttctatagaaaggtaaaggtaaagagaaagttagtgacagagaaatttaaccggaagcacaagaaagcaaaaaagatgacacaaaactcagatcatgttcataaaggtaaaaagaaagtcagtgacaaggagaaagttaatcagaagcaaaagatagcaaaaaagataacacaaaactcagataatgcttatgtaaatcagtgtttagaaatggttatgtcacttatgtcccaagtgcaaactatgtttcctcctacgcagcctatgatatccccaacgcagcctatggtacaacctaaagtacccccaatgcaaatcccaacatatgtcaattctaaccaagggccatttagcttacctaactatggtggagttcctgtttttcctcacaatacccaagttctcattttatcacaagattatcatggacagtcagttggtaacaactacacatcttattttggattgcttcaagaagtcgtgaaaaatggtggtcaaaccaataagatttattaa

SEQ ID NO: 3677 - DNA, 102 bp, Glycine max
  Peptide Sequence Number=SeqID_120455
atggaggtgttgacatggtcagggaccttgtggaaattggtggcattgacgatggtgatgatgcaacaaaggttcttcgcgatgttgatggctatgtggtga

SEQ ID NO: 3678 - DNA, 1059 bp, Glycine max
  Peptide Sequence Number=SeqID_120456
tcagcgccaatgaagcggaagaagtggtcggagctggaagagcaaaccctactctccaaatactccgagctcctccgttcaggaaccctcgccaagctcaaaacccgcgagaagaagttcaagcctgtggcggagcacgtgaatgcggtgcaccacctccgcaacccagcctccttccccttcaagtggtcgtggcgcgacgtctcgatcaaggtgcagaacatgcgccaccagtacctcggcgtcaagcagaagatccgcctctcccctcaccacttcaattggaaggacggtaacaatcattgggagaattttcttaaatacaaagaagtcttcggcgatgtgcaattgttggaatcccccaaacctatcaccaccgccaaattagggtttgatgttgattctgatgatgatgagaatgaggaggaagaagaagaagatgatgatgaggaggattgtgatgaagaggaggatgtgttgaaggtgaggaggttgggttcggtggtggagctgagggaggcggtggtgaagcgcgaggagaggcggcgggagagggagtttcggcgggagaaggtggaggcggagcgggagaggaagcggagggagtcggagtttcggcgggagaggcgaagggagttgctggaagatcgggagatggagctggaggagcggcagttgaggtgggcccggagggggctggagaagaggcttaggttggagagggagcttgacgcggagcggcggtggcggaagcgcgtggaggagaagatggaggaggaggagatggagtggaggcagaggatggtggcaatgcaggtcgagcacgagaagcagatgatgcagatgcacgtagaggcgtgccagaatcaaatgcaggttctagggatcatggctagactcctttgccagttcttcgggtccggaactgatggattgagtaatggtttgggggcattgcctcctcaggttttgcatcatggaggtggattggggaatgcgaaactttggggagggaaagaaggggaaacagttgagcatgcttgtttgacgtgtttctaa

SEQ ID NO: 3679 - DNA, 198 bp, Glycine max
  Peptide Sequence Number=SeqID_120457
atggcttctgcattgttggaacctagcgcagattgcgtgcctaataatgcatatgccgtgcaactgaggcagctgtaccttgttggctgcagtgttccagtagctcctaaatggaaacttgtaaaaggacttatgccaaatggcccatatccttgctacctctggttttcaagtgccccagaagtcgaatatacatag

SEQ ID NO: 3680 - DNA, 613 bp, Glycine max
  Peptide Sequence Number=SeqID_120458
gcggataccatatatggttgctctgaaacacaaacatggagcctgtgcatcattgctaaatcctacatctgcagaacctcttgtctggccgtctccattgaagttcatcagtgagcttaatcctgaagccaaagctttattagagcaggcattgatggatgcaaacagagaaagagagaaaaacatattgaaagggagttcttactctctgccatctccatcacattctgatggggtagctgataatatgtctgaggtgtgcacaattgaagttcagaactgtggccaccagatgtgtgcacaatgcacactagccctgtgttgccacaacaagcccaaccctgccactgcctgtcttactccaccagtttgtccattttgtcggagcacgataacaagactcgttgttgtgaagacagaatgccacgatgaaactgatcaagacagtgctgatatcaactgttccaagctgagcaagtcatcaaggaaactcagacacttgaatgacagtggtagcagcagcttcaagggactatctagtgttagttcattcgggaagttgggtagccgcagctctggaaggattgctgctgagtggcttgataaacagtga

SEQ ID NO: 3681 - DNA, 498 bp, Glycine max
  misc_feature (428)..(428): n is a, c, g, or t
  Peptide Sequence Number=SeqID_120459
atgtcaacggggtctttttttccggaccaaagtaccacacttgggagccttatgggtgtctctagcattgtagagctgtctagaagatcactaagaggaactaagacagaactattaaagagtaaaaagaaaatgttcaatttcagctcatggttattctgtttgggctcaaggagtaaaattactgaagctgagagccaaaaatataatccaccatctcttggtcaatttcttgctgtggaaagaagagctgctagtgaaaatagaaggaagcaaagcctatccatttacgaccctcatgatgagcttgcattggctgagcgaaattcattatttatgaatggcaccattgctccccctcactccataagtccaaggcagagtattggaacagagagagaaaacatggaattaagacaacacagcanagggtttggtttacttgcggagctgttttcatgcatgtgtggacaagatggcttattggctaacttctaa

SEQ ID NO: 3682 - DNA, 159 bp, Glycine max
  Peptide Sequence Number=SeqID_120460
atggaactagaaggacttgctagagggaagaaggatagtccatggagggcaagaagaaaggaatattggattttaacattaggaaacgtgcagtttcaaggagatgacgattcttcctctctgctatgccattttgttgtggtatatgaggacatgtag

SEQ ID NO: 3683 - DNA, 219 bp, Glycine max
  Peptide Sequence Number=SeqID_120461
atggctgaaagaagatcgaagggcctatgctacttttgtgatgaaccatttacacctgaacatggccttacacataagagattgcatatccatgtgttggaaattgaagatgaagaggagggccctggacctcaacaacttgatgctaatgtgggtactgaacctgattcagaacctttaatttctgtgaatgcattaaaaggagtagctaatttttga

SEQ ID NO: 3684 - DNA, 192 bp, Glycine max
  Peptide Sequence Number=SeqID_120462
atgctccaaccatatgagatcagcataggcttaaaggagcactcaaacccggtgacccccaaggcctacactccgaagagtccgtcagggcctctccctcctgattcagaagacactgctcatgaattatacaatacccacaacctatactcgtgttttaaacacgttcaacacaattgcgctacgatttaa

SEQ ID NO: 3685 - DNA, 177 bp, Glycine max
  Peptide Sequence Number=SeqID_120463
atgtcatcaaatataggggatcatcgacctcatgatctggcctatctagaggttttgctggagacacaactacctgctgttcacactccgggatactacttgtttgggtggatgcaaaatctaccgacaagtgcatcgggtcatcaagctcaagtactaaacaccgatgtctcgtga

SEQ ID NO: 3686 - DNA, 381 bp, Glycine max
  Peptide Sequence Number=SeqID_120464
tatggccactgtacaacacctggtgatggacaacaagaagagaagcccactatgtgtagaaccaagttagacctcaacaaaaatttcaaggaagttaccaaggctatagaggtggctcaagttcaaataagccttatggctggagaccacaaaattctgctatctaaatatggaagtggatctttctcaacaaccacacaggtcaaccctaagaaacattgtaatttaattacaacaaggtgggggactgtggtaggtttgaaggataatgatgagaaaaagaataaacaaggagttgaaaaagaaaacaagaaacatgatgaagtggtgactagtgaaaaagtggtaagtgaagaagagaagaagaaatcaaatgaataa

SEQ ID NO: 3687 - DNA, 642 bp, Glycine max
  Peptide Sequence Number=SeqID_120465
atggcgggaaaaggtctgccgcgcgaagtgctgccgggcattaagctggaaagcccgaaaattacccgtaatctcaccaccgcgtggtttgcccagcgggttgacgggcgatatcagcagtcaggcgtcgaccgggctgcaaacctatatggcgcaggtgtatggctggatgacctgcggcttactgctgacggcgtttgtgtcgtggtttgccgcgcgcacgcctggcgtcatggaactggtgtttgccaatcgcatcaccttcttcggcctgattatcgcgcagctggcgctggtgttcgtgctttccggcatggtgcagcgcatgagcggcgccgtggcgaccgggctgtttatgctctattccgcgctgaccgggctgacaatggcgagtattttccttgtttatacctactcgtcgatcgccagtaccttcttcgttaccgcgggcatgtttggtgccatgagcttttacggctacaccaccaaacgcgacctgagccgcttcggcagcctgctgtttatggcgctgatcggcattctgctggcgtcgctggtgaatttctggctgaaaagcccggcgctgatgtgggcgattacctatatcggcgtggtggtgtttgtgggcctgacggcttatga

SEQ ID NO: 3688 - DNA, 1250 bp, Glycine max
  Peptide Sequence Number=SeqID_120466
gccgagctgcaggcgcgcatcgcccacagcctcgggcagaaaaagcagacgcatttcctgcatcagggcaataccggcatcacgcagaacctctccttcattggtggctaaacacaggagttacggccatgggtaaaccttccggcgattttgtcgccttaaatgcggcggtgatgaccgtctctgacagccgcgacgccagcagtgacagctccggcgactatctgcgtgaggcgctgaccgaagccgggcatcaggtggtcgatcacgccatcgtcccggacaaccgttatcgcatccgcgccacggtgtcgcgctggatcgccagtgaagatgtgcaggtggtgctgattaacggcggtaccggctttaacagtaaaaacagtacgccggaagcgctgctgccgctgctggatcgcgaaattgacggctttggtgaactgtttcgcatgatctcctacgaggagatcggcagcgcgacgctgcaatcacgcgcggtggccggtctggccaaccagacgctgctgtttgccgtgccgggctcaaccgaagttataagcatgtcctcgttaacccatatcaacgcggccggcgaagcccacatggtggacgtctccggcaaaactgacaccgtgcgagaagcgcaggcggaagccctggtgttaatgcagccggccacgctgcaaatgatcctcgacggcagccatgacaaaggcgatgttttcgccaccgcacgcattgccggtattcaggcggcgaagcgcacctgggaactgattccgctgtgccatccgctgatgctgagcaaagtcgaggtgacgctggtggctgagccggagcacagccgcgttcgcattacctcgcgctgtcgcctgagcggcaaaaccggcgtggaaatggaagcgctgaccgccgcgtcggtcgcggcgctgaccatctacgacatgtgcaaagcggtgcagaaagatatcgtcatcgaccagctgcggctgctgagcaaaagcggcggtaaatccggtgatttccaggcggtgcgcgaactgaccggcaccgccgcgctggatctggcggcagagtatgctgacgtcgccacgctgcgcgctgcgctggcgcagaaaagcgatcgctgggcgctggcgctggagtccggcaagctgctggcggcggtgaatcagacgctggtgccgatgaaccatccgctgcgcgccggcgatgaagtggcgttcttcccgccggttaccggaggctga

SEQ ID NO: 3689 - DNA, 684 bp, Glycine max
  Peptide Sequence Number=SeqID_120467
atgaaggcgaacttgggaaagatggaggatcctaagtctgataaaatgaattatccaaagaactacgccacattatatgatttatttggtggattgttaagtgttgctgctctaattggggtactagattctcaaaagtctatctatttcttaagcatttttctttgggcaggaaagatgccttcggaaaataatcagcatgacacagaaaacccatcaaccaacaagtatacatttggatttggaactagtcaggttggatttttgccaccaaattatgcaacttttcaacaatttgtgaggtctgcatatgtacatactcttggcctttcaggagcggaattaaaggaaataaagaagacaaaaaagaggcatcaatggagtagtcaactcttgaaggcactattgaaaaggccttatgcagcattcacaggaagcgggggaaaaccaaccgatttggaagttgaagcagatatgtataatgtttatagccaatataaacaaggtgaaaccaccggattgggggggttggaagaagaaaagaaaactgaggctgatgacaaaaaaaattcaagtccaagtgagacaattagaaaggaaactgatgaacgtgctgacgagaagaacattgacaaaaaggagacagcatttttggttgcagcaagaaatggcatagttgaaatg

SEQ ID NO: 3690 - DNA, 1068 bp, Glycine max
  Peptide Sequence Number=SeqID_120468
atgtatgctgggttttcagcttcaactgggttgttattaagttcacactacatcctcggttggagctttaagatgaacgaagaagccaaatctctgcatttggaaacattaccctcactccccacttccaagaaccgcaaaatggttatgatattaggggttgctgtgtcttttgctattctgacaatcataaccgcaattgggtttgtgatttatgtggtgagaaggatgaagaatggtgatgctgttgaaccatgggagcttgaagttgcaacaaatggcttcaaggagaaacaattaatcggattcggaggcttcggtagagtttacaaaggtgttctcgcagagtctaatactataatcgctgtgaagagaatcaagcaagattcagaggaagggttgcagcaattcatgtcggagatagaaaccattggtcggctccgacataagaacatagttcagttacgaggatggtgtcggaaaaggtgcgatcttttaatagtttacgatttcatgccaaatgggagtttggacaaatacctattcgatgaacccggaagggttttaagttgggaacaaagatttaagattataaaagacgtggctagggatgaatgggaaggcttgttgatggatcatggggagaatccgaacaccacgcgcgtggtgggcacgttgggatacttggcgccggagcttacactcacggggaagcccacggcgagttccgacgtgtttgccttcggggctttgttgctggaggtggggtgcgggagaaggccctttgagcccaaggcgttgccggaggagcttattttggttgattgggttaaggatcggtggggcgcgggccgggttttggaggtggtggattctaagttgaattgggcttttgatccgaggcccagtatgaggcaagtggtgatgtatttggagagggacatgcagcttcctgatgttgaggagccaacgacgtcgttttatgatagggtgagtatgtggtcttgtactacggaggatgttgatgcttcctcgctttcactttccggtgacacggaagggaggtag

SEQ ID NO: 3691 - DNA, 831 bp, Glycine max
  Peptide Sequence Number=SeqID_120469
atgcctacttctatgtaccccttcatattccttagcattctcatctccatccccctcacaggtgggacgcagctcatattggtgaacaactgccaagagagtgtgtggcccggaatccttggcagtggaggccacccaactcctaaagacggtggttttcacctttgcagcggcgacgaggtggtgttggaagtccctgaaggatggtcagggagaatctggggtagacaaggctgttgctttgacaccaaaaccggaaaaggcacttgtgaaacaggtgattgtggaggccttttgaagtgtggaggaatgggtggagtcccaccggctacccttgtggaaatgacacttggtacccctcaatccgccttgcatttctatgatgttagtttggttgatgggttcaaccttccagtgtccatgaagcctgtgggtggaggaataggttgtggggtagcagcttgtgaggctaacttgaacgtttgttgtccctttgctttggttatgaagaggcaaggaaaggtagttgggtgcaagagtgcttgtttggctgcaaaatcagataggtattgttgcactggggagtttgcaacaccaaaaagttgtaagccaagtgcattttcacgtctttttaagactatttgccctaaggcttatagctacgcttatgatgattcaacagggcttaagatttgcaaagcacatcgatggttaagtgagtctcttataagttgtatttattgtggattgctgaatggagctcattggcctacggattgttttcatatgattattgtttacaatgtgctaaaagcaaaggtagtatattaa

SEQ ID NO: 3692 - DNA, 663 bp, Glycine max
  Peptide Sequence Number=SeqID_120470
atgacagggtttggctcatcatgtggagcatgcaagttcctaaggagaaaatgcacgagtgattgtgtatttgctccttacttttcctacgaccaagcctcaacccattttgcagcagtgcataaaatttatggtgctagtaatgtctccaagctactgtcacatcttccaatccagaatagaagtgatgctgccgtcaccatatcttacgaagccttggctcgcatgcaggatcctatatatggctgtgttgctcatatctatgcattgcagcatcaggttgccagcttgcaagaggagatagatgctcttggaaatctagtggcaaattcctcagttagtgttgtcaattgtggcagtgtccaagcaacaattaactcaaacaacggaacacagtttaatattttgcagcatgatgctacaaggacacagtattgtcaaaataatctagctaattttctttcacaagaaggaagtgccacagtcttccaaagtctgatcaactcacagatggatatagaacttcctaattgtacacaagtggaacacccttcatttggtgatttcaactctaatccgttagaacagttcctatctggaattgaccaagagatgttcgtgaatcatccatggttcaagcataatgcagacataaagaactag

SEQ ID NO: 3693 - DNA, 267 bp, Glycine max
  Peptide Sequence Number=SeqID_120471
atgtctaggagaaagaatcagattgacacagaaaacccaccaatcaatgaacagtttggatttggacttttgccacctaactatgaaacctttcaacagttagttaggtctgcatttgtacatattcttggcctttcaggagtggacataaatgaagtaaagaagacaaaggagaggcatcaatggggttgtcaactcttgaaggagctaaagatggaagcaccaccttttcaagattacattggaaacggggatttacgaatttga

SEQ ID NO: 3694 - DNA, 664 bp, Glycine max
  Peptide Sequence Number=SeqID_120472
atggcaaatcgttggtgggcaggtaacgtgccggtgaggcccaatgaacaagacgacggtgacaacaaccctactccgaccaacagtgggaacagtaacaccaacgttaacgcggttactgaggacgatgccaacacaaacgacggcgaggatcagaatctaagtgccgggcggcggccgcgtggcaggccacccgggtcgagaaacaagccgaagccaccagtggtggtaaccaaggagagtcccaacgcgctccacagccacatcctcgaaatcagcggtggcagcgacgtggcggagtgcattgccaccttcgccacgcgccgccaccgcggtgtctcggtcctcagcggcagtggcgtagttaccaacgtcacgctccggcagccggcagccccgggaggagtcatcaccctccaggggaggtttgagattctctccctctccggtgcgtttctgccggcgccgtcgccgccggaagccaccggactcaccgtgtacctcgccgggggggagggacaggtagtcggtggaagcgtggtggggccccttgtcgcctcggggcccgtgatggttgttgctgctactttcgctaatgccacctatgaaaggttgcctttggaggatgaacaaggtgaagaggacatgccagatgtgaatgaag

SEQ ID NO: 3695 - DNA, 240 bp, Glycine max
  Peptide Sequence Number=SeqID_120473
atgaataacatcatttctgggcagaagactggtggacaatatttggttagtggatttgattgtacagtgcatagaaatttctttggcagccagattcaaagctttgacgcagagctttcagtgctagagcttgtctccaaggaaggagagctagaagttcaagtgttggctgattatcctataccttctagcagattgttgagttctgattcctctattaaagaccaaatggttagttaa

SEQ ID NO: 3696 - DNA, 177 bp, Glycine max
  Peptide Sequence Number=SeqID_120474
atgtctcaacaggatgagggttggcctctgggtttactgcagccagcgaatgcaaggattgaattggtcagaaacagtgacaatgcggggtcaatatcattcaacaccttactcactcgttctccatcttcttctacagattcttcatcagattttgacactgagagaccccactaa

SEQ ID NO: 3697 - DNA, 549 bp, Glycine max
  Peptide Sequence Number=SeqID_120475
atgggggtatcttcgaattccaaagtctttctctctgacaaagatctgaaaggagtgataaacaacacggatcatcatgaagtgggtttattggtacacaaggaaggctgccaaagtttgatccaagaagatcaccagattattagactcaaacaactatcggtgcaacagcgtgaccaagaagaaggagataataaagacgatcatcaccaagaagagcaaaagcaacgacgcaacaacatgatcgttacagcaaaaccggtgtgtcctcctataaacttgaaactagagattccgtattcgcgtgtgggatcagagaacgatgacgacgggttgaagactccaacatcttcggaccacaaaatcccggtgatcctagagtgcccaggtgcacccaagaagacaaaatcaaagccagacacgaaaagaaaagagtgtcgaccaagaattgtgcttgatctgtccaaagatttggaatctttgttccctatgccgcatgctgttgatgttcttggcggtggcctcaagaataagagagtcaaacagtga

SEQ ID NO: 3698 - DNA, 214 bp, Glycine max
  Peptide Sequence Number=SeqID_120476
atgaaacgggcttctgaaaaatccggccaagccgtagctgctgaagataacgtgaaaaacaccgagttccttggccacgctggctgtccatccgaagatgtcggctatgatgcaaagttgttgctgatggacgatggctggtctcatggtaggcgatgctatctgtggtcggaggaagtgaaagggatttcgaagaagacgacggaggagtctg

SEQ ID NO: 3699 - DNA, 216 bp, Glycine max
  Peptide Sequence Number=SeqID_120477
atgacgggtaggggggtcctaattttggggtggcccatggcagcggagcagttttataactacaagctgttcgagggagaggatgctaaaaggacgagctatgagcatatagtggctaaaattgaattgttcatgaacgtgactgagaaaggaatcatgatgagaaagaaagttggtaatatcagatatatgataaggggatgctgcaaaagatga

SEQ ID NO: 3700 - DNA, 435 bp, Glycine max
  Peptide Sequence Number=SeqID_120478
atgccaatggaggaagcactagacaagcagctgaaggttggtaattctgcaacatctgttggcaagtcccgaaggaaaggatgttattatacctcaattccacatgttgtgaaatgcaaggggattagtgggcaggaacttacttctttgaatcttgacaagacacatttgttagaaactctactgacaaaagattatggagattctgaagacttgcttcttggagaactgcagtttgcatttattgcctttttgatggggcaatcactagaagcatttctccaatggaagtcattagttagccttttgtttggctgcaccgaagcacctttccgcacacgaactcatctattcacaaaggtacaaaacattgacattaatacttggaatgctgttaatttcatccctgattgtagtagttcttctgacttctga

SEQ ID NO: 3701 - DNA, 219 bp, Glycine max
  Peptide Sequence Number=SeqID_120479
atgaaatgggtcctactgccggccatttctcacgttgctgataattgggtaggcaaaggcaatagactagacgtgttcggtttggacttaggattcccaaacttcaccaccaaccatacgggagaagagagagaaaaagatactatatccatctcggtaaaagaaattgacaaatggaatatgcagaaaagagggaggacccaattgggatttgcctga

SEQ ID NO: 3702 - DNA, 1233 bp, Glycine max
  Peptide Sequence Number=SeqID_120480
atgttatccacgcaccaaaccgaaaaagtgttgggcgtgaagggatgtattgagaaaaactcaagtctcacatcggttaaagataaagataagttagagtatataagtttgagttcaaaggatggtaacaaggaagaagatggcttaagcagcaaggcctcaactccctctgttcctccaactccgcggacggagggagagatcttgaagtcctcaaacatgaagagcttcaacttcagtgagctaaaaactgctacaagaaactttcgtccagatagtgtggtgggtgaaggcgggtttggttgtgtttttaaggggtggattgatgaacagacacttgcaccagttagaccagggactggcatggtcattgctgtgaagaggcttaaccaagaaggtcttcagggacacagtgaatggttgacagaaatcaattacctggggcagctgcgtcatcctaatcttgtgaaactgattggttactgcttagaggacgaccaccggcttttggtgtatgagtttttgaccaagggaagtttggataatcatttatttaggagagcttcttactttcaaccactttcttggaacatccgtatgaaggttgctcttgatgctgctaagggtcttgcatatcttcatagcgatgaagcaaaagtgatatatcgagacttcaaagcttcaaatatcttacttgattcgaattacaatgcaaaactttctgattttggcttggcaaaggatggaccagctggtgataagagccatgtctctacaagggtaatgggcacatatggctatgctgctcctgaatatatggccacaggtcacttgacaaagaagagtgatgtatacagcttcggggttgttctgctggaaattatgtctggcaaacgagcacttgacagcaacaggccaagtggggagcacaatttaattgaatgggccaaaccttacctcagcagcaagcgcaggatcttccaagtcatggatgctcgcatagaaggccaatacatgttgcgcgaagcaatgaaagtagccactcttgccattcaatgcctatctgtggaaccaagatttagaccaaagatggatgaagtggtgagagcattggaggaacttcaggattctgatgacagagtcggaggggtgggaagctctcgtgatcaaactactagaaggagtggccctagacaacatagaggtagacaacatgaaacaacaaggaagtga

SEQ ID NO: 3703 - DNA, 111 bp, Glycine max
  Peptide Sequence Number=SeqID_120481
atggcaattgggttcatggaggtgcagcttgtgaaagcaaagggtcttcaagaaacagatatctttgcttctgatctgagtcatctgacatctcaactctcaattccttga

SEQ ID NO: 3704 - DNA, 1106 bp, Glycine max
  Peptide Sequence Number=SeqID_120482
tgcctcagggatttaggaatactctagaggaagctggatggaaggtggggcgctctcctattttcgaaactgtaactgcagctgatggaactgttaagttgttgttgaagttggaggacaatagattgattgaaactgttggcattccagttatggttgataaaggcttgactcgcctcacagcatgtgtctcatcacaggttggttgccctttacgctgctctttttgtgccactggaaaaggggggttttcaaggaatcttcagagacatgaaatagttgaacaggtcttggccattgaggaggtcttcaagaatagggtgacaaatgtagtgtttatgggaatgggtgaaccaatgttaaacctgaaggcagtacttgaagcacaccattgcttgaataaggatgtgcaaattgggcaaagaatgataaccatctccactgtgggcgttccaaatacaataaagaaacttgcttctcacaaacttcaatctactttagctgtgagcttacatgctcctaaccagaaacttagggagacaattgttccaagtgcaaaatcctacccattggatgcacttatgagtgactgcagagaatactttcagcaaactagtaggcgggtttcctttgaatatgcacttttagctggagtgaatgactcagtaaaccatgcattagagcttgctgaattactccatcgatcgggcagcggatatcacgtcaacttgatacctttcaatccaatagaaggctccgagtatcagcgtccttccaagagagcagtgcttgcattttctggtgctttggagtcctctaaaataactgttagtgtacgtcaaaccagaggactggatgcaaatgcagcttgtggtcagctacggaataagttccagaaaactcctgtagtcaccgacccttttgatcttgcagtcacagacacttctatgccatacaataacaagtttgcattgtggagtgataaaggtgtttactgttgctgcatcagttgtaatatcaacttgccatctgagaaattgtggacagacacctatttgcttgttgtcaattttgctggaccatgcaggcctgagagcctacagtag

SEQ ID NO: 3705 - DNA, 981 bp, Glycine max
  Peptide Sequence Number=SeqID_120483
atgcgtcggaacagccctgcatactacagtcctccgcggcgaggatacggcggtggtggccgaggaggaggaggaggaggaggaggaggagggtccggcaggagggggttcggtggaggcaggcgcagggacagcaatgggagcctcttggttcgtaacattcccctcgattgcagacccgaggagcttcgcgtccctttcgagcgatttggacctgttcgtgacgtttacatacccaaggattattactctgggcttcgtgaggaggtttttttagtttgtggttgtgagagctttgtgctcaagtgcttcttagaacctcgaggctttgcctttgtgcagtttgtggatccttatgatgcctcagaggcacagtaccatatgaacagacagatttttgctggaagggaaatatctgtagttgtggctgaagagacgagaaaaagaccagaggagatgcgccacaggactagtaggttaagactgtccttgctcgagttctggatcccatcaatgattgttatgatggggatccagacagtgctaacttgccaaggtgttgatggccggcagccaatttttcataatgctagttttctagtagcactgggcgttctcgatctcgctcagttaccagatcacgctcaccaccttatcactctggttctaggaatcgatatcgctcaaggcatgtcctattcgcctgctccaagacggcaaagtgattactctgtttcccctaggaggcaagctgagcaccccagatcaccaagaggtcctcccagggagagggatggtgaacagaagcgtaggtcttattctcctgcttatggcaatggtattgaacagaatcaaagcaatggatatgctgagaaatctatgtacaagtctgatgctgatcgtggtcagtggaagtcgtcgagatcaccacctggatctagatcaagatctgctgaattgtcaccaaggcgtggaagatga

SEQ ID NO: 3706 - DNA, 2454 bp, Glycine max
  Peptide Sequence Number=SeqID_120484
atggagcttttgaagcctttgcaccctcaccatgcacccattttgcgaattccctttcacgctgttccctcctcctcttcttcttcttctcaatctaaggttccccttcctatgatttctaaggttcatgtagctgttgggaaatcgctcgacaaagctgtccccttgcttcgatggactttaaatcacttccggaacgcggaaatcgtcattgttcatgcttatcaaccttctctcaccatccccactctattggggaaattgccagcatcacaggctagtcctgcagtggtgtctgcttttcgaaaagcggaaagagaacaaaccgtgaagctcttagacaagtatttgagcatttgccgcgctgctagggttagggcaagcgttattgtaactgaagctgaccaagtccaaaagggaattgttgatttggttattaagcataatattgagaagcttgtcattggagcaataccagaaaattgcatgaaagtgaaaaggaattccggtaaagcaaattacactgccaaaaatgctcctccattctgtgaagtatggtttatctataaaggtaaacacatttggacaagagaggcttctgaaacaccatgctattcatcctcatgtactcaacccgagattgccaccagagaaagcttgagatgtagatcttttcaatatggtaatgaattatttgactcagaatatcttcaaccaaattcagcaagaactactactggttctggaagtagaagttgggttcagggggaaatcattgaaactgaagccattttttcatccagttgcagcagtcattgttccccccaaaattcttctcgggcatatttagatacatatttagaggccatggaagaaagaattaacaaacaacttattgaaaccaagagagaagctgaggctgtgacagacgaagccttcgcagagctattaaagtgtgagaagttagaagttgaagccatggaggctataaggaaggtcaatttgtttgaatctgcccatgtgcgtgaagtaaagctcagaaaagaggctgaggatgcactgacagatacagtacaagaacaacaaaagctcttgaatgcgagtgaagaaattgctggcgagctacaaatgaccatgagaaatattgccctgctagatagtcgtgctcaggaagcacaccgtaggtgcgatgaagctgcagatgaactatcactaattcaagaatccatctcaaccctgtggcaagaaaggcagcaaatcaggagacagaaaatggaagccttacgttggcttgagcgttggagaagtcgtgggaaagttggagcagctcattgcaatggggtcattgggtttgctgaagaattacctgagttagcagaattttcattatcagatcttcaaaatgccacatgtaatttttccaatagctttataattgagcaaggtggatacgtttgtatatacaagggagaaatgttgggtaggactgttgctataaaaaagttccatcaacataacatgcaaggaccattggagtttcgtcaagaggttcaagttcttggtagtctccagcaccctcatttaatcactttgcttggtgtttgccctgaagcctggtcaattgtatatgagtacctccccaatggaactcttcaagactacctattccgaaaaagcaacaattcccctttgacatggaatacccgagcacgaatgattgctgaaatcgctagtgcactctgcttcctgcattcttttagacctgaatctattatccatggtgatctgaagccagaaactgtactacttgattcttcacttggttgcaagatgtgtggatttgggttctgcaggctggtcagtgaggagtctctcctccgtcctagtttccgcttgagcactgaaccaaagggtgctttcacatatacagatccagagtttcagagaactggaatactaacaaccaagtctgacatctactccttcgggctcattattttacaactcctcactggtaggactccagtgggattagcagttttagtacgcaatgcaatttcatgtggaaagttgtcttcaattcttgattcttcagccggagaatggccctcagctgtggcaatgcgattggttgaactgggattgcaatgctgtcaacaataccgaagagacagaccagagttaacacctacacttgtgagagaattggagcagttgcatgcttcagaagagcgacctgtaccatcttttttctcatgtcaaatccttctggaaataatgcatgatcctcaagttgcggcagacggatttacctatgaaggagatgccatacgtgaatggttggaaaatgggcatgatacttctcccatgactaatttgaaattgagtcacctgtttcttactcccaatcacgcacttcgacttgccatccaagactggctttgcaaaccttga

SEQ ID NO: 3707 - DNA, 769 bp, Glycine max
  Peptide Sequence Number=SeqID_120485
actgcttaaatttgacaacaagaattggagggcctcttacaattctctgattgtgctggagcacctgttgactcatggaccagaaagtgttgcagaggaatttcaaagtgacaaagatgtaattggccagatgaaatgctttcagcatattgatgacagtgggttcaattggggtctagctgttagaaagaaatcagaacagatactgaaactgctggaagaaggaactctccttaaggaagaaagaaaccgtgctcggaggttgtccagaggaattcaaggttttggaagtttcagtccacgttcaactcaagcacaaggcgttctgcaggaaaaatcatcgccaaccacatttgacagacgtaccgctgacttcaacgacaatgaaaaccaggaaaaccaatcctttggctcaaatctttgtctggacacagcagcagttaaatctgctagtcctagctctcaaggtagaattttaaagtccttagatgatagtgtagaaactgaaagctacctggatgatcagggaaacattcaaatgcaccagaaatctgaaacaagctctggagaaaacatgacacctagcaaggaggaattccatctatggaacttgaaaggggagtccaatccacttttggatggtagccaagaggatcattctagacttgggatgttcatagcccaagatgatcacccctttaactccacagaaatgcatgccacttcttccctactttctcgacatgaagtatgttacgcattaaaatga

SEQ ID NO: 3708 - DNA, 1524 bp, Glycine max
  Peptide Sequence Number=SeqID_120486
atgcgaagtgtgataggcattttcgcacaacagaggttggttcagttaatacatcgaacaccttgtggcattgtttgtttgaagctgttttgcacccaagcaacacaaaaccacgattccctgtctcggagaatcgagaagctccccaaaggagaatccgttggctccgctttccgcagttggatgagagatggcctccccgttcatggcggtgacatctttcacgccattaaccgtctcaggaagctcaacatgaacaaacgcgcccttcaggtgatggaatgggtgatcagggagaggccctacaggcctagggaactggattactcttatcttgtagaatttacaactaagctgcatgggatttcacatggtgagaagcttttctcccgaattcccgttgagtttcagagtgagttgctctacaacaacctagtgattgcatgcttggataagggtgtcataaagctttcacttgagtacatgaagaaaatgagggaattggggtttcccatctcacacttggttttcaaccgcctcattattctgcattcctcgccaggtcgcaggaagatgatacccaagttgctcacccagatgaaggctgataaagtcaccccacatgtgtccacctacaatattttgatgaaaatagaggctaatgaacataatcttgagaatttggtgaaggtcttcggtcgtatgaaagttgcacaggttgaaccgaacgaaatatcttactgcattttggctattgctcatgcggtggccaggttatatactgcaactgaagcatatgttgaagctgtggagaagtctattacagggaacaactggtcaacattggatgtcctgcttatgttgtatgggtatcttgggaaccaaaaggagctggaaagagtttgggccacaattcaagaactcccctccattagatctaaaagttacatgttagccattgaagcgtttggtagaattggacagctaaaccgagctgaagaaatttggttagaaatgaaatcaacaaaaggattgaaatctgtagagcaattcaattcaatgatgtctgtatattgcaaacatggattcattgacagagcagctaaactgtacaaaaacatgaaggcaagtgggtgtaaaccaaatgccataacttatcgtcagcttgctctgggctgcttgaaatctggtatggcagagcaagctttaaagacattagacttgggcttgcgtttgactattagcaagagggttagaaattcaaccccatggttggagaccactctttcaattgttgagatttttgctgaaaaaggtgacgtgggaaatgtcgagagattgtttgaagaatttcataaagctaagtattgtagatatacttttgtatataataccttgattaaggcttatgtaaaagctaagatttataatccaaatcttttgaaaaggatgattcttgggggagctagaccagatgctgaaacctacagtcttttaaaaattgcagaacaatttcagacctga

SEQ ID NO: 3709 - DNA, 561 bp, Glycine max
  Peptide Sequence Number=SeqID_120487
atgccttgggtgaggctttcagagtctccaaggctcgacgttgctattgacatgggtaatccatttctcaatctcactgttgatggtttccttaagatcggagctgtcgcagccacgcgatcagctgctgaagatacttatcatattatccaaaagggcctttgtcagactaattcaacatgtctgttccagggaatatctcaagtcgtgatttcgagaaaacttatagtgatgagaggattagtcctagcggaaaatgatgatgactggggtgaccccccaaaggacacctcggaatcctattcaatggacatttcgtggtgtatgctattctttgttccttgctcacgaggaactatagctggcgtttatgttggaatggaatatggggtagagaggatccgtggcaccagagactggaagaatgccatgattgggggtgcagtaactggggccctggtatctgcagccagcaacaacaagaaagacaagattgcgatagatgccattactggggcagcaattgctactgctgcagagtttataaattaccttacctga

SEQ ID NO: 3710 - DNA, 2364 bp, Glycine max
  Peptide Sequence Number=SeqID_120488
atgggaaaggacttggtttcttctgaccagactactgttcaaattcaggacaataatccaggatgcatgtggggaatgcttcaaattcttgattaccatcgttggcgcgtaaaaaaggtgttccctcacaaaaggagaagacatgccacatataagagaaaacccattttgtataaccaacatgaagatcaacaacatggagttacagaagcagaacccctccttgtcgggcaacctagcaaaaaattgcatgctgcaggcaaaagttctcccaaaaatcgcaaaaaggaaccacgcactgagaaagagtttaacaacgaaaactccaaaggcaacagtagcatggactactcaaagaaaaaccaagccagtagagagtatgcacttcatctggagaaagatggcaagacaacagaagctgcccttaaccataagcctatggaaacaaacaagcataatagagacatttccaataaatttgagaaacatactgatgtttttgagttgcttagagtagagaaagatttattactcaaatttctacgagacatagactttggtggaaaaaaagtccaacaagcttcccacatcaatgcaagattgaaaaaatctgggtcatttcctttggcctcaacttcacagatgagaaacataagctctaggtccttaaaacacaagcaaaacgaaatttgggcctttccaaagggagaaaaactgcatgctggtactcaagaatcaaacatgttggtgtccagttctgtgaaagatacttcttatgagaagtcaatgcctttagcgagtgatcttggtgtggatagtgccatgaaacaaaaagcaatcatttcttcagggccttctcagggatcaaatcacaaagggtggaatcaagtggttcttcatcaattcaaagttataaaacagaagataaaatatgttcttgtggaattcagaaaaagcggttaccaaactacttctgctgaagccatccatcgcagagcttcacctgaatatagcatcataaaaaatgaggaagagatctcacaaagcttagaagatggtgtggttcaacaattcaaaaggagtaaaagctcaaatgaaactagagcttctgattatgattccaacaagcatgatgctcgcctcatgcgaagaacatcctctctgaatgaatcattggatagatatactcagttgtttgagaaaagcttcagcaaagacactaagtggcaaagctcaaagtctaaaagcttaaaattgacaaacgaggataagaaccacaagaatgggcacgctcctaggttttcaagaagcaacttgtctatgcctaatctcgagactttaggcttcattctacaagatgcactttttgatacaaatgatatagggactacagtggaagcttataatcgtgttcatagaaaatcagtgagtcttcctttgaagatagacaagtcacttgatcattttaaagaggctgagattgtggaaacagtagaagggagtaacagagatgttaatcccagtcttttatcagatatgattatggagaaaattgaagaaattgatgaagaagttacctgtgaccagaaggaggaaatgcatgagccagcagtgggagatggaagttttccccaggaaaaagaggaaatgaataatatgactaccaatcttagcaaggaggtgatggcaactcttggaactagctttgaggacaataaaactggaaatgcagaaggcacagaattgaattcactaggctctacattggacgaattggagactgatttatcatataaaggaaatgtatatcattctttgccagactcttcatccgacagaaatgctagtgtgacagccgaagacacagacaacacttccaatttcaaatatgtgaaaaatgttcttgaattttcgggcttcttgggaaatgagcacactcagaagcgatacacagtagaccagccactgaagccctccatattccaagatttggatgcgactttgtgccatgaaattgaaccctctgaagagacaatcagccaccagcttctttttaacttagttaatgaggtgctgcttgaaatatatggaaggtctccaacttacttcccaagaccattctcattcaacccccgcttccatccaatgcctaaagggaactatcttctggatgaagtatggaatagtgttaattcatacctgaccttgagacctgagttagatcagacactagaagatgtcatcggtcgagatttggcaaaaggaaaaggctggatgatacttcaagaggaagaggagtatgtagcacttgaactagaggagatgatcatggatgatttgttagatgaattcatcttctcatga

SEQ ID NO: 3711 - DNA, 432 bp, Glycine max
  Peptide Sequence Number=SeqID_120489
atgccactcccagctccattatctgcaggaccatcagacttttcattcacaccccagatgcttcactccatgatgcaaagtttgcaccgagggcagtccatcatcatgaagagccttcagggcttgggcttgccctccattatgagcatggaggagtttgaggctcaggtggcttggccaggagatcggtcttcttcttctggagggggtggggcctctgcagcccaggagcctgtgattaaggagccaccagcaccagcaccaggcacaacaaaggatgaggatgagctcactcctcttgaaccttcttattttgatgtaggttcacatatggttcaggaggaggagactactccaaatcagaccccacaaccatctccagccctcgcacttattcctaaggatgttgtaccagttgcgaagcctgagtag

SEQ ID NO: 3712 - DNA, 432 bp, Glycine max
  Peptide Sequence Number=SeqID_120490
atgccactcccagctccattatctgcaggaccatcagacttttcattcacaccgcagatgcttcactccatgatgcaaagtttgcaccgagggcagtccatcatcatgaagagccttcagggcttgggcttgccctccattatgagcatggaggagtttgaggctcaggtggcttggccaggagaccggtcttcttcttctggagggggtggggcctctgcagcccaggagcctgtgattaaggagccaccagcaccagcaccaggcacaacaaaggatgaggatgagctcactcctcttgaaccttcttattttgatgtagctttacatatggttcaggaggaggagactactccaaatcagaccccacaaccatctccagccctcacacttattcctaaggatgttgtaccagttgcgaagcctgagtag

SEQ ID NO: 3713 - DNA, 243 bp, Glycine max
  Peptide Sequence Number=SeqID_120491
atggtgacacttcactcaacttctcgttggtcagaaccctccatcggaatattcattgatcctaaaagtagtcgaaacagattgtcaaggtctcggaaagagctacctacgaaaggttttgaccgatggagggttctgaccaacgagaagttgagtgaagtgtcaccatgtgaagtgttatactgtgagagtcgtcgagaaatcgacaatcaggggtgttacaatctcaacgaaagagattga

SEQ ID NO: 3714 - DNA, 162 bp, Glycine max
  Peptide Sequence Number=SeqID_120492
atgactaacggtgtaaggttggagcaagtgctgggtggagctctaaaaggtgtgttgttgtcagaaatcacatatttggagttaagcgacaaaggtgagagcctcaacaaaagtgtgttgtgtgtggagcctatggttgaggaaggagagtgcgaagggtga

SEQ ID NO: 3715 - DNA, 3690 bp, Glycine max
  Peptide Sequence Number=SeqID_120493
atggctatgcaagtcaattccaatcagagcaatttcaatggtaaagggggatattacaacaaaggcaagggctcttctaaaggtggtaatcgagtttgcactcactgtggcaaaacaaatcacatcgtcgacaattgttttgagaagattggctaccctcccggatacaagaccaataagtccaagaattcatcatcatcatctcaggccaacaatacctcaaatgcttctgctctggaatcaacccaacaaggttcctctgcacagtccagttttcagtttacgcaagagatgtaccaaggcattcttgaagctcttcaacagtcaaaagttggttctcaaccaaaggccaattcagtaaccacatctccctttgctttgcattccccttcctccaatccgaatggtaagaatccttctctttggatactagataccggtgctactgatcatattacttttgatctttcctctcttaccacttatcaaaacattgtccctgtccctgtttctttacccaatggatcacaggttctagcttccatctctggtagtgtagttatctcacctttaattactatccatcatgttctttacattccttgctttcatgtcaatttgatgtctgtcacaaaattagctagtacaaataattgccatttaagtttcactactgatttgtgcaagattttgcagaatcattctctggaaacgattggtacagctaagcttcaaagaggattgtatgtgatagatactgctgatatgattcgttcttgtaattcaatttcttctcattcttttgagctttggcattccagattaggacatgtatcaaattctggtatgcaagccatttctaaacaatttcctttcataccttgtaagaacaacatgtcaccttatgacagctgtcatttttctaaacaaaagaggcttccttttcctaatagcattactacttctttatctccttttgaactattgcatgctgatgtttggggtccatattccaccatttcccttctaggacataaatattttctcaccttagtagatgattattccagatttacctgggtcatttttctcaaaaataaaagtgaaactaaaaaccacattattaactttgttgcttatctagaaaatcaattcaacacatccttaaaatgtcttagatctgacaatgggactgaatttgccttaaacgatttctttctatctaaggggattatccatcaaaaatcatgtgttgagacccctcaacagaatggtgtagttgaacgtaaacaccagcatattttgaatgtggctaggtccttcttttttcattccaatgttcctctcactatgtggaatttttgtgttcaacatgctgtccatgttataaacagaattcctagtcccttacttaagtctaaatccccttatgaattgttattcaaattaccacctacccttctccaccttaaagtctttggttgtttgtcctatgccactactatacaagcacatcgtaccaaatttgactctagagccagaaaatgtgttttcattggttacaaagatggtactaaaggctacatgctttatgaccttcactcacacaatattttcctctcacgcaatgttattttctatgagcattgtttgcctttcaaaactgttcctggacccactccctcaaatactccatctaattttccactttatgatgatcctttggacatctcacctcatccttgtgtggactcctctcctttatccaccggtttgatagacagtacaagcaccagccctgcatccattccacccatagatcacactttggactctagttccttacctacccctgctgttacagctcatcctactcatcctacttctgatcttgatcaaaattcaatagatcaaacatcatcccacattactaatgttcctgttactttagagccacccttacccttatctaccagagtgtcaactcgtccaaaacgacctcctggttatttacaggactatcactgcaatgtcatatctagttgtaccaatcagttttcaagtaatgttgcttaccccctttcttctgttttatcttataataattgttctcctgattacaaaatattttgttgctctatttcttccaccattgagcccaaaacctataaccaagcttccaaatttgactgttggaagaaggccatggatgctgagattacagctcttgaggtaaataaaacttggactgttgtggatcttccttgtggaaaggttccagtaggttgcaaatgggtatataaaatcaagtatcatgccaatggcacaatagaaaggtacaaggccaggcttgtggccaaaggttacactcagatggagggtgttgactactttgacactttttccccagtagccaagatgactacagtacgtgttttactagctgttgctgctgttaggggttggcatcttgaacaactggatgtcaacaatgctttcttgcatggtgacttgaatgaggaggtttatatgtctcttcctcctggttatgatgcttcttccccttccaaggtatgcaaattgaacaagtccttatatgggttgaagcaagctagccgtcaatggtattccaaactctctactgctcttacttctttgggctatcaagtctctcaagcagatcattccctttatgtcaggtctgatggcacttcctttacagctctattagtctatgttgatgacattgtgttagcaggcacttccatggaagagataaagtctgtcaaactattccttgatcaacaatttaagatcaaagaccttgatcaacttcgattctttcttggcctggaaattgcaaggtcatcttctggtattttcctaaatcaaagaaagtacactcttgagctacttgaagatactggatttttgggttccaaaccggcttcagtacctcttgatcctcacaccaaattatctgccactgatggtgttccctttgatgatccttctggctatagaagactcattggcaggcttctttatttgactcacacaaggccagacatctctttctctgttcaacaccttagtcaatatgtttcaaatcccttagtgcctcattatcaagctgctacaagaattctaaggtacctaaaatcttgtcctgccaagggaattctattctctagtcacagcccacttcaacttcatggttttgctgactccgattgggcttgctgtcctaatactaggcgatccatcaccggctactgtgttttacttggtagctctctcatttcctggaaatctaagaaacaaaacactgtttctcgttcatctactgaggcagagtatcgtgcgttggcctcattaacatgtgagttacagtggttacaatacttgttccaagatcttaacattacctttccccaatcagcttcagtttattgtgacaacaaatctgccatatatcttgcccacaatccaacattccatgaacgcagcaagcatattgaactggactgccacatcattcgcgaaaaactgcagtcaaaactgatccacctcctcccagttccttcgcagtcacaactggctgatgtgtttactaaacctcttcactctccctctttttcctccatgatgtccaagttgggattgtgcagcatacaccatccaacttga

SEQ ID NO: 3716 - DNA, 213 bp, Glycine max
  Peptide Sequence Number=SeqID_120494
atggccttatggaaagaggaagcaaagaagcaactatggctggcagggccgatggtatttgttagtgtgtttcagtatagtttacaagtcatatctctcatgtttgtaggccatttggatgagttgcttctggctagtgcttctttggcaacatcatttgtcaatgctactggtttcaacgtgttgttttcccatttccagaatgtgagatga

SEQ ID NO: 3717 - DNA, 471 bp, Glycine max
  Peptide Sequence Number=SeqID_120495
atggcaattgggttcatgaaggtgcagcttgtgaaagcaaaaggcctgcgtggcactgatatctttggtaaaatggatccctatgttctgatacaatacaaaaaccaagagaagaggagtactgttgctaatggccagggtaaaaatcctgtatggaatgagaaatttatcttcaaagtagaatatcctggatcaatcaatcaacacaagctcatcctcaaaattatggataaagacttatatacagacgatttcgtcggagaagcaataatccatgtaggggatttactggcccaaggagtagagaatggaggagctgagttaccgactctcaaatatagagtggttcgtgcaaacaagtcttattgtggtgaaattgatattggtgttacttttacccgaaaggtggaagacaaatttgtggaaggagacataggaggatggaaagaaagtgaccactatctattgtag

SEQ ID NO: 3718 - DNA, 1185 bp, Glycine max
  Peptide Sequence Number=SeqID_120496
atggactttgtgccctatgctcaaattgacacaccaagtggggagagagaaatacttcacaccgatgctaattacaacgacactaaacatttacaatggacccaaattagttacggagctttttgggatggccaagggtggtgtggtggtcaccacaggaccaacgatgggttcatggtggtgtggttatggcttcatagtggtcacagatgggttcgaagatttggatctcacacttatggtgtggttgagatttcaaagaagacaaagaaggttaaggaagtagtccgaggaagaacagcagcaacctctgcccctgtacgaggatccgccgcggaatgcggcgtgtcggtgccgttgttttcggattcggaaacttgtcggcgtcagatgcgtactcgtactggttgtgtcggtggcagtgggggttttgtgagtggcggcattgttagatctgtttctgtttttgggttcggaggaaatgaggttttgggttttcgcgatttggggggtcatgacatcgtagcaagctttattgttaataaatctgcctctttgctagaagataacaaatttcagctcacgaatgaaatttttgatgagatagatgctccctctagcaaagtaggcatctggtctctagatcccttacctgggccaaacaagacaagagtggtttttacagttgatcctgaggataaacatacagaaatgtcttcagctgtcatcagtttgataagagcatcatttacaaccctggttatacgcccatcaattcttcaccttacttcttcatccttgtttggagatccctactcttttgaagtgctgaaatttaagggaggaattactataattccacaacagactgcatttcctcttcagaaagagcaagcaaaattcagctttaagttgaatttccccatttatcaaatacaatcaaattttaaggagctgactagtcaactgaagtctggattatatctgacatcctttgagaacttgtatatcagcttatcgaattctgaaggttcaactgttgatgctcctactgttgtccagtcaaccgttctacttgccgttgggattactccatcaaaagagcggctaaagcaactggctcaaaccatcatgggacctcataatctaggcttgaatcacactgaatttggtaaggttaagcag

SEQ ID NO: 3719 - DNA, 240 bp, Glycine max
  Peptide Sequence Number=SeqID_120497
atgtacaattcctacaaaaagaatcataaattggaggtccaacataatgctaacatggaggttagtgtgaaaggtgatatggatgaagactcaaataatggtgaggaagatactaataatgatgcgtttgaaattgaagaagttgaggatttgaaagcttatttattgataccaaagaaggataacatatttatgtcaagagacataaaattaagcatcaaattgttgatgattaattga

SEQ ID NO: 3720 - DNA, 492 bp, Glycine max
  Peptide Sequence Number=SeqID_120498
atgacaggagaagaggaggcggtggagggggtgtttggagacagtgtcgatgacagaaaagtggtcggaggggaacaatccaagcatggtggaaatggtctgcttcgcggagtctctggcggcgggggacacacctttcgagatggcggagttgtcgaggggctcgatgcggtggaggatggcgacgatcacggtgaagccacggtcgaagttgcacgtggagacagcgtcgtcggagaggcaggaagggatgaagccgccacggcggcacgtgagggggaggaggacggagggtggcggaggaggaggaaaaggggagggtgcttcgaagtagcggcgcaaaaaaccgatccagaacccgcgccgctccgtcctgtgcggccgctccagccgcgacatgaaaccgctccgctacagaggtgcccgtcgcggatgggggccgctccgctccactccgccgctatagcggctgctattgactacataggttaa

SEQ ID NO: 3721 - DNA, 216 bp, Glycine max
  Peptide Sequence Number=SeqID_120499
atggctcctgtgtttatggagaatgatgctccatacaaggagaaattgttgacgatgcatgaggaggagaaatatgagtgggatgggtatcatgaggaggagttgtctatagagaagtgggagaaaaatatcatggagaagactcaagtggaggagagcatcaaaactaactatcattttttcagtgaaaaacatacacatcctaatagattgtag

SEQ ID NO: 3722 - DNA, 138 bp, Glycine max
  Peptide Sequence Number=SeqID_120500
atgtctagagtttctagagagagaaaagaccaagttcccgagagttttgagagattatgctgtgtgaagatctgcaaagaccagagcttgaagcaagagctggtttgtgagcttgagatgagtttgtacctgatgtaa

SEQ ID NO: 3723 - DNA, 108 bp, Glycine max
  Peptide Sequence Number=SeqID_120501
atggatcgagcgtccgataagcgcaaccctcatgggctaagtgcgaggaagactctagaagaagatgagctgtacatgttctctaagcgcatcgcttcatcttactaa

SEQ ID NO: 3724 - DNA, 228 bp, Glycine max
  Peptide Sequence Number=SeqID_120502
atggacgtattcttcatgttcaaggcttgttgcctactttacaagccttggatgagaacctcgagcatagattgtatcaagacgacctcttcagagttgaacaactacttcatagatcaagaaataaggttgagttatggagattcagagtttgggagaaagaatgaagtaagaagtgtgttggagagtggcaaagagcttggtttattagttatggagaaagaatga

SEQ ID NO: 3725 - DNA, 225 bp, Glycine max
  Peptide Sequence Number=SeqID_120503
atggttccatacattttgttggatgcaaacacctcacataatgtcctactcaacagacctactttgaacaagctagaagccattatttctacacctcatttagcaatgaagtttccctcttccataggggaaattgtcactatcaaggctgatcaggccgatgctcatgaatgctatgtgaaaagttgcaaagttgagttgtacaacatggcgatagcaatatag

SEQ ID NO: 3726 - DNA, 300 bp, Glycine max
  Peptide Sequence Number=SeqID_120504
atggacattcttggtcgttttcctgttgcagaaggccaagtgaagttcttactgatggccattgactacttcacaaagtggattaaggcagatcacttctcagaagatgaaactcctttcagattgacttatggcaatagcgccatggttccagttgaggtcagtgaatcctcagtaagaagaacacaatttgaagaagcacttaatgacaaaaatttagccttggaactagataggattaacgaggtgagaaatcatgctgagattcaagaagaagctcgtaagaggagagcaacttag

SEQ ID NO: 3727 - DNA, 240 bp, Glycine max
  Peptide Sequence Number=SeqID_120505
atggtacctaacgcattgttaactaggaaaggatggaaagaacgtgctttatggtgcctttaccgaacacatgccaaagctagagtgatgagtgaaatagaggaggtgcaagagcaaatgaaggccaacatggaggccgtgaaagagcaaatgaccacaatgatggaagccatgatgagtatgagaaaaaatgatggaggtcaacacgactacagtcattgttgcaagtaccgccactga

SEQ ID NO: 3728 - DNA, 381 bp, Glycine max
  Peptide Sequence Number=SeqID_120506
atgagaagacacatttttgcttttcaccttgccctcccgtcgaaggagcattcatcacggcctttgcctggtgatccagagtatgcaagatttatctcagtagcggacgatcatgagcatggaggacttcttggcacagttggccttggcccagagtccagccttcctttttggggggaggccgctgaagacactccagaggctggggaggctgaggataccccagaggaagaggcaggggctaaggatgcaccagtggaggctgttgaggtgggagtttcaggcgcaacagaggcagacattgacattgactacgtagcagatgtcattgcggcacaagggacttgggatccatggcccactccagatcaggatgattga

SEQ ID NO: 3729 - DNA, 222 bp, Glycine max
  Peptide Sequence Number=SeqID_120507
atgttgctaaatagcaacgtcatctatatctgtgtaagagtggtcatgttggtgcgcatgacccgcactcatctctttgcagtggcacgggtgaaatcttgccccggtatgcatagtagctgcgtgatagcctccctctctggttgtgctcgcacagttggtcgcccttcaatatcagggggtggcccaggaactaataaaagggaactactggccccttaa

SEQ ID NO: 3730 - DNA, 1362 bp, Glycine max
  Peptide Sequence Number=SeqID_120508
atgcgatcttgcaagctaggtccagaatttcccaaatggttgcagacacaaaatcaatttgggaatattgacatttccaatgcaggaatagcagatatggttccaaagtggttttgggctaatttagcatttcgagaatggatttcaatgaatatttcatacaataatctccatgttgaaactttataccaattagacctttcaaataatcatttctcgggaaaaattccggattgttggagtcgtttcaagtcattatcttatttggacttaagccacaataacttttcaggaaggatacctacatccatgggatctcttcttgatcttcaagcattgctattgagaaacaacaacttaacatatgagatacctttctccttgaggagttgcacaaatctaatcatgctagatgttgcagaaaacagactatcagggctcatccctgtttggattgggagcaaattacaagagttgcaatttttaagtttgggaagaaataatttccatggaactttaccattgcaaatttgctacctaagtggcattcaactcttggatctgtcaataaacaacatgtctgggaaaattcctaaatgcataaaaaattttacttcaatgactcaaaagacatcttcaggagattatcaaggtcattcatattatgtcactagcagttactcatcaggtgatcaaacatatgacttgaatgcattcttgatgtggaaaggttcagaaaaaatgttcaaaaataatgggttactacttctaaaaagcattgatctctcaagcaatcacttttctggagaaattccactggaaatagagaatttatttggattggtttcattgaatttatcaagaaataatttgacagggaaaattccctcaaaaattgggaagctagcatcacttgaatctcttgatttgtcaagaaaccagttggttggttcaattcctctgagtcttactcaaatttattggctcagtgtattagatttgtcacataaccatctaactggaaaaattccaaccagcacacagttacagagtttcaatgcctcgagttatgaagataatcttgatctttgtggaccgccacttgagaaattttgtattgatgggagaccaacacaaaaaccaaatgttgaagttcaagagggtgaatattcacttttcagtcgtgaattttacataagtatgacatttggatttgttataagcttttgggtagtgtttggctcaatcttactcaaacgttcttggagacatgcctatttcaagttcttgaacaatctatcagacaatatttatgtcaaggttgcagtatttgctaataaaatatcaaaggtgcatggctga

SEQ ID NO: 3731 - DNA, 198 bp, Glycine max
  Peptide Sequence Number=SeqID_120509
atgtgtgcagttaagaaggtgatatggaccttccagcttcccgagaaaaaagacgagaccaacatacaatgcatgcgtgacgacatgatgcagatgcgtaaaagtgaaacagagggatggactaccagcgacaatatatcatcgaagagaaaaactctagatgaggtttcactatcatcaagcaagtcagagagttag

SEQ ID NO: 3732 - DNA, 1056 bp, Glycine max
  Peptide Sequence Number=SeqID_120510
atgaagcgtccactgccaccatcagtgagcagcgacaatgtagaggataggaagatgaagaagaaggtgaaggcattagatacgacgacaatgtggagcgcgtggagggctagcatgttcgatgacaacctcctgttcgaggtgttgaagcacatagacactagcgatgtcgggatgcataaacaagcagtgacacaaggcgtggagatcattaagggaaaaaagacaccagaaaagaaggttgaattgaagaaacttaaggagaaaaaaacaaaagaaaaacctaaaaagacgcgtgaggtgattgatggtggcgcgtatggtgtggagctggtagaggagttggtcggggattggtggggtggtttggggggttggagggtggaggaaagcttagaagcatcgacatttgaaattattgtgcttttgactggtgctcttcctaattccaaattgcaaacttcagtgctttctatatgccttaacaccaccggtgtattttggatggtaccatttggagttagtgttgctggaagcataaggatctcaaatgaattaggggatggtagtgcaaaagctgcatatttagcggttaaagtcaccatgtttttgggctctgcagtggggattttggaatttgctgtccttatgttggtacgcaaagtttgggggcgtgcttttaccaacatacatgaagtggccacatatgtgactgccattatcccaattgttgcaagctctgcctttatagattcaattcaaacagcatttcaagtttacattgaattgaatcaatttataaataccctacttgttcaactgcacagagttgccagaggatgtgataggcagaaacttggtgcattaattaatctaggatcttattatcttttgggcgttccttttgcaattgtgacagcttgtgtcctccacacgaaaggacagcaatataatgtcttcattgttcaggcaaataaggcagcaacaagattaggaggcagtatagtccaagttgaggcacttcagggtaaccaaaatgttaatactactgcttga

SEQ ID NO: 3733 - DNA, 564 bp, Glycine max
  Peptide Sequence Number=SeqID_120511
atgcatatcatggacatcttacaatctttaaagatagtaagtgataccttgtggctatgcataggggactataatatcatttcctctcaagaaggtgtcaaatacttcattcaaacacgaggaagtgaaagaggacattatccagatgcacccaacaaaagccccagtttttggaggctgaatcaaactaattttagaagttggctggaagacataatgagcgagatggaagaagatagtagagcaatggtcttcacagtggcaaggaacatatggtatggaaggaaccaatatgttttacagaataggagattggactttcgacagattcttgccaaggcaaaccagaatttacccctttgtttgatgagggatgtaccaaacgctcatagtcaacgggtacctgttgggtggaaacccccacctgagggcactttcaaagtcaaattaaatgctgctataagaaacaaccagggcacatgtatgggtttcattgatcgagaccatgaaggaaatgtcctagcagcttcctcaagaagcataagctcaactgggttttgttaa

SEQ ID NO: 3734 - DNA, 401 bp, Glycine max
  Peptide Sequence Number=SeqID_120512
atgccccaccgtcgctcgtggcactcttcgccacccttactgagccctccgctgctcatcattctcttcccaatcgtgatcctcacgctcctcttcctcgccgtgccgccgctcctctccgccgccacgcgcctcctccgcccggcctcctccgacgtcaagaccagctgggactccctcaacatcctcctcgtcgtttttgctatcctatgcggcgtcttcgcaagacgaaacaacgacgaagaacagacccagaataataaccacgtgcaccagcacgacgacgatgccgtttcggatcgaaacgccgcgtttcgtcgtgtgccttcagagggacaatcgcagtggttcgggttctcagaggagagaaaggtgtatggtaacgatacacctcttaacag

SEQ ID NO: 3735 - DNA, 1149 bp, Glycine max
  Peptide Sequence Number=SeqID_120513
atgtcattgacacttttcctgaagacccttttcctcttcttcccttgctacttgtgcctccctgactcagaaacaacaacaacccttaaccccattttgctaaccccatccaaacctgcaacaacaatccctgcattccctgaacaatctgaagtctcagggtgccctctcaccctctcagatgagctctttgatgggatcaagagtgcatgtggtggtgccaaaagtggtgctgacatggagctccaccacagcaggtgctgtccagtgcttgcagcatggctgtattctgcatattctgccactgcactaggcagcatggcaggtcatagccatagccatagcaataatggtcatggtcatgatggccatgccacatcagcatatgacatgattatgcctttgctcccagatgattcagaaacatgtgtgaatgagctgggaaaggccttggaactgaggggtgttgagctgacaaagcctaatgagacttgtgatgtcgtgtattgcttctgtggcattaggctgcaccacttgacatgtcctgattcattttctgttggccaaagtggggaacttgttggggatgcaagtgtgacaaggttggagaagaattgcttaagtagcaccacagatgctaatggcttaccagaagatcaagatggtttgggtttcatcttcatcttcttgacttcttcgctcatgcttggtacttgcttttgcacaattcctcacgcgccattggagcttgtgtggttcacgaacatggatagaacagaaccaatagtggactggattagtgatttagtgcttaacaagaagacttcaaattcaagcaaagcagaagacaggaccaccaagatccacaacaaagattgtgagcttatgggcttgacatggcttctggctaaaaataggacagcttatatgcacacggtttctgcggttctccgcgctttgatgttaaacactgatggctcttaccctcaatcctgctctctaaatagtgacggaatgcctcttgctgtggattcatcagaaatctctgatcactcttcatcaaccaacctcctaccgcccatctctctttctttgttattgctttgtttgttactactgcccatgcattttacaatgttatcctcatag

SEQ ID NO: 3736 - DNA, 276 bp, Glycine max
  Peptide Sequence Number=SeqID_120514
cacagaagccatcgactttgctccaaataacagcagggatagaacagtgatccgtgtcaaagaagggatttacaaggaaaatgtggtaatccaaagctataagatcaacattgtgatgcttggcgatggaagtgatgtcactgtcataactggtaacagaagcgttcctggtgaaggatctctggcacgtgatatagcttttaacaacagcgcagggctagagaagcagcgagcagtggccttgagggtacatgcagacttaactgctttttacag

SEQ ID NO: 3737 - DNA, 324 bp, Glycine max
  Peptide Sequence Number=SeqID_120515
atggaatataccgacttatgcatgtctcctgatgactttgaagaaaaggtgtctgagaatctctcaaagaaaaggaaatttcaaaacatttgctcggataaagttaaagccactgatgaactggtttcaggagtgactgaagtagaaaaatctgatattctatgcatggctgtggaatccccagagagtataaattctgatcagactaagaaaattgctgatttgaaaggaagaagtgaaagtaataagaaatccaagagaagcaacagcaagaaaacggggagtaacaacagaactcttttgaatttcttttctagagtgtaa

SEQ ID NO: 3738 - DNA, 1874 bp, Glycine max
  Peptide Sequence Number=SeqID_120516
atgactcctcgcgtcgacgatttcgaaaaggacgatctctccgcctccgacgacgacgatgacgatgatgacgacggcctcaaggaggacatggccgcgctcgcccgagcctgcacgatcgccgtcccgtgccccgacgataattccaccgccgaagatgatgttccggcggaggacccgctcctccacgccggagactcgatcgttcccgccgccaccgactccgacgacgaccaggacgacctcgagtgtctcaagagagtgcagagcctctaccagcctctgtccgttcttccgccgctgacgccgccggctgccgtgtccgacgacgacgatgacggcgtggacgacctcgagacggtgcgcgcgattatgaaaaggtttagtacctacggcgaaggtggaatgcaaatgttggttgagggggatcagacctccagcccaggctatgagggtgacatcgctaacggctcaatccattacgaatcagacgctggtgaattatgtcctgtttctcaagatcccaacgaggctgccaccgaggagttgattgagaacgttgaaatgaagcttagtgattttgttgagagttctgaacctgatgcctatgagtcatccaaattaccacagaaaagattgagctgtcctcctgtagttcggtgttttgttgatgccattaataaaaatagggatttgcagagatttattagaagcaagttgattgagcttgaggctaaaattgaggaaaacaaaaagataaggaacaaaattaaaattctcaaggacttccaggcttcatgcactagaagaacagggaatgcgttatcaatgaaaaaagatccacgtgttcagttaatatcttcaaaaaagccatttgctccaaagaactctaagaaacataaaaaagcctctgcaatgtgttatggcccggaagagaattctcatgttgctaattataggatggtattggaaagatttccactttcattggatcggaaaaaatggtctagtgtagaaagggaaagtcttttgaagggaattaagcaacaattccaagaaatggtgcttcaactttcactttcagttgatagttcagagggcttgcttggagatgcaaatgacatggataatgtaattgcatctgtgaaagatcttgaaatcacaccagagaggattagacaatttttacctaaagttaattgggatctcatagcttcaatgtatgttggtggccgtaatggtgctgaatgtgaatcaaggtggttgaattgtgaagatcctttgatcaaccaaggtgcatggacaaatgaagaggacaagtctcttttacttattgtccaagatatgggcatcaggaactggtttgatattgctgcatcattgggcacaagcaggactccatttcaatgcttggcacgattccaaaggagcttaaatcctgccatgctaaatagtgaatggactgaggaagaagattctcaactctgttctgctgtggcatgttttggtgctagggattggcaatccgtggcttctgttttagaacggcggacaggaacccagtgctcaaatagatggaaaaaatccatttgtcctgagaagaaagggagctttacacaagaggaggatatacgcttaacagtagcagttatgctttttggacggaaatggaaccagatagctaactatgttcctggccggatccaatctcagtgtagggacagatacctcaatagtttggatccttctttgaaatggggtggatggactgaggaagaggatttaagattagaagctgcaattgtcaagcatggatactgctggtctaagattgctgaagaagtgccacctcgtactgattctcaatgccggaa

SEQ ID NO: 3739 - DNA, 279 bp, Glycine max
  Peptide Sequence Number=SeqID_120517
atgaaatattttcacaggttcttattttcacccatattcatcggagttttctcatctacattggtgacactggagggaaacccatcacgagctgtacccaagcttaaacaggagtggttttctgcagttctagcaaactggaaactatggataccttttcaatttctcaacttcagatttgttccacaacaatttcaggtccttgctgccaatgttattgctttggtgtggaatgttattctctcatttatggcacataaagaggttcttccaaaatag

SEQ ID NO: 3740 - DNA, 1209 bp, Glycine max
  Peptide Sequence Number=SeqID_120518
atgaatccacgtttcaccactgcacaattacaatcccatgagcctctcgtgcatcctcaaacacaggatcttccctccacccccttcccccttcaccctcttcatccaacggcgatggaagaaacccaccgtctccgcccaaacccgcttagaggacagagtccgagacccccacttggacaaactcatgtcccacctcaaaagactcgaccttgttctcagaatccaccacctcatgtccgcgcgcaagcgcggtcccttcgtctccctcaccctcctctcccgctggcgaaacatcctcggactccacatccccgtggggctcttcctccgcaaatacccccacgtgttcctcgtcagcaagaaacggaggctgtgaagagggtaaagaagctgttaatgatgtcattgaatggcactcttcgtttgcacgccttgaggttgttcaagagagaattgggtctccctgaggatttcagagactccattcttggcaagtatagtgcggatttcagattggttgatttagaggttgtggcgttggttgattgggacgccgaattggcggtggctcgggttgaggaatggagggagaaggagtactctgagaagtggttgagtgagtttgagaccaagttcgcgttccccgttagtttcccaactgggtttaagttcgagagagggtttaaagagaggttgaagaattggcagaggcttccttacgccaagccttacgagaggaaagaggttgttcgggtgaggacgtgtggaggaatcgaacggtacgagaagagggctgtggctgttcttcatgagctgttgagtttgactgtggagaagatggtcgaggttgatcagctggctcattttcggagggactttggtgtcgaagttaatgtgcgtgaattgctgctgaggcaccctggtatattttacttatctactaaagggaagactctaactgtttttcttagggaagcttataggaaaggggggttggttgagccaaatcccgtgtatgagacgcgtaggaatatgttggatcttgtgttgttagggtgtaggaaaaccaaactattgttagattgtgatgagtctaataaggaagagagtaatgttgtagcctgtgaagtaaatgaggaaggtgaaagacaaggagattgggtgattcctttcttggagaaatgtgaggagaatagatccccttga

SEQ ID NO: 3741 - DNA, 1137 bp, Glycine max
  Peptide Sequence Number=SeqID_120519
atggcttccttccctcctcctggttcactcactctctgcgaagtcaatcgtgacctaatcaccgtcgacgccctgtccgacgatcgagccaaccaaacctacggaaaaatcctcggattggtgttcagtcccgtcccgtttcacaatctggagaacgacgcttccgatcaggaaggtccaacagcgacggagaccgctgccggagaaagcgttcagaggaaatgtccggtggcactcttgcaagggcttgtaaacaactatctcggacgcctcttttaccctaacgatgtgcatttgttgccggaggttgatcttcaaggagtaagctggcaccctaataagcatataattgcttttatctctgccccaacacaagttttagttcgtgattaccaagagtctgagggaaaggatccaagtattttgacaaatgagtcgcagagagatgctagagtgctggagtggaggcccaatggtgggaaaatgcttgctgtgggttgcaagggtggaatttgcatgtgggctgcttcttatcctggaaatgctgcatctgttagatctggagctgcttcctttttaggaggtttgtctagaagctcagggaatcggtatatcctggtcgattttcttcgtagtccatatgatgagcatgttagtgctctaagttggagtccagatggaagatatccttatttatgtcaaaaagtgcttcttattttcgggttttgctacgtgtttcccaaatatgatatggttgttctgcttctttcttttgtaatagaggctgctgttttaggcaaagtcacatctgcttcatatgaaagctcctcgttcactgtatgggattttgctcaaggtgtgggaacacccattcgacgtggattaggaggcatatctatgctgaagtggtcacctactggagattacttctttgcttcaaaatttgatggaacattttatctttgggaaacaaacacatggacatcagaacaatggtcatcaactagtggttttgtcaagatgaatttatttccaagaaagaaagtccatggtgggaggatggaatatcctcctcctcagaagaaaccatggagaagatcatggattaataaagtgttaggagctgaattaacatag

SEQ ID NO: 3742 - DNA, 637 bp, Glycine max
  Peptide Sequence Number=SeqID_120520
ttttttcaattttgacttcattcttgcatatgctgcagttagagaaggcgaagaactaaattggacaatgagaatgaggatagctatggggatagcctactgcctagagtatatgcatgagctgaaaccacccattgcccatagaaacctgcaatcttcctttatataccttactgaagattatgctgctaaaatatcagatcttagtttatggaatgacatgtgtgatacaaagaatgggtctgcaaccacacaattcttggaaacatcgtcagccgataccaaggacaatgtttacagctttggaatagtattgtttgagttgattacagggagaattccccttgctgggaacaatgaacttctggcagattgggcagcagaatatgtaaggtgggggaaatccttaagagatgttgtggatccaaggctgaagtctttgcaggaagaagagattgaggaatggtctgaagtgataagaaactgtgtacaaccagatccggagaaaaggccaactatgaaagaagttacatctagactcaaggaaatcacagctatggggcctgatggagcaaatccaaaagcatcaccactttggtgggcagaaatggcaattacatccactgattcaagttga

SEQ ID NO: 3743 - DNA, 2685 bp, Glycine max
  misc_feature (765)..(765): n is a, c, g, or t
  Peptide Sequence Number=SeqID_120521
atgcgagacctgaagctagttgaacgcttcaagagcacccaagttcatgccctcaactcagaagcaactagcagaagaaacaaggccacagtgggagccagagccagagccatcacaatcagatcattggtgtcaaagtccaaatccaacaccacaacaacgtcaacaacaacaacaacctcagcagttgcaaacctcgttgttccccttcagctcccttctgctgacactctcgaaccttccatagagcctcaccttaaacccatcaacctcgtggaggccttgtctgaactttaccaaaggctagagtgttgttgccttcagtctgagaaaaaaacatcactttgtgtggagcagttcacgcttctgcgcagcctcggagatcagaagcttctgagaaggtgtctaaggacagcacggcaaaacgctgaggatgtgctttccaaggttgtgctttcggcatggttgaggtttgagaggagggaggatgagcttgagggtgtgccttcaatggattgtggtggtggtggtggtagttgtgttcttgaatgtccaaaggtgaatttggtgaaagggtttagtagtccttgttcaatcaatgataggtgccagtgtccacaagggactaaagaggaagcaactagcaatgaagaaagtgtgtttttgtgtttgccagatgaggagaaaaaggatgtttctttttgcattgggattgaggaaattgattgtgttaggtggagaattgcagccctatctgaccctggnaaaaacatgctttatggtggctttgctgagtccaagatgaggaagattgatttcagcaaaaatgggatatgctcaaagggtatgagggctgtggagttttacagcagggctaagaggttggactttttctgtgccatgactgttttggagcttctttcctttgccaataggttctgttgtgaggagatgaaggctgcttgtgatgctcatttggcttcaactgttggaagtgctgatgatgcattgacacttattgactatggattggaagagagggcaccccttcttgtggcttcgtgcttacaagtgttgcttagggagctaccaaattctttgcataattcaaaggtgatgaatgtattttgtagttctgagggaaggaaaaggttggccatggtggggtatgattctttcttgctgtactatttcctgagtcaggtggctatggaggaaatcatggtgtcaaaaactacagttatgttactggaaaggttgggagagtgtgctgctgaaaggtggcagaaggcccttgcattccatcaattggggtgtgtgctggttgaaaggaaagaatataaagaggctcagcatagttttgaggtagcagctgaagcaggtcatgtgtattctgtggctggtgtggctagaactaagtacaagcagggtcagccatattcagcctataagttaattagttctctcatatttgagcacaaacctgctgggtggatgtatcaggagcgcgctctttacaacatggggagggaaaaaagttttgatttggatgttgcaactgaattggacccctccctttcatttccatataaatatagagccctggcaaaggtggaggagaagcaaataaaggatggaattttagagcttgataagattattggattcaagctctctcctgattgcttagaattgcgggctaggatgtttatagctcttaaggattatgacagtgccataagagatatcagggcattgttaactttggaaccaaattatgtaacttcaaatgaaaagatctcagggaaatacttggttcatctccttagccatgtggtacagcagaagagtcaggctgaatgctggatgcaattatacgaacaatggtcttctgtagatgatgttggttctttggctattatacatcagatgctggagaatgagcctggaaagagcctactagagtttcgtcagtctctactccttttgaggttaaactgtcaaaaggctgcaatgcgcagtttgaggatggccagaaaccattctagctcaatgcaagaaagattaatttatgaaggatggattctatatgatactggctatcgggatgaagcgctggctagggctgataggtctattacaattcagagatcatttgaagcctattttctaaaagcatatgtgttagcagatacaagtatggatcccgaatctgcttcttatgttatcgaacttctggaagaagcacttaaatgtccttcagatggtcttcgcaaaggacaagcactaaataacttagggagtatttatgtagattgtggtaagcttgatcttgcaaaagcatgctatgagaatgcccttgcaattaggcacacaagagctcatcaaggtctagcacgggtttatcatcagaaaaatcaacgaaaagctgcatatgatgagatgaccaagctaattgagaaggcagagagcaatgcctcagcatatgagaaacgatcagaatactgtgaccgtgagatggcaaaggttgatcttaatgtagcaacccaactggatcctttaaggacatatccatatagatacagggcagcagtgttttgtaaacctatttcctatgtcactgacaacaaaacacttgttgcgtattgtatttctgggcatggccaagcctctagaaatatgtaa

SEQ ID NO: 3744 - DNA, 399 bp, Glycine max
  Peptide Sequence Number=SeqID_120522
atggcgtgtggttgggagcattgtgaagaagctagagcctatgaacactctggcatcatctgtttggtgggtgtttggatttcattggattgttgtgggtggccaagcacttttggaagattctccacatctctactggatgaaaaggattgtaccagggacaggggcaggggtaggggcaggggcaatggaggtaggaatctaatcaatgaaaggagcaagggagtggaaggaagtgataggataggagagagggaagaatataataacaaggactggtggcaggggatttggcaatcatgggggaaaggaactcatattgtatatatgagtggtacagagaagagggggaatatcatagaatttggcataggctgtgggagcctgagtggcctttga

SEQ ID NO: 3745 - DNA, 1393 bp, Glycine max
  Peptide Sequence Number=SeqID_120523
atggcaccattcactccgtcgaagttgcttctgttaactctggttttcacgttgagccagaaacagagtctctgttccacgctcaagagcgaagaaggtttggcgctgctggcgttgagggagcgagtggtgagtgacccgcagggggctttatcaagttggagtggcgaagatggagacattgatccttgctcgtggttcggtgtggagtgttttcatggttatgttgtgaccttgaatttaaaagacctttgtcttgaaggaacactagcaccagaaattggaaagctgactcacataaaatcaatcattttgcgcaacaattccttctttggagaaattcccaaggagatactacacttagaaaaattggaagtccttgacttgggatataacaactttagtggattacttccatttgaccatggcagtatgccatccctgaccactcttttattggacaacaattactatcttaccaacttaactccagagctgtataagctcaagatgaattctgaatttcatgccaatgaagaacaactaactggtgccaccactagagaattatttgtttgcagatgtcatttacggcacattggccaacatggggatagatcatacaggaggcaacttctcaaggtagcaaatgatgctaatacacctagaatccaagggaatgttaaccgagggacacttaaacaatcagcatcacatttcgctttttcattacccccagattttgagcccttctcatcatcaccatcggaaagtccttcatattcaccaggagcagttccattatcatattcgccttcgccattgccatctccctccagtatttttttcactccttcacctgtagtgttaccaactccaggcatatcatccccagcaaacacactaccacccgagtttaattgggcgcctagcccttcaccattttctaaccaaggaaacacagacagttccaatcaaatacatcattcggtgataatctggaaggttgtggctgttaaaccatggtccacagggttgagtggccagctgcagaaagctttcgtaaaaggtgtgccaagtctcaaacgaggagaaattgaagcagcttctgaatatttcagtaacatcattggttctcttcctgatggaactgtctataaggggactctctccagtggagttgagatagctgtagcatcatctgcagtgaccacagctaaaaactggtcaaaaagtatggaagctcaattcagaaagaagattgcgacattatctagggtgaaccacaagaattttgtgaatctcattgggtattgtgaagagaataagccattctcaagaatgatggtgcttgagtatgctccaaatggaacactatttgagcatctacaca

SEQ ID NO: 3746 - DNA, 504 bp, Glycine max
  Peptide Sequence Number=SeqID_120524
atgctggccgtcagtgatctgattgaaattcgcgtgggcgatgcgctggacacgctcagtcaggacctgccagccagcgttgatatgctggtgctggatggtgcgaaggcgatctatccggaaattttgcagctggtgcagccctggttgcgtccgggtgccctgattgtggccgatgatgccgatttcagcccggaatatctggaaatggtccacggcagccgcctctatacctcgctgccgtttgctgatggcgtcgaagttgctgcgatgaaggttaccgttccactgttagtgattgcttttgcttcggcgaaagcgggagcatttcaggcgaaaatcgatccgttaaagctggcgctgaaaccggctaacgcgctcgccagcaccgatcaggcgcagcctctggcgattgccgaagcacatgcgcgcctggcggcggcggtgagtggctgtcagtgtccgttctgcacccagatgcggctggtgaatagcgggttatga

SEQ ID NO: 3747 - DNA, 696 bp, Glycine max
  Peptide Sequence Number=SeqID_120525
atggttgaagtacatggaagagttgcactttctggtggctattcttttcctgatcatgccggaacaacatatattgttcccatatcccttgaagctaaaaatgaacgctataaggtctatggtggcaggtcaaaacatttgcaagaagaacttggcataacaatgcatattgttcccttatcacttggtcatggggatgaaggctatcgggtctatggtggtaggtcaaaatatttgcaagaagaacttgggagaacaatgcatactattcccttatcacttggtgctaggaatgaaggctatcaagtctatggtggcaagtcaaattgttttcaagaagaaattgatataacaagagctcatagatcaagttatccttttactttgagagacacattgttgaaatcgtcaacatcaactaatgttggatatcctaggaaagatcatgttagatcaatggatattgttcactcatcacttggtgctagaaatgaaggctattttagcaatgtctatggtggtagttcaaataattggcaagaagaacttgatagaacaacagctcagagggcaagttattcttttgatggagtaaggtctgactttgagaggtacactactaaagtgcttgggaggtttgttcagagccgaatgaatatcttgatgaaagagagaagggtgtttgttgagtcctga

SEQ ID NO: 3748 - DNA, 213 bp, Glycine max
  Peptide Sequence Number=SeqID_120526
atgcttcagtgttcaatgtttgcttggtgtctgctgcctatattcctcggttgtgaagcctcttttgcaagaaagaacaaggagaaaaatccaggtgctacaaggttgtgggaaggaggaattactgaaggtaatggactatgcatccctcccacacttctgaagaaaagaagattccaagtcatccaaacatcatgcatcatgaaacactga

SEQ ID NO: 3749 - DNA, 438 bp, Glycine max
  Peptide Sequence Number=SeqID_120527
atgtctgaggaaactcaccaagaaaacaagaacgcaattgagttccttgatgaatacactttctattatgatgaggaacatgagaagtgcataccatgctacaaagaagactcaacgaaagtagtcttgaactcagtcgactttgacttcaacaaccataacaaagatttagataagttcttgaagaatcttgccactcgtgattcttcccctcagcttgaggttcttgctcttgctccttcaacttatgaggttcctgtcattcttgctccaaccactagtcctattgttgatgcccctaccaaagttcttgctcttgccatcgatgaggttgttgctcccaccttaggttcctacccttcaaagggtcttcatcctgttcctacccctcagagagttcatgctcatattgttgcagctactcctcctactccttga

SEQ ID NO: 3750 - DNA, 690 bp, Glycine max
  Peptide Sequence Number=SeqID_120528
atgaatcaaaagaacctaccacacaaaaattcagccaaaaataacaaccctaaccatcaaaacaaaaatcgccaattaaattgtaaacagtcgtcgctaatagaggatgaaaatgatggtcattcctattcttctactgggagtagaactgttaaggaacctagagttgtagttcaaaccacaagtgaaattgacatacttgatgatggatataggtggaggaaatatggacagaaactagttaaaggaaacccaaaccctaggagttactacacatgtgtagccctgggttgtccagtgagaaaacatgttgagagagttgcacatgatatgaaagctgtgattacaacttatgaagggaaacatatccatgatgtacctttaggacgaggaaactcaagctatagcatgaatagaacttctctaaacaacaacaccaacaccaatattgtaatagatcctgcccctattaggccctccgcagtgactaattattctaactcagcaagtttcacaaactcacttcatgacacaaagccaccaacatctgcaagccaagaaccttttccaatggacttggtgttgagccccgaaagcatcggatttttggctaatgacccgtttcttcagtctttttgtcaaagaacttttaaatttggaagcagaagaacactagaacgttacacataa

SEQ ID NO: 3751 - DNA, 826 bp, Glycine max
  Peptide Sequence Number=SeqID_120529
caatgttcccaaggaaacgagtaagaaatgcataaaaagaactcgacttcgtaccaaggaagtacaagatacagaggtatatagtgatgatgggatcaagacttgtggtgaagtcgtctctgcatgcagaaatgtttccaagaagatgaggtccaaaagacatacaaaaaacacccaaaattgtcccaaggaggtagtggatatatcttgtagtgacaaggtcaagacttgtattgagagttcagaaagtcaatctacctttattgcaagttctggaaatcaagattcagacaacataactattgtatgctttttacgcgataaatcaaaggagatgctatctagatttaccaaagacttgtgtcaggcttccttctccgccaggattacagatgtttctaggcaggttgaaagtcaagacccatttgatgatcaaatcatcagcttgtctcagtcatgtgatactgttggaactaaaaatttgttcgtgcagcagaaggctgcttctgatacactagtgggaacaccagaggatgcgaacactttgacaggcaatgatgatgatatgacccttgcgtgttttctgggaaacaaaccaaagaaagggagtcaagctgctaacaggcgtagtgcatgctcttcaaccatcatcatacccgatggcagtggactgtcaaggtcaaagcatgttgaagaggagactgttttgcatggtggtgttgctgagccaatggacatcgttgtggaaaaaaaggatgatgagcttcttacttccttgcaaaacaggccaacaaggcagcgaaaacgacccagtaggtttttatga

SEQ ID NO: 3752 - DNA, 429 bp, Glycine max
  Peptide Sequence Number=SeqID_120530
atgaccaccacaccgaatgttggctcttgttcttcttcttgcacacttccgttgcttctttttttagggcttttgtttgttcctgagggtgtggctttggttttggagtttcgttttggggttcagtttgatgggttttggagggttttcgttgctgcattgatgggttgcctttctgggattttgttcatccctgcttctagaagtgcacgttgcttttggcttgggaatgatcaaattcgttgcaatttgtcgatgataacttgtgggtggtttactcgtgcgattctttatgcaaaccagatgcttattgtggctttgaggcctaacctgcagatgtatctgaatgaagctttgttgtcttggtaccaaaggcttcatgctagcaaggttcctgacttgaattatagaaaggccaaagtcatatga

SEQ ID NO: 3753 - DNA, 318 bp, Glycine max
  Peptide Sequence Number=SeqID_120531
atgcggggttaccgtatggtcacccgcacctttcgtcaacaaggggaaaacgagcccgttgacgcgaagagactaacatcgtcttctacaccttttgccatccagggacagcgagtcaggtggcaggcgaagataccttatggtcatccgcacctttcatcaatcgaggggaacaaattcgacggttttactctcgtcgtccggaaacattcaagcccaacgacgcacgagattcttttctactgggcagggacgatcgagtgcaatggcgtagggaagtgttgtggttgtcccactttgtcgctttcaagacgttga

SEQ ID NO: 3754 - DNA, 288 bp, Glycine max
  Peptide Sequence Number=SeqID_120532
atgaaagtgcagtgctttgttgacttgtccttaagacagagacctatgacgagtgttgtgaacgttatggtgtctggctgtttaccatttaaacttatagcatacagcgtgccatcaaaatcttcttctccatttctcgtctttgcatgtgtcggagaggttaacgacgacgccgattttgcagcaggtgtcggcagtgagggtgggggtggaagtgtagtatccgttgcaacgcgagggcctcccgaaagagagggagtttcgaggaaggacgaccgacaacaataa

SEQ ID NO: 3755 - DNA, 240 bp, Glycine max
  Peptide Sequence Number=SeqID_120533
atggatcttggtgttggaagttggaatggaagaggtattggttcatatgggaattacctatggtcagacaagtgttgtggaaaagtgtctcaagagggagaacaaaacacaagagacaaccacaaggtggggcctcatgaaggagatgaacagggtggtactactttgtcgacaagtccacttgagaaggtggaagcctttagagtggcgtctcccataaaagaacaaaagtttacctga

SEQ ID NO: 3756 - DNA, 414 bp, Glycine max
  Peptide Sequence Number=SeqID_120534
atggttgtggaaggataccacactttctctggctccttctttctctcactattctctttcttgcaacaactctcccgaaaacctccgcacttgttcagctgtcgacggtggtttctggtgactgcatcggaaaggaagaagaaaaagaagctgatggtggcgctatcgatgctgcaggacacggtcgtggttgagttgaagccgagggacgatgatgagagtgtggtggacttgggaatgaaggttgttaagcgaagggagcctctcaaggcggtcacaatggccaaggctgttgcctccggtcagcaaagcgacgacactggtattttgatacgcttgttgcgctccgatttgccgtcctcgacgccgctaaacgttggagatgtcgccgttgccggttctggccaccagtga

SEQ ID NO: 3757 - DNA, 180 bp, Glycine max
  Peptide Sequence Number=SeqID_120535
atggcggcatcgccgtacaagcttcatgctagtaacaatggtggcactcacggtagagacatcagcatgtgtgattgtgaaggtgaaaatctaaagagtagagacaaaaatccgtacagtggatgtgcagagagagagagggagagggtggacagcatattagacaaagaaaaagggtaa

SEQ ID NO: 3758 - DNA, 923 bp, Glycine max
  Peptide Sequence Number=SeqID_120536
tggcagaaaaaaacaagagagagttcaatggtgcaacaccagttgtggtgagctcaaggtggaatccaagcccagagcaactaagagcccttgaagaattgtacagaagaggaacaaggacaccatctgctgagcaaatccaacacatcactgcacagcttagaaggtttggtaacattgaagggaagaatgtgttctattggtttcagaatcacaaagccagggagaggcaaaagcgccgccgccaaatggaatcagatgctgaacctccagagaagaaagatttagctgcaagtaggacagtgtttgaagttgaacggaccaagaactggacaccctcaacaaactgcagtactatggcagaggaatctgtttcaacacaaaggacagcaaaagcagtagcggctgcagagagtagaacagatggatggctcctattagatgaaggggaactacaacaaagaaggaaccttttcgaaaggaatgcaacgtggcatcatgtgatgcagttaccttgtccttctccttctgcacctgtcacccatctcataaacaccactcctaatgcctctgcagctagtagcagcatgaccactactacaaccacagtaacaacaacaagaagaagaaaaatggacccaaacctcattattaagacacatgatctcagcttttttatttcacccctgcagagagaaaacagtgttatctacttaagtagtagcagtagtactagtgaagatgataactgtgtggatgagtctcaaacccttcaacttttcccattaaggagtactggtgatggaagcagtgacaacatgatgaaggataatgagacagagatatcaacttcagcaatgaataatgccaacaacttgaccacccctggccagttttttgagttccttcctatgaaggagtaa

SEQ ID NO: 3759 - DNA, 399 bp, Glycine max
  Peptide Sequence Number=SeqID_120537
atggctgtggctgatgcatttgatgagcactgtgattacttgttcaaggttgtattggggagtcaggaggacaagctcatcaaagcacagatatgggacactgccggccaagagagggctatcacaagctcatactacagaggtgccttgggggcaatgctagtgtatgacataaccaagagagcaacttttgtgaatgtaggaaaatggttacatgaattgagagagtttggaggagaagacatggtggttgttttggtgagaaacaaatctgatttggatcaatcaaggcaagttgagagagaaaaaggaaaagggtttgcagaaacagaaggattatgtttcatggaaacctctgctttgcagaatctgaacgttgatgaagcattttggaaatga

SEQ ID NO: 3760 - DNA, 1113 bp, Glycine max
  Peptide Sequence Number=SeqID_120538
atgaatgagttactgttaaactcagaaagttacctctatcttcatccaagcgagaacccagccgtgacactcgtctctccagccttagattcgagcaactatcattcatggagtagatccatgataacaacactaagtgccaaaaacaaagtggagttcgtgaatggaaatgcaccagagccattaaagaccgatagaacatacggggcgtggaatcgctgcaataacatggttgtatcatggttagttcattcggtatctacatccattcgacaaagtatcttgtggatggacaaagcagaggagacttggaatgatttgaagtcacggtatgcgcagggagaccttttaagagtctctgatcttcaacaagaagccgcttccattaagcaaggatctctttcggtcacggaatatttcacaaagctgcgagttatatgggatgaagtagaaattttcagacctgatcccgtgtgttcatgcaccgttaaatgtacatgctcagttcttaacatcatggctcaacgaaaacgggaagatcgggccatgcagttcttacgggggctaaatgaacaatacaacaatattcgttctcatgttctactcatggacccgatacctacgataccaaaaatcttctcccttgtggcacagcaggaaaggcaactagcaggtaacaatgcacttccaaacctcaatattgaagttaaagaaggaccttctattaatgctgtcaaaagcacctgtgaattttgtggacgcgttggacacagtgagaacgtttgctacaaaaagcatggcataccctcgaattatgatggaaaaagcaaagggtttggtatgagaaatggaaagacatgcgcatattgtggaaagcctggccatacaatagacatatgctataagaagcacaggtatcccctcggattcaagttcaccaacagtagaacaatggccaacaacatagtggcagtagaaggaaaggccacaaatgaccaagcacaacatcaagaacaccaagaattggttcggttttcacctgagcagtacaaggccttgctagctttaatacaacaaccatgtgagaagaactcagcatcagctaattcacaa

SEQ ID NO: 3761 - DNA, 1449 bp, Glycine max
  Peptide Sequence Number=SeqID_120539
gatgccaataccaaggtgaagattggtacagctgaagtgagtcgtggtctctatcaactcatacccgaagccataaaatcccatactatgtgtaccactatcattcacccacaatgtaaagtcacccctataaacctatggcactttcgtatgggtcatccctccctcgaaagactacgggctatgcaatcctattacccttttttgagtagcagtaaagatttcgccgaaactcaatttgatagtcacgttaaaactataagaagcgacaatggagcagaatttctcatgcatgaattttactctcgcaaaggcataattcatcaaactacttgcatagaaacacccgaacaaaacggcatcgcagaaagaaagcatcagcatcttttaaatgtcacacgagctcttctattccaaacacagcttcctcttactttttggtgttttgctttagttcatgctacatatctcataaattgcatccccactccttttttaaaggatcaatctccttatgaaaagctatatgcaaaatcttatgacatctctaaccttcgcatctttgggtgtttatgttatgtaagtacccttcagaatcatcgacaaaaacttgatccccacgctcacccgtgcatttttcttggctttaaacctcatacaaaaggatatctagtatatgatcttcacactcacaccatcataacatcccgcaacgttatcttttatgaagaccacttcccatcaccaacccaaagtccagacaacaccaccacagatacccgcgtttcgtcatcccccttttccaacaccacagcaacccttgacactcctattcttctcccaatacccagacccactactccatcctcacactctcaaaaccctacattaagacgttccacgaggacaagacatgcacccaattatttacacgactttcatcacgcactcacttctcctgctgactccatctccaccaaggttaggtatccctttcactctgttctttcctactctcgtttatctaccactcacaaacatttcaccttgtctataagcaccatcactgaacctaattcatatgttgaggcctctaaacatgattgttggattaaagccatgcacgctgagttacaagctcttcaacagaaccacacttgggttctaactcaactcccaccacacaaaaaggccattggttgtcgctgggtttacaaagttaaacacaatgcagatggcaccattgagagatacaaagcgcgtctcgtagcgaaaggatacactcagatggaaggtctagacttcctcgataccttctcccctgtggctaagctcactacggtcaggttacttcttgctctcgcatctctccataactggcatcttcgacaactcgatgtcaataatgccttccttcatggggatctccacgaagaaatgagtaattaa

SEQ ID NO: 3762 - DNA, 348 bp, Glycine max
  Peptide Sequence Number=SeqID_120540
atgtatttctccccagtagtgatccgcaggaagcaaccaccacgaaggggaaaagttagaaggaaaaggaggagaggagatgagcaacaaaatccaataaaaatgaaatataaaagagacagatctgggagagtttgggggtcacgtcggagggaaaatagggtgaaggtttgtcacgcggaggagggtgtgggcttgcagtggaaggatgtagggatgcgggtttggttcacggagagagcagatggtagtgatggggttcacaaaggggaggagagggtatgtggcgcactaaagggtgaggggtgggtggtggagcttgagagaaaattgaaagtggaagaatga

SEQ ID NO: 3763 - DNA, 162 bp, Glycine max
  Peptide Sequence Number=SeqID_120541
atggaacaaggttggttcttggattctcagcgaagaaattgtggaaggttaattggttggtataggacctcagagacagagagagagagggagggagctgctctatcagtgacgaaattccatatcaacaagtctccagtgttggaaaaatctattaattga

SEQ ID NO: 3764 - DNA, 273 bp, Glycine max
  Peptide Sequence Number=SeqID_120542
atgtcgtccaccaacaaaaaggttagtgaggctcttgcacttgcaggccttgagtcttctaatcttattgttggtgttgattttaccaagagtaatgagtggacaggcaagaattcattcaataggcgaagcttgcatcacattgggagaggtctgaacccttatgagcaagcaatatcaattattgggaaaagcttggcagcattcgatgaggataacttgatcccctgctttggatttggagatggtatctctttaaacaatttaacttaa

SEQ ID NO: 3765 - DNA, 282 bp, Glycine max
  Peptide Sequence Number=SeqID_120543
atggagaaaaatgaagaaacaacaatggaagagagggtaaagctgaaaattaatggaggtttaaggagcacctacttgaagttcttatgctttgagccttcatataaaattaatggaggtttaaagagcacctacttgaagttcattagaaaccacttgatggaagcttacttcagaagtttctatgaagggagtgttttggataagaagcttaaagaggaagcttcaatagagcaagagaatgagagagagaaggggggcgtgggaattgaaggagattag

SEQ ID NO: 3766 - DNA, 420 bp, Glycine max
  Peptide Sequence Number=SeqID_120544
atgtctgcatttttacaatttttgatgctggtctcaaatgtagctgttcaggagttacaagagcaacctggtggtgattctaagtcacttaatgtagtgagatgtacgtctttgaagcaagatgggatcattaaggatgaatgtagtttttctcctcttcagaatttacttctatattacccaggtttcccctctttctggcatttgaacttggtatctcaggaactggaagaaggttgcgtctccacagatgaaagtaataaccgtctcttcttttctgattgcaatcatcataggattcttgtatctggtggaaatggagagattctggattgtgtaccatttcctaattccaacactcccccctcgggcctcgagctagttgaatgcaccaagcttggaacaaatatattggattag

SEQ ID NO: 3767 - DNA, 465 bp, Glycine max
  Peptide Sequence Number=SeqID_120545
atggcaaagattccccgactaaaagatgaaatggtcaaagttaagctaaaaatgcaagagtacaaatatgttggtaaaggtcaagttaaagataccctagccaaggctaagctgaagatgctctggctatggcataggcaaatttactctagtcatggccaagttaaagttattctagacaagcttggagatggatcttgcactcaagatcgattcttgccaagatcctgtactagagatgtagctaggatctccacgggtgtagagggcaagttgcatggtgaagcaaatctcaaatctatgaagcagaaagaagggggcggtaaaggactagatgctgtgggcgatcgtgtggaaggaagaggcaggggaaggtttgtgtgggaggaagttaaaggcaagaaagagtttgagtgggagatttggggggaaatatttaaaggaatgcttgtgtgggagatttaa

SEQ ID NO: 3768 - DNA, 864 bp, Glycine max
  Peptide Sequence Number=SeqID_120546
atggagctggggttggagtggttggcaaccttgggcgaagttaaggccaattttggtgatctaaccacgaagctgaaggtacaaggagagactacagtgctgaaggtacaaggagagactacagtgctgaaggcagatccaaaaatgatcaaggcatcggcttctattaagctcatccaaggggccttacaagatcaaggccttggctttattttagagtgcaatcaggttgagcattctgaagaacaaatcactattccacaatatgttcaggaggtgttggaggcatacacgtcagtttttcagaccccacaagggctgccacacatgaggagacaagatcatgtgattatcaccaaacctgcggctcaaattcctaatttgagaccttataagtatccacattaccagaaggaagaaatagagaagttggtcagagaattgttgtcatctggctttatccagcccagcaccaatctgtatgccagccccatcatattagtcaagaagaagcttgagaggtggagattttgtgttgattatagatcccttaataagttggcggtgccagacaaattcccaattccagtgattgagttactggattttaaagatgccctcatacagaggttccaaccagcatccatggtaaactcatttgaatccttgttaacactcaaacaagatcaagctgttcacgaattcatgacacagtttgagaaatatgcaaggtctgtgaaggggttagatgagcagtatttgatgggaattttcatcaatgggctaaaagaagagatttctgctgaattatggttgtatgagcccaagaccttgtcagaagcaatgaacaaggcaggaaattaa

SEQ ID NO: 3769 - DNA, 1989 bp, Glycine max
  Peptide Sequence Number=SeqID_120547
atggcttctgcaaactatggttcgattccgattaacaccggtgagattccgatcaactctggcacgattccgaacaaattcggcacaattccagtcaattcgattccaatgaatcaagatcaaatcaagccagcaatcactgcacttggactcaattgctttgtagctaatcctcagatccctccccgatatctttctgatgcaaatcatgatcttgatcacgtcaatcctctgtttttgatgtggcagaagcaagataaatttatgcttgtttggcttcaattcacactttcgagttcgatccttgctcgtgttctgagatcaactcatttgtatcaagtatgggacaagattcacgcttattttcatcatcagactcggacgaaggcacgtcagcttcgatcggtgcttcatcacactactcttgataatcgtcatgtttcggaattcctttctcgcattaaggtgctcatcgataaacttgcttctatcggagatgctgctacttatcgtctcattcttgcacaggaactgagacttaggaaatacaataaacttgattcttcaagtaacacctttgcgccttctgtgaatcttactcaagcaagttctggtggtcataatggccgcggagaaggaagtttcaaccgtcatggtggacgcggtggtggccgaagctcagttcaatgccaggtctgtttcaagtatagccacatggctcttacttgttacaataggttcaatcctcaatatcaagcttccaatagtggaaattatggattcaatggaaatagtggcaattgctctaactggtctcagaatcagaatcaaaactggaatcagaattcaaatcagaattggaataattccaattggaactcaccaaaatcaaaatcctgcatcctctcagtggctaactctgactctgctgcttcttcatccagctggcagactcaggagcatcctttcattattgctatcccacagtctcctattcatgacacagtgacttctcatgatcctcaacagtctttcattaatgataaagcagcttctactgctactggaaatgccaattctggacttctgagaaacaaagcatggactatggttcctcttcctccaaatagaaatgccattggtcataaatgggtgttcggagttaaagaaaactctgatggaagtgtaaacaaatacaaagccagattggtggctaaggaggcttcatcaacgatcatttgcatcttagtccatgtggatgatataattgttactggcaattcctctttagttcaaaaactgattcagcaactcaatgccactttctctcccaaacagctgggttctttggattattttttgggcattggggtacattctttgtccagtggagctcctttaatgacccaatacaagtacatcagggatctgttaaccagaacaaatatgttggaggcaaaaccaatttcatcacctatgacttctagttgcaagctgtcaaaggatggttctgatctgttacaagatgcgtctttctacagatctgttgttggagctcttcagtatgtaactatcactcatccagagttaagttctgctgttaataaagacttattctgtatcctgcctcacctcataaacctcttctcatttgaggtttctgtgaatctgactgggcttcagaccctgatgataggcactctaaatctgaaagtagtctctaaatccagcacagaggcacaatacagaagcttgtctgctgtcacagctgatattctatggattcagactattcttaaggaacttgcagttcctcatattacacctcttgtgctctgtgacaactccattctgactaggcagctaatagttcaacatattcctggaatagatcaatgggcagatctacttactatgcgcttgcctcctactcggtttgcttatccgagttccaaactcaatgttgctgagcttcctttggtttcatag

SEQ ID NO: 3770 - DNA, 792 bp, Glycine max
  Peptide Sequence Number=SeqID_120548
gtaacaaaaaatgttgacactaaacatgggagactaagtccacaagaacagaagactgtggataccatagttgctgttagtaaatttcctctttcaatcatattggttggcgttggagatggactgtgggacatgatgaaggaatttgatgacaatatcccagctcgggcctttgataattttcagtttgtgaatttcacagagattatgtcaaaaagcatccctccttcacgaaaagaggcagcatttgcacttgctgcattgatggaaattccttctcagtacatggcagcaatagagcttaatctactgggtagtcggcaagccaatgctcctcaaagacatgctcttccacctcccacatatagttctcgtgctgcaaggtttgagccaagtatccctcctcaacatggcaacagccacccatttgccacagctccttctgccccaagttcaacttatgacaatcaaagagatattcatggcaccagttgcctgaaaaatctactatcaaatgaagcaagcatgcttgttgatgtgagtgataaaacagaatgtgttaatctagagtgtcatttgttgcataattttggtgtctcttccgtgcgtcataagctttgtcccatttgtctaagcaatgcgaaagatatggccttcggatgcgggcatcagcaacaaagtggtgatagtgactatgtcagtgatgatcacgatagtagtgaagggatggtactagcaatgatgggtgatagtattgtccaagctaaatgcaagcctgggtggttatcctag

SEQ ID NO: 3771 - DNA, 987 bp, Glycine max
  Peptide Sequence Number=SeqID_120549
atgggagcacggacagtggagactctctatcctacaagcgcccctaacaagggaggtattcaaatatggaattggatcatgagtaagcttggtttagaaagcagtgggaagaccagtgttcaggaaagatctgaagtatttgattctaaattatatttcccatggcatttgctgaaatcacctgatgacacattctacattatggaccgaaggtttcaaactttgtgggtcatggatatcaattcaggaaagatagatgaagtttttgaaggttcccctagaattcttaagatctgtggacagctaatcatgaaaagtttgtccatcatagatcagattcctagtgattggtttcaacagcaaactaagaatggctttttgctggggggcctacagcattctgatcttttatcttcactggcaactttgcataatcacattttcatttgtgatccagtgcatgttaaaatgtacgatattggagtaatgtacagagagttgcagtattcaactgcactctcagttaaggcaaatggactttcgggtacaccaattgatcatctgcaacattttgatttgctaccaggcagaattgacataaatttgagggttgatcttcctatggatattgagcttgttgtaccattacaagaatcctgtatatggtatcaagcaagaggtgcagctactgaaacttctggaatggatgaggtttccttaaacaagagtggccttgcacaacagtggtatgatgaattagatgatcttgctgctccaaaacctgaatctgaaataaatgttcaagatgataatctggataaaaaatcggtagtggaagatgagaaagttccctttagcgttggagtctttactagccccggaacaagtgagttacttaagctaactcgagttaatcactcatatacacttacaccctcctgcaaactcaatggggctatgaaaccaaaggaagctcagcaacattga

SEQ ID NO: 3772 - DNA, 450 bp, Glycine max
  Peptide Sequence Number=SeqID_120550
atggctttgagacatcgccgccttacgaagcaactctccaagtttctaactcccgttctcaacgcaggtaactgctgtcagcaatctagcaaagctttaaacttagtggctttgtctataatgcatatgccttctgctcagagtccaattgctaattggactcaagtgagaggatttcgtgaatacaggatctcaacaaagtctgatgaattatgtgaacctgcaactgaaattgatcttttgtctttcattaaggcttcactggatgagtttgaaggcacccatcattattggttaaatagatctgacaacaacgaccaactttttggagctgatggaatatttttagttctttctgcaagggtttttgactgtggcattaagcttgaaaaattgaagacaattcaaaagaggcatacagaagttaaattttttcttctcactttgtag

SEQ ID NO: 3773 - DNA, 543 bp, Glycine max
  Peptide Sequence Number=SeqID_120551
atggaggagcttgttggtgacaatgaagatgattacatttttgattctactcgcatttatcagcaactggaagtttttcctggtgatactgaagctccgaaaatcccatccccgctttatatatcagcaaaaaatgaaggaaatgttgctcggtttatgaaccactgctgctctccaaatgtattatggcgtccagtcatacgtgaaaataagaacgagtcagatctccacattgctttctatgcaatcagacatatcccgcctatgatggagttgacttatgattatggggcagttcttcctctcaaagtaggaggaggcctccgaatgaatatacttaaggataagctatacaagtcagacagcaggatggaactgtgtagaaagatgttagcagagaccaacttttcttttttggcaaacctagtaaattggcacatgaaagagcaagttgtctattttgctattgaggccaaaaacggggtgcatttcggaaaccaaaaagggggtgcaggaagctccttggaggtgcagaaacaataa

SEQ ID NO: 3774 - DNA, 345 bp, Glycine max
  Peptide Sequence Number=SeqID_120552
atggcactatgtttcatggctattgaaggtgtgcaacttacaattcctgaaaatgctccagttgaaggtatttttccagatttaagtgcaataaaactgaacttccttagtagtagtgctgagtttctaccaatctcattttttccacgtgtgacaaagacatttcttcattctttcttggaccctacaaaagctttgcctcaacactatgattcaattaaagggatagaagctcttggatcaagacaggccagtagattgttagaaatgaagaggcatgaagcttggcaagtttatggggctttgttgataatcttaaaaaatgacattgtcatccttctttaa

SEQ ID NO: 3775 - DNA, 309 bp, Glycine max
  Peptide Sequence Number=SeqID_120553
atgagacaaaaggagctagtacaaggtgcttttcgtatgaaagcacaaaattcaagagatggcaaagacaagaagaacaacaaatggaagaacaaaaaatcagaacactccaacaagcaccaagatgagacctttcctccatgttcgcatttcaaaatgacaaaccatcctcaagcaagatgttggtggaggccaaatgtcaagtgcaaaaaatgtggcaatataggacatgtagagcgaatctgcaagtttaaaccagaggaggcaaaggtgactacaaaggaacaagaagatgaggagttcaaatga

SEQ ID NO: 3776 - DNA, 456 bp, Glycine max
  Peptide Sequence Number=SeqID_120554
atgaagctagagatgaaatttttgtatgagaattttttattatatatgacaacttatgagaattttcggtaccgatatgataaaaaggaaaatccattcacaaaaggaatattggcaaacttcaaagaactttcctgtgctaagatcccaagtaaattagtcaattttagagaatgggttacaatagagaataatattcaagatgaatcctatacttcagatcttgaaaaaggttttataacctcaaaacataaatttgatatggaaatgggaacaatgtatggtaaggatggtatgcgagttccttccattttgaaggaattggattacaatgacattgatgatcatctaaagaagaaggcaggagaaaaagaagttgaatatgatatttttgttcctgctgatcaattgaaatccaaaactgaaggagccaatgctcatgaagagaagcaataa

SEQ ID NO: 3777 - DNA, 213 bp, Glycine max
  Peptide Sequence Number=SeqID_120555
atggtgattcatctcagtcaagggaaatggaccatggctattgacaacttgataggtttgaaatatatctcggatgccttatatgtgcctagcattgaccaaaatttgctcaatgttgcacaacttgtagaaaagggctacaaagtcatatttgaagacaattggtgtttgatcaaagacacaaaaggaaaagacacatttagggtgacatga

SEQ ID NO: 3778 - DNA, 273 bp, Glycine max
  Peptide Sequence Number=SeqID_120556
atggcagaaataggatttttaaaaccatttggtagagtgatacatatgttttggaaagagaagcttgagctaattgagattgtggcaaagcaagaagctgctcgtagtattgaagagttaactgcaaggggtggtcagatggaaacaaaccataactatgatcagaaagcattagttccctcttcagttgaaaaatgcgatgaccgttttgctgctcaaatcattcatgaatatcaggcaagattgcattgtggaaggagtcagttaatctga

SEQ ID NO: 3779 - DNA, 819 bp, Glycine max
  Peptide Sequence Number=SeqID_120557
acactctctcttgatcattctctctcagtgctctcgatctgcactgcaacttccttgtctgacagatcccgtgttccggagaaaggaaaaggcaagaaagatgtcggggcaaacgcagcgtctgaacgtggtccccaccgtgacgatgctgggagtggtcaaggcgcgtctagtcggcgccacgcgcggtcacgcgctcctgaagaagaagagcgacgcgctcacggtgcagttccgccagatcctgaagaagatcgtgcaaaatacgtcgccggcgacaacatcaagcacgtcgtcctcgaaaacgtgaaagaagcctccctccgcgtccggtcgcgccaggagaacgtcgccggagtgaaactcccgaaattcgactacaccgccgacgccgacgccacgaaaaacgaccttacgggactcgcacgtggtgggcagcaggtgcagcagtgccgcgccgcctacatcaaggcaatcgaggtgctcgtggagctcgcgtcccttcagacgtcgtttctgaccctcgatgaggccatcaagaccacgaatcgtagggttaacgctctggagaacgtggtgaagccgcgactcgagaacacgattagttacatcaagggggagctggacgagctcgagagggaggatttcttcaggctaaagaagattcaggggtataagaagagggagattgagaggcagatgctgctgcagaacaactccaatgtcgagactaatctccctttgcgcaaaggggtttcgtacaattctgctcacaatttgttgtctgtgggtgacaaagatgaggatattattttctga

SEQ ID NO: 3780 - DNA, 744 bp, Glycine max
  Peptide Sequence Number=SeqID_120558
atggggggttctccttctggcaattcggttcacaaacaaagaaggctttatcaagtttggaggggaggcaacaacttcacgtgtactgatgattgcttgcttgagagggttaatggtaaactggcttttctgaagtttttctgtggtgggaggctggtttttggtccggatgtagcttccctgtttcttacaacattcctaattgctggacctgcaattgcattttgtgtaaagatatatcttaaaatcaagaagaccgatggtcttattcatgattactggtttcctgtattgattgtgggttcaattctcactgttttggatttaatattcctccttttgacttctgggagagatcctggaattgtccccagaaattcaagacctcctgaatttgatgaaacatgtgatatacctaccccttccatggagtggattaatggcacaacccctcatctgaaactacctcgaactaaagatgttgttgttaatggtcacatagtgaaagtaaagttctgtgatacgtgcttgctttatcgccctcctcgtacttctcattgttctatatgcaacaattgtgtccagagatttgatcatcactgtccctgggttggccagtgcattggaatagctgaaattctgccatataaacacaccattgctcctattcacaaattgtctgtggcggctggcaaaaaatccaccacgccattttgccctggcagcaccttggccgctatttaa

SEQ ID NO: 3781 - DNA, 471 bp, Glycine max
  Peptide Sequence Number=SeqID_120559
atgggcctctgccagtcattcggggttcccgtcacccccagtaaggtgattcgaccgccgatcacccgggccttcatcgagaagtactacacgcctaggcaggcgcagggtgatgcacatcaggtcgcagacgcaccgccaccgcctcatcaggtcgatcccactggatcactaggcatggagtgttatctacagcacttggttcgccagcaggcggccaaccaccgggggcaggtgcagatacatgagtgtctctaccggttcagcctcagtcaacagaggcagggtttcgcttcttttgcatgccctactccaaagcagtttggggctgaggtcgcatggcccagagactggcccgaggcccaggcaggggaggagcccgcaggatcccctggtgaggcagaggaggcccgtatggatgaagaaatgactgacttgctcggtttcttgggaggaagcggagctatgtga

SEQ ID NO: 3782 - DNA, 342 bp, Glycine max
  Peptide Sequence Number=SeqID_120560
atggtgaagttaaaaagagttacttttgattgtgatgataacagtgatagacacattacacctacaatatttgaatgtaggcaatgtgtagaagctcaagtggctattaagcaattggaacttggtgaacctgaggacatgtcaccaatgtcctcatacgctgatcatgaatttggtgagctgaagttagtatcacatatgagaaagttgcaatctagcagagtcttcggtagagagaaaaacgagacagagctaggaagaagaaggacaaaaggaaaagtggagccgagacactacagagttgtgaccgtggatcacttccttcgacatttctcttgttag

SEQ ID NO: 3783 - DNA, 300 bp, Glycine max
  Peptide Sequence Number=SeqID_120561
atgggcttagaaatctaccctgaggttcatgagaccctagggccttcttcagcagctctaacccaatcctcttggagcctcttgctcatggctctggtgactggtcccttcctagggaggattgcattaggaggactcactcctacaatcaacagctatcagactggaagagtcacatcttgctttggaattgctattggctctagagaagagatggaggagtaccaggaactattaaggcagttggaacaggcatctaaggaggagcgtgacgatccttccaaggcacatcttagttag

SEQ ID NO: 3784 - DNA, 1050 bp, Glycine max
  Peptide Sequence Number=SeqID_120562
atgagacccttgaatgaatttaaaagtccttacaatgttgagaagatcacggggcaggaagctcctggcagacctaatcatccacatgtacatgcaagatctccttcttggactgaagggataagttctcctgcagtacgtagaatgaaagtcaaagatgtttctctatacatgattgatgctgccaaggagaaccctcacttagcccagaaacttcatgatgttttacttgaaagtggtgtggttgctcctccaaatctattttctgaaatttatgatgaggaattaagttcctcaactgaggccaacttactaactgaagaaaaagatgaacatgaacagggaagtggacggcaagaagctgagatagatggtaatgttagtcctgctcaattttttcctcctagagctcttcccaaggcaagttctagcagtcagctggagcatttgaaacctgtagaaggtttaggaatcaaccttcctcttcatacaggagaagcagctggacagcaaataccaactcaggtaaaatatgggcaaaatgtcccagttgctgccgctgccgctgctgctgctgctgttgttgcatcttctatggtagttgcagtggcaaaatcaagcattgactcaaacatagagcttccagtagcagaagctgctaccgctactgctgcagctgtagtaactgctgctgtcagtagacagtatgaacagggcagtcgaagtgatggagatacagacagtgctggctatgacctgaagggtagtggtgatggagagcatatagctttaggagcaaattcagaaggggacagaagatctgataggtcagtagtaagtaatgatagcacaaaatctgattctgcattagatgatcatgaagttgctgaggttgacattccatgggaagaaatcacgctcgggtcgtatggtgaggtatatcgtggtgaatggcatggaactgaaattgctgtaaaaaggtttctagatcaagatatatctggtgaatcacttgaagaatttaaaactgagttgcctccattaatgtga

SEQ ID NO: 3785 - DNA, 768 bp, Glycine max
  Peptide Sequence Number=SeqID_120563
atgtcatctcatctgaattacaatgctcttggttatgatgacaagaccttggatggtttctatgatctgtatgggagcttaactgagtcaacccctgcaagaatgccttcccttgtagatctgcaactgcaaggaacaccaatcgcaggtagtggtacatgggaagctgtcttggtcaatagggctgctgattctaatttgttgaaacttgtgcaaaaggtccaggagttgactggcaaatcaagtccagattttgtagttatagatagcaatttggtgcgcaagcttgcaatatttgtggctgactatatgggtggacccgttggggatcctgaaagcatgacaagagcgtggaggagtcttagttacagtctgaaagcaacccttggtagcatgattttgccacttggttctctaactattggattggctcggcatcgtgcgttgttatttaagagggtgctgaaagtactattggagaaggatatcctttgtatctttttgtctgaacgtaattttggaaggtttgcaatggttctagctgatagtttgggcatcccatgtcggttggtgaaggggctgcaatatacaggctccaatgatgtggcgataaactttgtcaagattgatgatggaagggagtacattgttgacctaatggcagatcctggaacacttattccttctgatgcaactggatcacaaatagactacgatgagtctttgtatgtggccagtccttcatcaagagaccttgattcctctcat

SEQ ID NO: 3786 - DNA, 258 bp, Glycine max
  Peptide Sequence Number=SeqID_120564
atggagcagtttcctttacaccccagacgacaacagaaagacactgtttacaccactccacacatcatcatcgtcgtcatctactttaggaagcagaaagaggtaaaaacgagaatcactgagcaaccccagattgagaaagaaggatcttttctgagcggagcacaaagacagagggagaagcaacaagtggaaggagtagtaggggcccacttgagtagaggagcagaaggatttcaaggtcccagaaaaaggtga

SEQ ID NO: 3787 - DNA, 468 bp, Glycine max
  Peptide Sequence Number=SeqID_120565
atgaagaaccttcttaagaagcttcatatcatgtctaaccaatcagagaatgaacaagggtcttcttcatcatcttcaaagggaggaaacaagtccaatctaggttcatcttcatcttccaagaagaaggttgtgcgctcaacgtcccctcaaagttctgagcaaaagcccttttccgggctctccagttggttgaattctctgaggggtgagagaatggagccatctgatgcagtgagcagtggtggtggtttggatgctgtgttttcagattcagctaggcttgattcagggtctagtggttcaagggatcctgaagtggaggaagagtatcagatacaactggctttggagcttagtgcaaaggaggatcctgaggccgtgcaaattgaagctgttaagcagatcagtttgggatcttgtgaccctggttacacaccagctgaagttgtggcctaccggtattgg

SEQ ID NO: 3788 - DNA, 552 bp, Glycine max
  Peptide Sequence Number=SeqID_120566
atgttcttatttgcattttctattgcatctattttggtgggacagggttcaacttctgctagtacttctcaaaatgctgcaaatgaagatctcaggaggaagcttgaacactttcaatcaaaagtcaaggaatctcttgcagtgcttaagcctcattttaaccatgaaagtccagtcactgcaattgctgctattcaagagctagaagtactgggaactatggacctcaatgtaccactaagggatgaaacacttccacatcaagtggagctgccaccaccacagccaccagtgcagcagcagcagcagccaccacagcagcagctgcagcagccaccccagcagccaccacagcaacacctagcaccacaacaactgccgccacagccaccgatatttcagcaaacatatcctccatttcatctgccgcagttccaccatcaccagccttcgctgcagttccagcaacagcagcagcagccgccacagccaccgccacagctattccagcaccaggcacagcctccttcccaccaacagtttcatccttag

SEQ ID NO: 3789 - DNA, 399 bp, Glycine max
  Peptide Sequence Number=SeqID_120567
atgaaaatgttaaccaacgatggggctgatgctaggtgcactcagcatttttactggtgcacccaacacttattgggaaaagacttaaatatccctgccatatttttaaaaaaatttgtgcacccaacagtttctttttccgttcgtgctgtgtctttttcgcttcttcttccttttgcgactacaacttcctcttctgtgcgttctttggctgtcagcgtgcttgttgagcctgttcttctactgtgcgttgttgttcagcattgttggtggcgtgttggtggtgctcttcacctcgactgtgcgcgttcttcttctgttcatgctgctccatcgacgtcgagtgtagtttgtagggatgtagttgatctgcatagagatttaggtcatctacagtag

SEQ ID NO: 3790 - DNA, 294 bp, Glycine max
  Peptide Sequence Number=SeqID_120568
atggttgagatgtgtaataaacaagaagcaactacaggaaacagtgatgtaatgagcgcagtagaggaagttgttaaaatccctggagatagcatcggccagaacggtgagggggttgtaggcgccgccacgtgtaaccttgacgaggaaggcgaagaagaacatgttggcgatggagaaggtagttttgataacctcaccgagggggccatgagcgaagccaaggtggttgaagacgatgatccgaaggagaacaccggaccatacccacatgaaagacagaacgaagtctga

SEQ ID NO: 3791 - DNA, 1467 bp, Glycine max
  Peptide Sequence Number=SeqID_120569
atgatgaagacggtgagagatagagatgcttctttctcatcctatctcagaccaggtaacaaggcaacaacaattactgctgctcctcttgaagatgccaccactgagcttagcatcttcgatgctcgcaaatacttcaacgatgacgacgacaatgacaacaataacaacattcaaaaggttagcatcagcagagtctctcccatggagagaattccagagaggggtgatgtcaccatcacagaagccaccagatactcctctgcttcatcttctgtggacagctacgcccacattagaaactacagagggcgttccttccacgtggtaactccaacggcttcctcagaagccagctggaacagccaaacagggttgctatctcaccctccaggtgcaatccccgtctcaatgcaaaaccctcaaaaccctaaaaacctccaaaaccccaaactctccaaatcaatttggctcctgaggcgaaaatgcccatgcacggggaaaaaatcagttcgagtcaaagaatcaacacaagaatcaaaaactcagatatcacaacaagaaagagataccgaacatcacaacaacaacaacgttcgtaatcacatcacaccgaataattggattctgaatcaaacaccagcactggcaccagcaccggcaacagcaacaattatcgctgcaaaatcgcaacgatttcataattccaactctcacagagttgttagctccgtgagagttccgttcacggacggattcactttccctgtgctaaaccctaacaatccaatcacgaaactaaagctcgcgaacgtaaacggcatcgtcgaggaagatccaccgcgtgaatccctggaggttttccatccgccggacgagccgtctccaaatccgtcgccgaagcaactcaactatccattaccggcgaaggcgcgagtcgtcgtggaagacgacgccgcgagcgacgcgagctccgatctcttcgagatcgagagcttctccaccgcgacacagtcaacctaccccgccgcgtaccgccgcaacagcagagactcgttcgacgaagccgccgccgccgccgccgcctccagcaccgccaccgcgacaggattcttctacggccgaagaagcatggaagaaggttcaacaactcaaacgataaccgaatggtacgaaccgagcgaggcgagcatcgagtggagcgtgaccaccgcggagggacacgacgaggccatttccaatggcgtggccgtggaagaaaagtggaagcggaaaggtggaaacggtttgttggtgagctgtcggtgcgagaaggcggttagcgtggggccgcagccggtgaaatgtggatcagagggacagagaaacgccacgtcagcatcagatgtgaacgtgattgggagtataaacaagccaccacggggtcaccgcaacgcacctcgcgtgtcgcttgctttggcgacatag

SEQ ID NO: 3792 - DNA, 1233 bp, Glycine max
  Peptide Sequence Number=SeqID_120570
atggagcaaaagcttgcaacggttgatgcgctttcagacatggtgaaggaaaggcagcaccgtacatgccaccaagatcactttcaagatttgatgaatctgccacagcaaggcagcttggcagaatttattgatgtgatttcttgtaaacttcgcttatcagaagactatcttgttgatgcgtctttagttggtctgcaagaggaatatgctgaccctgtccttttattcaagccaagaaccatgggagaagctcgctgcttggcacgtctactacaaataaagcttcaacagcatgatgagaagaaaatagctattaagaacatgagatacttggctcctgaaagggcattaaataatgacccttttacccccaagaatttatcaagaatgttgaaagctttaactgcagaagaactcattgagcttgatgaagaagaagttactgttgtagaagaagctgaatgtgataatgaaaataatcctaacatttccttgcatgcaattgaaggtgtggaaggaacaacctctatgagaataaaagggcatgtgggatggagaacacttcaaatcctcattgacaatggcagcacccatgatttcttggactatgatttggccaagaggttgtgttggaaggagaatgggctgaattatctgcagtcgacactcaaagattgttcaatgggttttgaggtggaaacggacgcttgtggagatggaattgaaagaattgatggttgtggtcttagtagtggagcattggcatcaatatctagagaggtggagctagccgggtatgattacgagattcagtataagaagggcaatgataattatgtggctgatgcacttcctaggctgccacgtcagcaaataatgcacatggtacttgatacttcgtcctcagaatttctacagaaaattgagaagatttgggagcaagatgcagatttgcatgccttaatgtctcatttaacttggaagggaggtaatttgggacactacacttgggatggtcaacttttgaggaagaaaggaaatatgctcatattaggtggtagagaaaaggttgagacattcacaaaagttggacaattggaaaaggccagtgatgctgaacagagtattcaagttgacggttcaaatagaggcaccggtctgagttctcctattcctcttccagcacgtcctcaaagaatttctactggaagagaattattctaccagtaa

SEQ ID NO: 3793 - DNA, 414 bp, Glycine max
  Peptide Sequence Number=SeqID_120571
atgtttgtggttgcagttagagaaggtggggaaatggaagagaaatactcaaacctggaaatttcggaggagagcccaaattcagggagctctgcatgcactggatcacaaccaggaggtgaaggtgatcgtcttgtcgagcgccggggcccactgctgctccggcatcgacatctccctcctgggatcaaccgccgcgaattcgggttcctccggcgagagatactggcgatgcaagacgcggtaacggccctggaacggtgccgtaagccggtgactgcaagcatacagggggcgtgcatcggcggtggaattgatatcgtgacggcgtgtgacataaggatgtgcaccgaggcgtttttctccatggggaaatcgcatgcgcacacgatcagagagattctgatcaaatga

SEQ ID NO: 3794 - DNA, 1365 bp, Glycine max
  Peptide Sequence Number=SeqID_120572
atgtcgggcccacccagagttcgatccatgaacatggccgtcaccgacgctgacgcgcgcccggtgctcgtccccgccggcaacaaggttctccctgccatcgaccgacgcaagccggtgatgaaatcgtcgccggagacggagaagaaaccggtggcgcattcgccgcaatgcgtctccgttacgccgccagctatttcgcggcggcaggagcaccatcaggccgtgctgaaaagcctgtcgtcgatgaacgcctcctgctcttccgacgcgtcgtcgacggattcctccactcacagcagcggcgcgtcgtcgagcgggaaggtagcgcgtcgggttagtgtggctttaaggaagaagcaggttggtcccaagacggagaaggtgagtagtgacaatgtggctggttctgatgatgctgatttgagtgatagcttggagggcaagaaaaggtgtgcttgggttacaccaaatacagctaccttgccagatgaatctcttgtaaaggaagcatggacacttaaaaagccatgttatattgtttttcatgacaaagaatggggagttcctgttcacaatgacaggaaactgtttgagttgctcagcttctctggagccttggctgaactcacatggcctactattcttagcaaaaggcagttgtttcgggaagtctttttggattttgatccaagtgctgtttctagaatgaatgagaaaaagatagctgcacctggaagtcctgccaactcattgctatcagaactcaggttgcgatccataattgaaaatggacgtcagatgtgtaagaagggtcttgctgaagtgaatcaacccatacacttaccttttcaaacttttctgctacctacctttgaaaatattaagaaaaacgaaataaacctgcttcctgacccacacacagatgaatattataaaaagaagacttgggaaaaagaaagacaaattcttaattcgacttgtttaaggggtggtattgaagagtttgggtcctttgacacatttatttggaactttgtgaaccataagactatagtcagccagttcaggtacccacgtcaggtccctgtcaaatctccaaaggcagaattcataagtaaagaccttgtgaggagaggattcaggagtgttgggccgactgtcatctatactttcatgcaagtggctggcctaacaaatgaccatattatcagttgcttcagattcaaggagtgtacctccaatgcagaagcaatgggcaaagagagttccctcaactccaaggtcaaagagaaagcaaacgaggaaccaaccgaggtggacctgttgctggctgcaaacaaattgagcttcatctctaagtag

SEQ ID NO: 3795 - DNA, 408 bp, Glycine max
  Peptide Sequence Number=SeqID_120573
atgaaaagttgttacggaaaagcaaaagaaaggagaagtagtttgtacatgacactgataaatgaacatgcaatcattgaaaattatcaaggtattgaaggttatgaagtgagggcgagccctggtgcagcgaaacagcctctttgcatatgcaagggtaaggctgcgtacaatatccctcccccataccttcgcatagcgaagagcctccgggcaatggggtacgaaatgtataagggatttagtgatgaaagactacaaaagggtgaagatcataacttgggagttgttactagatcaaaattgagggagttacaaggagacattaataggaagatgattttatttgtggaaaaggatgatggaagtgagttgaagatcataattttgagtcaacttctagattga

SEQ ID NO: 3796 - DNA, 426 bp, Glycine max
  Peptide Sequence Number=SeqID_120574
atggcctcagagacagaagctgctcttgctgccactccctctgatggtcccaccgtatttgacaagatcatcaataaggaaattccttctactgtggtctatgaggatgataaggtccttgcctttagggacatagatccacaagctcctacccatattctaatcattcctaaagttagggatgggttaactggtctgtccaaggcatattatgttgtctcagatgttcatttgaagatcatttatatacatgtgctcagaaaattcacaatagtgatagatttccttcagtatcagcatactggtagcaggaaaggcttaatttttctgatgaaaaagattgtgcagcttgtacactcatctaataatactgctttgaagttgttatttgaggactctatggcttgggaaaaattacttaactga

SEQ ID NO: 3797 - DNA, 570 bp, Glycine max
  Peptide Sequence Number=SeqID_120575
atgggtataaatactgatgcattgtgcttacagaataggtactatgacatggtcttaagcaccaaattggcaggccttggccatgcagcatttttgtttatgacaactgcccgagatagagttagctatatctacccaaatgtgaatgccgcaggagcaggattacttctatctgaaacattcgtcccagatagtcaaaatctctcagacggaggatataatatgtaccatcagatggttgactggctaggaaaaccatttcgagaagttccaagacaaccagtgccaccacttagggtatcaatctcaaagaagttgaaggaggttgttgaggcaaaatacgaaaaagcaggtgcaaaaaaaggaaaatatgttgtcattcacggtataaaatcagattcaaaggcctccatgcagtctaggggtgatcctgatagcttgctacccattgaagtgtgggctgaaattgctgacgttataaggtatgcaatgttgctcaatgaatctcgtattgaactaaaaagcattcttaatgtcacaaagagtctacctcgtggaaccatcttttga

SEQ ID NO: 3798 - DNA, 921 bp, Glycine max
  Peptide Sequence Number=SeqID_120576
atgggatctcaaggtgggacaacccaagaccaagagccaaagactggttctttgaccaggcaagggtctttgtacaatctcacccttgatgaggtgcaaaaccagcttggaaatttagggaaacccttaggaagcatgaatcttgatgagctgctcaagagtgtgtggactgctgaatctggaactgatgcttacatgcagcatggtggtcaggtggcttctgctggctcatctttgaacccacaagggagcctaacattgagtgggaatcttagcaagaaaactattgatgaggtttggagagatatgcaacaaaataagagtgttggtaaggaaagacagcctacacttggtgagatgaccctggaggatttcttggtgaaggctggtgtggctactgaaccttttcccaatgaggatggtgccatggccatgtcaggggttgattcccaacacaacacatcacaacatgcccattggatgcaataccagctcacttcagttcagcagcagccacagcaacaacagcatcagcatcaaaatcagcagaatagtgtgatgctgggtttttcgggttttatgactggccatgcggttcaacagcctataccgattgtggtgaatacggttctggatgcaggatactcagaagcattgccatcttctttgatgggtgccttgtctgattcacaaactgcaggtaggaaaagggatgcctcaggtaacgttgttgagaaaattgtagagaggaggcagaagaggatgataaaaaatagggaatctgcagctcggtcccgggctagaaaacaggcttacacacaagagctggagattaaagtttcccaattagaagaagagaatgaaaggcttagaagacagaatattgcttcctgccatcttggcagggcaatgaatggttga

SEQ ID NO: 3799 - DNA, 665 bp, Glycine max
  Peptide Sequence Number=SeqID_120577
atggcaggagcaacaccaaaaggtgttcttagagtgatgggtgttcctggactgaccatttatcatgttaaaagtcatttacagaaatatcgccttgcaaaatacttgcctgaatcaccagctgatggtaaagaccctaaagatgagaagaggatgtctggggacagcatttctggtgcagattcttcctcgggaatgccaatcaatgatgccctaagaatgcagatggaggttcaaaaacgtctgcatgagcagcttgaggttcgcatttctgataatgataaaagccttgcatctttttcaatgacatttcaggttcaaaagcaattacaaatgagaattgaagcacagggtaaatacttgcaaaagatcatagaggaacagcagaaattaggtagtaccttgacaacctcggaaaccctccctttgtcccatgataagcaaaatcatcctcagtcagaggcttctggatctagtgatgcccttgcaagcactgtgtctccacttaaaaaacagagaatcgatgatggttccaaggaaggcttcactgcttcccaagtaagaaagaatgacaatgttggtcagttggatccaaacttatatgatgatgctgggtttggatttgatttggagacaaaaaaggatgaagataatgagagtggaca

SEQ ID NO: 3800 - DNA, 100 bp, Glycine max
  Peptide Sequence Number=SeqID_120578
ggtgcgcctgtatggggaggttgaaagggagtatgcctgcactggctgcacccaaatgaaaggattgttaaggtggagaagaggggcaacgctacactag

SEQ ID NO: 3801 - DNA, 258 bp, Glycine max
  Peptide Sequence Number=SeqID_120579
atggcaatacgaattcctgaaatggaaaaacattatattttgatcagaaaatcatatcatattatcgactatcaaatccatcccaatactagttttgcattactgaaggacgagttttctggtgcacatggtgcagtaatgcctgcgcttggtcttagagtacaaaggaaggaaacagaaactccattggctctcaaagtccatagcctggatcatccctccacagtaaggacacgctcctggtgctggctgccttga

SEQ ID NO: 3802 - DNA, 747 bp, Glycine max
  Peptide Sequence Number=SeqID_120580
atggcgtcccaaatccgtgagtggtctggaatcaatacattcgcacctgctacccagactaagttgcttgaactcttgggaaatcttaaacaagagaatgtgaactccttgactatacttgtgatgggaaaaggaggtgttggaaaatcttcaactgtgaactccatcattggggaaagagtggtttcgattagtcctttccagtcggaagggccaagacctgtgatggtgtcacgatcaagggctggttttacattgaacattattgacactcctggtctcattgaagggggtttccttctgaacaagaccatagatgtgctgctttacgtggatcgcttggatgtgtacagagtggacaacttggataagttagtcgccaaagctataacagatagttttggcaaaggaatatggaacaaggccattgtaacactcacacatgcccagttctctccaccagatggattgccctatgatgaattcttttcacaaagatctgagtctctcttgaaggttcttaggtcaggtgccaggataaagaaagaagcctttcagggaccagctgcaatgcaacactacattgtgaaagtgctgctattgataaccctgactgggaatagtgtgaagcagccagaggctgctaatctggactccattggagagttttgtgtcgctggagtctcagctgcaaatagcattcactcccaaaatttgtggtcattgctaccgctactgttgacctag

SEQ ID NO: 3803 - DNA, 216 bp, Glycine max
  Peptide Sequence Number=SeqID_120581
atggaaattataattttctcgggaaaagttagagattggggattggtggtgttggaaatgattggatttgagagagagagagacgttatgaatcccaacgttgaattgaacagacggcggcgttttaaagggacgttgtcgttaaccgaggtgctggggacccacgcgcttgtcacgtgtcactgctcctctttgggtgtcgtcgtttctctttga

SEQ ID NO: 3804 - DNA, 411 bp, Glycine max
  Peptide Sequence Number=SeqID_120582
atggccgagccacaaggtggtattggtggtgacagtggtgcttctggaagcaagcgtagaagcactgtttccaagcgtggcatggtagcacaaacacaagatgaagcaatagtgggatcttcacccgcaacaccatgtggggcttgcaagttcttgaggaggaagtgcattgggggatgcatttttgcaccctacttttgtactgatcagggtgcagctaagtttgcagctgtgcacaaggtgtttggggctagcaatgtgtcaaagctcttgtccaacattccggcgaaccgccgccacgaagcggcaacatccatatcgtatgaggctcaggcaaggctgtctgatccagtttatggttgtgtctccaccatccttgccctgcaacaacagctttttatctatccctaa

SEQ ID NO: 3805 - DNA, 1257 bp, Glycine max
  Peptide Sequence Number=SeqID_120583
atggcaacaaaagcaaaagaaactagtgtggctgggaaggagaagaaggctcaatcttcaaattctcccatgacaagcaccaaaaagatcccaaccaaggcatcaacaacaagctctacaaacaaggccacctcaagcccatcagagaaacaagtccctaactatctcaagcccacaatcagctcactccttgattctcactcctccttcaagctccctaggaatgatgctcccaccaagcccactctaaatagaagaagatctcttgatccatcatcatcttcaaggttacagaaacacgcacacacaccctctctttcaagacaaaacaaggcccttgtgtcccctggcccacgtgaaagaaccctacaacttcgatcttcgagtgttcctattaaaactactaataacccttcaaaacccattccggagaggctctcaaagaccccaaaggaagggagaatacaaccactgagtgccaagaagagcaacaacaacgcttctacttcaactagtaagaaggtaataagtaacgatgcttctgctaactcaaccaacttttcaaagagtagtggtactactgcagaagctgaagaagctataaatgaagaaaagtttggagaagtgaaaaatgtggagaatcatgaagaagaaccaagtcaagtagttggctctgaacatgaacatgatcgtgaacaacatggccgaaagctcgatgagtctgatcaacctcatgttcaggatgatgatgagaaggacattcctacagtgccagaagaaaaaaaggatgagaatacaaaccaagatgagtgcaacattaacgaaattcatccagaaattgatcattcaacaactgaagaagttgaagcgaaagaagaggaacaagaacaagaaagagaagaaagtggggttgtagtacaagaagatcacaaaagtgagcccaacaatgaggaagaggtagtggaagagagggaaagagttgaagaagtaacaagtgaagaggttaaagagttgagggaaggacaaaatgaagatgaacaagtagagagtgaatttaaagaagaaaaggttgagtcaccaaagccaaagcaagtagaagaaggtggtggggtgcaagagaagaaagaggctcagtctccagtatccaatgatgtgatcgaagaggatgcaaggaagcaattggaagcgaggaggaataaagttagagcattggctggtgcatttcagaatgtcattgaccatcaaaaaaccaagtga

SEQ ID NO: 3806 - DNA, 258 bp, Glycine max
  Peptide Sequence Number=SeqID_120584
atgatggcacatcaaaaccccccatacttagccttttgcactcctgggcaaaatgaaacaaagaacaaaatccaaggatatcaaagagagacaaacaaaaacattcacatatttctcaatgaacatcaaggaatgcacatgaggatcaaaaggtattttaaggttgtaatggggccaaggacaagctatggaaaaatatggaataagtggctaaatcccaaaggaatagaggagcaatggggaataagtgcatattaa

SEQ ID NO: 3807 - DNA, 288 bp, Glycine max
  Peptide Sequence Number=SeqID_120585
atgacgtgcgaccattctttggtcctcgtgaggtgcttggcacccatcattaggcaatttgtgaaattccaggacatgccgaaaaaccaaaaagatattgatgcacaatcccagaggggggtgtacttagtaaaaatgggggtgcaaatagcacccaggcccacttgggccctccggaatattcctccagaaggcggttgcttctggaggaagcaaccctgctcgcctgggcgagctgagctcgcctgggcgagctgggcggcaaccacctcccctattttgctataa

SEQ ID NO: 3808 - DNA, 249 bp, Glycine max
  Peptide Sequence Number=SeqID_120586
atgagtaacatgtccagtccaagtaaatttattagaatcattagtggtggacgagatagggggaggaaagccaaagcacttaaggtttctgtgggacagcctggttctggaagtccttggtcactatttgaagagcaggctcttgttgtcctggtgcatgatatgggtccaaactgggagcttgttagtgatgctatcaacagtactagagaagggtttaggtcgtatgacttgacccgtatgacatga

SEQ ID NO: 3809 - DNA, 411 bp, Glycine max
  Peptide Sequence Number=SeqID_120587
atggtatgtgtagggactaaaaggggatgctttgaagcattgggactaaaagggaaaggtagtgcccgacagttgtttcaacgtttgcaaggaccaatggaggaggatactctgaagtctcattttgataaaattatcaagattggacctaactcaactcccacaaaatcagcttgtaaggtgaggattgtccaagcaccacccttagggctacagttaaggcaacccccaaagaagctgcaactaaggcagggaaaacacaattgcgatggtgtcgtgttgcataagccgcaaaaaaaggcaatcgtggctgctttgctcctctcggctgtcatgcgtgttgcggatcttgcgaaggggagaagtttctccgtccacaatcgtggaggcagtttcaaattagggttatga

SEQ ID NO: 3810 - DNA, 321 bp, Glycine max
  Peptide Sequence Number=SeqID_120588
atgagtcatcattcatctagtgttaatggtgagggtactagtcataaggaccctctatatagaatcttagatgagttgagttccctcaagttatggaaagaaaaactagaaagaaaagaaaaaggaaaagagagggacaatgtaacgacttacttagattggaaaataagggtaaagcaacaacttaaaagaaagtctactttaaaatcttatggttctcactcttatccaaagaaagaccaaggtctaggaatcttaggggcaccaccttctaagcccaaagatgataaggggaagacaatagaaaaacaacccccctaa

SEQ ID NO: 3811 - DNA, 138 bp, Glycine max
  Peptide Sequence Number=SeqID_120589
atgggcaagcccccttgttcatccacccttgaaggtggtgccaccacgtttacaatgaaactcaatgagcaagaaggagataaaggaaaaggtcaactatccaacccagttgttccggttattcacagctttgtttga

SEQ ID NO: 3812 - DNA, 345 bp, Glycine max
  Peptide Sequence Number=SeqID_120590
atggataagcgagtgtatgtggtatctttgcaagcagagctagctatgttgcaaactcaactcatgaatagcaagtttttctatacaagtgctcttcaaaccacacaactacatcaaccaaacatgaatgcagcagcactacatccagcatattccaacaattcatgtggttccaccaaccttttaaacttgagcaacttcaataatacgcctagctttgaccttgcaatggacacaacaccctcatcgcatagtttggagcctcttcaactcacaaggttgtcccaatatgaggaagaggaggaagaagaaagcaaaacccaacaaactttcgaccaccattaa

SEQ ID NO: 3813 - DNA, 114 bp, Glycine max
  Peptide Sequence Number=SeqID_120591
ggtatgtgtgttggttgggcctttaagcgtaaggattggagatccaaccatctagacagtctacaaccatcaaattatctgaaaggtatggatacatgtccggtcgtcgaataa

SEQ ID NO: 3814 - DNA, 1260 bp, Glycine max
  Peptide Sequence Number=SeqID_120592
atgcaaccccagcagagctcaagaattgatttgggtgaattgagagcacagattgtaaagaagcttggagcggataagtcgaagcggtacttttattacttgaacaggtttttgagtcagaagctgagcaagtccgagtttgataagttatgttttcgagtgcttgggagggagaatcttccattgcacaatcattttataaagtcaattttgaagaatgcatgccaagccaagaccccaccaccaatccatccgccaggtcccctgaagtccggagaacatgcttcagacatatctcctggcagagaagatgggcatgaacacagtgttgccagcttccaaaatcagaatcagaaagcacccatttggtcaaatgggtttttgccggcatcccccaaggttaggtctggagtacgtgaacggaagctgagagatagaccaagccctcttggaccaaatgggaaggttgattctgtttctcaccaatccatgggttcagaagactctggtagtaaggttgacatggagaatggaattcgtactccatgtgattatcagagaccaatacagcatcttcaagctgttgcggagctacctgagaatgaaaggggagatgctgttcggagacctacagaaaaaccaagaatacgcgggaaagggccagctgaaatgtcaattgttgaagacggggaagaagtggatcagttaagtcgcctgggtttctctagaagtcccttgatagcacctcttggaattccttactgctcagcaagtgtagggggagcccgcaaaacattgccagtgagtagtgctggtgattttgataattgttgtgacagtggtaggttgtctgatacaaatacactgcagaggcgcatggagcagattgctgcagtacaaggtcttggagctgtttctatggaatgtgcaaatatgttgaatagtatgttggatgtgtacttgaaacggttgatcaggtcttgtgttgaattagttggagctaggtctacaaatgagctgaggatgccccctgcccccaaacagcagatgcagggtaaggtcatcaacggcatgtggccaaataatcatttacacgtacagtgtgctgatgggtcagcagaaggtgtgcctgaacacagaccaccatgctcagtttttttgcatgattttaaagttgccatggagctaaatccacggcaacttggagaagattggcctttgctgatggagaaaatatccatgcaatcgtttgaggaataa

SEQ ID NO: 3815 - DNA, 387 bp, Glycine max
  Peptide Sequence Number=SeqID_120593
atggatgaaagttctactggaaaacttggttatgattatgaatgcagtgaggagacaaagaaaaagaaactttttaatcatgatcttgccatttctgggtttttactatttgttacaactcgcaacagatccaatttacacaatactgagcttcaagtggttatgcctgtgacaataataatccatagtaaataccaaaaggtgcaactaagattggatgaagacacggccaatgaactgagagtatgtatccaaggctattcctcgtggaacagagggatattggggtgctgggtcatattgggagatgggtcaactatgtatgatgatctggttggttcagattgttggggggttgttgtggggtttaatatgggaaggttttag

SEQ ID NO: 3816 - DNA, 672 bp, Glycine max
  Peptide Sequence Number=SeqID_120594
gatgagagtggaaagagagaggaacagcaacacagtgatgccggcggcggcggcggcggcgggggggaggagaatcgggtacataaacgcgcaaacggcgtcgttgcagcagcatcagatccgtggctcctcagtggtgacgtggttcctgcagaggccccactccatccccttggtcctcgccgtcttcctcttcctcgcgtggctctcactccgcctccagcgcgtggcctacgcgccccctcactccttccaaacggacatcagggccaacctcgccaggtcgcaaaggacaaccgcggctggatcttcgatcctatcgccctcgcccgcgcttccggcatttcaggtggagcagtgtcgtgtgcgtcgcttcacgtgggagaaattcggccggggaagataagagcgaatcacagacaccacgattctaatgagactttcctcatttggggcgctgctaccaagtttaggaacaacgatgaagatgatggttatgctgaagtgatccttggcagagatgagattgctgtagctgcaagtccagttcacaaagcgcatgctttagtcaacattgattccattcggagtatcttcttcataggatgtcaagacaatgttgtaagctataatgcatctagtactgacttcaatgtttggaaagatctttga

SEQ ID NO: 3817 - DNA, 900 bp, Glycine max
  Peptide Sequence Number=SeqID_120595
atggagaataaaaataatgtaaactcttcagctattgaaaatattggagctagtttgggagagagagtacacaattcaacaaatttagtggatgcatctgcgaacttggccagaggattaggttctcaggtctctccagatttggatagtaaactagatgagttccaacctgaatctgtgctgtctaatccagttaacattaattttgaacagaatcagggctctgttgctgttcagcagaccagagttttgttccactgtctctcagtagaagttttacaattttacttagcttatgaaaatccatgccacataggtacacaagatggcggcgaaataactacttcaggactaagagatgggtcctcggatgatatgcacagggatggcggtctggttaaagtcaatggcatcagtgacacaaatgggcctggtcatcagctagattctgttgaagaaactagagaagcaataaattctagattacaagatagtaaccacttagtaatcaaagagaaggttagagcagaagatgcattagcaaatggttttccctcttcagagccaagtttcaatccagggcaggttattgaacagagcacaaaaacattggacaacaaacctaatacgactgattcaagtcaggaaaggacagctcagggtcttgagcaagaggagtgtcagacgttgcgtgaatcagcggaggtgcctgatgtgattggggacgactccgttgctggcggtgttgtctctggttcacagaacagttccagtgtgtatgaggttcagccgggtgtagaatcaggcttgtcaaccacaccaactagcattgctaagcaaaagggaagaagaattgcaaccagatacaacagaaggggcaggggcaagggtgtcaaatga

SEQ ID NO: 3818 - DNA, 1488 bp, Glycine max
  Peptide Sequence Number=SeqID_120596
atgtcccttcctattaagatttgtcttctttacttgacctgcctcacagtttcctgctttgcagagcaaacttcaaccttaattgtagatgctaaaggatcagtgagaaaaattccagatactttctttggagcattttttgaggaaatcaatcatgcaggagctgggggattgtgggctgagcttgtgaggaatagagatatgcaaatgctcaatgagatcttgacgtcactttctttattaaaaatttcacgctcaggttttgaagctggaggccccaacgttccctcaaatatttttccgtggtcaattattggagatgattcaaccatccttgtctcaactgatcgtacctcttgctttgagcgaaataaagtcgcattgcgtatgaacattctttgtaatgaatctaatccttgcccagctggtggtgttggtatctcaaatcctggtttctggggcatgaatattgagaaagggcagaagtacaaagtagtcttctatgtgaaagcacgaggtagacttgatctagacgtttcatttgttggatcggttagtggtgcaaagttggcttcacaaaactttagagctcctggacaaaatatttcaatgtggacaaggatggagactatactggaagccaatgatacaaatcgtaatgcaagtcttcaaataacaacaagcaatagaggagttgtatggttagaccaagtgtctgctatgcccttagacacatttaagggtcatggttatcgaaaggacctttttcaaatggtggcagatttgaaaccaaattttttcagatttccgggaaattatctaagaaatgcatttaggtggaaagacacggttggaccctgggaagagagaccagggcactttaatgatgtatggaattattggactgacgatggatttggtttttttgagggcctccaattcgctgaggatgttggtgcattgccaacgtgggtgtttaacaatggtctcagccttaacgacgaagttaatacatctgccatcgcgccttttatccaagaagctctagacggaatcgagtttgctagaggttctccaaaatcacaatggggatctcttagggcttccatgggacatcctgagccatttgacttgagaattgttgccattggaaatgaagagtgtggcatgcctaagtatcaagcgaactatctcaaatttcacgctgccataaaacaagcttatccagatattcagatcataaccaattgtgatggttctaaaaaaccattagatcatccagctgatctctatgattttcatatttatacaaatgctacggacatgttttcaaagtctaccaagttcgatgatgcaccacgatctggtccaaaggcgtttgttagcgagtatgctgtttggaaggatgatgctggaaatggaactcttttggctgccgtggctgaagctgcattccttattggactagaaagaaataggttggattaa

SEQ ID NO: 3819 - DNA, 978 bp, Glycine max
  Peptide Sequence Number=SeqID_120597
atgaagagacagagcagcgcggtgtcgccgtcatcgtcgcggcgagaaactccgccggagaagattcacgcgaagaccatcgggtgcatgtccggcattctccacttcatctccagctccaattcccgtcgctctcgccgcttcctcacattcggaaagaggcagattaataagaatcccgcttctacccccgccgacgccggaaatttgccgccggaaaatgccgccgccgatgactggaggctgtcgtccgacgtgcccaggagtccgactttgccggcggagattcgacggtcgagtgctaaggcccctccgccggagaggcgccgcgaggcgccggctctggtggcgaggctgatggggctggaggcggcgccggcggagccgacggatacggtggcggagaagaggcagaagcttctcggggcgttgcagcggtgcgacgaggatctgaaggcgctgaagaagatcatcgagaccgtgcgtttgaccgatcctcctccgccgtcgacgccgtccccgtcgccggcgttggcttgtattggtttcgaggataaatttcgaacggttccggaggtgaagtgttcggtggttaacggggagcaacagcaaccgagtccagtgtctgtgctagacgagttcactccgcgaatacagcaccagaagcagcagttgctaaagaagccaggagaggaagacatcagcagcacatacatctacgagagaatggcatacgagtcagtgaataggaaagtcaacgacgaagatcatttggttatgtggagtagcaaagccatgataaaaagtgtggatgaagtgtgcagggacgttgcatggggagaaaagcgagagcttggaagaattgggttggctttgcaggattatatttgcagagatttgattgaagaaattgttagggaattaggatgcttctacactctgccttttgaggcatgtaagagaagactctgcttctaa

SEQ ID NO: 3820 - DNA, 3873 bp, Glycine max
  Peptide Sequence Number=SeqID_120598
atggcggatggcacacgttcgaaggcatcatcagagtgtttgggagatgcaattgccaagctcactgcttcgcaacttgctatgaattcaaagattgatgatcttctccagcgaatgtctcagcttgaggcgaatcaaccgcaactgcagtctccgccatcgtcgtctgccagacacacgccgcagactcaaacctcttttcaccgtatgaagcttgatgtctcgaggtttgatggatctgatccaaccagctggaccttcaagattacgcaattctttgagtttcactctacgccggatcacgagaggttaaccattgcctccttctacatggagggaccagcactcgcgtggatagtaggattaccggctccattcgtcttgagttgcttcatctcaggattgaatcaaccgattcgcagagaagtacaagtcttacaaccgatatccttagctcaggcagtatcctatgcacgattacaagaagaaaaacttctcgatgctcaccggccatcgccatatcggccattagtctccacaggaccttctagcacacgctcatcatcaagcaactctacacaacccttactaccaacaccggtacgaacttcctcctcaattccttttaaacgttttacaccagaagaattggcctcgcgcagggaaaaaggactatgctttcactgcgccgagaaattctctcgtggccacaaatgtgcatcttcattgtttcttttagttatggatgatgaggataccacgatcgaaggggagtcatcaagatactatacaccaactcaagagttgctaccagaattcccgctggcacagctaagcttacatgcattatctggccacttagcaccagagacgttacgccttaaaggctacattaatgaccggcctatcaacatcttgatagatggaggcagcactcataatttcctccataatcgagtggtactgagcttaagattaaaaaccactgaaacagcaccgcttagggtcacgatggggaatggcgaagagcttcactgtaatcagttgtttacagcgattcagattaacatacaacaacactccttcaccattgacttccatgtattgccattatgtggagtggatgtggttctgggggtccaatggttgaagactctcggaccagtcttaacaaactacggtgctctaacaatgaagttcatcactgggaaaaaggagatcgaagaacaggtagctattatgctagagagagggttcatacaacctaactcgagtccgttttcatccccagttttgctggtaagaaagaaagatggatcatggaggttttgtatcgattatagggcccttaatgccaaaacggtccgcgatcgttttcccataccaacagtggatgagttactcgatgagctgggcggagcaaggtggttctctaagcttgatctcatgcaaggatatcatcaaatattgatgaacacggcgaacatctgcaaaactgcatttcgaacacatcaagtcgtaatgccctttggattgtgcaatacaccttctagttttcaggccacaatgaatcagctatttcaaccatacctcaggaagtatatcatcgtcttctttgacgatatcttgatatacagcaggaccatgcatgaccatcttcttcacttggagatagcttttcaggttcttgtagaagggaagttttctcttaagctttccaagtgcaccggggtcactccggtggcggagaaggtacaagctgtctcacggtggccaacacctcgcacaccgcgggcattgagaggctttctaggcctcaccggattttacagacgatttataaaaggctacgcagctttagcttctcccctcaccaaaattttgtgccacagtcaatttgcatggagtcacgaggccgagatagcatttcaaaacctcaagaaggctctcacagaggcacccgttctcgcgttgcctgacttcactacgccatttgtggtggaaacggacgcttcagggtctggtatgggggcggtgttaacccagaagggccaccctctagcttattatagcaaacaattatgccctaagctgattaatgcttctacttacgttcgggaattggcagcaatcacgacggccatgatccaaacgccgaagcagcatcgttacttggccagactattggggtttgattactccattcagtatcgcgcagggaaaaccaatgtggtcgcagatgcattatccagatcacaagaagaccacgctgcttcactcttcttcctttcgatgccacgcttcgtcttcctcgatgatctccgcaaggagctagcctctctcgagacgtttcaagacttgcgcagacgaatccaggaaaacccagcttcatatccagattatgcattaactgagggactcatcatgtacaagaagcgaatatggcttccctctaactcctcttccatcaaacaattgcttgaggagtttcatcaatctcctacaggtggccacatggggatccaaaagactctccaaagacttcatgataattttacttgggcctcgatcaaggaagacactcgcaagttcgtcacagcctgtgcaacgtgccaacacactaagtatgataaccgtaaaccagccgggctcctttgccctctttcggtgccgacactaccatgggaagatctatccatggattttattacgggactaccctcgtatcgcggcaacacatgcatcttcgtcatggtggatcgcttctcaaaaggtttgcacttaggtatattgctcacccaacatacgacgcacacagtggccctgttattcatcgaaatggtggggcgcctccatggcatgcctaaaagcatcatatcgaatagagattcgttgtttattagtaaattctggcgcgagatcttcacactgagtggtacaaagttgcgcttaagctcatcatatcatccgccgtccgatggacaaacggaggtcgcaaaccgcattattgagcaatatttgagagctttcgtgcatgaaaaaccagcaacgtggggaagatacctaccttcggccaaatggtcctataatacgtcctctcattccaccacgggtatgacgccttttgaaattacctttggccggaaaccacccacttaccctcattatatcaccggtacttctcccgtcgaagctgtggatgccatccttagtcagagggaagaagtttttgcaatgttgcgccgcaagctactcaaagctcagtcacgaatgaaaacaaatgcagatcgccaccgccgtgatcaggaattccaagtgggtgattgggtcctcgtcaagctcaggccacaacgacaagtttcggtcacaggcaccacctgttcgaaactgagtaagcgctattatgggccctttcaaatagttgaacgtatgggtacagtagcctaccggttacaacttccagaacactcacgcattcatccggtttttcatgtctcactcctcaagtcttacaccgcgaaccccaccacgacaacaacagtcatggaccttccccctttagcatctaataatcacccagttattacacccttagccattgtagcttctaaagtcattccgtcggagacaggacctaggcatatggtcctcgttcagtggcaagggttaccacccgaagagacttcatgggaagactgggcgagcttgaagcgcactcaccaccttgaggacaaggtgctgctagatgggcaggggagtgttacgggagaagtaagggaaggggtgtcactagcaagggagccatgcagaatggaggaacacgtgaagcttctcgaaggaatcgcgagcacgatcaaggcgtggatggcatag

SEQ ID NO: 3821 - DNA, 470 bp, Glycine max
  Peptide Sequence Number=SeqID_120599
tcgcactaagtatgaaagttctttgtagtgaatcatttccttgcccatcgggtggtgttggcatctcaaatcctggttcttggggcatgaatattgagaaagggcagaagtaccaaatagtcttctatgctaaagcagatggtgcaattaatctagacgtttcatttgttggatcggagaaagagcttatggacataatgttacaaattggacaaggatggagactatatatggtagaagccaatgctacaaatcataatgcaagtcttcaaataacaacaagcaagggtggagttgtgtgtgtgttggagatgtgttgcataatcaacactgacagtcgtgggaacatggaagaattagtaggagtgtgttttattgttggatggtctttttcccatagggttttggctcttggaggttttaatgaggccccccgtttttctcccgagtacaccttgtacttcggatga

SEQ ID NO: 3822 - DNA, 414 bp, Glycine max
  Peptide Sequence Number=SeqID_120600
atgcatttaggtggaaagacactgttggaccctgggaagagagaccaggacactttggagatatatgaaattattggaccgatgacggatttggtttctttgagggccttcaatttgctagaggttcgcccgaatcaagatgggggagctcttagggcttccatggggcatcctaagccatttgacttgagaattgttacaattggaaatgaagattgtggcaagtttaactacaaagatattcagattatctcaaattgtgatggttccgaaaaatcgttagatcacccgactgatctctatgattttcatatttatacaaaagccatggacatgttttccaagtctactaagtttgataatgtatcacgatatggtccaaaggggtttgttagtgagtacgctgtttggtag

SEQ ID NO: 3823 - DNA, 282 bp, Glycine max
  Peptide Sequence Number=SeqID_120601
ggaggggcagagatcggagagggagcgagaatcggtgtcggagaggaaggagcgggtccagtgagggaggcgttcggcggggaagacgtatttgataagggagaggcggtcgacggcggcgatggcggcggcgaggtcgccggagtggcggtggtggatccaggcattggaggggagtcgatggaggcgcacgcggatgcgatttgggagggggtggtggcggattggatggcggaggataggtcctgggatttggagagggaatcgaaggaggaggaatga

SEQ ID NO: 3824 - DNA, 117 bp, Glycine max
  Peptide Sequence Number=SeqID_120602
atgacaactaagaggaacaaaaccttgctagtgtcattagatctggacgatagtggtggtgtcggagatgcaaaaattaggagcgagatttcttggaagcgtgggttggggaggtga

SEQ ID NO: 3825 - DNA, 186 bp, Glycine max
  Peptide Sequence Number=SeqID_120603
atgtccattgaatttaatgatgaaatatgtgcaatttcagctcatcagtgggctaagcacacatccaccgctaagtgcagcttcaacgcacttagcgcgatagaagaacctggcaaagcatcaataccaaggcctcgcgctaagcgcgagatcagtgcgctgagcacaacagttgtcttcaactag

SEQ ID NO: 3826 - DNA, 655 bp, Glycine max
  Peptide Sequence Number=SeqID_120604
atggcttcccgcaaaagaaaggcactagcctcagcatctcaggcccgctatgatagatcaagattcacatcccaagaggcctgggatcgctattctgacattgtgattggtaggaagattcttcctgagaggaatgtaatgatatatcatacagaatttgatgaattcaagactgagttggaaagaaggaattggcacaaggagctgaccaattttctagataggagcatcgatgttgctatagtgaaggatttttatgctaatttgtatgaccctgaggataaatctcctaagcaagtaagggttaggggtcacttgataaagtttgataagaatgccctcaacactttccccaagacgcctatgattattgaggaaagggagagcctatctgcctactctaggttttgtagactgaggccagatccacaggaactggcaacccgattattcatccctgggaggggatttgagctaaatacaaatgggctgcctttgaagattttacagaagaatttgaccatactagctcagacctggagcattttgtcattctctaacttggcccctacttcgcacatttctgatattacattggatagggccaggctgatatatggcataattcaaaagatggatataaatgttggatcaa

SEQ ID NO: 3827 - DNA, 267 bp, Glycine max
  Peptide Sequence Number=SeqID_120605
atggagaattggcgaacagcgctacgcaataacttcgcggggctccagactcgaagtggagaacggagaattggcggacagcgctacgcaataacttcgcgcggctatagactcgaaggtggaggacacatgaagagcgctaggaaattacattcatgggtctccgaaaaaagtagagaatggagaattggcgaacagcgctacgcaataacttcgcggggctccagactcgaaggtgggggatgcatgaacagcgctaggcaatga

SEQ ID NO: 3828 - DNA, 309 bp, Glycine max
  Peptide Sequence Number=SeqID_120606
atgaatcgacaggcggaacaggaatggtctgggtgtatccaaactgccgcacgaccctctctggtcggtaatacacagcaacaggcccccagtgcaggagatcggaatatcatgaaatcaaatgaaagtcccggaccgctcaaaggtcaatcaaagaatgagttcaagatagaatcaagaacacttcaagattcaagaggaaagttgatttcaagaatcaagattcaagagatcaagattcaagactcaagaatcaagagaaggcttaatcaagataagtatgaaaaggttttttcaaaaactgagtag

SEQ ID NO: 3829 - DNA, 405 bp, Glycine max
  Peptide Sequence Number=SeqID_120607
atggctccgaaaaagctttccgcgaagaggtctaggagagacgccgcggttgaagggaccagtgccgcccccgagtttgatagccaccgtttctggagcgccgagcaccagcagcactttgaagccatcaaaggatggtcgttctacagagagaggcgcgtccaactcagggaggatgagtacactgattttgaagaggagatagctcgccgacattggacgtcgctggtgactcccatggctaagtttgaccctgaggtagtcttggagttttatgctaatgcttggcccacagaggatggagtgcgagacatgcattcatgggtgagggatcagtggattccctttgacgcagatgccctcagccagttcctgggtgacccgttagtgttggaggaaggctag

SEQ ID NO: 3830 - DNA, 432 bp, Glycine max
  Peptide Sequence Number=SeqID_120608
atggcgctgagtaaatcaacggtgctgatctcctctgtgctgccacctgcctcggtgatgctgttgaccggcattacagtgagtcaggcgagcatgcatccggcgctggcgtggctggccgtggtgatgggggcaacggtgggttcagtgctgaacttccatatcggccagctgatggggcacacgcgatggataacccgcctcaccgcaaaacacgccggtaaatttttgcgggtgcaacatcagctgcagaaaaacggcgtgctggtactgttcagcgcgcgcttcctggcggtactgcgctatatcgtaccgctggcggcaggcatgctcaggcttaacgtggtcaaggtttacgcggtgagcctgctctctgccgccgtctgggcggcgctgtatgtcggcattgtcaccggcatcagcgccttctga

SEQ ID NO: 3831 - DNA, 964 bp, Glycine max
  Peptide Sequence Number=SeqID_120609
ggtagaccgtacgcgtcaccagcccgcgctgctcgaacaggcgaagctgcttcgtcagctctttttgcgtaatcggggcagccgcccgcagcagatcgccaaagcgaacgggcgtattgaacacaatcaggcgatagagaatggggatcgcccatttaccggaaatcaggttgacaaactgcgtcatcgggcagagacatttcaggagaagaatatgggtcgtttaaccgataagtacacgctgattaccggcggcaccagcggcatcggtcttgctaccgcgcaggcgtttatcgccgaaggcgcacacgtcgccgtcaccggacgcaatcccgacacgctcgccgaagcagagcgcattctgggcgaaaacgcctgggtgatcccgaccgatgcgggagatattgcttcgcaaaaagcgctggcggagacccttgccgcccgctggccacgcctggacgcggtctttctcaacgccggtgatgtgacgcacgcgccgctggaagcgtggcaggaagaagcctgggatcgtctgatgggcatcaacctgaagggaccgttctttttaattcaggcactgctgccgctgctgaataatccctcctccgtgatcctgtgcggctccgtaagcgcgcgcatcggcctgcccaccagcagcgtgtatgccgcgagcaaggctgccctgctgtcgctggcgcgcacgttgtcggcggaactgctgccgcgcgggatccgcgtcaacggcctgagccccggtccggtggagaccccggcctttaacaaaacgggcttaagcgaagaagcgcttaacgcgatgatggcggagatcatcaagctggtgccgctgggcagaatgggctccacgacggagctggcaaaagccgcgctctatctggcctccgacgagtccagctatacggtaggcacggagctgctggtcgacggcgggatgggaagtttgtaa

SEQ ID NO: 3832 - DNA, 108 bp, Glycine max
  Peptide Sequence Number=SeqID_120610
atggagcttgcatcaagttatgaccagttgaatttctcgagtgctttcgttgttgaatttgaagcgactcgctatattattagcctaaatcggacatctgagtcaaaa

SEQ ID NO: 3833 - DNA, 309 bp, Glycine max
  Peptide Sequence Number=SeqID_120611
atgtcttccaaaaaaagaaagagcattagtgcaaggcccacagctcaatatgacacaagaaggttccactacttcgaggcctggaccagatatacggataatgtgctaggaagatatatactagctaagaggaaggtacaaatataccatatggaattggatgagttcaaggctgaattggagaggcataacttccataagcgcctcaccaattttgccgacagcagcatcgacttagccttggtgaaggagttctatgccaacctctatagcccccaagggccttcatcgaaacaagtcagaatatga

SEQ ID NO: 3834 - DNA, 373 bp, Glycine max
  Peptide Sequence Number=SeqID_120612
atggcagaaccatcaaagaagcgaaagggttcttcgagtcggagtcaacgacattccgagactcaggaaacgccgattccttcctctattccctctgcctcattgttttcatccgaagaacagcggatacgtaaaggtgtaccatttgaaggtacactgattgatgattggaagtttgacttctctgtgcatgttgcccgccggttggtttgcaccaaccaagcggatatgatcggaaggcttcttgtcggttcattggcttttgagagccgcatccttcattatctcatagttcgtatcttgcttccaagatcttcaaaccttgcacaagtttctgaagaggatcttattgttatgttggcttttcataaag

SEQ ID NO: 3835 - DNA, 584 bp, Glycine max
  Peptide Sequence Number=SeqID_120613
atggctgatgccaagtttgcggggcttgcttggtttagccattgcttaagtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacctcgtctgctcgatgggaattgcgcttcaaggcgtctcgtagggctaatccgcctcacgagggtcaccaacggcac

SEQ ID NO: 3836 - DNA, 579 bp, Glycine max
  Peptide Sequence Number=SeqID_120614
atgccaatctccccctgcaaaagtatcagttggtctgtgtcgtcccgacatggggatcgcacccacaaagacacccagtggacccggaaaagtccaacagggccctggggtttccagctctggttacaggcctctatcagtcctacagggtgcccgtacccccccggcaagggatcgcacctgcaagacacccagtggacccgaagaagtccaacagggtcttggagttgtcaagctctaattacgggtctctgtcagttctacagagtacctgtaacctccagcaagggcatcaggccccctactaatcgagctttcatcaagaagtactgcgccccccaggcaggcgcagggcgaaacaccacagcagcattgggatggccggtagcgggcaatagatacaccgccaccacctctagagttcacctcagctcatccgtaaaaaggttagaacgttgcctacgacacatggccgaccagcaggcgaccaagtccaaagccaaaggtaagcaaagtactaggtccgtgacctacaagccatcatgcgtccagctaaagacgttaaagaagcgctactag

SEQ ID NO: 3837 - DNA, 153 bp, Glycine max
  Peptide Sequence Number=SeqID_120615
atggtgaggcttcagcgtgacagagaagctggcacaataccaatatcaaggccacacgctaagcgcgagatcagtgtgctaagcgcaggggttgtcattagccaggctcaatgcatgactagcgctatgctcaaatccacttactcgcgctaa

SEQ ID NO: 3838 - DNA, 420 bp, Glycine max
  Peptide Sequence Number=SeqID_120616
atggcaccaaatcagttggtacgacccaaggacacaaaaggaaaggcaaaggtggacacagaagaaagcgacaaggctagcccagttcttgataaggagatcccggccgagagatttgctaagggagaggaagacttcagtagaaagaagttatccaccatagaagcaaatgagttcctttggattattcaacaaagcgagttcaaagtaatcaaacagctcaacaaaaccccggctagggtctccctgttggaattgctcataaacttggagcctcatcggacattgttggtaaaaatcttgaatggagcccatgtagccctagatatctctgtggagggcttcggaggcttcatcaacaatattacctccaacaattacctcaccttcaccgatgaagagatacccatcaagggctga

SEQ ID NO: 3839 - DNA, 154 bp, Glycine max
  Peptide Sequence Number=SeqID_120617
atgtcggccttcatctattcctgtacttcctctagttcacccatcgtcctagatttggatctggagacagcggatctcctcgggggcggagtaggtgtctgccatagctttggcctttgccagcattcagggaagctcttgactcccgttcaaa

SEQ ID NO: 3840 - DNA, 717 bp, Glycine max
  Peptide Sequence Number=SeqID_120618
atggccggacgtggatttctaaaagatgttcctccaatccttgatgaaaaaattaaaatgctaagaaatgggaggtggcaaatgatggcagaacctatcaattttgacagaccaacttcaggaatcagcctggctacaacatttgcttcatcatggcggttattccataatcaggaagatgatatcggattgattccttgtgctgatggcggaacaagcctggatgactggtcagtggagggagcattatttcaaaatgctattttccaagctaaagcggcacaaaaaatcagcacattaagtggcattctttggcatcagggggaaagtgacagtcatggacaaaaatacagatcatataccgaaaaattaagctacatcataaatactttgagagaagagcttaatactccggaaattccattgatcgttggaggattagggagctttttaacggaaggtatgtatggacaatactttagtgaatacagtaaaattaatgaggctttagttcagtatgcgaaagataacgagcatgcctattttgtatctgcagaaggtttaacaggaatattgtctgatgaagagcagataatgaacaagattcacaatcgtccattaacaaaaaatgaaaaatacgaattgcttcaatatgattttgcgatgggattggtgagtgcggatgaatttcaggtacaatttgcccagcttaagtaa

SEQ ID NO: 3841 - DNA, 249 bp, Glycine max
  Peptide Sequence Number=SeqID_120619
atgaacgtgtcgcaacctacccttcggcgggagggcgacgcaagggctcacgggtgcgtcttccatgggaggaagatgcacggagtcgccaccaacatttattcgagaaaaacatcggaaaaaccgaaaaggtgtggtctacaaactttaagtgtgaaaggttcaggagttgtatttacgcatagggaagggtgtttcccttgctcctacatattcctcaattgtgataaggaaatcagacctatgtag

SEQ ID NO: 3842 - DNA, 357 bp, Glycine max
  Peptide Sequence Number=SeqID_120620
atgtacaggggaaatgacctaaaagggaaaaagcctgacactaaatcaatttccaattgcaccatctttcagaaggcaggaatagattttaaaagggatcaattgaaggttcaagtgacctcaaagctcaccctaaggctaatgggtgaacgactgatcactgaaaatagatggcatcgtttcaatctagaattgcctcttcttttttattatgacactgacagtgtgactgccaagtttaagggtgctaagctatcaattaaatttggagaactttcacagactaagcttggtgacttgaatcacttcatcttcgcaaccatgagtggtgttacatgctttgattgttcatactag

SEQ ID NO: 3843 - DNA, 537 bp, Glycine max
  Peptide Sequence Number=SeqID_120621
atgctttctgaaacgttaagaaagctagtagatggacctaaaagaaatgttataacttggcaaggatacaacataaacaagtattccttttatacaaaagcacaagatgagaaaagtacaatgcaaaacagtggggtcaccctaagggttgaatctcaacacttcgccagtgtacatgatgacaatccctgtgtagcttccatcccttactttggcaacaccagcgtgcggaccaatgatgtaggatttacgtttgtaaatctaaagaaagtagcttaccagaatgaccctttcatcatggtagaacaatttaaacaagtattttatgttcaagacccttgtgatgaaaggtggtcagtggttctacacgggaaaacaattggtgttaatgtagaagatgatgattcatacattaatacttatgttagtcctttgtccacacaaatgtcgcctaacatcgtcggagaagaagaacttgatgacgttcttgctaatcgtaatggtcatgatgaaggagaattaattaacatcgtctaa

SEQ ID NO: 3844 - DNA, 378 bp, Glycine max
  Peptide Sequence Number=SeqID_120622
atggattttgaaatctgccaaatcgtgcagcaaaaagctatcaaatttgtgcagcagaattttccaaatgtgcagaaaaatgtttgtgcattgctggttatgggaaaggtagtacatattgggttctggacatttctagctaatcccaacgagttttctgcctctgcccttttttcttggtttagggtagttcatgatgtttggatattgtggaagcttagaggggttgatggggacccgatgccgagaggaatgagaataagggctacatgggggtacgtgagcttagttgaaggtgggcaactggggatggtgggttcatgtttgatttgtggatgtgggagagttgatttgcaccatcgcccgatctccacctag

SEQ ID NO: 3845 - DNA, 244 bp, Glycine max
  Peptide Sequence Number=SeqID_120623
gggggcagctgtttcttcagctggtgtatcaagaggggcagtagcttcatcattggagttcgtggctcagctggcattggttcgacccgtgctgggactaaagtttgcgggtgttggacatctggctctatggcgactgactgaggagctaggatggatgatgatgaagggatgtcgtcggttcaagacctctttctcgatgacatctgcaaataacggaaccaaacagctaaataggatataa

SEQ ID NO: 3846 - DNA, 522 bp, Glycine max
  Peptide Sequence Number=SeqID_120624
atgcctcatcgagttatattttatttggaaggacctactcctggagttgacctgcttatacgatcagtagagatcaattgttccactccaaataatagtgtaagtcaaagaggctgcaagtcgcatgattccatgaatgatgggaaaattgttccaaagtctgggaaattctttgcatctgcaacagaacgcacacaaagcaggaaaggaattcagcaagagatcattggacgtgtgcagtgcaaactggcctatgaggtcactacattagttagaatatttggaaacaatgtatctactgctgatcatgcaactaaaacacctccttcaaccccactagatgtaaagattcgtaaacgtggtgttatcctgaaattctctggactggactctggtagctatgctaataccttggtgatagtgaagattccttttggaaatgacatgatgaaggtgttcacattggtatgggtactcgctacaaggaaatggctattattaacaagaagcagggtgttctag

SEQ ID NO: 3847 - DNA, 1803 bp, Glycine max
  Peptide Sequence Number=SeqID_120625
atgtgggatctttggaaagaagttggcggtgaaacggatggtggtatggtgtgcagtggtggctcaatgaaaattcaagtagcagttcatggttacagtgatatcaagaccgaggcagcaatagagccttgcacaacgaggcttccttttgttctctgtaatggaagttacatggagacaccatacagcattactgtttctgtttctaaatgtttccttcatgtattttggctcattaaactgtgtggaatgttctgtagggaaccttttgtaacagggatgtccggtggacgagaacgagttcgggagtctgactttgaatattatgaacgtgaatattataaagacttgaagagtgattactataagctcaaaatctccaagtcatcgtataagtgtcccttttgccaggacaagcgggaatactcattgaatgagcttttgaagcatgcagtaagatttgaaagggactcacggagcatgaagacaaaggatttagctaagcactctgctcttcaattgtacattaaaaagtatcttgatgaaaatgataggccaggaagtgttgtccatgataaagcaggaagcgttgtccttgatagaccaggaaaagtggtccatgatagatccggaaaagtggtcattgatggatctggaaacgtttacaatgatagatttgggaaagttgtgaatgatagaccaggaaatgttgtcattgtcaatgatagatcagaaaaagttggcaaagatcaactatttgtctggccttggatgggcattgttgcaaacattgccactgaatttaaagacggaaggcgtactggagatagtggttccaaactaagggatgagtttactttgaaaggatttcatcctttgaaagttcaaccattatggaaccgttatggacattcaggctttgccattgtagaattctccaaagactgggagggtttcaccaatgcaatgaactttggaagaagttttgaggcagaacattgtggtaagagggattacaacaaattaagagaccgaggggatagactgtatggatgggtagctcgtgatgatgactaccactccaagagtataattggtgatcagcttcggaagacgggggatttgcaatctgtttctggaaaacaagcagaggaaaaaaggaaaacatcgctgcttgtcttagatttagctaaaaccttgaaagtgagaaatgagacattggagcaggtttgcagcaaatatgatgatattagtgtgtccctgaacagagttatggatgagaaagaagcgatgattgaatcatataataatggtacgctgaagggtcgtgaaaaggccagattggaactgcatgctcagaggaaagaactagagggccgtgagaaggatctacagagaagtcaagtgaagaatgagaatgagaggagaaaactgtaccttgaaaggaaaaataatgagatggcaataatggagcagaacaaagccgatgagagagaagaaaaggagaaaatgcacaaaaaaattcttgaactacaaaatgaacttgatgccaaacaaaaattggaattagggattcaacaattgaaaggaaatcttcaagtaaggaaacaaataggagaggatgacgaggaggagaaaaataaattggatgcaattaaaacagaactagaagataaggaggaggaattagaaggactggaagcacttcaacaagctcttgttgtcaaggagcgtaaaaccaatgacgagttgcaagatgctcgcaaggagttaatacgtgtatgtgtctattcccaagcataa

SEQ ID NO: 3848 - DNA, 177 bp, Glycine max
  Peptide Sequence Number=SeqID_120626
atgtcaacaacaggcaacgcaggaaccgtaaaaggaatgcttaggacaatcgtttatatacatcgtgacgatgaagacgacgatgttggccaccacgaaggtggggaccagccatgggaaccagcgcttgaagaggctgaagtcacgatcgcgcacggcgggggggctcggcggtga

SEQ ID NO: 3849 - DNA, 231 bp, Glycine max
  Peptide Sequence Number=SeqID_120627
atggaagttttagatgaagaagatgaaaaactgagaactttaaaggatgagtttggtgacgatgtctttcaagctgtggttacagctctgaaggagttgaatgagttcaaccctagtggtagatacccattacgggagttatggcattctaaagaaggaaggaaagcttccttaaaggagggttgttcttatataatcaagcaatggaaaacgttaaagcgaaagaagtag

SEQ ID NO: 3850 - DNA, 654 bp, Glycine max
  Peptide Sequence Number=SeqID_120628
atgggtgctcttgaagtgggtaaagtgattcatagacaccaggtttggcgccttttctcttgtatatggttgcacggtggggttgttcatctgcttgccaacatgttgagtcttgttttcattggaattcgcctagagcaagaatttggatttgttcgaattggatttctgtatgtgatatccggttttggaggcagtttgctgtctgctctattcatacaagagggaatctcggttggtgcttctggtgcattatttggcttactgggaggcatgttatcggagctcttgataaattggacaatatatgccaataagtttgcagcgttactgactcttatagtcatcgttgtaatcaatttagctgttggaattcttccacatgtggacaattttgctcatattggaggatttgtctctggctttcttcttgggtttatctttctgattcgcccccagttcaaatgggttagtagtagacacaggaattctcactcttcagctgctgcaccttcggtgaaatataagcacaaaccttatcagtatgcattgtgggtcatatccttcatactactgattgccggggatctaattgcattgttttctacaatagggtatttacacaagattgggactttgatgcttgtttcctaa

SEQ ID NO: 3851 - DNA, 600 bp, Glycine max
  Peptide Sequence Number=SeqID_120629
atgtggtccaccttgacgctttccgggacctcgctcatagtggtggttacgcttggggagttgccgcgctggaccaccacccgacagcttgcggggtacttgacactacttcagtgctggatctatgagcacttccctagtgtgcaccagtgcgtgactgacgatacataccaggagacgtccccacgtgcttccccgtggttgacgtcgaaggcgcacatgaagggcatcacaggagcaccctacagggcacgttgtgatggtttgaccgtcacagatgtatcctggttgctgtacacggagcatcggggggttagggcgtttcaggagatttcatcgttccaaggtcagctcagatggggtcctatgatcgtcacagttcgactggagagggtggtacgccagttcggttacatccagagcatccctccgccacctgttagtgcacgattgtcacacgatcagataaatgactggtggatggagtttgcggatcacttactacctgcgggtcagctttgtctagtgcctggcaggatgattacaacggatataaggcgattgcatagaggttggagcgtgtgctcaaccttaggatag

SEQ ID NO: 3852 - DNA, 1419 bp, Glycine max
  Peptide Sequence Number=SeqID_120630
atgaagaaagcttatggaaattttatcccaagctttttggtccttggacatcattctatgacacctccatccattttggtttcatcagtaagaaatgtagtgattctgtggaatgcaagcttacacatgttctcctttgattccagattgctgggatatgaaggggtagaagtcataaatccggacggtggtaaagaggatgcagaggaggaagctcaaagaggaagatggaaaccagaggaaagagatggttactggaagatgatgcacaaatatattggctcagatgtaacatcaatggtaacactaccagttattatttttgaaccaatgactatgcttcagaaaatggcagagttgatggagtactcctacctgttagatcaggcagatgaatgtgaggacccatacatgcggctggtgtatgcatcatcatgggctatatctgtgtacttcgcataccaacgaacctggaagccttttaaccctatccttggagagacttatgagatggctaaccatggtggaattacatttcttgcagaacaggtgagtcaccatcccccaatgagtgctgggcatgctgagaatgagcattttacatatgatgtgacttcaaagttaaagactaagtttttgggaaattctgttgatgtttaccctgttggaagaacacgggtaaccctcaagagggatggtgtagtcatagatttggttccccctccaaccaaggttaataatttgatatttggccgaacatggattgattcacctggggagatgataatgacaaacttgacaactggagacaaagttgtactatactttcaaccatgtggatggtttggggctggtcgctatgaagtagatggatatgtttataattctgctgaggagcctaaaatattgatgactgggaagtggaatgagtcaatgagttatcaaccttgcgattcggaaggagagcctcttccaggcactgaattgaaagaggtttggcatgttgctgatgttccaaagaatgataaattccagtatacatactttgcacataaaataaacagctttgacactgcccctaaaaaattgttggcatcagactctcgtttacgtccagatagatatgcacttgagatgggtgatctatccaaatcaggggcagaaaagagcagtttggaggacaagcaacgcactgaaaagaaaatccgagaagccaaagagcataaatttacaccgagatggtttgatttaactgaagaagtgacatcaactccttggggtgatttggagatctatcaatacaatggtaaatacaccgagcatcgggctgctatagataactcaggcagcattgatcatgttgataataaagaaattgaattcaatccatggcagtatggcaatttgtccaccgaatga

SEQ ID NO: 3853 - DNA, 579 bp, Glycine max
  Peptide Sequence Number=SeqID_120631
atgaggttaaaatgttcttctgcctcctttttcttttctcttggtctcttcacttgtatattgagtggtgtggatgtagggcaggaagatctgtctatggctattgcattagcaggcttatggtccctatttcttgctcttggctgttctgcgtgtgtttggcccatatattacactgttagcactgcttatcagaaagcattcgactcaggattatcatacgatagcccagcatcagttctagggcttcttttcgtggtgaatagcattatcttcatgacactgggtttggccattggctacccagttgcttcagcttcagttaaggtgcttcaaggtctgtggaggaatgatttagcagcactaaagggttcttgtccaaattgtggagaagaggtatttgcatttgtgagaacggacaaggctaacaactcttcccacagagcagattgtcatgtgtgtgaatgcttattggaatttcgcaccaaagttgagcaatcggctttaagattagggagacaatgggtttatgggcgtatttaccttgttcgcagatccagacgccaaggagacccgtaa

SEQ ID NO: 3854 - DNA, 750 bp, Glycine max
  Peptide Sequence Number=SeqID_120632
atggcatctgttagaagaaccttgtctcccgtgcctagagctggaactgtagcaaatggagaagtgtgttcagtagcttctcccttgtcgaagtcctcatcgagtcctcagaacttctcaccatcggttggattggactaccgtgcacttgtgtttggtgttttctccccaaggtctttcagggctttggagagatcaaagccacgggggcagctttggaggaagatgctttttcattttttcatttgcttcatggttggtgtttctattggactcatcccacttgcatcgacacacatgtccgcaaatctcatgccaaaacaacaagccttctcctttgaggtgatatctgcagtggcaaatttccagccatttgaaaatgtaaatttaaatgtgaccccatcaatcaacgaggctgtgaattttaatgctactttgtattcaactgtgaaagaacaggaactaatagatggagtggcatataatgtctccaacagccaaatcagtgaaaatccatatttggagtctcagaagcttctcataattgtaaccccaacacacaatcatatatttcaagcatattatttgcatcgcttgtcgcagacattaaaattggtcccacctcccttgttgtggattgttgttgagatgacttcccaatctgaagaaactgctgacatcttatggagtagtgggattatgtacaggcatctcatttgtaaaaccaaatctaaccaacccaagccatag

SEQ ID NO: 3855 - DNA, 1653 bp, Glycine max
  Peptide Sequence Number=SeqID_120633
atgaaagcgccaaatgctttgtttggtgcaaaacgtagaaagtttcacggggttttcaatgctttgtgtgctatggttgtgtttttcttcttttacaaccgggaagacatcatccacaacccgattctcaggcaatcctcgtattttccgaatcatgggttgcctcaaaatgcgatttttagagatgggtcttccgtgattcaccgtcgaatggttgaaatcagcgccaacacttcaggtgtagctggtgacaatggtttaggcgtaagtagttctggattatgcaatggcttggttcaacatgagggttatgctagcccctgtgaattcttaaaagttaatccacagtgttcgtctgatgggtatctcgattacttgaagtttttctattgtacatgtcagggttttagtgtgtttggttatttagtgttgggtgtgtggcttgctgcattgttttatctcttggggaacactgctgcagattacttttgcccttctcttgagcatctctcaaggctcttgaaattgcctccaactgtggctggggttgtgctgcttccacttgggaatggagcacctgatgtgtttgctagcatagctgcctttgtgggtgctgaaagtggtgatgtagggcttaacagtgtgttgggtggtgctctttttgttaccactattgttgctggaactgtttctctgtgtgttgcggataaggagattggaattgatcggagatgctttataagggatgtgagtttctttcttgtgactcttgtttcgctgcttttgattttgtttgttgggaaggtgggcgttggggtggccattggttttgtgttgatttatgttgtgtatgcattcattgttgctgccagtgagatattgaggaaacatgcatggaggttgaaattggatgctgtcacaccattgcttcctgttcggggaagtgtgttctccctaggtttggaagaggatacttcgatctatagctctttgcttgaagacaccgagagcgatcctccacgcctccctccatcattgccacagtggatgtggtcttcaaatgtggctatatattcaaaccatgcaagtaagatcaattttttggatgatgaaaggcctccatggggatggagtgatgggtccatggaaaacaccaagacttcgttcactgtatcaaaactttttctgatgatggagatcccactggcaattcctaggaggctaacaattccaatggttcatgaggaagtatggtcaaagccttatgctgtggctagtgcttcattagctcctattctcctagccattttgtgtagcacccaagataatgtgagtaatcagggtgttatactttcttattgtgttggtgtttctcttggatgcacatttggtattcttgcatataaatacacagtgtctgatcgtccaccacctcagtttttgcttccatgggttcttggaggattcatcatgagcatagtgtggttctacataatagcaaatgagcttgtggctctattggtagcgtttggtgttatttttggaatcaacccatccatcttggggtcctatgttcaacacacttattggcttggggatctcgttgctgcttggggcttggtcaaagaaaccctctttgtatgtggtgcctga

SEQ ID NO: 3856 - DNA, 1446 bp, Glycine max
  Peptide Sequence Number=SeqID_120634
atgatactgcactcagctctacagctcattcttgttatctggagtagtgaagcagagaggaagggttcacttctaggtctagaggttgatggttctggaagatcttatcatactgaattgatctctctgaaagatgaaaaggataagaataaagtggccaaagctaaagacggatactttttgaaaagccatatatacaccgttaagattccacagtttaggggaggctccgtcttctcaattaagatcagatggtcacagaaaatattatttcatgatggccagttatctctctgtgtccctttcagctttccctcatacgtcaaccctgctggaagaaatatttctaagaaagagaagatatttttgaaagttaattccggtgctacaacggaagtgttatgcaaaaccaccagccatccttttaaggaactactgcgccaagctggcaaattaaatttatcatatgaagcagaagtgctaacatggtcaagtacagacttaagtttttcgtactctgtttcttcaaatgacatatttggagctgttctcttgcaatctccattcctgcgtgattttgacgaaagagagatattttgcttgtatctttacccgggaaacagcccggatagaaaggtttttaaaaaggatgtggtgtttgtagtagatataagcgcaagtatgaagggaactcctcttgataacacaaagaattccctactgacatcactctctcaactaaatgcacaagatacatttaacattatagctttcaatggggcggtctacttattttcatcatcaatggaaagagctacagaggaagcaattttaaatgctaccacgtgggttgacaccaattttattgctaatggtgacactaatatcatgcttcccttaacacaggcaatgaagctacttgagaaatcaactgattcggttcctcttatttttctcgttaccgatggggctgttgaggatgagagagatatatgcaattttgtgaaaagctatgtctcaagtttatattgtaatcactacttcctgcaaatgctagcacaaattgggaggggccactatgattctgctcatgatttagattcaattgactttagaatgcaaagactattcagttcagcttcatcagttatggtagctgatataacaatcaaaagtttagaaggtcttgattcacttgagttattcccaactcatatacaagacatatcatttgaaagtcccttgatcttatcaggaagatacagtggaacttttcctgaattagttaaagtcactggtactttggcagatatgactaacttcgtagtagaccttaaagtgaaaagagaaaaggatatgcagctcagtaatgtcctttcaaagagacatatagatcaggtcactgctcaagcctggttgttaaaaagtaaagagctggaggagaag

SEQ ID NO: 3857 - DNA, 261 bp, Glycine max
  Peptide Sequence Number=SeqID_120635
atgattatcagtggaccagtgttagttatggtcttggagaaggataatgctattgctgattggcgtgctttaatgggccctactgatgcaagcaaggctaagattactcaccctcacagtgaactagttactatattgtgcagtatcagagcaaaatctggattggatgtggaaaagaattgtgttcatggttcagactctcccaagtctgcgcaaagagagataccatttttcttcaaagagctctctgcaggtcaataa

SEQ ID NO: 3858 - DNA, 846 bp, Glycine max
  Peptide Sequence Number=SeqID_120636
atgaaggcgaggggaagtatttggtcaaaaatggagacacgtattggaaaggaagtaatgttcctcagctggatgcaaaataaacttggtggaaaacaagacaacagaaaaccaaatacacatactactaatactactacatatcttgcaaaacaagagcctagagaagaattcagcgattggcctcatggtttactagcaattggaacatttggaaataagagtgaaatcaaagaagacttagacgaccaaaatacacaagaggatccatcttcatcagaggaaatagcagacttcactcctgaagaaattgggaatctacagaaggagttaactaaactcctgagacgaaaacccaatgtggaaaaggaaatttctgagctccctctggacagatttcttaactgcccttcaagcttggaggttgataggagaatcagtaatgcactatgcagtgaatcagaagataaggaagaagatattgagaagacactgagtgtgataattgataaatgcaaagacatttgtgcagataaaagaaagaaagcaattgggaagaaatccatttctttccttctgaagaagatatttgtttgtagaagtggatttgctccaacacctagcctaagagatacccttcaagagtcaagaatggagaagcttttgaggacaatgcttcacaagaaaatttacacccaaaactcttctcggtcaccgttggtgaagaagggcatagaggataagaagatgacaaggaagaggaatgaggatgaatcagatgagagaaatggtgatggctgtaaatgggtcaagactgattctgaatatattgttctagagatataa

SEQ ID NO: 3859 - DNA, 990 bp, Glycine max
  Peptide Sequence Number=SeqID_120637
atgatgaacaataatacttatggttctgaatcatcactagtggttctcctagtgtatgtttatgacataattcttgttggtcctagttctacatgtgttgctaaggttcagcagaaacttcaatccatgttcaaattgaaagtccttggttctctgaaatattttttgggtctggaaattgcaaaatccagcaaaggtatttctctgtgtcagaggaaatacgccttgtctttgctggatgacactggttacttaggctgcaagcctgcctctctcccaatggatcctaacttaacccttcttgatggtgaaccaattcctgatccttcactgtataggcatctcattggcaggctcatgtacctaaccatttcaagacctggcattacctttgttgttcacaagttgagtcagtatatgaaaaatcccatgactacatacttgaatgttgttcatcatttacttcaatatctcaaatctgcaccaggacaaggccttttctttcctactactaattctcttcacttgtcagcttatgctgatgctgataggggaggttgcttggacactagaaagtctacaacagtctcttggaaatttgttaaacaagggacagtttccaaatcttcagctgagtcagaatatagagctctatcttctgttgctagtgaaatcgagcggctaaaacgcttgctcactcattttggaatcctcattgactcagccatgttattctgtgataacaaatccactatacacttagcttccaacccatcactccacgaaaggtccaagcacatcgacattgactgccacttcatccaagagctagttcaatttcgtgttttcagcctcatccatgttaagactcaacatcagattgcacatgtcttcaccaaagcacttcctgcttcagttttatccgcaagttgggtctcattaacatttactctccaacttgagggaaatatcacgcatagctacttttag

SEQ ID NO: 3860 - DNA, 312 bp, Glycine max
  Peptide Sequence Number=SeqID_120638
atgtatgagaaacttcttgtattgctgagagatggtagaaagctcatgggaacacttcgctcttttgatcaatttgctaatgcagttcttgagggtgcttgtgagagggttattgttggtgatctatactgtgacatccctttaggtctttatgtgatccggggggaaaatgacttggagagggaggaacttcccgaacatatgacacgtgtttctaccgcagaaatcaagagggcacagaaagcagaaagggaagcttcagatctgaaagggactatgaggaaaagaatggaattccttgactttgactaa

SEQ ID NO: 3861 - DNA, 1217 bp, Glycine max
  Peptide Sequence Number=SeqID_120639
actccaaagttgtgttctttgttgtgaagtcaaaggaggagctgttagtggttgttgggggtggagcagcaggggtgtatggagccattcatgccaagactgtagcaccccatcttagtgtggtggttattgagaagggaaagcctctctccaaggtgaaagtttctggaggaggacggtgcaatgtgactaatggacattgtgttgacaatatgattttggcagaaaactatccgaggggtcacaaggaactgagaggatctttctttaatacgcatggcccagtggatacaatgtcttggtttgtctctcaaggggtggaactaaaggttgaggatgatggcagggtatttccagtcagcaatagttcttcttctataattgattgcctcatgtctgaagtgaaggaaaggggagctgtatctattttatctagtggcaaattccttcttgaggttcagcagcatacatctgttcatgctgagcatgtcgaagctgattatctattgattgctagtggtagtagccgtcagggttatactcttgcatctcagcttggtcattcagttgtagatccagtgccgagcttgtttactttcaaaatagaagatttgcgtttgcgagagttgtctgggacaggtttcagagaacttgtagcataccttgttgaacatgatcattttgctaatgtgctgtttactgcccttgtgaaggttacattccccaaagttaaagtgaggctaaaattggatagtgtccaaaggaatatacctcagcttactcaggttggtcccatgttagttacacattgggggcttagtgggccggttgttcttcgattatctgcttggggtgctcgttttctgttcagttcaggttacaaaggcaaactttttgtggattttatccctgatctgcacgtggaaagtttgaagtcagttctttctcatcacaagcttcaatatgcgggtttaagtggagatattctgtgggcttccatttcaaatagttcattgatgtccattggttctttattaaaggactgtgtatttgaagttacaggcaagggtcaatttaaggatgaatttgttactgctggtggtgtgcccttatcagagattatgcttaatacaatggaaagcaaaatttgctcacgcctgttctttgctggagagatactgaatgttgatggggtaactggtggtttcaatttccag

SEQ ID NO: 3862 - DNA, 276 bp, Glycine max
  Peptide Sequence Number=SeqID_120640
atggcaagtattgcaggcgtgtttcagactctgcaatatgttatggtaagacagtgcatctcaggttttggacaaccaaaccactctgttctctgtcttgggttttcctcactacttcctaccattcactacaaacatatgaaccttttcttcacccccagggcaaggaggtgcactacccttgccatttccccagccacaaagagcattacaaagtataaaagttacgacttgggtctagcggaaggggttagtacccgtaacatagtgaactaa

SEQ ID NO: 3863 - DNA, 267 bp, Glycine max
  Peptide Sequence Number=SeqID_120641
atgtccaacctcattagtgcccttcttaaggatggcctcattgtccccaacaacaactctttctcttctctggtcctttcagtgaagaagaaaaatgacacctggagagtttgtgttggttacaaaggccttaatgttgtaaccattaaggatagtttccctattcccgctattgacaagctgttggatgaactggatggatccgattatcatcaaatccatgtgcttgttaactcgttggcaagtgtaccaaatcgtcataagtag

SEQ ID NO: 3864 - DNA, 192 bp, Glycine max
  Peptide Sequence Number=SeqID_120642
atgggggtatcacaagccatggacgctcttcgaaaaagagcagtgtttgtgaaagagtcacttcacaagagtcagaccatcaccgataacatggtttctattctcggttcctttgatcatcccctctccgcactcgaaactgccatgcgtcccactcaggataactatgttaatatttcagacttaaactga

SEQ ID NO: 3865 - DNA, 378 bp, Glycine max
  Peptide Sequence Number=SeqID_120643
atgccaaacaagacaaataaagatcttgaggaggctattttggccttagtagttgaaatggaaaatttgcaagctcaccatgagaaccgccacgagcaactccaatccaccatggatgctaggaatgacgccctccatggagttttggcctccattatggacaaactagccatcatttcgtcagccccagcacaggtattctcccctgctatttttgccactacttctcccacattccacatggcttttgatggcactatccatatcaccacctcaccatttgggggtcatattctgtcctcttctaccttactacaccaacataatttctcccctcatcacaccccaaatttttctaccaatcccttcatccagtaa

SEQ ID NO: 3866 - DNA, 338 bp, Glycine max
  Peptide Sequence Number=SeqID_120644
atcaaattgctaacttaaacaagattcttgatgatcttgaaaatcttgaagtgaagatggaggatgaagacaaagctctaatgctactcaatggacttccaagcagctataagcattttaaggatgctatgttgtttggaagggatcaaaccattacctttgaagaagtgcagtcatcaattcgaaccaaggaaatgcaaaggatacatgaatccaatactaacaacaatgcaaaagaattgaatgtgatgagggggacactacaagaaggattgcccctgaaaggagaggcaaagattcaaagaaatctcaagaaccaaagatgtggacaaaaataa

SEQ ID NO: 3867 - DNA, 993 bp, Glycine max
  Peptide Sequence Number=SeqID_120645
atggagttctttcaaaaggctaaagtggtgcgcttgagaagccaccatgataaatacatgttggctgatggtgatcaagaaaatgtcttccaagaccgcaatgggtgctacatgaatgctaaatggattgtggatgttgtggagaattccaattttataaggctgaagagttgttatggaaaatacttaacagcctcaaacatgccattcatattgagaggcacaggaaaaaaagtgttgcaaacattgcctactaggttaaattcttcaattgaatgggaacctattagagagggggttcaggtgaggctaagaacacgctatggccaatatttacgtggtaatggagggttgccaccttggaggaacaccatcacccatgatgttccacacagaacagcaacagctaattggattttatgggatgtggatattgtggagcttcgtccacaaacacaagctcctaaaccaagaccaaggcctacacctattaccccacctaatcattctatgaatgcaaccccaacaaatctttcaccttgtccttctccttcatcatcaccattaatttcggagatggattccttggtcaagattgatctcaggtctcccacaacatctgagtccgaagatgaaatagaatgcttgtcaccattgaaagaaggaagaattatattttatgatgtgggtaatgataatggtgatattgatgatgcaaaaaaagagtcattctttacctttaaaggaagttgtgcgagtgagttaaaggataaattgaaagaggaaacaggacttgatgatattattgtatgttgccgcaatccgttgactacaaaactttatccacttcacttacaactacctcctaatagcattgacatgcatgtagttgtggttccttcttcattcaaacgtgagtttttctctacctatttgttttatgatgccatttgcttgtttaacaatccttcttttattaggaatgttctttga

SEQ ID NO: 3868 - DNA, 498 bp, Glycine max
  Peptide Sequence Number=SeqID_120646
gcttttgaaaacggaaacatgctaatttcagatgctcttccaattctagaagatttgaatattgactattgcaatgatatggtggaattgcctacggggctatgtgagatcacctccttgaagatgctcagtattactaattgccataagctttcagcattgccccaagaaattggaaatttggagaatttgaaacttataaggctaagttcctgtactgatttggaagggataccaaattctattggaaggctttcaaatttaaggcatatggacatctcaaactgcataagccttcctaatttgccagaggactttggtaatctttgtaatctaagaaatctgtacatgacaagttgtgcaaggtgtgaattgccaccctcaatcatcaatcttgagcatttaaaagaggtggtatgtgatgaagagacggctgcttcttgggatgctttcaaacctatgcttcccaatctaaagatagatattcctcaacttgat

SEQ ID NO: 3869 - DNA, 966 bp, Glycine max
  Peptide Sequence Number=SeqID_120647
atggcacaacaagtaaagcgtccttttggtgttcctgaagagccagaattcactgttgggttggatgcaccattgagggagttgaaaatggaacttcttaaagaaggtgtgtccatcattgtgctgactggtttaggtggatcgggaaaaaccactttggctacaaagctttgttgggatgaacaagtcataggttcattcaaggaaaatattttatttgtcaccttctcaaaaacacctaagctgaagattatcgtcgaaagactatttgaatattgtggatatcaggtgcctcagtttcaaagcgatgaagatgtggttaatcaatcgggacttttgctgaggaaaattgatgcaagtcctatgttgttggtcctggatgatgtctggcctggctcagaacccttagttgagaaatttaaggttcagatgccagattataaaattttggtgacttcaagagttgcatttcctagatttggctctccatacatcttaaaacctcttgttcatgaagatgcaatggcccttttttgtcaccacactctcttaggaaaaaacagctcaaatattcctgaagaagttgtccaaaagattgttagacattgcaagggcttaccgcttgccattaaagtgattggtagatcactaagtaatcaaccttacgagttgtggcaaaagatggtggagaaattgtcacaaggtcattccatacttgattctaacactaaattagttgcttccctcaaaaagatctcagatgtcttggaagataattccatcatcaaagagtgcttcatagacttagctttatttcctgaaaaccaaaaaattcctgttgctgctcttgtggatatgtgggtagagttgtatggactagataatgatggcatagtaatggccaatgtcaacaaattagcttccatgaatctggctaatgtcttagaaacaaggtacagtcgatga

SEQ ID NO: 3870 - DNA, 528 bp, Glycine max
  Peptide Sequence Number=SeqID_120648
atggcacacattgaaactcatcgtcttgaaggaattgtttactttgcagatgatgataacatctactcagtggaactctttcagcaaatgagagaaataaggcgatttggaacatggactgtagcaagattattaggggataaaagtagcattgtcttgcaagggcccatttgtaatggaagtcaagtaattggatggcatacagatgaatcaaatgggaaatctaaaagatttcatgctgaaatgccaggttttgccttcaatagtacaatactctgggatccgaagaggtggcaccgccccactcttgaacctatcagacaacttgattcggtcaaggaaagtttgtgggttagcacattgattgagcaggtggttgaagatgaaagtcaaatggagggcttaatggacaactgctcgagagttatggtctggcatattgatcttgaatcatcttattcgttctatcctcagaagtggattgtaaagaacaacctagatgccattgttcatcttccacttgtgtga

SEQ ID NO: 3871 - DNA, 1998 bp, Glycine max
  Peptide Sequence Number=SeqID_120649
atggatagaagagcagtctccagcatcaatactgatcaagagtgtcctttggacgacactgattcctcctccgctctctttagctacataaagcaaatgctcatggaagacgacacccaggagagttacagtattttccatgattccttggccctccaacacactgagagatcattttatcaagttatcactcacaactaccctccttcatcttcctccccccatcatcagagtcctgagcaaagtctctccgtttcctcaagtgattctagtagtagctgcagcactaacagtactagcagctccgccgactctcccttcagaagccttccccctctacttccacactctacttttcctattcctcataacttttttttccactcaaattcaacccaatcttcaatcaatactacacttggattcttcgacaatcccctcgctgaaatttctgattcagcatttctacaacaatttgagagaggtgtagaccaaggtacccgtttccttcctctacacactactccattcaatattaatgttgacccgaacaacacagccttttcctcttctttcacaaagacaaaaactccacctccgcagatgctaattaagacagaagcagaaggagagccttttctggcaggaaggaaacaaaggcagcgggaagagtatgaagcagatggaagaagcaggaagcaatcggcaccatacatggatgacagtgagctatccgaattgtttgataaagtactattaggcactggcttaggaaaaggggtacctcctgacacaacccatgaaacaatattaacgaacatgtttggtggagatgctagcaaaagtgatgaggaagttgtggatcttgggacactgttgatgctatgtgcacaggctgttgcttccggtagtagtccttcatttgctaagcagttagtgatgcagattaagcagcattcttctccaataggggatgagactcagaggctagcacattactttggaaatgcccttgaagcacgtttggatggaacgggttaccagttttatagtgttcttctatcctccaaaagaacttctgccaaagacatggtaaaagcttaccgtgtatatctttcaatatgcccatttgaaaagctagcagtcatttttgccaacaattcaatttgcaacttaagtgaggatgcaaaaacaattcacatcatagactttggcatccgctatggcttcaaatggcctgcacttatcagccgtctatcaagacgccctggtgggccacccaaacttcggatcacggggatagatgtgccacaacctggtttaagaccacaagagagggtgctcgaaacagggcgcagacttgcaaattattgcaagcgtttcaatcttccatttgagttccatgctattgcacagagatgggacaccatcagagttgaggacctcaagatagagacagacgaatttgtggctgtgaactgcttgtttcagtttgagcatctacttgacgagaccgtggtgttgaataatcccagggatgctgttctgaagttgattaagaaagctaatcctgacatatttgtgcatggcattgtcaatggatcatatgatgtaccgttctttgtttcacgtttccgtgaggctctctatcattactctgcattgtttaacatgcttgacaccaacgttggtcgtgaagaccccataaggttgatgtatgagaaggagttgtttggacgggagataatgaacatcatagcttgtgaaggttgtgagagggttgagaggcctcagacatacaagcaatggcagcttcggaacatgagaaatgggtttaggccgcttcctctggatcaacgaatcattgacaaattaaagggtaggttgagagatgatgcgtacaacaataatttcttgcttgaggtggatggcaactgggtgctacaaggttggaagggacgaattctatatgcttcctcttgttgggtaccggcatag

SEQ ID NO: 3872 - DNA, 891 bp, Glycine max
  Peptide Sequence Number=SeqID_120650
atggaagccaagctctgggaggctcgtcttttctctccaacactccctcttcttcctcctactcctcgtcttccttctctcaatcttcactttccctcatcatcaacttcaacgctccacctagctcgcaattctgtctcagataccgttcccattcaaaatgaggaaaaggaacaaactctgtcttctgtcaaacctacttactcccccactcttcccaatcgagacctacgaacccctcatagcgggtaccatttcgatgggactactcgcaaattcttcgagggttggtacttcaaagtctccattcccgaacggaggcagagcttttgcttcatgtattccgtcgagagtccctcctttcgtaagccactgacgccgctcgaactggcccaatacgggcccagatgggcctatcgggtcattgttattgaaccacccatagatgtccaatcctctaaacttcctgttaagagatgtgtccagttatcggtggggaatttaatgatagagtgctggaaggttttcaagtcacccccctttggcatcaaggttttattcgcgatgatggaaggtggggagacggtaaagacagctcgttgggagtatagtacacgtcctgtatatggttggggtgatgttggttctacgcagaagtctactgctgggtggcttgcagcttttcctgtttttgaaccacattggcaaatatgcatggctggtggactgtcaacaggttggatagagtgggatggcgagaggattgagtttgataatgctccatcttattcagaaaagaactggggtggaggattcccaagaaaatggttttggaataatcaattgtctatttacttaacaagcactagatgcaagaacagtagtccttaa

SEQ ID NO: 3873 - DNA, 201 bp, Glycine max
  Peptide Sequence Number=SeqID_120651
atggatccaaactttatcataagcggcaacgactttgatgaatcaaaacagtgggatctcaatggacactacaccaaccttctcaatgatcctctttccgatgttggcccacttggtttttctcacaattcaatcttaaactctgaaccctttgtttcatcctctgcttccgccgccgccgcctcctcctccacggcgacg

SEQ ID NO: 3874 - DNA, 759 bp, Glycine max
  Peptide Sequence Number=SeqID_120652
atggtggcaaaagcgagtctgctcaatgctgagcatcatgttaccggcatcctgctgtttaacggcacgcacttttttcaaatcctggaagggccggagcaaggcgttctggcaatctacgcccgcatatgtgccgaccggcgtcatcacaatgtggtcgagctgatgcgcgactactccccttcgcggcgtttcggtaatgctggcatggagctgttcgatttgcgtaatcaccacagcggcagtgtgctgcaggcggtgcttgatcgcggcacgtcgaaatatcagctgacctatgacgatcgcgggctacagttcctcagaacctttgtcgaagcgcgtgaaaaagagaactactttgaagtgccgccggctgattgctgggagttcatccccgcggaagggcaatctcccgcgccggccagtggcgtcactttccgcccagtggttgatcccctcggccgtgaagtgacggccattgaggcgattccgcacgcgcaacccgccggattaaaggaacatgagcgttacattcatgacctcaacgtggtgacagacgcactgcataaagccggccaggcatgtcccgatggcatgacgctgtatatcagtatcctgccgatgacgctggtttatcttcccgatgcggtaagtcagctggtcagcgccatcgcgcaggcggagctggtgccgcagcaaatcattcttggcgtgagcgaaacggaagtcatctcccggctggaagatttttccacggcg

SEQ ID NO: 3875 - DNA, 327 bp, Glycine max
  Peptide Sequence Number=SeqID_120653
atggctgggcaacagatgggacaccatcatgcatgcatgaacataattgggtggctagcaaacaattaccaaaggaagactctgttgcatcatgtgtttggtgacatcggctataaagatgtgtctcgtggttgtcagaaccgaccttggatgacgctggccaaaggtaggtccaatggcatccacctcgaaggtggtatttttgtcaccactaaaaaaccgcaggatgacactgtcgtcaattccgtgagttcttctaaactctttgaggccatccgtaaaaaagtatcggctattgatgtgccattattttctcctatttcttaa

SEQ ID NO: 3876 - DNA, 174 bp, Glycine max
  Peptide Sequence Number=SeqID_120654
atgaatgggaacaagaacaactatggcgagcgaatttcaattatcagagagattaagatgaagagaaactattatgagatattgggagttcatctcgataacaacaaagcccttggccccgaggaaatgttaagatggtgtcaaatgcgtatcggtgtcttagtgatgaagtga

SEQ ID NO: 3877 - DNA, 432 bp, Glycine max
  Peptide Sequence Number=SeqID_120655
tgctataagaaaatagatgtctatccagaaccatttgtgtgcccatgtggcaaacataatgatcgggctgtgcttagatatagagttgaagtcatggtcaattataaagatgaaaacacaaaatttctcctgtggaattgtgaatgcactgaattgattgggcagtcagctgatgaagtcaacaccctcaaaatagaagatggtgatctagatttaaatgcctccccaaaagcacttgataaactactgggtcatctgttcaccttcaaagtcaaaattcagccgcagtataaaaattctactgttttgaagtgctccagtgacttaactttaattaatgatgttctggacatgttgcctgatgttgagacatgttcaaagattgaagctacaacatcgtttgattccaatgatcctgtccacgatgaatgt

SEQ ID NO: 3878 - DNA, 828 bp, Glycine max
  Peptide Sequence Number=SeqID_120656
atggctcttcctggtgttgttgacatgaactggcaacttctgttccaaaatgcaataagcttgatatcagcattgaaggaattgcaaggagttactgctctggatcttaataaattattgagggactctgaaaatttcactattcattaccttactgaaaaaggatcattgctgaagattgatatggaaaagcttgcaggatcccttccgttgcaccttactacactgctgatgtcaggtgttagagatgaagccctgttcagatacttattacgtggcattcgattattgcattccttgtgtgaattagcctcccgaaattctaaattcgagcagattttgctagatgatgtgaaaatgatggaacagctgactgacttggttttctacatgctaattgttcttggtggttacagacaggaataccgtgcttttagttatatgcaccttatgcattcaactctcgtagcatgcaatttacatctcttaacagcgtttgtttcaacacaatggcaagatattgttcatgtattgcttgcgcaccccaaggttgacatatttatggatgcagcttttggatcagttcgcatgattgttagttttcttgagaatgcactggtagcatatcatgaagatatttctgtggaatcaaatcttacagcagaacaaatggtttattatctttgtcagcagtgtgaagcttctctgcagtttcttcagtcattatgccaacaaaaaatgtttaaggagcgcctgcttaagaataaggttcccaaaccaatcttacattcttacttcataaatttggagagggaactgtgtccctaa

SEQ ID NO: 3879 - DNA, 780 bp, Glycine max
  Peptide Sequence Number=SeqID_120657
atgtcaagcttccccaacacggtggcggaaggccgcaggtccggcaaggcaccggaaaaatccaccttttctcagacttgcagcctcttgagccagttcttgaaggagaaacgtgcttctgctgattccacccttggaattggtggaaaaatggaacctaaaggaatatctagaaagtttgtgaaattgcttgtgacgagaattgctgatgggggtgttgtttgtttggatttggaaattccagcgaataccaaggctttgttaggaagcttgcaaaactctgatggggccttaaagctaagcgcttctgccatggaatttcttccccagcttgtggaaaacccctgcattaagaagtctaggtcaccgggacctgaatctccccaattgacaatattctatgccggaaaaatgttggtatttgatgcctttccgccggagaaggcgacagaggtcatggagatggccaccaagttggcctcgaacaactccggcactgaagaaagtccccctagccttccggttaccactgaaaaattggctgtgtccaagatgcctcaaacaaacacatcctcagaaacccctaagcccggaaaccaaggggttggttcagatatgaggtacccaaggagagcttcacttctaaaatttcttgagaaaagaaaagaaagggtcaatgctagagggccataccaaatgaacaatctcaagccagaaggaagcagttcaggtggtgaacctgaagatcagtgttccaaacagtttgaccttaacttttag

SEQ ID NO: 3880 - DNA, 291 bp, Glycine max
  Peptide Sequence Number=SeqID_120658
atggctctaagcgagaagggcgcgctaagcgcaattccaaccctagagattataaatacgttattcagcgtaaaaaacacgattttcactctctcctcctctccaaacgccacccaaaccataacacctccttctcttccacccatgaccactggtggccaccacgagccgctgttgcttgccgccgaacccccacatcaagaggaacattttaatcgaagcggaatcctccttaaggattcaatggagaaattttccccaatcctccatttcaaagcttctctgaggtaa

SEQ ID NO: 3881 - DNA, 183 bp, Glycine max
  Peptide Sequence Number=SeqID_120659
atggtggtgttgggaacgatgcacgatgggtctaggtcaaaagtagagtgtgagggtgagacgacaaaggaggaggtgttggtggaggactggaaaacatattcccatcgacaaaactcagcaaaacaggttttggaaagtggagggaggaaacaaatctttgttgttgttgtttacaattaa

SEQ ID NO: 3882 - DNA, 132 bp, Glycine max
  Peptide Sequence Number=SeqID_120660
atgggagattacagaggaagcaccaacaacaagggtgcagaagggagaagagatcaggagcaagaggagggtgatgaagccaacatacctgaaggactacccttgagggcaatcctggaagagagaaattag

SEQ ID NO: 3883 - DNA, 270 bp, Glycine max
  Peptide Sequence Number=SeqID_120661
atggcaagagctggtgatggtggtggtgattatcatcaactggacgaatctcagtgtttgttattagacggagtaaaactcaatgtacctactttcaagggcaggagtgatccagatgcctaccttgactgggagatgaagattgagcatggtgatgcgaaagaggagtactacaaggagatggagatgacattagtgagggccaacattgaagaggaaactaaggacacaatggctcattttctgagtggcctaaatcctgacatttga

SEQ ID NO: 3884 - DNA, 423 bp, Glycine max
  Peptide Sequence Number=SeqID_120662
atgtgttcgtggcatttgaggagcagaggactcacccctacaaccaacaactttcaggatacacgcatgtcactttacatgtgtcacactctagtacacatggtgctggtagatagactagatgccacacccatcaccatcaatcatgttcagtattgctacattcattggggatttatgtctcgctggcaactgaaatggttcgaagacatcagtttttatctgggcatggaagtgcctcacaatgctcaagaattcgtagtgaccccagtgaggtttgatgcgagagataatatcttgagttggagattcgagttagtacatcttgtgtgggtcactggggagcatggagatcacatcaacatgacgctcaaggaggagaaagagtatggagcttctacgagacttagagccttcatttga

SEQ ID NO: 3885 - DNA, 1299 bp, Glycine max
  Peptide Sequence Number=SeqID_120663
atggctctgaaaattatgtttaagaggcattttgtaggagtaactgtgaagttaaaaccaagccttggagtaatgacttatgacccatgtgccctctcactcagactgtctttgggtgagaagtggcattattctaacctagggaaaaatattgagaactgtccttttcctccttttctgttgccgtttcgtctatatgtaagagagatgaggtgtattgaaccatatccaagtggaaatttgcctcctggttttgatccaaaaatttttgccgtgcttaaaagcaattctggtgtaccaaaactacctgtaactgagccgcttttgcaagaagttttctcgggtactggcccagttgaaggttgtaagcttatcagaaaggataagtcatcctatggattcattcattactttgatcgcagatctgctgctcttgccatattatctctcaatggaaggcatctatttgggcagcctatcaaagttaattgggcatatgctagtggtcagagagaggatacgtcaggtcactacaatatatttgttggcgatctaagtcctgaggttactgatgctacgttgtttgcatgcttttctgtctatcccagttgttcagatgcaagggttatgtgggatcagaagactgggcgttcaaggggatttggatttgtttcattccgtaaccaacaggatgcacaaagctctataaatgatttgactggtaagtggcttggaagtagacagatacgttgtaactgggcaacaaaaggtgctggtggtaatgaagagaagcaaaactcagatgcaaaaagtgtggtggaacttacaaatggctcatctgaagatggtaaagagacatctaacagtgatgctcctgagaacaatcctcagtatactactgtttatgtgggtaaccttgctccagaggtaactcaacttgatctccatcgccacttccatgctcttggggctggagtgatggaggaggttcgggtccagcgtgataaaagggtttggttttgtgagtgctcttgggggagcaagcccactccacctggaactgcttcaaatccccttcccccacctgctgctgcatctctgcctggcctgtctgcaactgatcttttggcgtatgagcgacagctagcaattagcaagatgggtggcgtccacgccttgatgcatcctcaaggacaacatcatcttaaacaagcagcagctattggagccagccaggcaatatatgatggtgggttccagaatgttgcagctgcacagcaaatgatgtactaccagtaa

SEQ ID NO: 3886 - DNA, 352 bp, Glycine max
  Peptide Sequence Number=SeqID_120664
actgtgcaacaaccaaattgcatttctgttgttggctcctaccagcaacaacacagattctcccaccataatcaccatcccaaactcattaacaacaacaacacatattcaaaaacaacaacaacaacaaaatggattgatgacaaggtggggatgggttcaagtggatccacgacagggtgggattgacgatgggggcaaggtaattgatgcaatacgaatcgacaacaatggtgcttggaactcgaagggatgggtgtgcatgttgtctggaggggtggtatggggaaagtggtggcacaagagctcagcatttgggatgccagggtggaggagaagactttggatctaa

SEQ ID NO: 3887 - DNA, 579 bp, Glycine max
  Peptide Sequence Number=SeqID_120665
atggcagaacaagctaaacaggtattttatattcaagatccttgtgataaaagatggtcagtggttatacatggaaaaacaattggtcttaatattgaagatgatgattcaacccttgatacttgtctcactcctttctccacacaaatgccaagcacatggctacaccagccagcttaccttctcctcctcctcctgagtcagcaacacctttttcactgtctgcgtcgaagaagaccagatgaggtggagggaccagtggttgatgtttatcctgtcactgggaaagccgatggtccccacagaaagaaattaagaacatatttggggattgtcgctcgcgataaggtggatgttacatatgataattggaaacaagtccatgtcgctcaaaaggatatgatatgggaggatattcaagagggcaaggatgacaaagtctatgagaagtacggaataagcaaagagaagtgggcccaattttgtaaaaagtggtacagacccttcatgggaggatgttctaaagaaggtgcaaaccattcagaaacaaaacattgttcctcacgtgttgtctcgtag

SEQ ID NO: 3888 - DNA, 333 bp, Glycine max
  Peptide Sequence Number=SeqID_120666
atggcccgcacgaagaaaactagtcaaatgacgtctaaggctgtaaaggaaattacaaataggattaatgtactgactgttgccattgggctatcagagcaccctgatcgtgtttgtgctgctgaagtcggtgtcaaccagatgcagtccctgatacaatcacagggactcacactgccttctaaggttgaggttagtccttttgttgctcgtgtcaacacaaagaaaagttgtatggatccctttgggcagcacccagaaacgggggtcacgaccatccacaatgttcctttaggaaatgatcaagtgaaggtcggtgttgaggaagtttga

SEQ ID NO: 3889 - DNA, 207 bp, Glycine max
  Peptide Sequence Number=SeqID_120667
atgcaggttgtgagagtgattggaagattgggatcaagaaattgccacaaggttaatctatttgcgattcttgtttggttacaaatttccattatcaaggaatgttcatgggtgataaagcgggtcaacccgcctcctctgcctaaagcaaggtgggatgagttaacccatcatgaaagtaggttgcaaaagactcttcctgtttag

SEQ ID NO: 3890 - DNA, 1461 bp, Glycine max
  Peptide Sequence Number=SeqID_120668
atgagccattatctcaaagagaaaggaggtcctaggttggttatcatgggagagaccaaacaacttgttacccttttgacacaatttcaagaggcaatgaggatggtcaaggatatagtggaaaaaagcagatcgagtaaaacgagcaaacgattactaaggaaaaccctcaagaatatgactcctctactgcaggaaatcaatcaatacaatgaacacttggacccacccagagaagaaatcgacactcttatcaaagaaaaagacgccgtagaagagattgtgtgctgctattcctgctccaggagcatttggtggaccaaattattctcttggcttccactctacggggataaattttggaataacaagaattattcccttgctgcagatgacaaccaagttaagtatatcaaaaacacactgtacaaggtgaaagaggttcttgagcgtctagacatagagaattttcagctgaaactcaaaggtgttggatcaccaatcaagtgtccttttggtgttcctgaaaaccctgaattcactgttgcgttggatctaccgttgagcaagttgaagatggaggttatcagggacggtatgtccacccttttgttgactggtttgggtggatctggtaaaacaactttggctacaaagctctgtagggatgaagaagtcaaaggtaaattcaaggaaaatattttatttttgaccttctcacaaacgcctaagttgaaaagtattgtagaaagactatttgatcattgtggataccacgttcctgagtttataagtgatgaagatgcaattaaacggttgggaattttgctgcggaaaattgagggaagtccacttttgttggtacttgatgatgtttggcctggatcagaagccctcattgagaaatttcaattccagatgtctgattataaaattgtggtgacttcaagggttgcatttcctaaatttggaaccccatatgttttaaaaccacttgctcatgaagatgcaatgaccctattccgacaccatgctctcttggaaaaaagcagttcaagtattcctgacgaagaacttgtccaaaaggttgtgagatattgcaagggtttacccctcgccattaaagtgattggtagatcactcagtcatcggcctattgagatgtggcaaaagatggtggaggaattttcacaaggtcattctatacttgattccaatattgaattacttacatgcttccaaaaactcttgcatgtattggaagataatcccaacatcaaggagtgcttcatggacttagggttgtttcctgaagaccaaagaattcctcttcctgttctcattgatatatgggcagtgttatatggatatgatgatgacggcatagaagcaacggacatgataaataaattagactccatgaatctagttaatgtcttggttgcaaggtacagcgactag

SEQ ID NO: 3891 - DNA, 645 bp, Glycine max
  Peptide Sequence Number=SeqID_120669
atggcgatgggcacttctcccagttacttcgaccctcacaacctctcctccagacagcagttccgcagatacgggaagagacactcaagttcaggtgcttcaatccaatacgacaactcggcttctaagttaagtgaaactgggttgttatatgatggccaaagcatccatagtccaactaatgcagcacttgttcttgaaaatattaaacaagaggttgagagtcttgatgctgattacctggaagagaagacaccatattccactagaaggaaattgtctgccgttattgatggagtccctggggtggatgctggttttgactctggacgctactcattaaaggcttgtaagacagagggtgactcattgggagatggtgcagaaacaatcttcactttatttgcatctctgcttgattcttctttgcaaggactgatgcctattgctgatctgatactaagagttgagaatgcatgccgaaatgtttcagagtctataaggtatggtttgaatataaggcatcgagttgttgaggacaaattgatgaggcagaaggctcagctcttgcttgatgaggcggcaacatggtctctcttgtggttcctttatgggaaaggaaatatatctctaaccatatattaa

SEQ ID NO: 3892 - DNA, 612 bp, Glycine max
  Peptide Sequence Number=SeqID_120670
atgtgtgatgctactctatgtgacatccctggaatgggcttattgaaatctatttacttatcacaggtgtcaggaacctcacatgtggtggcttgtgagtttgttgtggaggaccacacagctcaattatgccttcggatagtccagtggttagaaggtttagcttctaaagcacttgacttggaagcaaaggtgcgtggatctcatgttggtagttatctccccagctgtggagtttggcatcatactcagcgttacctgaagaaaggaaatcttgacatgaatgttgttcatcacttggactttgatgctccaacccgtgaaaacgctaatcttttgcctgatgacaagaaacaagatgaatctcttctagaagatgtatggattcttttaagggctggaaggctagaagaggcttgtggactttgccggtccgctggacagccatggagagcttcttctctttgcccatttggaggcttgaacacgtttccttctgttgaagctctggtgaagaatggtaaaaatagaactttgcaagctgttgaatttgaaagtggcattggtcatcagtggcatctttggaaatgggcttcattttgtgcatcagag

SEQ ID NO: 3893 - DNA, 438 bp, Glycine max
  Peptide Sequence Number=SeqID_120671
atgtcggctttgaaagagcaaatgacttccatgatggaggccatgttaggaatgaggcaactcatggagaaaaacgtggccatcgctgccgctgttaaatggtgcgattgtaacagacatttgttattggctgcttgcacaatagagactaaaggcccgattttcacagcaatgttcacccctctagctcttataatcacagcaatattctcagcacttttgtggaaagaaacactttacttgggaaggttcaaattctactctaaatctcaaaacaagcacaaaattgttggtggcactgttttactagtggttggactctacagtgtcctttgggggaagagcaaggagagtgtaaaggagggtgtaaaaggagaaaacctagaagttgaacaaacaaaagaggaaaccagattggagtgcattgtaaagcattga

SEQ ID NO: 3894 - DNA, 261 bp, Glycine max
  Peptide Sequence Number=SeqID_120672
atggaagtagcgcgcggattgtcttcctcattgacgatggaggagagaatgggagtggttgttgttacgacggtgctggtgggagcgtgtgatcggaatcggagaggtaagtgcggcaacaacaacagcatgcagcagcaacaagaaacaacttcacaattgcaggcagttgtttctcccccacaggtgggatcgtcatcaatgggcgtttcaccatcgaaccaacaaacgcagccgcaagccagccaaaaaatattttaa

SEQ ID NO: 3895 - DNA, 3981 bp, Glycine max
  Peptide Sequence Number=SeqID_120673
atgggggtctccttcaaggtgtccaaaaccggcactaggtttcgccctaagtgcattccccaacttcaagatggcgcatccgacaattccaaaccccagagtgatcttgttgaggctggtgaaaacattgctcagattcccaggtcatctgtgtcatctgaaactctttcattagcagatagggaggcttctttcacattgaacctgtttccagatggttattctattggaaaaccctccgagaatgaagcagctaatcagtcaaaataccaagattttcccaagttgttacatccatatgataggtcatctgagagtcttttcttggccattgagtcaggtcacttgcctggggatattcttgatgatatacctgccaagtatgttgatggagcacttatatgtgaggtgcatgattatcgaagatgctcttctgaaaaagggggtagtgtgtctgcagaaagttctcctactgttagcaaagtatgcctcaagatgtcgttggaaaatattgtaaaggacatcccatcgattactgacaagtcttggacatatggtgatctaatggaagttgaatcgaagatactgaaagcattacaaccaaaacttcatctagaccctactccaaagttagatcggctgtgtgaaagtccgcttccaacgaagctcaatttgccaagaaagcgattaaaaaatatgccagagtttgctgttacttctactaataaaattcatgggaagaaagtatgcatagatagagtgcaggaaagctcaattaacagattaggtgatgtaggaaacactgcatcaaatgctattgtgcagcagacccatgaaaatccagccatgcagaatcttagtccgaatgttgccatggccttgagatctaagaattttatacctgattcttccatccctaactttcctatgatgtcccatcaatcaagatattcaatggctgttggaactcagagaagtttgcaggagcagggaccaactccttccattaattcgttaggggcttctcctgctacacaagatgtcatgatttcatatgctgaaaatgcaaactcgggtgcctctcttcttggaaaaagggataatcaagatggacaagcatcacctttgtccaatattgctaaaagaatgaggcctgcttccactgtgcttgatgcaatgcagcatcagcaaatagggtcacatgttgaagctcttcaaggatcagatatgaattggcagaatacattgcaacaacaagcaatggccagaattcagtatgcaagtggtggcattcaaaagtttcctcagcaggcttttgaagggggggcaaatcaagagacaggggctattccctttgcttctagtcagcagcagggcatgaggttggttgccaaggaagaacagtttgaaatggaaaaattagatggtgcagagataaaccgcaataaaagtgagatggaaatggaaatgaacaatttagatccacaacaattacggattcagcaacgattgtcacagcatgcattcatgaggtctaatttcccccaggcagcctggaacagtttgggtcagcctatggagaaagaaacaaaaaaagaggaccagcttcagaaaaggaaatcagtacagagtcctcgcttatccaccggggcattacctcactccccattgtcttcgaaatcaggtgaattttccaatggtgcagtaggaccaagttttggacagtctgcaatggctgctgtgcctgggacatcacaaaaagacaagacagcaatggtctcagttcctgctactgttggaactccatctaatgactctacacaaagacaacatgcacaactagccgcaaagcggagatctaattctcttcccaagaccccagcaatgaatggagttggttctcccgctagtgttggtacaaccagtgtcccactgaatgcaaatagtccctcagttgtgacctcgggtttagttgaccaaaatcttcaaaatatgcttgaaaggttctcaaaaattgaaatggtgacaatgaggcatcaacttaactttaagaagaataaggttgatgactatcccattaagaagcagaatccatatgcacaaaataatctagctgcacttcttgccaatgcaactaataatgagggattgccagaggagtcaatttctttgtcaaagtcgcttattggtgggagtatgaatgcatgtaaaatgagaatcttaactttctgtgtgcctgagcgtgtagttcaaggaagtgttgttactataattccgaggatgcgaactaggatgataatatttgagaaatctgatggtactgtcgctatgcattgtggggagattgaagaagttgattacgtagctgcagaggatcatcttctcacattacccaatacttttgattacgtagctgcacaggatcatctcctcacattacccaatactcattctgcagatttgcttgtacaacagttctgttcactgatggtacgcgaaggatttgtgaaagaagatgaccgaatccaacttaaaccaaaccgggtgaaccttccattgggcaatcaatctactacccctaataatgctgtagttgaaatgcaacaatatggagaagccattcctggtcaatcatccaatgaagttgcaaaaccaactagtggcagtaatgcacctgtaaacctctctcagaatcttgtaacaaatccaaggatgctgccacctggaaacccccaagccttacagatgtcccaaggacttctctctggtgtttcgatggcttcaagaccacaacaaatggactcacaacaagccatacagcagcagcagcagcagcagcagcaacaacaacaacagcagcagctgcaacaaaatcaacacacactcattcaacagcagaatccccagttccagaggtctcctatgatgcttgggacaaatcagctttcacacttaaatccagttggacaaaactccaacatgccattaggtaatcacatgctgaacaggccttcagctctccagcttcagatgttccaacaacaacaacagcaacagcaacagcagcagcagcagcctcaaatgcaaaggaaaatgatgatgggactcggacaagctgtgggaatgggtaacttgagaaataacctagttgggcttgcacccatgggtaaccctatggggatgggaggtgtcaggggaataggaggaagtggaatctcagcaccaatgacatctattgctggcatgggaaatatgggtcagaacccaatgaatcttagccagacttcaaatattactaattccataagccaacagttcaggtccggatcgataaatgcagcagcatctgctgaccttttatcaaagcttagattggtacatcagaatcgtcaaggcatgctagggtcctctcaatctaacatagctagcatctcaggggctagacaaatacaccctggtggtactccaagtctttcaatgttgggcagggctaatacaatgcagcgaccaattggacctatgggtccaccgaagattatggctgggatgaatctttatatgagtcagcagcagcagcagcaacatcaacaaccccaaccccaacaacagcagcagcaacaccaacagcaattgcaacttcagcagcatatgcagcagcaattacagcagcaacaacaacaagaaacaacttcacaattgcaggcagttgtttctcccccacaggtgggatcgccatcaatgggcattccaccaatgaaccaacaagcgcagcagcaagccagccctcagcaaatgagtcaacgaacccctatgagtccacagatgagctcaggtgcgattcatgccatgaatgctggtaatcctgaagcttgtccagccagtccacagttgagctctcagacccttggctctgttagtagcataacaaactcccctatggacatgcaaggtgtcaacaagagcaactctaatgcacaatga

SEQ ID NO: 3896 - DNA, 1494 bp, Glycine max
  Peptide Sequence Number=SeqID_120674
agagagtttcattcatcaaggacgaccaaatatttacctccggagctgcacgaaatcaccaccgaatccgactcggattccgactgggacgattcggaagaagaccccgatttccacttgctcgaagaaactcatagcaagttctcaaacctctcacttaagcacaaggcaaaagcgggccttatttcgtggcaatttggtgtttgcattgttttcgaagataaggatctaggtgaagaggtgaatgcatctgctcatgatggagacacttttgaggaagttcaaaaattaatccaactgggacggttagagaaattgaaagtggatgaatgcaagttgtatccgaggaagaatggtctgaggctaactggaaacaaggacacacttatacaacgcataaagaagcatttagagattttaaatggaggggtgaagaagtatccaccttcaagctttgtgttgaattgtaaagaattggatttcccagcaagtggtccaccttgtggcaaaaggattggcgcaggccacatagtgcaagaaagttatggtgctactaaacaacagcatacatttccgatatgggaggatgaatcacaaaggcagaaaatattgatggaaaaacactcaaggggatctcttgctagggaagatagagaagcaaggatacaagaaaaggagaagaggaaaaaaactaaggaaaataggtacttgatttcagacttaaagagtcttctaacactgtttatctgccaacataaaggaaagaaacattcctctattgtaaataaaccagcagctgtaactggacgacatggtgattctaaaactttaggaagagcatcatttactgttcacaatatgcataatcagcaagcttggaaccgcacaggtgactgtaggaatatttctgatattggtcatatgaggaggggagctgatcttagtgtatgctacaactatgctgacccccatttcagagataaaccaactattattcagaaataccaccctttcatggatgagacaagtggatttacagtggggactcatcttcatcataggatgcctttggcaaatgcaaaccactctcaaccggtgatgccaaatagagaaagctataataagcaaaagcaagtgtgtagacattatgcccgtgggaagtgctattttggggacaactgcaaattcttgcatgatttgagagacaaaagagaatgcgtgaatttaaaaattttgttgtggcatgttttcattcatgttgtggaattaaaaaggcttggggtttttggtttgcctgatatacaagactttgtgatgtttccctctctaagtcccttctctgtaactcccaatggtttatgtagaacctataatcttgcaatcatattaattttctatcctgacctcctcacctatgaattgaaaggcattttagctacatctttgtattcagccaaaaaaaacctatatctttcgttgtgtatgttcctttaa

SEQ ID NO: 3897 - DNA, 1851 bp, Glycine max
  Peptide Sequence Number=SeqID_120675
aaaatagcagaccaaggtgggaaatgtgaagcagctgtatatgcagcccagtgtagcaacctaaaacggatgcttccactctgcaacgactgggagtcagcatgctgggcaatggcaaagtcttggctagatgtgcaggtggacttggaaatcactcgttcactgccagggggagttgatcagcttagaacttttggagatgtaattgatggaagccctggaaatgctgatggttcctttgagccttctaatggacctgaaaattggccaattcaagttttgaatcagcaacctcgacaactctcatctcttcttcagaaacttcattcaggggaaatgattcatgaagctgttacccgacaatgcaaggagcaacagcgacaaattcagaaaaccttccagtttgtaggaatcatttcacctaaattctttgtgctttctcacaggcctagtggagatcctcaaatgatacgatttggtgcacacctagtgcttgtgcttagatatttacttgccgaggaaatgaaggacaccttcaaggacaagattctgagtgagcatgaggagttggtgggcatatatgcttctcagcttgcacgccaccgttgcattgatctctttgtgcacatgatggaacttaggctgcacaacagtgtacatgtcaaatacaagatattcctttccgctatggaatatttgccattttcttctatggatgattccaagggaaattttgaagacattattcagagatcccgagagatcaaggttggcaaatacgataacctgtcagatgttgcagaacaacacagactgcagagtcttcaaaaagctaaagtcatccagtggctttgctttacaccaccatcaacaattactaatgtcaaagatgtcagtaaaaagctgcttctccgagcactgattcatagagtaccagcaatgcctataggtgcccacacagtacttggttttcttgctgaacccttaaaacagcttgcagaaactcttgagacctctgaggattataatgtttttgaggatctgagggagttccaagactggcgtgagtattactcctgtgatgcaacctaccgcaattggctaaaaactgaagtagagaatgcagaagttcctatctcggaactgtcactagaggaaaaggaaagggccatttcagctgccaaggaaacactgagtgcatccctttcactactaaaaagaaaagaaacaccttggttggcttcgactgattgtatgtatgaatcagctgaacctgttttccttgaacttcatgcaacagcaatgctctgcttgccatctggagagtgtttgtgtccagatgctactgtttgtactacactgacgagtgccctctactcttcggctggtgatgaggttgtcttaaatcgacaactaatggtgaatgtttccatatcttcaagggacagttattgcattgatgttgttcttcgttgcttagcaatagctggtgatggacttgaaccacatgatctcaatgacggtggtattcttggcaccatcatggctgctggttttaaaggtgagcttcctcggtttcaagctggagttacaatggaaatatcctgtttggatgcatggtattctgacaaagatggtaccttagagtgcccggcaacatacattgtgaaaggactttgtcgtaggtgctgtctcccagaagtcattcttcgttgcatgcaagtttctgtttctcttatgggatcgggagtcctgcctgattgtcatgatactttgatagaactggttggcagtcctgaaaccgactttcttcacttgtttagtcaacagcaattacaggcaagattataa

SEQ ID NO: 3898 - DNA, 222 bp, Glycine max
  Peptide Sequence Number=SeqID_120676
atgtaccaaacttacatgcaaatgctgagtataggttacctgcaaccggaagaacaggagagcttcagcctcttctgcaacttccggcaagtcgcaattggaaattgtgaaaaagaagtagcaaataaatcttcggcgatgaagcatggttgtgatgcgcgcctccaagatcggttgttgaggtcttcttgggaagggaaacatcggagatcggagaattag

SEQ ID NO: 3899 - DNA, 354 bp, Glycine max
  Peptide Sequence Number=SeqID_120677
atgaagacgaagttctacgcaatcaaccccaagaagatgatgaggaaaaagctaagcatggtagcatacatccttgtaagtaagcagtgggaaataagaaagctctatgaaacccatacatgttcaaatccatcaatttcacaagatcatccaaagctacagtatctgctcactagtaaaagcatccacacgttgattgaaaatgatccatcaacttcagtgctagccttgatatcactatccaaaagcactaaaggatacactactatgtatcgaaaagcatggttggaaaagaaaaaggtcattgaaaatatctatgacaactgggaaagatcgttccacgatttaccatga

SEQ ID NO: 3900 - DNA, 301 bp, Glycine max
  Peptide Sequence Number=SeqID_120678
atgaaagatagcatacttggtccaattgttgaagttggagcctttggtggatttttcttttcaaggattcaagtgcatggccttgctttctttgaaagaacatcagctctttgttctccatctaccttgaagctctctgttctccatctgagcatcatttcgtctaagcttgagcatggtttccgtctcactcaagcatcgtcacaactctctacttcttctccttcgccaccttacctagaggtgcaccccgtagggcattggatagttgatcgtgcgggtgcgattaggctaagatcta

SEQ ID NO: 3901 - DNA, 807 bp, Glycine max
  Peptide Sequence Number=SeqID_120679
atgggaacttcaataggattgccaaaggtgaatacttccttatctgaaaaggaggaaaaccattctctagaagaattcgaaaaagaagaggaatcagttttcccaccttcaggggaatcattggtcgaatttctatcaaagaaacaaaaggctgaaaagaggaacatgttgaaaacctcatggagaaaacatcagagaatgaaaagggatgcaatattggagatgcaacaaaagaatggtgttagacctttagtttttaatggaataaccaaaggtccacccctaggcttcaaaaagaaaatattaagtaaagagcgggaagataaagaagtgataatagactgctttgagtctggtttcgaagattccttagaagccatttgtggagtaatttcaatattacctgcaaagtacgctaaagattatcaaaataggcataattttgtagtcttcgatcctccaactaatgacatgaggggtcacatgaagctactccacttaacatctacagtggaagaccaaatcattaataagatattggtatatggagggactgcattcaacatcttaccaagatccatgctacgaaggtttggtagaaatgtagaagacttgatacctcacaatatagtgatgaaaagagacaaagcgttggctacaactactcctttcaaaattgatgactcattttatgtgaacaataaattaggtgaagataaaaacaagttcttttgttgggatttgactaagggtttccttttgattaacatggccatcgaaaaaatggccaaggttgaagagttatga

SEQ ID NO: 3902 - DNA, 366 bp, Glycine max
  Peptide Sequence Number=SeqID_120680
atgaggatcaaaaggtcttttaaggttgtaatggggccaaggacaaggtatggaaaaatatggaataagtggctgaatcccaaaggaatagaggagcaatggggaataacctttgagaaacagcatcatattcagcatgtccaacatttaaccaatatgcaattgagcttcaaaacaaggaaagggaaacaaggctcaaaagggctatcaaaggaattaattcaaggtaagtccatttggctagaagcttataagaacaaaattgcctcaatcatttccaaatatgcatgtgaattaggaagcatcaacaagaatcaagccaaggctattgtgcaaacaatcaatggggcaaaacacaccaaatga

SEQ ID NO: 3903 - DNA, 465 bp, Glycine max
  Peptide Sequence Number=SeqID_120681
atgaaggctgacatggaggccatgaaagagcaaatgacctcaatgatggaagtcatgatgagtatgagaaggatgatggaggtcaatctggttacagttgttgccgcaagtaccgccacagaattggacccgagtcacccacctggcttcaatcaagtaaatcatctagcctcggatatggtaggtcagggaggcaaagcgttgggaagtacgggtggcccccattttgtgcaggtccagagcacgcattcctttccaccatatggcttgcctcccaactatacaccatttaatgttgcacacattcccgatgagaatgtcgacaactctgctcccatacccattgagagtcaacatccccaatttggtcatgcacaggtttctcaactcatgggggagacacatgaagcacctcgagaccataatctagtcgactttgggcctcacgttggatatgctgcttag

SEQ ID NO: 3904 - DNA, 333 bp, Glycine max
  Peptide Sequence Number=SeqID_120682
atgagtctctcgttgaacaacttgtctcttattctcgtgcttcttatttccatgtcgaccttcgcgacaaacggagcattatcaaagactaacaacacattaagtgaccttaaggctcaagcggaagctttgatcctgagtgccaatgacattgatggcctattgacatgctttctttgtcctagtaacgtttttggacctgatgactattcgaacccggcaagtgcaccggatcgcgcaagtagtataaaatggaaagaaccgagtatcgaactctcggggaacttgtgttacttagtaaagttatattcagtgaataggcgtctagtatga

SEQ ID NO: 3905 - DNA, 141 bp, Glycine max
  Peptide Sequence Number=SeqID_120683
atggcggtggtgggaacaacagctcatgctctccatcactcactgaccgtcataggtgtcttctatgccaccccaccctatgttgggccttgtggcctcaataatcttaagagggataggcttagaatgcagaagaagtaa

SEQ ID NO: 3906 - DNA, 525 bp, Glycine max
  Peptide Sequence Number=SeqID_120684
atggccaactcaaatttattttttccattgcttattttcttgaatttagttatagcaaatgctacaatttccaaaagtttagacttgaagattcttcaccaccaaggttttagcatccaagaaagaggtgaagttaaaactcatgctaatacaaatatgttcaataatattgcaagtaaagtgcttcctattctccccaaaggacatgttccacatcctatccctttacatggtcgaggtagtccaatttctcatggatctccagcttgcttgagtgatggatgcaatattggtgttagatcttatgctaataaatatgttgttaacaacattaaaaccaaggagtttcatgttccacattttatacctttacgtggtcaaggtagtttgatttttgatggatctccaacttgcttgagtgatggatgtaatattgatgctaaagctcctgctcataaatatgttgctaacaatattaaaatcaaaaagcttcattttccacatcttgtacctttacatggttga

SEQ ID NO: 3907 - DNA, 153 bp, Glycine max
  Peptide Sequence Number=SeqID_120685
atggagcaatatcgtccaatgactaatacttttcctatcatccaaagcctttcagttcatgttgttaaagatagggggagcaacaacatgagcaacatgaaacaacctaaggctaaagcttggagcttaaggaaaagtttgaacgagctttag

SEQ ID NO: 3908 - DNA, 183 bp, Glycine max
  Peptide Sequence Number=SeqID_120686
atggagtcgccaccaatgtttattcaaggaaaacgttggaaaaaccaaaaagtaaaggtcgaaggtctacgtattttgaaaaggagggttcaagagtcatttacgcacagggaagggttgacaagggtgtttccctctctcctacgtatcctcgggtgcgatgaggaattcagatctacgtag

SEQ ID NO: 3909 - DNA, 318 bp, Glycine max
  Peptide Sequence Number=SeqID_120687
atgacagaaaatttttctctgcataattggcttagcgtgataggcactcgcttagcgccaaacacttatatttcaaacaatggcttagcgagtaatactagcttagccttatgcatgccgcaacgaatagcacttagttgggctaggcgtggcttagcgcgaggcagtcaacaaaaatatctgtctaagcgcacacggcagttgcttagccacgatgttcataatgaagatgaacattcaacaacctggttgaactcgcttagcgcctgcatgctggctaagcgagttcatcttgaaatgtatatgttcaaggcttaa

SEQ ID NO: 3910 - DNA, 1608 bp, Glycine max
  Peptide Sequence Number=SeqID_120688
atggcatccctcattcctggagttctactgaagcttctccaaagtatggattctgatgtgaaagttaatggggaatatagatcagtccttctgcaagtgatcagcattgtgcctgcaataaccgggtctgaattatggcctaaccaaggtttcttcttgaaagtctctgactcttctcattcaacttatgtctcactctcaaaggaagacaacgagcttatcttgaataacaagttgcagcttggtcaattcttttatgtggacaggatagaggctggaacaccagtccctattcttgttgatgttagaccggtccctggccggcacccttttattggaaatcctaaggatttaatgcaactgttagagccatcagagggtccagtgcaatctgatcataatcatagagttaatcgctcgaaatccatgaattcaacaaaatccaaagagagcaaaagtccaaggcagaagattgttattaaagaggaaaaagctgccgttgcatccaggtacatgcgaggtgttagaagtccaacctcaaatgtgaatgtgcaagatgctaatgaagaaagaaaaggaaatgattttgagaatggtgtagatagtaagaaggtggcatctgcaaaagtaaaacttaagaaattacagacactctcagtgaatacaactcgtagtctacaacttgaaataccttcaccaaggcaaagggttgctcaatctaacatccaggagaatgtcatgtcacctaagcgcatatctgccaaacgtaattctactaaacaggaaactacaaacttgaatgttttgtccagcagtgaagataaaagctatagcacagaggcaattccatggtcctctttgccagccagccttctgaggcctggaaaggaattgcttagaaggaaacatctagcctcacaggttgctgttgaagctcaaagagaagttactgctactgcagtccttgtcaagtttttgagtatgtttgccaacatctgcgcttcagctgcatcagagaaccctcatggcacactgaataagtttttttccttccaagaactcatggaccagtcaaattttacaagtacaactccacacaaagataaatcacttcaactatataaattttcttctcctacagaaacagacaaaactgacaagaaatcagatttagtgcccggtaaaagttcatcaaagtctccaaaatactcacctgaattatccgaggctgagaaacaagaatgggtaacaggaaatggtctaaaagagataaatgagctgagagaagcccttttgattgaaacaagatcatggtttttgaaatacttggaaaaaacattggatgtctggttttccacaagctcccgagacaagagggggaagatgagtaaggacagtgcagggaggcaaatggaacatgccaataatatagctctcaccttgtcacaccttaagcaagcaaatgaatggttggaaaaactgagaagcacttcaaacttggaaaatgatgagctggtggaaactgttgacagattgaagcaaaaagtttattcttgtttgcttctacatgttgactctgctgcatttgctttggaaaaccgagcttga

SEQ ID NO: 3911 - DNA, 1719 bp, Glycine max
  Peptide Sequence Number=SeqID_120689
atggcccacttcattcatcatatatttacattcatatgtggctacgcagttgggtttaaaagatcatggaaagtctctctggtggtattctcagtcactccattgactatgttctgtggaatggcttacaaagcactttatggtggcctaacagcaaaagaggaagcttcttatacgaaagctggtagcattgcggaacagggcatcggttcaattaggacagtgttttcatttgttgcagaaaggcaattgactggaaaatatgctgagctactgcaaaaatcagctccaataggggacagagttggttttgctaaaggtattggcatgggtgtgatctacttaataatgtattcaacatgggcattggctttctggtatggctctatattaattgccagcaatgaacttgatggaggttctgctattgcttgtttctttggtgtcaatgtagggggaagagggttggcactgacactttcatattttgcacaatttgctcaagggactgttgcagctagccgtgtattctatatcatagagagaatccctgagattgattcctatagccctgagggaaggaagctttctggtgttcgtggaaggattgagttaaaaagtgttagttttgcatacccatctcgtcctgattctcttatatttgattcccttaacttggtattaccatcttcaaaaactttggcagtggttggtgccagtggtgggggaaagtccactatctttgctctcatagagaggctttatgaccctattgaagggattattaccttggatggtcatgatttgaggacattgcaagtaaagtggctaagtgctctttgccacatctattctggactgcgagtggacaactactcttatgccaaagctagtaacatgcttctggagcagatagttaagtcctttgaaagaaccctgtcagaacctaggagaaaatcattaagttcacaacttcaaggtcttatgtttgggttgtttcaagatctttctaaattttctgtggaacaacttgctggcttggcaccagatacttctatggcggctacagcaattcctgcagttcaagatatcataaaacgtaggccactgattggcaatgatagaacagaaggtggaagcacagtggccttggtgggaccaagtggatcagggaagtcaacagtcatatggttgacccagaggttctatgatcctgatcatggaaaggtgatgatgagtggtatagatttgagggagattgatgtgaagtggttgaggaggcaaatagctttggtgggtcaagaacctgcattgtttgctgggagcataagggaaaatatagcatttggggacccaaatgcttcatggactgaaattgaagaggctgcaaaggaggcttacatccacaagttcatcagtggccttcctcaaggatatgaaactcaggttggtgaaagcggggtccagttatcaggtggccagaaacaaagaattgctatagccagggccatattgaagaaatcaagggttaccaaagaggcaacaaccataatagttgctcaccgtctttccacaatcagagaagctgataagatcgcagttatgagagatggggaagtggtggagtatgggagccatgacaagctcatggcttcaggtcaaaatggcttgtatgctagcctagttcgagctgagactgaagccaatgccttttcttga

SEQ ID NO: 3912 - DNA, 2343 bp, Glycine max
  Peptide Sequence Number=SeqID_120690
atgtctgtagaagcagattctttaggcatggaaggagacaatgacacatggaaggagacaccaaaaaatcatctcatgaaagagagaacagactctctcaatctagaggctggtagagtttctatgacttcaacccatttctccaagttggattggaggactactctgagtttagcctttcaaagcataggaattgtgtatggtgatattggcacatccccactttacgtgttttcaggcatcttcaccaatggtatccatcacaatgaagacattctgggggttttgtctctcataatctacaccattgtgatcatacccatgattaagtatgtcttcattgtactgcatgctaatgaccatggcaatggtggggcatttgcactctattcgttgatatgtaggcatgccaaggtgagtttaattccaaatcaacaaccagaggacaagaagctttcacattacagactagaaacaccatctcataatctgaatagagcccaaaagttaaagcaaaagcttgagaacagttattttgctcgtgttgtgcttgtacttgtaaccatgttggggacttccatggtcataggagacggcatttttactccatcaatttcagttctttctgcagtgagcgggatcagtacctccttaggtcaagaagttgtcgtggggatctctatagcaatattgatcgcccttttttctctgcaacgatttggcactgacaaagtaggatcttcatttgctccaattctcttggtgtggttttcattcattgccggaattggcatctacaatttatttaaacatgacattggagtattacgtgctttcaatccaaaatatatatttgactttttcaaacggaacggtaaacaaggatggctatcattcggtggagtcttactatgcatcacagggtctgaggcaatgtttgctgacttgggtcactttagtgtgcgagccattcaaattagcttctcttttgttgtatttccttcaatactgattgcatatattggacaagctgcatatctacgaaagttccctgagaaagtgtctaatacattctatgcaagtatacctgaccacttatattggccaacatttgttgttgctgttgctgctgccatcatagccagtcaagcaatgatttcaggagcattttctgttatatcccaagcacaaagtctgggttgtttcccaagagttaaggttgtgcatacttccactaagcacaggggccaagtgtatattcctgaggtcaacttcatgttcatgattgcatgtattgtagtcactgctgccttcaagacctctgaaaaaatgactcatgcatatgaaaagtatatgggtggtgctctcttcttgccagtcggttgcattgagcttctttatttatcatcacaactgactaaattcacaaagggagggtttgttcctcttctattagctttcttcttgacaatattcatgggaatttggcactacgtgcaaaaggaaaggtacatgtttgaactcaagaacaaggtttcctccgagtatgtgagacaactggctaacaacgcaaacataaatcgcatacccggaattggacttttgtattctgagcttgtacaaggcattccccctatattcccacacttcattgctagcattccatccattcattcaattgtggtatttgtttccatcaaggctattcctattgcaacagttgcattggaagagaggtttctgtttcgacaagaatggcctagagaatatagaatatttcgttgtgttgtgaggcatggttacagggatgtgcttggggatcatgtggtgtttgagtcacagttagtgcaacaactgaaggaatttataagacaagagagcttcatggttgagtctgagggaacaacaactggtgaacaagagcctattcctgccaacgaggatgagatggctgacatgcagcaaggtttcagttccactattaatgttacatcagctcaagaaggaaaagctaggactagtagttcttctgctagtgcaagagtaatcccagatcaaggtgctatagttgtgtctcgtgcctcttcagattcagttcaaccacttggggtgactaagggagttgaagaggagatcaagtttatagaaaaggcaatggagagtggtgtggtgtatatgctgggggaagcagaggtagtggcagacccaaaatcatctatcttcaataagatagttgtcaactatgcttatagcttcctgaggaagaactttcgcgagggggataaatcgatggcaatccctcgtaacaaacttctcaaagttggaatgacatatgaaatatga

SEQ ID NO: 3913 - DNA, 378 bp, Glycine max
  Peptide Sequence Number=SeqID_120691
atgtgtgatcgtgcataccctaagaaactagcctttcaatatcttgaagagctgaggaatgagtttgagcgtgttaatgggtctcaaattgaaactgctgctagaccttatgccttcattaagtttgatacatttatgcagaagacaaagaaactttaccaggatacacatactcagcgcaatattgcaaaattgaatgatgaactctatgaagttcaccagataatgactcggaatgtgcaggaagttcttggtgttggtgaacagttggaccaggtcagccaaatgtccagtcgcttatcatcagaatctcgcatatatgctgataaggctagagatttaaatcggcaggcgcagactgcctatccctgcagataa

SEQ ID NO: 3914 - DNA, 2082 bp, Glycine max
  Peptide Sequence Number=SeqID_120692
atgaaacaagttttggagactcaggataatgcacgcgcaacctcaaccccacctttagagcagcaacaccagagggtgaggcaatctaaagggaatcaagggatgcatgatgagctgaaaatgaaggctgatgagcttgaaaagctttttgctgagcataaactgagggttcctggggaccagtctggttctgtgaggagagttgagccagccgatgtgcatgtggaacagtcacaatatagaagaggtggagtaggggagtcgactcctcagttgccttccagaagcaatgtgattgaagtggctgcgagttctagcaatttgacaagctttgatgctaagttggttactaagatggtggatagtcagaattatggtgatgctttgaggcaaaacttctctgatcttaacttgagtgaagattctagaggaaagttttatgaaaagtacatgaagaagaggaatgctaagcttcaagaagattggagtatgaacagagctgagaaggaagctaggatgaaagccatgcaggatagccttgagaggagtagagctgaaatgaaggtcaagttttcggggtctgcaaacagacaagattcagcatcaggtgcttaccgtgccgagaaacttcgatatttcaaatcaaatattaagaaagagcagcatccaatagattcccttcaaaatgaagatgatgaagatctttctgaattctcagaagagaagacttatggtgcttcaaggcaaagtaggaaattttttcccaacagacatatatcttcaggcacacctcgtacaatagctgtgtcagtctcccgttcatctggtggcaggcgaagagacgatcctcttgctcagtctgttccaaacttttctgatttaagaaaagaaaatacaaagccttcttctgcagttagtaaaacaacccgcactcaggtaaggacctattcccgtagcaaaagcaccactgaggagatacaaggagtaaaggaagagaagtcaaggcaaactctgtcgttacggaaaagttctgctaatcctgcagagtttaaggatttgtcacatttgaactcagatgggattgttttgtctccattgaaatttgatatgggcgagagtcatctaggcccttatgatcaatcacctaggtctttccttaaaaaagggaataacataggttcaggttctgtcggcaacgctatccggatgaaagcatcaatggtatctgatactcagaaaaataaagaatttgatgaccttgaatttgatgaggaagattctttgcggatggccacagaggaacaggatgacattgaaactatggctatcaaagatgttgcttataataataatggaaaggtgagtctgagccaggaatctggtaagtctggtaattctggatctgaaattggtgattctactaggtctcttgctcaggtagatcctatttcagggggcgagatggctactgggtttccatcaacattcaatggtgtaagatctctgcaggactctcctgttggaagtcctgtgtcatggaattcgcgtgtgcctcatcctttttcgtacccgcacgagtcatctgacattgatgcttctatagattctccaattggaagccccgcatcttggaattctcattctcttaaccagggtgacaatgatgctgcccgaatgaggaaaaaatggggaagtgctcaaaaaccatttcttgttgctaattcatcccaaaatcaaccccgcaaggatgtcactaaaggttttaagcgattgctgaagtttggtagaaaaactcgtggatcagagagtttggctgattggatttctgctacaacttctgaaggagatgatgatactgaagatggccgagatctggccaatcgttcatcagaagacttgaggaagtcaagaatgggattctctcatggtcatccttctgatgacagcttcaatgaaaatgagctgttcaatgaacaggtccaatccttgcaaagctctatccctgcacctcctgctcattttaaactgagggatgatcatatatcaggaagttcattaaaaggtgatccctgggtaacataa

SEQ ID NO: 3915 - DNA, 1541 bp, Glycine max
  Peptide Sequence Number=SeqID_120693
atgaagtctgacacgcttcttgattatgctgtatttcaattgtctccaaggcattcaagatgcgagttgcttgtttcaagtgatggacacactgagaaactagcatcaggattggtgaagccattcttgacccatttaaaggttgcagaagagcaggttgctctagctgcttcatcaatcaagcttgaaatcgatagacataaaaatgctgagacgtggtttacaaagggaacatttgagaggtttgtgcggtatgttagcacgcctgaggttctggaaatggtcaatacctttgatgcagagatgtcccaattagaagcagcacgaagaatatatgctcagggggcaggagatcagcgttcagatccacaaggtgggaatggagcaggagccataacagtggcagatgcaaccacaaaggagctcctaagggcaattgatgtacgattgagtgcagttaggcaagacctaaccacagcatgtgctcgtgcatcagcctccggtttcaatccccacaccgtttcacatctcaaacatttcgcagatcgattcggtgctcatcgcttcaatgaagcatgcactaaatacatgtcactgtacaaaagaagaccggaccttatcagtcactggccaggtggcgatgacagggaactccgttcatctgttagttctgacatgtccatcgacaacgacgatgggcccaaccaagcccaggaccaggcccaacccatcgatccacctaagcccaagcctatttccaacttcgcttcgctgcgacgtagcaacaccagcgtgagctcgaaagacgagaccagcgacacccccaccaaagaggagacggagtcgccggctccggctccaacgactgctccgtcggggcggaggctgagcgtgcaggaccggatcaacctctttgagaacaagcagaaggagaattccggaggcagggcgccggagctccggcgcctctcctccgacgtgctgcgccggtggagcggcgctagtgacatgagcatcgacggcagcggcgagaagaaagactttgacagccccttacccccgccagcatcctctgtttctgaaaccaagtccgttgtcgtttctgaagataaggttcgaatcgacaaatcggagaaatttgtgataaccgatcaagggtcttctcaggaaacagggaaagtttcagtttttgatgaggacaagaatggggggtttaaggatcaggtgggtggtggtgtttctgaggcgacattgaagaagggttcatccgaggttgttattgttggtcctatgttgtcttctggggatgatgatgcgaagttttatggtgggatgaaaaatcatgtggttgcaccgtcacttattaggggatcccgaagtcattctcgatctctatcagcacagttcgaaggtggcaatggactcaaatttagggatgtttctgttcgtgttgatcaatcttcaccgaatgaggttgaggactcttcttcttcttcttcattccctaacaaggaagaggattcccaaatcccaaaaatgaa

SEQ ID NO: 3916 - DNA, 1170 bp, Glycine max
  Peptide Sequence Number=SeqID_120694
atgaagagggtaaattgggcatatcggtggagaccacggaagcagatcggcggcgaggaggatatggacgacgacgacgagatccagtcgcatccttcgccggcgagcggatcccctccgtcgtcgccgagggcgaacggtcggataacggtgacggtcgcggctccggcgccgccaccaccgccgaacagtctggcattagcgcttccgattcagcagccggcgaagggaaacggcggaggaggaggcggcggcggcggaagggaggattgctggagcgaaggtgcgacggcggtgctgatcgacgcgtggggagagaggtatctggaactgagcagaggaaatctgaagcagaagcactggaaggaggtggcggatatcgtgagcgtcagagaggattacacgaaggcgccgaagaccgatatccagtgcaaaaaccggatcgacaccgttaagaagaagtacaaatcggagaaggcgaagatcgccgccggcgccaccagcaagtggccgttctatgaccgactggaacaattaatcggtccaagcgccaagatccccggcgtcggcggtgcctccggcaccagcgctgccggaaacagtaatttacaaccgcagaaagttccgttaggaattccggtcggcgttcgcggcggcgcgaatcagtttaaccatcctcataaacagccacaaccggttccgttgaagaaccagaagattcagttccggcgccgcggtcctccggtggagtccgattcggaggagcgagacgcgtcgtcgccggcgtcgagcgacagttttccgccggagagtttcgagaggaagaggccgcggttgatgagttcaaacaccacgaaaggaagcggagaaagacggaaggcgaagggttggggaagcgcggtgagggaactgacgcaggcgattctgaaattcggcgaggcgtatgaacaagcggagagttcgaagctgcagcaggtggtggagatggagaagcagaggatgaaattcgcaaaggatttggagttgcagagaatgcagtttttcatgaagacccaggtagagatttcgcagctcaaacttggaagaaaaggtggtaaccctagcaacaaccaccatggcaccaccaacaataacaacagcaatcataacaataatagtggcagtgaatga

SEQ ID NO: 3917 - DNA, 414 bp, Glycine max
  Peptide Sequence Number=SeqID_120695
atgagtgtaggaaatccagggcatgggggacttcttggacgaaatgttaacaatgatgagtcataccaaatcaaattggataaagctagacataacatagtgtccgcttttgtcaaatactatgaaaatggagaggagagctttgaggagttgcaacagctttttgaagacatgtttcaagcggatattggattggatggaggcccttctcttgcttcttctgattcctcaacttcatctgcttacatgacttacagtgaaagttctagttcaaataaacgcaattcctctgagatgaatttcgggaaggcagagaattcttctgtctttgatgccagttaccagaatttctgttttgggctatatgccaagaaagtgttaaattggttaagggaaaagatagggaaaagatag

SEQ ID NO: 3918 - DNA, 570 bp, Glycine max
  Peptide Sequence Number=SeqID_120696
ggaagctctatgtttggtgagctaaaacttgtgaataaagtccagttaaaaagggcaacaaaaacgtcatttgcactctctggtggcattaacactataatctcgtgctccacggctgaactagaaactctgcaaattgtacaaagcacaattgcgaagcagctttctattgatgaagccactgtgactccccaaactaaattttcagatttgggtgctgattctcttgacaccgttgaaatcatgatggctttggaagagaaatttgacatttccattggagagggtggagctgagaacatctccaccgttcaagatgctgctgatctgattgagaagggggtgcgaggggtggtaggcgcagaaggagcagaggtggtggtggtggttccgaaaccagattgggagcgaacaatggtgatgctgcgacttatcggaacatgctccgccaccgttgaccggacggagcttccgccggagaacgagttgtactttcggagcttccccacacgcgtttcggtgctggacccgccaacgtttcgtcccatagtttgtgaagaaaacccatga

SEQ ID NO: 3919 - DNA, 510 bp, Glycine max
  Peptide Sequence Number=SeqID_120697
atgttactatcaaacaacattaacaaccctaaaaatgtttgggcagaaacttgggaatggctattagatggcattctttttgaacaaagaagagcattacatattccagcctctagcggtataacttccctgttgttacttggtggtcgaactgctcattcaagattcaaaattcctatccctacattagacaattctatttacaacatccatcaaggaagtgagctagcagctttgctaaaaatgacaagattaattatctgggatgaagctcccatggcacataaattttattttaaggctcttgacaaatcattgagagacatcatgaaaactaatagcaatgagccaaaattttttggggaaaagtttgttgtatttggaggagattttagacaaattttgtctatcattccaagaggaagcagatcagatatagttcatgccactgcgaatgcatcatatcaatgggacagttgtgacgtcctcactctcacaaaaaatatgtga

SEQ ID NO: 3920 - DNA, 525 bp, Glycine max
  Peptide Sequence Number=SeqID_120698
atggttgaagctgtcgccactgttggtggtggcggtgacagagagagagagatgtcgagattgcgaagactgatccaagcttcagttgatgctactaagaaagttatatctggtaatcttgatgatttgatgccaccaccggagagacccatcttcagcttcaattccaagcaagagttaagcaagtggcatttgtattctgattctgaatttggaggtgggataactgagtcggaaaatggagcaacttctggaatcttctccgggaacctttctctggatgtctctgagggctctaaatggaacatcactcggagtggcttctgtggaatgcgctcaaaaaagtttgatggctttattgatttggattcatatgatactattgctatgaaacttaaaggagatggaagatgttatatatctacgatctacacagagaattgggtcaattcacctggacagatggaagataattcatggcaagcttttgtttatgtgcctgaaggcaactggtacattaccaag

SEQ ID NO: 3921 - DNA, 363 bp, Glycine max
  Peptide Sequence Number=SeqID_120699
atgggtgcaagagaaagcaagttaaggaaatgggtgatgagtagtggaagtgcttattattataagcgcttagaaggcactctattggtacctaagggttatgttccaatatgtgttggcaaaactgaggatacatgcaagtggtttatggttcacaccagagcacttggtgatgcatatttccaagagctgctggttaggtctgttgagggatatgggtttaggaatgaaggggttctgaggatccaattcgaagcacaagattttgaagagtggttgatcaaaaggtccaagtccaatgagaagattacatataagcgcactaaatataggttaaatatggagatgtctattactagataa

SEQ ID NO: 3922 - DNA, 1602 bp, Glycine max
  Peptide Sequence Number=SeqID_120700
atgaaagataagccgaacctcacattagttgctccctttagggacctatgcaaaatgggagggttaatgatattgatctgcatggttgtttcgtggatgttcatacacagatggagtcaaagaaacaagaaaggccccaaaacttggcccttttttggagctgccattgaacaattgatgaactatgacaggatgcacgattggctcgtcaactatttgtccaagtcaaaaaccattgtggtccctatgcctttcacaacttatacttacattgctgatcctgctaatgtagaacatgtacttaagaccaacttcaacaattatccaaagggtgaagtgtaccattcatatatggaagtgttgcttggagatgggatatttaatgttgatggtgagtcttggaagaaacaaagaaaaactgctagcttagagtttgcatctagaaatttaagggatttcagcaccaaagttttcaaggaatatgccttgaaactttcaaccattctcagtcaagtatctttccttaaccaagaaatagacatgcaggaattgttgatgagaatgactttagactccatatgtaaggttggatttggagtggaaattggaacattggctcccaatttaccagagaatagctttgctcatgcctttgacactgcaaatatcatagtaacacttcgcttcatcgatccactttggaaaattaagaaaatgctaagtataggatcagaagcacaactcggaaagagtatcaaagtcattgatgatttcacttactcagtaattcggagaaggaaggcagagatagaggatattaaaaagagtggccagcaaaatcagatgaagcaagatatattatcaagattcatagaactaggagaaagaaatgcaacagacaagagtctgagagatgttgtgttgaactttgtgattgctggtcgagacacaactgcaacaaccctatcatgggccatatacatggtaatgacacatgctcatgttgctgacaaactttacttagagttaaaaaaatttgaggagaatcgagcaaaagaagaaaacatttcctttcctcaatgtgacaaagaggatcctgaatcattcaatcgaagagttgagcaattttcaaggttgttgaataaagattcactagagaaattgcactatctgcatgctgttataacagagaccctaaggttgtatccagcggttcctcaggatcccaagggcatcttagaggatgatgaattgccagatggaaccaaaataaaggcagggggcatggtaacttatgttccatactctatgggaaggatggaatataattggggtcctgatgcagcttcatttgtacctgagagatggtatagggatggagttctaaaaacggaatctccattcaaattcactgcttttcaagcaggaccaaggatatgccttggcaaggactctgcatatcttcagatgaggatggtgctagctattttgttcagattttacaaattcaacttggtgccaggtcatatggtgaaatacaggatgatgactatattatcaatggcatatggtttgaaacttaccatagagagacgttcttga

SEQ ID NO: 3923 - DNA, 342 bp, Glycine max
  Peptide Sequence Number=SeqID_120701
atgcagggtagcatacatcctttgccagccttgatatcactatccaaaagcaccgaaggatacactaccatgtatcgaaaagcatggttggaaaagaaaaaggtcattgaaaatatctatgacaactgggaaagatcattccacgatttaccaagattgttgcaagctatatatcaattttttcatggtatggtcatggagaagaaaacattgccaatgccgccacaaggaggtcaaacagtagagggttttgtgaaattccatcgtcttttttggagttttagactgtgtatcaatgggtttcaatattgcaagcccatgattcaggtcgatggaacatga

SEQ ID NO: 3924 - DNA, 1578 bp, Glycine max
  Peptide Sequence Number=SeqID_120702
atgtcggcagcgtcgccgtcgccggcgacatcaacggctgcgccaccgctacaaacaccaccttcttccaacaatactagtccttcaccgtccaccgctaccactccaccgttgcaacaaacccctccttccacttcaccgccacaacaaccggcttctccgccgccgtcgaccccttctccggcgaatccgccgccgtcatcaccacctagttctccgcctccccccatgtcaggaaccccacctcctttagtacctccaccatctccaccgccatcaccaccgccgtctactccggcggcgcagccagcggtgccaccgagctctccaccgccaccaccatcaccatcaccatcagttccatcaagccctccaccatcaaaccctcgtaacaacacatctccaccaccttcaccaccaccacaaccaccagctccaccacctcaaccaccagctccaccagctaacaacacttcaccaccaccacagcgaaattcgccaccccctccagctgccacgccgccccggacctccccaccgcaaacttcaccatcccctccggctgcaccgcctcctagaaactccactaggttgccgccaccggttaattcaccaccaccgccggtggatgcacctccaccgaggtcatcgtcgccaccagcaccagcaccatccacccctccttctaggactagtcctcctcccacaccaagttctcaaccagctccaccttcaaattctacaccaaggtcatcacctccatcgccaccttcaattactaatttggccccatccccgccatcacgaattttgtcatcgccaccaccgccaccggctcagaatgggacagaaaactcaagccctgatggaggtggagatggaattggcattggtggtgtagtggctattagtgtggtggctggatttctgctgcttggcttcattggtgttcttatatggtgcatgaggagaaaaaaaagaaaggtgcttgtgagtggtgattatgtcatgccatccactcttgcctcatctcctgaatccgattcatccttttttaagacacactcctcagctcctcttgtacaaagtggctctggcagtgatgttgtgtacacaccatctgaacctggtggactaggccactcaaggtcatggttttcatatgaagaactaatcaaggccacaaatggtttctcaactcaaaatcttttgggtgagggtggatttggatgtgtgtataaagggtgccttcctgatgggagagagatagcagtcaaacagctgaagattggtggaggccagggggagagagaattcaaggctgaagtggaaattatcagtcgtatacatcatcgccatttggtttctttagtgggatactgcattgaagacaacaaaagactacttgtctatgactatgtccctaacaataccctttattttcatctacatggggaaggtcagcctgtattagaatgggctaaccgtgtgaaaattgcagctggtgcagcccgaggactaacttatctccatgaagactgtaattatcaatccttattattttactcttggtcttga

SEQ ID NO: 3925 - DNA, 165 bp, Glycine max
  Peptide Sequence Number=SeqID_120703
atgggaggttctcgactatccaagccaaagtctggctccgcttccggcagcacaaactgtttcatgctgtatgcgagagcactctcaattacctggggagacactccagaatattggatatgggtacaacagaaagaaacaagaaaattaggaataggtggttaa

SEQ ID NO: 3926 - DNA, 202 bp, Glycine max
  Peptide Sequence Number=SeqID_120704
gggattctgtgggttccagcgaggacaatgtgggtttttcggcagtgtagggggttctgtggcttcgaccgacgacaatgtgggtgtcgagggagcggtttttggcagatttcaggcgggaggagaaagaggagcgatttcaggcaggaggatgacaaagagaagagggagggcaaggttttcgagcacgtgcggcttgtga

SEQ ID NO: 3927 - DNA, 310 bp, Glycine max
  Peptide Sequence Number=SeqID_120705
tctaaacctaggagggttgtctaaattgagcctagtgcaacaagagggatctgaggacgatgcttggattgattcagtccaactagggatcgaggatttagaagcagcaataactccagaagaagaacctcaatcttccgaggcatcttctagttttcctatggctgaatacgaagcatgcgctctaggcgtccaagcagtaattgacttcaacgtcaagctaatcaaggtgtacggagactcggcgctggtgattcaccagttgagaggggaatgggagactatagaccacaagctgataccctactag

SEQ ID NO: 3928 - DNA, 333 bp, Glycine max
  Peptide Sequence Number=SeqID_120706
atggctttttatggaatcgcgggtggtggttttgatatcttcaataaaaaagggaaaaaggtacgttttgttcggtggggatttcctggtaaaaatcgtcgtattattctcgaaatacctatgaacgagcttcactccatcagaataataacagaagttaaagaagagggtatttttactcgtaccagtacttttgagagtatcgtttatctggaaaccatagaacaggggtttattcccttgactcgtattgaagataatttgaatgggacacaaattgcacataaagctggcgaattatctgtatttttgggtgtaccacttttttactga

SEQ ID NO: 3929 - DNA, 865 bp, Glycine max
  Peptide Sequence Number=SeqID_120707
atgagttctaatatgcaacgtcaagcagttccgctttctcagtccgaaaaatgcattgttggaactggattggaacgccaagtagctttagattcaggggtttccgctatagccgaacacgagggaaacatcatttataccaatactgacaggatatttttatttggtaatggagatactctaagcattccattaactatatatcaacgttccaacaaaaatacttgtatgcatcaaaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggag

SEQ ID NO: 3930 - DNA, 429 bp, Glycine max
  Peptide Sequence Number=SeqID_120708
atggcagaagaccacccacagaggatgacgctagaggactactctagccttgccacacctcagtacttcaccagcatagccagaccagatgtgcaagcgaccaatatttcatatccacattccctcatccagctaattcaagggaatctatttcatggtctgccgagtgaagatccatacatacgcacacctggccacatacatcgagacttgcaacacggtgaagatagcaaaagtgaagcgaaaagatggcttcactcattcaaggggaatagcctgcggacgtgggaagagatggtggagaagttcctgaagaagtacttcccgaagtccaagaccgctgagtggaaggtggaaatctcatttaatcatgtagaagaaaatagaaataataattcaagcacgctcaacaaaagtgttcataagtaa

SEQ ID NO: 3931 - DNA, 947 bp, Glycine max
  Peptide Sequence Number=SeqID_120709
tcgcctttagagggctacacgccgtcaccttcagaggacaacacgtcctccccttaagagggctacacgccgtcgcattcaaagggctacacgtcctcatcttcagaggattacacgtccttgctttagaggactacacgtcgcctccttcagaggggtacacactctcgccttcactggggtacatgttctccccttcagagggctgcacgacatctcctttagaggacaacacgtcttcaccttcagagggttacatgccctcgccttcagaggactataagtccttaccttcagaggactacacgtcctcaccacaagagggctacacgccctcgcctctagagggctacatgccctcgccttcagaggactacacgtcctcaccttcagtgggctacacgccctcgccttcaaaggactacacgtcctcgccttcagaggactacacatcctccgcttctgaggtctgcacgccctcaccttcagagggctacacgatctcacctgcagaggaaggacaacacgtcctccccttaaaagggttacacgccgtcacattcaaagggctacacgtcctcatcttcagaggactacacgtccttgctttagaggactacacgtcccctccttcagagaggtacacaccctcgccttcacttggctacatgtcctccccttcaaagggctgcacgacatcgcctttagaggacaacacatcttcaccttcagagggctacacgccctcgccttcagaggattataagtccttaccttcagaggactacacgtcctcacccccaaagggctacatgccttcgcctctagagggctacatgccctcgcctttagaggactacgcgtcctcgccttcaaaagactacatgtcctcaccttcagtgggctacaggccctcgccttcaaaggactacacgtcctcgccttaa

SEQ ID NO: 3932 - DNA, 891 bp, Glycine max
  Peptide Sequence Number=SeqID_120710
atggcagaggtctccattgaggccattgcctccctcacccaatattatgaccagcctttgaggtgcttcacctttggggacttccagttaacacccacagtggaagagtttgaagagatcctggaatgccctctgggaggaaggaaaccataccccttctcgggattctatccctccttatctagaatttctaagatagtcaaaatctcgacacaggaattagaccgcggaaagcaagtcgaaaatggggtggttagggtaccaaggaaatgtttggaagcaaaggcaagagtcttggcaagtcaaggcgaatgcgcccttttcatggacatcctggcacttttgatcttcggagtggtcctctttccaaatgtggatgggttggtggaccgggcggtgattgatgcttttctcgccttttacgaccgcaaagaaagcccaattgtcgctatcttagccgatctatacgacacattccatcgaagatgtgagaagaacaatcaaacaaagaagaagcgtctgtcaattggttccccctacacacaagatctggattggctcccgagtttgaggaccactaagggggtggaggttgaagctccggaagaagacgaagaggtacaggccctcaagatagaacttgagaaagcccaaacagtcaaagaaaagttcaagtcagcagctgttaggatccgaaaggagaacactgaactgagagatgtcaatatagccaccaccaaggccttagaacaagagaccaagagggcccttagggaagaacatgaccggaacaaattccagggggctctgtggggcagtaacagcgagcttaagctccaaagagaggaaagggaccaatcgcgaataaacggtttgatcctgaaaggatga

SEQ ID NO: 3933 - DNA, 225 bp, Glycine max
  Peptide Sequence Number=SeqID_120711
atggtgtccattcaaataaaaacgttgaatgaaaaggcttggcttaaattgaaggtggtttcagcaacagcaagcacaggcttaatcagtgggaataggatggagctactggaccactggctggtatgtgaaatgtacatgaattcggcttctgctgaggctcttgtgatccatgactcagacatgtgttggaccacaaacagtactcacacatatggcccatga

SEQ ID NO: 3934 - DNA, 315 bp, Glycine max
  Peptide Sequence Number=SeqID_120712
atgatgtatgaagaagttgatatgaatgttgaaaatgagaaagataaagtagtagaagaagaagaagcaccaaggcgaagatggaacaagaagcaggaagccgaagaagaaggaaggaagcttaataaacgaggaagaaaaagcatttatgggggaataatgactcatacagatgaaccactgtttgattatatagcaaaggatgaaggacattatagtcctttcatttggcacgaagttcattcgaaagcggtgactaatttctcgttaatgattcgtgaatatatgatggtgacagatggaatgactaactga

SEQ ID NO: 3935 - DNA, 2082 bp, Glycine max
  Peptide Sequence Number=SeqID_120713
atggtgacatccaaggttggaaagcgccatgccttgacaggtttcgaagctctgcaagaattatttattgcaagcttattaccagatcgtaaattgaagaccttgatacagcgacccctaaatcatgttcctgagactaaagatggttactcccttctccttttctggtattgggaggaatgtttgaagcagagatatgaacggtttgttgttgcacttgaagaagcatcacgagacatgctacctgctctaaaaaacaaggcactaaaggccatatatgtgctactgagtcggaagtcagagcaagaacgcaggctactttctgcacttgtgaataaacttggggatccagataataaggcagcatctaatgctgactttcacttgtccaaccttttgtctgaccacccaaacatgaaggctgtggttattaacgaggtggattcttttctctttcggcctcatttaggaccacgttcacagtaccatgccgttaacttcttgagccaaattcgtctcacaaataaaggagatggaccaaaagtggcgaaacgtcttatagatgtatattttgcattgtttaagggagtgaatagagcatttccttttgtctcaagtaatgaagctgatgacattgttgacattcaaacaccagcagaaatgtttattgcacttcttctcagagcaatgaaaagggatgttaatttaaggcgtgtagctgcattttctaaacgtctattgcagatcgcacttcagcagccaccacaatatgcttgcgcatgtcttttccttctttctgaactccttaaagccagaccacctttatggaacctggtgttgcagaacgagtctgttgatgaggaacttgaacactttgaagatgtgatagaaactgataatgagcctaacagtctatcaaataatcagaacaatgatattggagttgttcagaatggtgaggatgccaattctgacaccagttcttctgaaagtgaagatgatcttccagcatcttctgaagatgatgattcggatgatgatgcttcagaggatgcagattttttgcttgcaaaaaatgaaaaagaacacgagaaacaaaaaaaatcaaaatctgtatctgataaaggtcagcagtcacaattatctcccaagtcttcccttcctggaggctatgatccacgacacagagagcctttgtactgcaatgcagaccgtgtaagttggtgggagttaatggtgcttgcttcacatgcacacccttcagttgctactatggccaaaactcttctttctggggccaacattgtctataacggaaatcccttaaatgacctctctatgactgctttcctagacaaattcatggagaagaaagcgaaacaaagcacatggcatggtggttctcagattgaacctgccaagcagatggatgttaacaaccaattgattggagcagaaattctttcactagctgaggaagatgtacctcctgaggatctcgtcttccacaagttctacacaaacaaaatgagtttgtcttctaaaccgaagaaaaagaaaaagaagtcagctgatgaggaagcagctgaggagttgtttgatgttgataatggtgaagttgatggtggggatgagagtgacaatgaagagattgagaatctgttggattccactgatccaactttgggaccagacagtgactatgattatgatgatttggatgaagtagccgatgaggaagatgaggacttgattggtgatgttagtgatgcagagattaattcggagatggatatagatataccctctgatattgatgaggaagagactgatgatgctccaattgatgatgacgacgacgacaacattgatattcaggttggagatgttgatgatgcctctgatgctgatgaggaggaagttggcaaaagaaaacgaaaacataaaaggggtggtaagagtggtgtgtctccatttgcaagttatgaagagtttgagcatctaatggaagatgatgaccatactgagaagaaaccttcctccaagaaaaacaaatcaaagtctaagaaaagaaaaacgtaa

SEQ ID NO: 3936 - DNA, 969 bp, Glycine max
  Peptide Sequence Number=SeqID_120714
atggaagaagccactggcaccatttttgcgaaccaaacggcaaagctaaggtggggtgatgaggtgaagatgagaagcactgtcacctttcagtttgatggtgaaagtctcttgataggcaaagtggaaggtggttttgaagggtttgacagtaaggataaaggtgatggtgaaaaagatgaagtagatggtaaggaattggaagaagaaattggagcaggattttcatactgggaagaggcaaagcgagtcggaagggcctggagaaagacaggccatgaagtgctcatgctcaagagtggaatggtactaaaaaaattgggtgatcttgaagatccaacccagggggatgaaggtgtgactggatgtgtctggtttatgaagttggtgaataagttcatcaagcttgagggtcatattatgaagtgtttcactaaaagatatttggtgtgtagtgagcttggtgatggcctcctcgagtctgtcagagttggccttggacctagtggattctgtcatctcgatatgacaacgagagcaccaaattgtttgaactcgagaaaggtgaagaagagaacctggcttcgaggatggatgaaatggagaaaagcatcgggggtgttatgtgatgcaaaggtaccgatcaagctaaagggaaagttttatcggactgcggtaagaccgacgattttgtacggaacagaatgttgggcggtcaagagccaacatgagaataaagtcggtgtagcggagatgaggatgttgcggtggatgtgtgagaagaccggtagactctgtagtgaggagagtagaccagatggagagaagacaaacaattcgaggcagaggaagacccaaaaagactataagagagcatttctcatccacaatctaacccgtattgccatgatgcttgaggatcctaagaacacaacacattgtatccacaaagtagctgaaaaatattga

SEQ ID NO: 3937 - DNA, 450 bp, Glycine max
  Peptide Sequence Number=SeqID_120715
atgttgacaaacagagaagctattttcgctgaaattcgaaagaagctcttgaaagctcaagtcattatgaaacaaattgctgacacaaagagaagggatgtcaattttaatgagggcgattgggtaatgctcaacaagagatactatggtccatataaagttgttgaacgtaccggtaaagccacttataagctcgaattgttggagggtgcccgtattcaccctgtttttcattgctccatgcttaaaccttttcatcattttacagatgattccaatacgccattgcccttaccggcaatcgttctcaacaatcaacccatcattgctcctttggtcattttgggtacccatcaagaccctgtttgtgttgattctaagttacaggttttggtccaatgggaaggtttatcacctaacaacacaacatggaggattgggatcaactga

SEQ ID NO: 3938 - DNA, 351 bp, Glycine max
  Peptide Sequence Number=SeqID_120716
atgacacatgaaccttttaaatggtcttctactgctcaaaccacttttgatacattaaaggctgctctgaccatgaccctggtgttgcttttgccagatttcactcttccttttaccttggagacagacgcctccggtgtcagaatgggcacggttctttcaaaaaatgggcatcccatcgccttctttggtaaaaaattcagccccaaacttcttcgtgcttccacttatgtccaggagttgttcgccatcaccatcacaattaagaaatggcgccattacctcctgggccatcacttcaccattattatcgatcaccgtagtctcaaggagctattgacgcaacaatag

SEQ ID NO: 3939 - DNA, 339 bp, Glycine max
  Peptide Sequence Number=SeqID_120717
atggttgtgaatttggatacatctcctgtcatatgtagggaagaagaagacaaacacaagatttatactggttcggccacaaaccgtgcctacatccagtccccaagcaacctgcggttcttgagatttctttcaaccttatgtaccctctacttgtaccacaaaggatgtaccctccaatgtgttaggacaaagaattctcaggcgattagtcctttgaatatttgtaaggagaaacaaaagatatctcaggcgggacaagagagacacaaaagaattcaggcggttagtccttctgttcttttggcaaagggagaagagaatgaaaaagatgaatag

SEQ ID NO: 3940 - DNA, 477 bp, Glycine max
  Peptide Sequence Number=SeqID_120718
atggcctggcaaggtgaaaaggctgaggtagatggcatgtttaggttgggtgagaggaaaaagacagtgataccagtagactctaatgttcactcttcccaccacaagtttgctaaggtctatttcctcacaaaccctagcaaatatccctcaatttgcctaaagagtgttagtatctacgttgatcggttttccaactacagaatccagaccaaggaaaaaaatttcatcatagtagaccgtgttaaggctgggaaaatgaactcgggccaagttattgtctatggtgtcaccttctgcaatgaaatctatagtccaaattttggcaatccagtagtggtcaaaaaacacccatgggccgccactcatggacttctacctatctttaagagaatcaaatttcaccataaaatagtcgtgcccaacatcacaaagatcaaacccttgtctaagcaaaagatcatttttttttcttag

SEQ ID NO: 3941 - DNA, 290 bp, Glycine max
  Peptide Sequence Number=SeqID_120719
tcttctccctcccgcggttcgtgttctttattggtcttcttcccagcagtcttcttgccggccggcacaagctttggttctccattttggttccgtcccttcgtcttcttcattggctttctgtgagcatttctgccgccatcgaggttagtgttctaaccccattggctttggttatctgtttgaatcgcgtaaatggccttaggatagaagacattgttgttgtttggtgctggaggttgaagacgaagttcttctgcgagaagaagcttcttccgcccgtgtgttag

SEQ ID NO: 3942 - DNA, 219 bp, Glycine max
  Peptide Sequence Number=SeqID_120720
atggcttcagctttttctgaattgctaacatttgttatcagaaggatgagaaggcctctgcttgtccttttgtgtcttactgctctctatccagcactgaccactgcttgtccattcctgtcttactcccctcaatacagcagtagcgttgtgaatatatacggaaattttgatgaaaaaggggcaaaggaaatgagacctaaaaggaaaaaaatgtga

SEQ ID NO: 3943 - DNA, 468 bp, Glycine max
  Peptide Sequence Number=SeqID_120721
atggctaacatacccaaaaaacgattgacgtacccagaaaatgattatgcttgtgacggcttaaaaaatattataaatagaaaaattaaaagcaaaattggcacgatagtagagttggctaagttgaaaagggtttgctggctagaagtgcatggaaaatttgacacaagaaagctttcactaggaattctatatcaagtgtcatttctaattatgttggaagaatcatctcaagggtgggaagttccaataaatgttagatttgtccttcctggaggtaagagacaacaacacaaagtaaatttaaacgagaagttaagggagagttggatggagattctagtaggtgagtttgtggcatctgaaaaagatgctggcgagatggaaatttctatgtatgaatatgaaggtggcatgtggaagaccggacttgtcatccaaggtgtagtcatcaaaccaaaaaactag

SEQ ID NO: 3944 - DNA, 342 bp, Glycine max
  Peptide Sequence Number=SeqID_120722
atggtgaagggtaagccaaatcataatacgaatcttctcaaggatatggagcttccacaaccacttaaaaggagcaatggaggcattagaaatttgaagatctacaaaggagagccatttataagcagaagccgcagtgtaacatccattgctagagtggccccaaactcatctgtcaatgaaaccttaagccaaagtaggttccacttccaagatgaggtcaatgaaattgttgggcaaggaggttctgatatccctaagataccaatgatcatcccggataatgttttgcatgcacatggtatcaacatagtccacataggggacttttttggcaaataa

SEQ ID NO: 3945 - DNA, 429 bp, Glycine max
  Peptide Sequence Number=SeqID_120723
atgaagacttccttcactacctcagggattgcccctatgcaagagaaatctggcttaggttgggcttcctttcaaggccagagtttctcagctccaatacttgagtctcctccttcgggttccttgaagcttaatgttgatgggagttgcttactagaatcgagctctataggtgcaggtggagtcatctgtgaccacacttacaattggatcgttggagtctactcctttgatggtcttggagatagtgctaaagcggagatcatggccttgagacatggcttaatccttgcctgggataaaggcttcagaaacatcctctgtgagatggacaacaagaatatggtggacatcttcaacaacaattgttgcccagattttcacccccatattgccgtagttttgatagtcttagagcttattaactga

SEQ ID NO: 3946 - DNA, 132 bp, Glycine max
  Peptide Sequence Number=SeqID_120724
atgacaagtactaaggtagtcatcagagcatcctcaaacttttcccagattaagacatctcccaggaactacggttacaagtttctatgggtactacacctaaaaattctcattcttgcacttaggtggtaa

SEQ ID NO: 3947 - DNA, 588 bp, Glycine max
  Peptide Sequence Number=SeqID_120725
atggctcgattttcattggatgagatatcagacactggtgcctttgtgagatctgcttccacattcagaaattggatttcgagggacctgaattcgcaatttccaccagaatcagggaggtgccttgcttacttgaatattaaaggacttaacaaagctatcagtttctcggccgtcaagcccatctttgaaagaacaaatgaatctgatgactataaggggtgggtttttcctgaatcagaaactgaggtgcctggagctgaacctgatatgttgaatggagcaaagactattagggaactttatgaaattgcaagtgcaaactacaccggaaagtacactgttccagttctgtgggataagaaactcaagacaattgttaacaacgagagctcagagataatccgcatgtttaatactgaattcaacagtattgcagaaaaccccaccttggacttgtatcccactgatttaaaaccccaaattgatgataccaacgagtggatatacactagtataaataatggtgtttataaatgtgggtttgcaaagaagcaagaaccatacaatgagggcatttattgttga

SEQ ID NO: 3948 - DNA, 189 bp, Glycine max
  Peptide Sequence Number=SeqID_120726
atggttgccattgatgattcgaaacagaagcagaagctctttgttggtgttctatttttggaattttctgctggtgatctcgttggaaaacccgagctttctgaggctcgggatctgaattgtgaagatggattcaaattcaacaaaggagaagctgcagaacagtgttgttgttgcagatggagctga

SEQ ID NO: 3949 - DNA, 291 bp, Glycine max
  Peptide Sequence Number=SeqID_120727
atggactataaaactctttatcactttctccaaattgcgaacgacaaagaccagcaagactctccccaacaaaatgcccctttctcctattctgactctgattccgactactcctacaacgaggcagaggacgaggccttccactgtgcctttggccaacatgacgacggtgacaactcgtcatctatggagaacccgaatcgcgatgacccggaggtgaactttcgtgccttctcggaggcgctggagagccccgcgatgaaggagtttcacaacggcgtcttcgcgtag

SEQ ID NO: 3950 - DNA, 1464 bp, Glycine max
  Peptide Sequence Number=SeqID_120728
atggataagagcttgaaggtaggagaagatgagtggagggagagggagagaaagggaacggaatttatgcctcaaatgagtcagagtttctccgatcaccttaagcacttaagaacagccttgcaaactcttgccgacaacaacttcgttctgaaattgtccaaatgttccttcgcgacccaacaagtggaatacctgggtcacctggtttctgagaaaggtgttgaaccagtgcctgcgaaggttgccgctgtgcaacaatggccaactcctcagtcaactcgagcattgcaaggattcctaggcttatcagggttctatcgtcgatttattaagggcaagccgttatgctcaaagttacttcgcgcttcaacctacgtccgggagctcgccgcaattacggcgaccgtgaagaaatggaggcaatatctgttaggacaccgttttatgatactgacggatcataggagcttgaaggagcttatggctcagactgtgcagacccctgaacaacaagaattgaaaactgagcttgcctccaaccaggaattcctcaatcgtcgtcaacagataaaagatgaacctcataatcttcaggactgggttataagagatgatttgattttgcatcaggggcgcatttggcttccaccgcgactccggttgatactgacaattctagctgagtttcactccacccccaccggtgaccatatgggagtcatgaaaactctagctcgagtccgtgagaactttgtgtggacttcaatgaaacaggacattcatcactttgtcactagttgtgccatatgtcagcaaactaagaccgaccaccgacgttcaccaggcctcttgtgcccgcttcacattctggcgcgaccatgggaggatctctccctggacttcattgtgggacttcgtccgtatcacggtaactcagtcattttggtgattgttgaccgtttttcgaagggtcttcacctaggtacacttccacaacatcatactgccaccagggttgcaagattcttcatggagatctccgacaagctccatgaaatgcccaaaagcttggtttcagacagggacccgttatttgtgagccatttttggcaggaattattcaaactcagtggcaccaagctccgtatgagctcggtatatcacccccaatccgatgggcaaatcgaggtcatgaatcgtattattgagcaatatcttcgcgcctttgtgcatcaacaaccagccacctggggccgcttttttatgtgggctgaatggtcatacaacacttcgattcactcggccaccggcatgtcaccatacgaaattacattcgggaagaaaccgccctgtttgccacagtaccttgaaggaacatcaaaggttgaagctgttgatgaatggttcaatcaacgtgacaggatcattaccagtttagtgaagaaattatccaaagcttag

SEQ ID NO: 3951 - DNA, 927 bp, Glycine max
  Peptide Sequence Number=SeqID_120729
atgaatctattattgcagaatgcttctcaacctcctggaagttctccaaacaatggctccccgatgatatcgattaatgcttctttgcctgttaaagagatcttacttggatttcctcactttgatggaacaacaccggtgatggagtggatcttcaaggcggagaaattttttacttatcataatactcctgatacgtctagagtggatattgtggcgatgcattttgataaggatgtaatggcatggttccagatgtcacagaaattatctctggtgtctacttggtctgaattgactcatgctctagagtctcaattcagtccttcaccttttgattgtccaatggctgagctcttcaagcttcaacaaacaggtttggtatcagattattacctcaagtttatgtctctagctaatagatctttgggattaagtaatgaggctctccttaattgtttcattagtggtttaaatcctgatattagaagagatgttgttgctatgtgccctcctaccttattgcgtgcagttgttttagctaaaatttttgaagaaaaatatggtcatgtttataagccatttcaaaattcctatagtcacaaatattcccaaatttcttctaccccaatctctattaatgctcaaccaaaaacgcaaattaaatccagtttactttcgcttttacctactccatcaggccctccaattcggtcctcgaatgtaaaaaagattactcctgctgaaatgcagttgagaagggaaaaaggattgtgttatttttgtatgagaaattctcttttaatcataaatgtcctaatagacaatttttgctgttgcaaatggaagatgataatgaggattacaattgtacctcagggtactcatgtaggccccgattgtttgggtctagctaatagaaaatga

SEQ ID NO: 3952 - DNA, 993 bp, Glycine max
  Peptide Sequence Number=SeqID_120730
atggcaccattaccttctcggtcacccatttacaatcctcacagaccatcgaagcctgaaggatctcatgtccaaggtaagatttggctgtcgacggataatcccttcactactctgctgatggatgaattccataaaaccccattaggtggccacatgggtgtcgccaaaacattacatcacctccaggccaattttgtctggccccaaatgcgtaaggctgtccatcaatatgtggcacaatgcaccatttgtcaacaaaccaagtatgaaccaaagaagccgacgagtctccttcagcctctacctattccatcatctttatggaaggatctaacactggatttatcactggcttaccctcctctaatggattctcgaaaggtgcctacttcaatgcgttaccacctcactacacagcccaccgagtcgccgtcctcttcctcgacatggtgtgcaaattacatggatttccccaaagtttggttttggattgcgacccccttttcatcaatgcattttgtcaaagccgtatatactaagttgtccaaaaggtattatggcctattcttggttgaggagcgtatcggccctgtagcgtaccgccttcaattgcctaccaattccaaaatccatcctgttttctacgtgtccttactaaaattacaccagggccctttccctgacattccagattcattgccacctttgagttccgacaatcacccaattgtgaaacccctacaaatactagactccaaatgggactcttccactaatccaccatctaaactagttctggtacaatggactggtttggcaccagaagatacaagttgggaacagtgggacaacttgtgtgtcacttataaccttggggacaaggttagtttcgaagacggaggggatgatagcaataacaatagcctagtaacaactaacagaccccgaaggaccaccaggagaccaacacacctttcagactacccataa

SEQ ID NO: 3953 - DNA, 270 bp, Glycine max
  Peptide Sequence Number=SeqID_120731
atggttcctcaacattgtgatggtgttggaggaatagaatatacaattcacttcaagtgcaacaaaaaactgctgcgcgaatacccgaatcttttcaattacactaaagacattttccaaattcctggcattagtagcacagtgaacatggaacatataaagttgcattactatggaagtcatccttctatcaatccatttgggatcgttcccgtagggccaaatattgattattctgctcctcatgacagagaaaggttttctgcatag

SEQ ID NO: 3954 - DNA, 300 bp, Glycine max
  Peptide Sequence Number=SeqID_120732
atgacgaaggactacaaccacatgctcaatcatataaattcacgtgacaacctcatcatcatcaataagattatggatataattcgcagttctttagtgctagcagagagactttatgagcaacctctattatcgacagttcttccactaatgacttcgtccaagaaaagcaacctgttgctcctgatgaacaactttaacaacaagaacatggacgagtacgtcgacaatcagcaagaagcaggcaacctcccagatgtggaactagtggacacagacgacattaattgccctttttaa

SEQ ID NO: 3955 - DNA, 1683 bp, Glycine max
  Peptide Sequence Number=SeqID_120733
atggatgtctatgaacgagtttctcaattcctagccagctatgctttaagccttggaatcctgcaaaaaggaacagtgaacgattatctcactaagttcaagaggttggtcaaccgaatcgtgggtttagcatcccctttcatcctcagctgtttcattttcggattgacgcttgagctccgttgtgaagtccaagccctccaaccattatctctccctcaagccatggcattggccaaattgcagaaagataaaagtcacaatcgttgtcacagcttccgccctcactcgttctctctgttactgcctgcacctttgggccctgtaccgacagccgctccgcgctttcccatcaagcgcctttcgatggaggaactcactatacgtcacgacaaagggttatgctatcactgtgacgagaaatggattctcggcgacccccctgatggtgacatttctcgtaaagattaccctgcctcacctactgcttcggatgacccacctgaagtcccaaggttctcacaaataagcctaaacgtgttatctggcatgcctgctccaaaaaccttcaaattttttggaactatcgcccaccattatgtcattattctcatagatagcggtagcatgcataactttgtgcaatctcaagccgcaaagttccttaatcttccatctaccctttgtgtaatggttggcaatggcagcacccttgattttgatacctcttgtccgcaaatccccattgatattcagggacacacatttacaatcgaccttttctcgttacccctcagtggtgcggatatagtattcaaggttcagtggctcaaattactgggccctatcaccaccgactatgtaacccttaccatgaccttttcatatttgggccagcccatatcacttcaggctgatgttcccttcaagcccactatagcctcagcgcaacaagttaagaggctagctcacacccacaacatttcagccttattccacattacccacataccagaccaagcccacttttattctcttcgcacccctgacccagacacctccaccccacctaccatagaccttcttttttgtcattttgacgacattttccaggaacccagccaactcccacctcaccgaaatattgcccacaacattcacctcgtccctaactcgactctggctggactgatccagcccagttataatcccttttcttcgccagtcttactggtaaagaagaaggatagtagttggcggtgttgtgtggactaccgggccctcaatgcaatcaccacgaatgaccattttcctatgccaaccatagatgaacttctcgatgagctcggtcgtgtaatgcctttcgggctttgtaatgctccatcaacctttcaggccaccatgaatgatctccttcaaccattttttgctgaaattcatggtggcaaattttccttgtgtcgcactaaatgcttattcgctgtacaaaaactcaactacttagcccacatcgtatctcctcaaggtttttaccagaagtttgttcgaggttacgccaccgtagccgcaccattgatagtgctcttgcgagaggatcagttcctttggaatcctacctctcaggtcacctttgacaaactcaagtcactaatggcggaggcacaaccatgggagctattttga

SEQ ID NO: 3956 - DNA, 573 bp, Glycine max
  Peptide Sequence Number=SeqID_120734
ccagaccggcatctatccgctggccgcacccggtggctggcagctgattggtcacacgtcgcttagcctgttcgatccacaacagcagccaccgacgctactgcgtcccggcgacagcgtccgcttcgtgccacaacgggagggcgatcgcggccgccacggctggcggcaatacggcatcagcctgagcggtgcactggatgagccttcaatgcgcacggccaatatgctggtcggcaatgcggaaaacagcgcggtgctggagattgtgctcggccagtttaaagcggagtttcgtcgcgacggctggtttgcgctgaccggtgccagctgcagcgccgaactggatggccagccggtgtggaccggctggcgtctgccggtgaaaaaaggccaggtgctgagtctgtccatgcctacgcgcggatggcgatcagctgccgctgggcaagccgacgcgccgcttcagccatcaggctggcgtacggcagctgctgtggggcaaccgcatccgcgcactgccggggccggagtacaacgaatttacccacgacgcgcaggacgcattctggc

SEQ ID NO: 3957 - DNA, 219 bp, Glycine max
  Peptide Sequence Number=SeqID_120735
atgcggtacttgcaccgccgctccatctgcgggacacgctgcctggactcaccgccaggaagactttcgatacaagggatccccaaagctgagatccatcaccgccatcttactcgtctgagccgatcaccaagtcttcttttgtctataaaaaatcccttaatgaaggtcacaagaagagttgaagctatgagaggtgtttccacttccagagcttag

SEQ ID NO: 3958 - DNA, 594 bp, Glycine max
  Peptide Sequence Number=SeqID_120736
atgggagaaattgtgatcgtgaaggcatatcaaaagcaagcacgaaagtgctacatagaaagcctgaagatagcaccttatcctcccaccagggagcctgccaagccttaccccgcagcggctgaaggcctaaagcccatcaaagagctcgttatgttgcaactcaaacctaaacttgagcagtgtacgcagctcagtaaagacctcactagccatgagcacaggggcatcattgatgtcctacacaaaaacatggatttgttcgcttggccgccatctgacatgtcgggaatcaccctagtattacctgccacaagcttgccatttgtccccaggcaaaaccgggcgtgtcccaaagatgcataccctttgcccaacatcgacaggctagtcgatggagcgtctgaattccaggtgctaagcttcttggacgcttacttcgaaaacaaccagattaagatgcacactccaaatgaggagaaaatgatattcatcactgaagatgtcaacttttcttacagggtcatgcccttcaacctaaaaaatgcaagcgctacataccagagattgatggaccggattttcaagcagtag

SEQ ID NO: 3959 - DNA, 1203 bp, Glycine max
  Peptide Sequence Number=SeqID_120737
atggtggatgtggataaggtggacttttggacttcatacgtcggattgagagtgacctttgttaggaggacaagaggaagggcctgcaaaacaaaggactctgacgctcaaggttcgaaggaactagatacttataggagtggaatggagctacgggttcttgtttgtaggggtcgttatagtccttggccagacgtccgcgcttctgtgctagggctggcatggagggtggatacgtgtctcggagtgccatattgtctgatgtctagtgcaatggccttggcaagtaggagggtgacgagtttgtcaagcccccaagcatggacaagtgttgtccaggcgaagtctaacgtgttaggagagagggacgagcttgttaaagtggttgctgatttagaggcatggctaaaggagttagagtctaggttggaggagttcgagcatcgggcagccaaggagagggaggctagcaaggagctggcaatgtacaagaaaaaggctgtggagcagcatgaaaaggactttcaaaaggccgtcaggcaggacgtgaaggatggtgttctgcttgacttgggccaccatgatgaaagtgaaatctttgacggcataggaagcaagaccttgtggggtggaggcaagactttggtgggtggtgcttcctttttgctttggggagcttttcctctgattgatacctggttgaaggtcttgtcaactgatctactgataggttgtcttggcctatggactttctccactgatggttatgaggaatatgtttggcttgcccctggttggaggtcttgccaactagtctggggagttgcgttgaggcttaccaaggatgggcttgggttttgtgaacctggactcaccaaaggtgaactttggtttaacgagcttggtactcatggagtggcatgtactggagtcgtagcggcatgctcttgcacacatgtcactcatggagtggcacgtactggagtcgtagcggcatgctcttgcatacgtgtcacccgtggagtgttacatactggaggcatggtggcgtgctcttgcatacgtgtcactcatggaatgggctcaccatgggtggtccttgggtttgaagagccttggagttatgactacggatgtacctgtcttgacaagaaagttatgaaaggaaagggatgtagaatttcattcaatgtatttgattga

SEQ ID NO: 3960 - DNA, 327 bp, Glycine max
  Peptide Sequence Number=SeqID_120738
atggcagacctagaagagatctttagagagctccacaaatacgacatgggcctcaacttgaaaaaatgtactttcagggtcggcgaaggcaacttcttgggctttatgatcacacatataggaatagaagtcaaccctaacaaatgcactgctattttggagatgtgcaatcctactaatgtccatgaagtccaaaagttgaacagaagactagcatccctgtccaggtttctcccgaagcttgctgaaaaagcgaagtcgttatacaaattgctcaagaaaaccgagtcattcctatgggatgaaacctgtgaacaagctttctaa

SEQ ID NO: 3961 - DNA, 501 bp, Glycine max
  Peptide Sequence Number=SeqID_120739
atggagtcacatttgccaatgtttaaggagaagaatcatcaattagaggtggctactgagctcattcgtggtcagcatcctcatctgaagggtttttacattgtaattgatgattctcccatgcaatgttgtatgggattgaatattggcctgtataaagccaataagaaaattaagctcaatgttgcaaagatgagattgttaaaatggatgagtacatacaagacaagatgggatgatgaatgctataaagaaaaagttggagtaacacctatcgtgaaaaagatgttagaatctttacttagagaacaaaaaccagcgagtaatatgcatgaagaatatggatccagaagacttactaggctaaggaatgcattgggaaggaaggtagtaaaattgaggacaagacatgtaaccaaacaccctagtgtgcaagcacatccatcatttgttgctctagtgatttacaatctcataaaactaatcatcccagaagcttaa

SEQ ID NO: 3962 - DNA, 243 bp, Glycine max
  Peptide Sequence Number=SeqID_120740
atggtgttgggctacaatgatttggtgcatgatggagtttggatgatgcctcatttgtttcgatccctttgtctagctttgatatggtgtgggcgcaacctcagaggtcttaaagttcggacattccttgacagcctcgaagatggaacagaagatgatcccaacctctttaagagactcgtggtaggtggtgacgacattgttgaaaacactactgacattattcaagacaaagattgttaa

SEQ ID NO: 3963 - DNA, 237 bp, Glycine max
  Peptide Sequence Number=SeqID_120741
atggtgtgggtctggatgtggatgccctcgacagcgtcaacgaggaggagggatgtagggacccttcagcggtgccttcccagtccacagtcgtggcattgtaggcagcacaaagggcgggaacggcgcctcatggatggtgatcagcttcaccttcggcatctcagagtagctgaactagaactcgaacaacacttcaacattgtggaagaaaaaaaagcgccgcaaccatggtag

SEQ ID NO: 3964 - DNA, 180 bp, Glycine max
  Peptide Sequence Number=SeqID_120742
atgagtgagggtgaaaatgaggagaagctagggtgcacgagaacaagtgagggtgtacttgttgagcttcatcggcacatccgtgggggtctccacgacaatggaggttcgaacacagagagagtgaggaggagaattggatctgagaggagtgggaaaagagtatggaatgcattgtga

SEQ ID NO: 3965 - DNA, 195 bp, Glycine max
  Peptide Sequence Number=SeqID_120743
atggaggcaacgacattgttatggaaacaagattgtcacaaagcttcaaagatacaaaacatgcgatggagaccagagactcacacttttcatcttcctgttagagaatgcacaattacattggaggatgtagcaccaaagcttggcataagggtggatagtaggctagtcattggtgcaacgcactatgaatag

SEQ ID NO: 3966 - DNA, 288 bp, Glycine max
  Peptide Sequence Number=SeqID_120744
atggctgctatcagggatgaaaatggatcagattgtttagtagggatatttggcctcacatgtttaagcattgaaccagttcctgcgccttttctctgcttggctgtggctcgtggaagcactggcaactctaacttttgctccaatgggtgcaagccacaaagggaactcaccaagttgaagagatgctactgctgtatggaccttgatggccgaacaccactgtccacaaagcgcaaaccaacgctggctatggtggtggtggaggcagtggcttcgatggtggtg

SEQ ID NO: 3967 - DNA, 1869 bp, Glycine max
  Peptide Sequence Number=SeqID_120745
atgaatcagaatcgattggacttaagagctcatcattctggatcaacacaatcagaggagtcagctctggaccttgaaaggagctactatggtcatcctaacccttcctgtccttcacccttgcaaccttttgcaggaggtgctcagcattctgagagcaacgctgcctacttttcttggcctacattgagtcgctggaatgatgcggcagaggatagagccaactattttgggaaccttcaaaagggtgtgctgcctgaaactttgggtcgattgccaacaggacagcaagctactaccttgcttgaactgatgactattagggcatttcatagcaagatcttacgcagattcagtcttggcactgccattggatttcgaattagaggaggtgttttgactgatattccagctattcttgtcttcgttgcccgtaaagttcgcaggcaatggctcaaccatgttcagtgcctacctgctgcccttgaggggccgggaggtgtttggtgtgatgtggatgttgtggagttctcctattatggtgcacctgcacaaactcctaaagaacaattatatacggagcttgctgatggcttaaggggaagtgattcatgtgttggctctggttctcaggttgcacttcaggcaacccccaaagaggctgcaactaaggttgcaagccaagagacatatggaaccttgggtgctattgtcagaagccgaacaggaaatcgagaagttggctttctaacaaatcgacatgtagctgttgatttagactatccaaaccagaagatgtttcacccattaccacccagccttggacctggtgtgtatcttggtgcagttgagagagcaacatcatttattactgatgatctttggtacggaatttttgcaggaacaaacccagaaacatttgtgcgagctgatggggcattcatcccatttgcagaagatttcaatatgaacaatgtaatcacaactgtaaaaggtgtaggggagatcagtgatgtgaacatcatagatttgcagtctccaatcaacagtctcattggaagacaagtggtcaaagttggaagaagttctggtttgactactgggactataatggcatatgctctagagtacaatgatgagaaagggatttgttttctcactgattttcttgttgttggtgagaaccagcagacatttgaccttgaaggtgacagtggaagtctcattctcttgactgggcaaaatggggagaagccacgccctgttggcattatctggggtgggacagctaatcggggtcgtttgaaactaaaagttggtcaaccccccgaaaattggacaagtggagttgatcttggccgacttcttgatctccttgaacttgatctcattacaacaaatgaagcactccaagctgcggtgctagagcaaaggaatggttctgctgctggaattgattctacagttggagaatcctctcccactgtgccaataaaagaaaagcttgaagagagctttgagcctttttgcttgaatatcccacttgctcaagttgaagatgaaccctctcaaagagtcaacccatcaataaggccctgtgattttcatataaaaagtgagattgaaacagctccaaatgtagaacaccagttcataccaagctatgcaggcaagtctccggcctgtcaaagctacctgaaagaagacatggaactgaaaagtctagccgaacttaggaatggccctgatgaagataattttgtttccttgcatttaggagagccagaaatgaagagaagaaagatttcaaattcctcgttttgcatcaaagaattaaaaaacgcaaggcctttagcatgtggtgcctag

SEQ ID NO: 3968 - DNA, 345 bp, Glycine max
  Peptide Sequence Number=SeqID_120746
atggttcttagcctcctcctcctcttttccctttggggattttggccaccacggtgggaagctcacccaacatggtccacacacccaaaagcacccgcagtgaccatggggttggtttttgaaggagataatggtgtggggaagtgggcaaagacagaggagaagttgttgaaggagaccatattagaattaacattagggagtggaggagggcaaatccattgtaggcacgaacacggtggttttgtttgctggatgggaggcggtgttagatgcggttgtgcgcagctaccatgttgggtgtgtttgggtgcagtgaccatgtggggtgcgtttgtcatctaa

SEQ ID NO: 3969 - DNA, 939 bp, Glycine max
  Peptide Sequence Number=SeqID_120747
atgtctatattggcgttctatctgagctattttattctcatttctaattattcactttcacaaagtagtatctgccttccaaaaaatcacacagctctgttcatatttggagactcattgtttgatgttggaaacaataactacatcaatagctccacttttttgcaggcaaacttccccccatatggggaaactttcttcaattatcccactggaaggttttctgatggacgtgtcatcccagatttcattgctgagtatgcaacgttgccactaattcaggcatacctgagtccagctggatttcaggatcattacatatatggggtgaattttgcatcagcaggagctggagctctggttgaaactaatcaaggactggttatagacttaaaagctcaggtaaaatacttcacagaagtaagcaagcaattcaggcaaaaattaggagatgaggaagccaaaaagttgctgtccagagctatctacatatttagcataggaggcaatgactatggcacccctttccttacaaacttgacaagtggtgcggttcttccatgcccccaacaaaaatttgtagattatgtgattggtaacattactgccgttatcaaagaaatttacaatgaaggaggaaggaaatttgggtttgtaaatgttggtcctttaaattgctttccccttctaaggatggccataaatagtactagcttaagtgcctgcctagaagaagaagcttcggccattgcaaggttacataataatgctttacccaaaatgcttcatgggctagagaaacagctaaagggattcaaatactcagttaccgacttctacggtgcacttattgaattaatgaagtacccttcaaaatatggttttgaagaggggaatgcatgcagcttgttgtggaggtggtccctacagaggagataa

SEQ ID NO: 3970 - DNA, 267 bp, Glycine max
  Peptide Sequence Number=SeqID_120748
atgaaaataagagagatgtttttcttgagtgtgcaaaacttggtcagaaagggtgaagacatgcaactcgcaggagccattggcgagttcggggacaaggtgacagctggcactggtctcgccagtggtgttagcgctttcagagtaggttgcaggaagcgttgcaggaagggtggcagctttaagcagttgaaaacgccagtgctactggcgatttgcgctgcagttggagtagccagtagcactggcgagttgagcttcaagtag

SEQ ID NO: 3971 - DNA, 288 bp, Glycine max
  Peptide Sequence Number=SeqID_120749
atggatgttgttggtgctctcaagaggcaggttagggttctctatggttgcagtggtcgtcgtggtggggggaagatggtggataaagagtttccatggtatcgcacaaggctggcaagtggttccgggtactctcaaaatcaatcacaagggattgagctagatgtacatagggagaaggtgtgtgttgagacgaaagggatgagtcttgcagaagtggttgtcagtggaaggctgtgtggagaggatgccatggaaagaggtggtttagctggtggtgtggactga

SEQ ID NO: 3972 - DNA, 1299 bp, Glycine max
  Peptide Sequence Number=SeqID_120750
cccaaaatctaccctaaggctcatgagaaccttagggccttctcttgcatctctggcccaatcttcttggagtcttctatccaatacccttgggggatgaacgacaaaccttttgggagtgctttaggcaacctcatgtatgctcagagagctgctaagaaagtgataaggtacttgttgaagactaaggagtatatgcttgtgtataggagagttgacaacttagagtttgtggggtacacaaattcaaatctcagtgggtgccctaatgataggagatcgacttctggatacatctttatgatggatgggggtgtgatatcctggaatagtaagaaacagtttcttgttgcctcttttactatgcaagcagagttcattacttgtttttctactgttactcatgttaataataagacttctaaaggatctaagcacttggagttgaagcacctgactgttagagatcttgtgaaagatgtttccatagtggtagagcatgtggacatagatttcatgttggctaatcccttgaccaaggaactcaggcctgttgttttcaaacgacatgttgaaaacatgggtattgtgagttcttttgatatgcttgtgttcgaagagatcaccaatgctaaggatttccttgacaaactagagaaatgctttgcaaaaagcgataaagcagaaacaagtacattgttgcaacacttgatatccatgaagtataacaaaaaaggaaacattagagagtacatcatggaagtgtctcatatagtttctaagcttaaaggaatcaagctagaactatctgaagacctcttagtgaatttggttttgatctctcttcccgtgcaatatagtcaattcaagcctagtcttaagcactttcacatttggggatgtatggttgaagcacaaccttataggtctaaggaaaagaaattggtatgcaaaacaattagtagttacttcattggacactctgaacactccaggggctataagttttgggatcccacacttaagactatatttgaggatgttgagtttaggaggaataaggctatcatacctattgttgttcaagaagtaaatgcagaacctaaacaagataacgttgaacaaattcctatagaacaacctcaacaacaagtgcctttacaacaatctattagagagaggaaaaatacaattccagatgattacattgtgttccttcaagaacatgatggagataatggtatgatgacggatgatccaatcaacttccatcaagccatgaaaagcactaactcttaa

SEQ ID NO: 3973 - DNA, 994 bp, Glycine max
  Peptide Sequence Number=SeqID_120751
ggtacatctacttggggattgttatactgagaacaagagagagtacatctcttgtggatcagttctagtggagggtacatccacttggtttttcaaagagaacaagggagggtacatcccttgtggatctttggcttgtaaaggattttacaaggttgaaagaaatctcaagaatcggttggttgcttggggactggacgtaggcacgggttgtggccgaaccaggagatattatgttcatgatgaggataccgttgtatactacctttgcagcaaagtttggcatagggcatccaaatgcaaggatcaacctagaaaagatgtccttgacaacaacaagcaaacacctatcatggtacctagacagtggttgctcacggcagatgatagcataaaggtatatgttcaaaaagggaaaataataagaatggataagatagataacttgggaaagagtgattcaaaaagtgataatggaacattttttgaatactctgaaacatctaaggcattcatggtttacaactttataaccttggtagttgaggaagctattcatgtgaagtttaatgatactaggtctgataaagatttatcacagatagataagccctttatagatatgagattggacaatgatattaaagataaggtgtcatccatggaacccaaacacataaacgaagcaatgcaagatgagaattggttgaaggctacgcaagaagagctcgaccaattccaaaagaatgaagtttggaagttagtagagctaccaaaagataggaaagttgttggagccaactgggtcttccataacaagctagacgagaatggtaaggttgtgaggaataaggtacgattagtggccaaaggttactcacaacaggaagggaatattctagactcacaagttattgtgatgctgactatgttggagataagcttgaaaggaagagcacaagtggaagttgtcacttcattagtggcaacctag

SEQ ID NO: 3974 - DNA, 345 bp, Glycine max
  Peptide Sequence Number=SeqID_120752
atgacccctactcatgatgccctgctatattacaatgggaggtggaacatgccacgccaaaatgagtttgttggttactcgttcataggaaaaaatccaaaaaagtttgacattccttctagatgtaccatcgatgaactgaaggacttgatcaagcgtatttcacctcatgggattcccccttatggtattcatgaatcacaaacgctatgtacggagtgggtcactgctttgcttgagaatgacaatgtgtactctacactccacagcaatgccactggtggcaaaggacaatggtctcgtaacaacacttgttacataacgacagtggtaattgaacgttaa

SEQ ID NO: 3975 - DNA, 1296 bp, Glycine max
  Peptide Sequence Number=SeqID_120753
atggagattaccaccatccaatctgatgacaaaccaaccatccatgtcgaacacttcattgacttcatcgagttagaaaaagttggtgtcaaactcaacgagacattgttattctgtgctatcgtgtccaaagttcttggggtgaaggtgaatctgtcaagtgactccattgccaaggctgctgggtgtctttgtgagggcaacacataccatgaaggaattttacaagatagtgaaactctcaagagagttgcttggggactggacgtaggcacaagggatgatgatgatgatgatgatgatgataatgttcaacttgctctgaggaaaaggaaggaaaatgctcaaaaacaagcatttcttgctcctaagaaggctagagcagctaacaaggaatggactctgccctctcctccttcatcatcaagcaatgaaaccacacgtgaggcttccatctcaccatggagaatgtgtccatcttctacagagcagcatccacctccatctcctatcaatccagagattagtgcaatgcgagcctactcaaagagcaaccaggccattgcatatccacctggtttgcatatctccaaggccactgagatcaagattgttgcagatagagttttccctcgtctacctatatggcatgcagcaaagaagaaatgcttcaaactctattattatgttgagatgcctagtaggcagatgaaggacgttgatagctacgacttcatcaccaagttgaagaaccttcccatcatcttccatgaaactacttatgatcttacgaagatggatgaaagggacttaaaagatcatgctgaagttgttactaaggttgtggacgacaacattgttaatgaggtcatcatttatctcactaacagtggtgtcatggatgaaggcccagatgtgtccaaggaaactcaagctgatgaggttataagtcaacaaaaggaacttgcatccaagaagtcagaaacctcacatgaagctacatccagggaaaaggatgtgcttgatgcggtgattgtctactccacaagctcaagtcccactcttataaactatgcacctccaaatgttgtgatcagagatcaagttcaagatataattattgttgcaccccttattgttgtacttactattgcaacaccacctgatcgtccacctctatccctccaacaaccacctactcttgagcaacaactaacaacaagtgttccatttgtcgatgttgaacctacaccaccaccagaacaacctcctctaccatcacaagttcaagagtga

SEQ ID NO: 3976 - DNA, 471 bp, Glycine max
  Peptide Sequence Number=SeqID_120754
atggccaaaatacaagagcaatgtaaaaatggtgtcaaacttttcttcttggcttccgcttctaacaaccctcctccgccgccgccggtgaccactgaagttgcggtgcataatgagacaccggttgagcttgtgatcaaagtccatcgtcttcactatctcctcacaaatccacaaattcctccgcgatatgcttctttggcagatcgcaatactggaaatgtctcttctgagtttttgctttgggaacaacaggctcaacttctgtcgtggcttcaatccacgatttcaggtgaagttctccctcatctcatcgtctattttgttccagcaactgagcatgttgataacattcttgatggactacccgatgagtttgagtctctggtcacgctcatcagttgtagatttgagtctctcacaattgatgaagtcgaaactctccttgctcgtgagactcgcattgaatag

SEQ ID NO: 3977 - DNA, 789 bp, Glycine max
  Peptide Sequence Number=SeqID_120755
atgattgcaaaactgaaaggatgttttgaagagttgatttgtgggaatttggcatgttgctggattctgatgtcactgattttgagcaattattcaatgaatatagagaaatatgatagtggtcaattgttgtcagacactattcaacctgctgatgttggccttaaagaagaaattgcagacgatgatcgagggcatggattttttggcgctaatgcacttagtagattagctcgatgggctcaaccaataacttatgtagacattcatgaatgtgatagttttacggtgagcttcaccatttattacacaccagtgacaccactactgcctctgcactgctgcaagcttcatgtctatgctcgtgtatgtttattgaagtatgtttcattcttgtcttctgagtactggtatcagatgtgtatattttgtttccctacttcttcagttattcctctccatgaccatcctgggatgactgtatttagcaaacttctctatggctctttacatgtgaaagcttatgactgggttgagcctccctgcatcatagaaagcaaagaaccaggatatgctcaagtaagactagcaaagttagcagttgataaggtcttgaatgcaccgtgtgatacatcagttttatatcccaaacacggtggaaatctgcactgtttcacagcagtgacaccttgtgccatgctagacattctcacacctccttacagagaagaggaaggaaggaggtgtacatactatcatgattatccttattcagcattctgtaagtaa

SEQ ID NO: 3978 - DNA, 411 bp, Glycine max
  Peptide Sequence Number=SeqID_120756
atgaagatatgtgaaggtttcatgtatggagaatctttagtaatagatcttgagtttgatcttgagctcaaaatttggtctttaaaagatatacctctaaaggagggagttgaaatcttcacactggatgatgagatcttctacaagatccctcataacttctgtccaggcattgatccgaccacgatccgtcacgatcatggctctcctcaacactctacttccaccgtcacaccatttggcaaaaacacattgtcctccttgatgctccgcacagggagggtaggttgtagagggagggtggggcttcgagggaaaaggaaagggggaatagggaaggtagggcgccaaagggaacgggaaagggggaagagggtgggtggggcagaggggaagggaaaggagatctaa

SEQ ID NO: 3979 - DNA, 143 bp, Glycine max
  Peptide Sequence Number=SeqID_120757
gagaaaaagctgcaaagttgaacgttgagaacaacaaaagagacatacccagaatcgaagaaagcttctgcaaagcttgggacgaaggagggggtgatccagagggcgataagatggttttgcaatgttcatacaaagcctga

SEQ ID NO: 3980 - DNA, 360 bp, Glycine max
  Peptide Sequence Number=SeqID_120758
atggcagaatcgtcaaagaaatgtaagggttcatccgcctccgcttcggcttcaagagttcatcgttccggagccaccagcacatccacaacaccaatttcaccctccatatcctcttccacattgttttcttctgaagaacagcagaaaccgtactcaaacctcttctcatctcgttccattatcgaccctaagttcattgatatggaattcttttatgctgaaacctttgattgcattcaagcatttcagaatttaggtctcatacctttcatgtcattacaattgcctgtttatcctgaattggttaaagccttttattgtaatcttgaaattcaggacaacactttgatttctgag

SEQ ID NO: 3981 - DNA, 204 bp, Glycine max
  Peptide Sequence Number=SeqID_120759
atggaggaacgtcgcaaggggggaaggagctgcgcaggggattctgaaaatgtgatatttatagagcaggacgcgtggaggaggcagcctactggtaatcgattacatgaataccgtaatcgattacaggccatctgttctagtgtaatcgattacagtattcatgtaatcgattaccagaacaaaaaaatagccttttcctaa

SEQ ID NO: 3982 - DNA, 354 bp, Glycine max
  Peptide Sequence Number=SeqID_120760
gggcaaacaagcccgttgacgcgcaaagacttacgtcgtcttctggaccttttgtcatcccaaggcaacaagcccgatgacatgcggggggtgaacgagcccattgatgcgcagagactaacgtcgtctcttgcacctttcgtcaaccaggggcaaacaagcccgttgacgcgcagagacttatgtcatcttttgcaccttttgttatcccgaggcggcaagcccgatgacacgcgggggtaccgtatggttatccgcatctttcgtcaaccaagggcaaacgagcccattgacccgcagagacttacatcatcttctgcacattttgttatcccgaggcggcaagctcgatga

SEQ ID NO: 3983 - DNA, 1229 bp, Glycine max
  Peptide Sequence Number=SeqID_120761
atgattagaacacgaggttttggtcatgctttagctagggttataggcagagttagacaggatgaggatgatgcaggtgttccgcaagtgactgaggatgttcctcatatggcggaggatgttcctcaggtgattgagaatgtccctcatatggctgacgatgttgctcagatgagtgaagatgcgcttcagatgattgcggacgtagatgcgactattgcaaaggacttagatcatgatgttctgacttcatttgcggagcatgtcgcacaggccatttggactggacaagagtgtcctgagttgaagttggtatcgcacgagaggaaggtggcgttaattgggaggccagtgcctgcgattgaagggttgggagaccagcaccttccaccttccaatagagagttgatgatcacactagatgatgtgtcgtcactcttccatctccctatcagtggcaccttccacagcttcgaggctctttccgtggacgaggcggtatttttgttgatggagttgcttgaggtgtccggtgaggaggctagagccgagacagtacgagggcgcggggcatatgtatgcctctcatggagtgcaacaactattcatgtggtgcatctagaggcttttcgcgacctgggtcagagtgggggctatgcctggagagctgcggccctgtgttggatctatgagcattttccgagtgtgcatcagtacgtcatcgatgatgcgtatgaggagacgtcccctcgttcctcctggtggctgacgatgaaggctcatacaaagggaattacaggagcgtcgtaccaggcacgttgtgatgctttgacggtcacagacatgtgctggttgcctcacagtgaccatcgagggctcagatggggtcctatggtggtcacagttcgaccagagagggtgctttgccagtttggatacattcaaagcatccctccgccgtctgttagcgcttcattgtcatatgatgatatagattacaggtggatgcatttctcggacaatgtagtagctgtgggtgacctttgtgtagtgcctgggcaggtatcggcggattacatggagtggttttctcagatatctcactcattcatgataccgacccaggcaggtgaacagcccagacatgcacctgccccagaccatgaggactacatgcagccggacatcccacagttccagtggcatttgaccccgctcgacatgcagtg

SEQ ID NO: 3984 - DNA, 267 bp, Glycine max
  Peptide Sequence Number=SeqID_120762
atggttagaactagaggtcttggtcaggctttagggcgagcaataggaaaagtgttggggaagagagacgagacccgtagacagcgacagcaacaggttgttgtcgaggaccctcctacggccgaggaggaattggtcaacgaccagccaaaagcacctattgaagaaggtgctgctgatgttgagggttttccaggtggaccccatgacacatcagttttgagtgatcttgaaaatcacattgctttgaaagtgtggaatggagag

SEQ ID NO: 3985 - DNA, 243 bp, Glycine max
  Peptide Sequence Number=SeqID_120763
atggacaagccattgatcgagcctaatgggttgacggagttcaacctaataattatggtcactatcaaggaaattggaatgttatatatacggctattggaagtgctaattaaactactagttgtttatgccgaacaagaaattatgtgcatggaaaaggagggggaagcactcctccaattaaaggcttcccttgtggacatctgtgtttcctgcgttctatcaatttttcaacttcattag

SEQ ID NO: 3986 - DNA, 222 bp, Glycine max
  Peptide Sequence Number=SeqID_120764
atggggtgggtgaacagtgaaatggggtatggtgttaccgttttgcccttgtcagtggtagccggtgagttttctagttttctttggttttggaaagtggtcagcaagcatcatgtgcgcagaccacacgtgcctggcacaggttccttttctggtttattattacgcaaaaaatgcgggaaaaaagggacagaaagtaataaatatggaatgcatgattag

SEQ ID NO: 3987 - DNA, 861 bp, Glycine max
  Peptide Sequence Number=SeqID_120765
atggcgattgtgctgatggatcacctgctgcgccagcgtgggcagaacgctgacgtcaacagcagcgtcccgcgctgtgcggtcagcctggctgccacgccgtggcagcaaatccatcaaccgattgccggcagcccgcagtccatcggcagctttgccaacggctgtatcgtcggggcgcagcagctgccgctcaactcgcccaactatcaggtgatgcgtcaggatcagcgtcgttattacggccacccggacctgatcgcctttatccagcgcctcagcacccaggtgcatcagctgcagctgggccaggtgctgattggtgatatgggcatggccgccggcggacgtttcagcagcggccacgccagccatcagaccggcctcgacgtggatatctggctgcagctgccgcagagccgctggacggcacagcagctgctgaagccgcagccgctcgatctggttgggccggacgaccgccaggtgattgcgcgtcactggcagccgcagatcgacagcctgatcaagctggcggcgaaagatgacgacgtcacgcgcatcttcgtcaatccggcaattaaaaagcagctttgtgccgatgccggtaacgatcgtgcgtggctcaacaaagtgcggccgtggttcgcccaccgggcacacatgcacgtgcgcctgcgctgtccgccgggcagcctggagtgtgaagatcaggcgccaccgccgccgggcgatggctgcggcgcagagctggagagctggttcctgccgaagaagccgggcactacgccgccggtgaagaagtcgccgccgccgttgccgccttcctgccaggcgttacttgataagcatctactgtag

SEQ ID NO: 3988 - DNA, 617 bp, Glycine max
  Peptide Sequence Number=SeqID_120766
attgcggaagcgccggtgcatcccggcctgttcgtgctcggcgcactggggtcgcgcggactgtgcagcgcgccgctggcggcagaagtgctggcggcgcaaatgagcggcgagccgcaaccgctggacagcagcacgctggcggcgctgcatcccaaccgttactgggtgcgcaaattgctgaaagggaaaaaggcaggacgctaaagcgcggggcgagcgatcgccccggccagtcaggcagtgaggcgcgcctgggtaaacaggttatcccacatgcccaccaccagcgcctggtcgcgcggcgacagttcaccggcggcgatggcgttttgcaggctgttggtgacctgaatttgcagcgcttccggcgtgtgttcgccgctctgctcaatttccgctactgccagcgtcagatggccacgcagataaccgctggcaaacagttcgtcgtcgctggcgtgttcgaccatatcgtcaatcagcgccagaatgcgggactcgaattctacgatcatcttctcatcatccttcatttatcggagtgcggctcacagatcttccggccacggaaactgtgccgccgtcagtgcaggcgtaccataatagctggctaa

SEQ ID NO: 3989 - DNA, 465 bp, Glycine max
  Peptide Sequence Number=SeqID_120767
atgtttcacggttcaaatgtatttgcaacaactaacaatcaaggaacaatagttgactctggcacaacattggcataccttgttcaagaagcttacaatccttttgtcaaagttaaaaatatgcaaactgaagaacctagttcacgccaaccaactctacagtcttcacaccaaccaactccagtagagagttctactggtatagctgaaggtcctaataatgaacttatgcaacaaccacctagcatggaggtggatgaccatgttgcatcgtcaacaaaaactggaggaggggggctcaaaagtattgtgtggaaccattttgataagattaaaactattgatgggcaagacaaggcccaatgtaaatactgcaaaaagtttctcgggggagggagcatcaaagaatggaacaaagcatttgcatgcccatatggagaaatgaattcagaaaaggttacatga

SEQ ID NO: 3990 - DNA, 276 bp, Glycine max
  Peptide Sequence Number=SeqID_120768
atggtggaggcgacaaaggcaaggtgtggtgatggtggtgacagtgaaaaggcaataatggtggtggaggtggcattggcggggtgtggtggaggtgggggcgatggtggtggtggtggtgggaaaaagacctacgaagaattcaagattgtagtaaatgtcatgagcataaaacctaggattggcttaggtgtaagacaaatttctatacacttgaatgctttgggtaggctacctatcgtgggacgcaatgaaaaggaattgctacaacaataa

SEQ ID NO: 3991 - DNA, 558 bp, Glycine max
  Peptide Sequence Number=SeqID_120769
atggatgtatctttccattggtttgacagaagaaaatttttaaagggaggaaaagcataccagatgtggtatacactttcaaagactttggccgaagatgctgcctggaaattcgtaaaagagaacaacattgacatggttactattaacccagcaatggtgataggacctctcttgcaaccagtccttaacacaagtgctgcttcaattttaaacgtaattaatggtgcacaaacatttccaaatgcatcttttggttgggtcaatgtgaaagatgttgcaaatgcccatattctagcatatgagaatgcttcagctaatggaaggtattgtttggtggagagagtggcacactactcagaaattgtgaagattttacgtgatttgtacccgacattacaacttccagagaagtgtgcagatgataacccatatgtgccaatatatcaggtatccaaagaaaaggcaaagagcttggggattgaatatactcctttggaagtgagcctcaaggagactgtggatagcttgaaagaaaagaagtttaccaacttttaa

SEQ ID NO: 3992 - DNA, 225 bp, Glycine max
  Peptide Sequence Number=SeqID_120770
atggaaaacattagtgcaaacttcaagaatcccccctcaacaaaagagaggaaaagaggaggtcttgatactaaaggaaaccgtggccaaggagaagggacaccatggccaaggaacaacactaaggatcatccaaggaatagaggaggccttgatactaaaggaaatatgttgccttgtactttttatgtttacagagagaaaagaccagacaatggacaataa

SEQ ID NO: 3993 - DNA, 309 bp, Glycine max
  Peptide Sequence Number=SeqID_120771
atgtcttcctcatctgtcaaatggttagtgcactacgatggtcaaataatcaaaacaaatgaaagggatacgtttcaaagcccccatccattgttctttgaaacaaagcgaggccttgaaaagaaaaatctaggaaaggctctgtcttcaaccatggaccaagaggaagatgatgaggaagaagctgagcatgtttcaccaattacaatcgtaccaccatactacataccaccatacatgcaaaatttagaagaatccaattttcaagattttgaatatggtcatagcttggatcacgaagaagtttaa

SEQ ID NO: 3994 - DNA, 261 bp, Glycine max
  Peptide Sequence Number=SeqID_120772
atgaagaacatgagcaaccacactcaggtcgccaatgagggtggtcaccggaggtggttccctagagttgcttggccacagcttaggaggttcacaagagagaaggcaagtgaaaccatagggttttttaaaaatgataaaaaaaaagaaggggaagttttgccatgggcgttgtggcaggcaggcactatggcagacggccatacaacgacaaataacgaatggggaattgcaaaggggtccaaaatcgccacattatag

SEQ ID NO: 3995 - DNA, 582 bp, Glycine max
  Peptide Sequence Number=SeqID_120773
atgagcagcggcgctggaaaggtggtgtgtgtcaccggcgcttccggttacattgcttcctggatagtcaaattcctcctcaatcgcggctacaccgttaaggccaccgttcgcgacacaagtgatccgaaaaaaataaaccacttggttggcctcgacggtgctaaggagaggctgcacctctacaaggcgaatcttctcgaagaaggttcctttaactctgtcgttcaaggttgccatgctgtgtttcacactgcttctcccttttatcacaatgtcaaggacccccaggctgaattgttagacccagctttgaaggggactctcaatgttctgaaatcgtgtgtaaacttgccgacgctggaacgcgttgttttaacctcttctgttgctgcagttgcgtacaacggaaagcctcgaactcccgatgtagtagttgatgagacttggttttctgacccgggtttctgtagggaatcacagaatcaggaattgggatacatgctttctatctcaaaggtcaattatgcaactttccttgctactattagcttcaaacatgggatgcttctgctctattaa

SEQ ID NO: 3996 - DNA, 477 bp, Glycine max
  Peptide Sequence Number=SeqID_120774
atggaaattcctcaacagtggttcaatgattcaaagttcttaggtttttctctgtgccttgtaattggtggcttccaacaaaacagttatgaagggtgccatgaggttttaattcagatcatatgcttatgctactatcccacttttaatgcctccattctgcaagatttcaaggatataggcttgtactttgatgccaacaacttaaggctcagaatcatctttaaatttaagggtccatatcaacggttggacattgtaaagaagtgtggggtcagacctctgttgattgctaatactgaaaggcttcacatggaagtgaactacaacctgaatagaagggagtatgaaagtgaaactgagattttgatgaaatatattatagctgagaactttgaggattccagtgatgatccagtaaactggtcttattccttgaagaggtccaaaatggtttgtagcccaaagatccgatga

SEQ ID NO: 3997 - DNA, 1083 bp, Glycine max
  Peptide Sequence Number=SeqID_120775
atggggatacttggggctactatcctggactgcccttgctattgtcgttcagtgatttcctgtatgagtttttcgtggggaaatgtgtcaccagggtgtttatggtgtggaatttgctgccttggatgtacactgttcggcatcagcctggtctcagagagtttgctctttcatcaccccgatgcttgtgttgtagtgttctctgagatggtggagcttgatttcttcaaggaaagctttgttaaggatgggtacaaagtggctgttgcgattttaaggtacaaagtggctgttgctacgccaatgcttgatgagctgctgaaggatatgcctgctcacatttttgctactgtgtggtttgaatggaagaagacagggttctgttcgactcattacagtgagcttatccaccttgctgctctgtacaatttgttcataaaggagtgtttggaagagttcaacatgacatatgatgataccagtttgagaggaaatggtgttgatccattgacaagggttgatcgaaaatatttgggagaggagaataaatctgttaagcacttggagttgaaagtagaaccctcttatatcttcatccctgttagttctcagaacataacaaggagaccgttatttgatagtgagatgggtatggcagtctcattcctaacggaactagagcgcttcagaatccaacctcacagtgatgaccagtgggtgtggaaggcagagccaagtgggcagtatacagccaaatctgcttatagtgtgccttggggggaggtctctagtgagcaccaggatggagctttcaaggagttgtggaaccttaagcttccgcctaaaatcgtcatatttgcatggaggctaattagagacaggctaccaaccaaatcaaactttaagataactccattgtggtgggagtctttgtcttgggtgaacatcatgggtgcttttcccaaatcacccaaggcaacactttctccaacatatacatggagtgacagccgacatgaggtctcacagatggaaatggtggtgggctgcattgacatggatcatttggatgcaaagaaataa

SEQ ID NO: 3998 - DNA, 335 bp, Glycine max
  Peptide Sequence Number=SeqID_120776
atggaagccttttcaagtgtctttgcttactgtcaacatctcaagtcactgtcggatcaactcaagaacgtcgactttccggtcgataacagtaggttggttctgcaattggtgttcagtctcactgaaccctacaagagagtggccacacttatccgtcaaagtgatcccttgcctcaattttatcaagcacggtcgatacttgttctcgaagaattctgcctcaagaaggcggctcagacctcgtcctccgccatggtggctcgtgacttggacgaatctcaagaaatgtctgatcattcatcagcacgcctcacaaataatggtggaaaaca

SEQ ID NO: 3999 - DNA, 1605 bp, Glycine max
  Peptide Sequence Number=SeqID_120777
atggcgattttgctgggcgaaattcttcaatcgctggagctgtggctgaagctgatcaagaacccgcagccgcagccctacgtaaaccctaatctggaccccgttttgctggtgcccggtgtcggtggctcgatgctgcacgccgttgacgaaaccgacggaagccatgaacgcgtctgggttcgcttcctcaacgccgagtacacgctgaagaccaagctttggtcgcgttacgatccttccaccggaaaaaccgagtccatggatccaaattcaacaattattgttcctgaagataggcatggactccatgcaattgacattttggaccctgacttgatgtttggaagtgattctgtgtattatttccatgacatgatcgttgaaatgcgtaagtgggggtttgaagagggaaagacgctttttggttttggatatgattttcgccaaagtaacaggttgaaggaaacaatggatcggttagctgcaaagttagaatcaatttataatgctgcaggagggaagaagataaatattataactcattctatgggtggtcttttggtgaaatgtttcatgtgcctgcaaagcgatatttttgagaaatatgttaagaattgggttgcaatttgtgcaccattccagggtgcaccgggaaccatctattctacctttttaaatggaatgtcatttgtggaaggatgggaacaaaacttttatatttccaaatggagcatgcaccagttgctgattgaatgtccatcaatatacgaacttatgggttgtcctaattctcattggcaacatattcctgttctggaattgtggcgtgagagacgtgattctgatgggaaatcacatattgttctggagtcatatccaccatgtgatagcatcgaggttttgaagcaagctcttttaaataacacagttaattataatggtgtggatttgcccctgcccttcaacttggagatcttgaaatgggcaaacaaaacatgggagattctgtcttctgccaaacttccctcacaaaaatggtattctgtgaagtgtattaacaatggactattggatgcaagtagctttggaagtggggacaagcctgtcacagatctgcaacagctatgttatttccaggccaaatacgtatgtgttgatggagatggaacagttcctatagaatcggcaaaggctgatggtctcaatgcggaggcaagggttggtgtgcctggtgaacatcagcgtatccttcgtgagcctcacgtattccggcttctcaagcactggctgaaggctggagaacctgatcccttttacaaccctgtcaatgattatgtgattctacctactgcttttgaaatggagaggcataaagagaagggtgtagaagtagcatcccttaaagaggaatgggaaattatttctaaagtccaagatgaccaaagctgcacagcagataaagtgtgctccatatcagtttcacaagaaggagccaatcaatcttattccgaggcgcatgctactgtcattgttcacccagacaatgagggtaaacaacacgttcaactgaatgctttggctgtttcagttgacgcctcatga

SEQ ID NO: 4000 - DNA, 240 bp, Glycine max
  Peptide Sequence Number=SeqID_120778
atggagggaatgatctacattgaaatgcataatgcaaaaataatttcaactgtagaacaaacatgtactaagaaaagtgtgttttcacactctcatgcagcggttcacgctctcactctctctcacggtggttcacactcgcattgtggttcagagtgtgttctcattctctctcacacggtggttcacgctctcactctcacgttactaaacaatgctttgacgggattcaaaggataa

SEQ ID NO: 4001 - DNA, 1290 bp, Glycine max
  Peptide Sequence Number=SeqID_120779
atggtggaaacattaccacaccatactcctcctcctcctaaccatcaccaagtcttggttctaaaatctgcaatatgttcgagactcctcctcgtaaccctaatcatcctcttccgaaccctcgtttccccctacgacacatccgcatccttaaaccctccatgcctctccacccccaaccccaactccaccacccacccttcccccctcgaaaacggcgtcgtttgggactccgtctacttcctccgcatcgcccaatgcggctacgagtacgaacaaaccttcgccttcttacccctccttcctctctctctctccctctcttctcacaccctcttcgcctttctctctccctttctaaaccaaaggcccctcctcgctctctccgcttacgtcatcaacaacatggctttcgttctcgccgctctctacttctacaagctctccctcaccgtcttgaaggacccccaaatagcgcttcgggccaccgttttcttctgctttaatcctgcctctatattttattcatccatatactcggagagtttgtacgcgcttctgtgtttcggaggaatgtaccacttcatgtctggtgggaacaatttggctgttcttttctttgcgctctccggttgtgctaggtctaatggggtgctgaatgctggctatctctgctttcagactatgcatcgcgcttatcatgctatgtttcaagaaaagcgtgttacttgtttgatggctaattttattgaccgagtatggatgcttatgatattaggtgtggaagttggggggtgtgagactgaatacttgattgattctttgtcattgtaccagttggctttgcagattgttattgctggagctttacgtactgcatgtatttttgctccatttgtagctttccaggcttatggctactacaatatgtgtgttggacgttctcctgatgaaataaggccatggtgcaaggcaagaataccattactttacaattacatccaaagtcattattggggtgtaggtttcttgagatattttcagctgaaacagttgcctaactttcttcttgcttccccaatactgtctctggcactttgctcagttgtccattatgctaagtcaaggcctcaaaactttctctcactgggttttttagctcctatggaagaaaagagccgtggagttgtgtttttattagatgaactctcaaggtccaaagaagcccgaagtgtgaagaaatcctctgttagggtagaaggtatggttctgaaacagattgtgttttag

SEQ ID NO: 4002 - DNA, 672 bp, Glycine max
  Peptide Sequence Number=SeqID_120780
atggtgatgtttttacacatcgttgctcacaaccttgagtatagagttgtgcatttggattattacagatctaaagaaacaataagcagtcaattcaataatgtcttgagagatgtaatgaaagtgagcgaggactatttgaagtttcatacatataatctagaaggtttagaggcaattaaatggagttggtttgagaattgcgttgtagcacttgatggaacacatattccggtattagtttttcttgaagataggcctaaatatcgtaatagaaaaagtaatgtctctacaaatgtgttagcagcttgtggtccagatttaaggtttatttatgtgttgtctgggtgggaaaggtctgttggagattctcaagctggagatttagagcttttattcattgttgatcaagtgttaactcgaccaacggaaagagttcaaaacaatgtgacaaatgatgtcacaactattcaagtcactgaagagtggacaagatttcgagatacattagcaacgaacatgtttgctaatcatcaagttgttgatgatgaggaagaagccccctcaacgttgaaggtcgacaacatcagcaacattgacaagggcaactgctttttgtttttgagtgagcatgtggatcatgatgctaacaaggttcatgagaagccttag

SEQ ID NO: 4003 - DNA, 360 bp, Glycine max
  Peptide Sequence Number=SeqID_120781
atgtggggaaatgtgatttttgttgaaagtgcagaaacatttccaaatgcatcttatggttgggtcaatgtgaaagatgttgcaaatgcccatattctagcatatgagaatgcttcagctaatggaaggtattgtttggttgagagagtggcacactactcagaaattgtgaaggttttacctgatttgtacccgacattacaacttccagagaagtgtgcagatgataagccatatgtgccaatatatcaggtatccaaagaaaaggcaaagagcttggggattgaatatactcctttggaagtgagcctcaaggagactgtggatagcttgaaagaaaagaagtttaccaacttttaa

SEQ ID NO: 4004 - DNA, 1953 bp, Glycine max
  Peptide Sequence Number=SeqID_120782
atggaggacccaaattcagggaatcaccaactacaagaggcaacaactatatggaacatggctaaacaactgggggaaacaggagggtcagagcagggggaaatcattgacaaaataagggcaatggaagaaagagacaagaaggaggcagagagattggtcaagaaggagcatgtagacatgatctgttttcaggaaacaaagaaggaaataattgtcaaatccgcatgccaagcactatggtgggattttgatgttagctgggagatgcaacctgcaactaacacagtaggaggcattttatggacaatggttaaaggaggcacatcaagtcaatatagtaccatttactcaccgtgtgatattcaaaataaaagaacattatgggataatgtcaagcagctgaaaaatgcaaaccctgggggtttatggtgcataatgggtgacttcaacaacattagagatccaacagaaaggctgggaacttgtcagaaggggttaggggaaagcaacataaaggagtttaatgactggatagaagacatggaggttgataacgtaccatgggtgggaagaaaattcacatggttcaaactcaatggagcttctaggagcaagctggacagattcttggtgtcccctgaatggcttgttaaatggcctggaaactggggccccaaacctttcaggatcctaaattgctggctcttggataactcatttaagacaattgttcagaaatgttggaattctaatcaacagtggggatggggaggcccagatggactaaacttcaagttcatcaagaaattttggcatatactcgaacctgatgtccttcagtttctagctgaattccatgcaaatggaactttcccaaggggctgtatgtacaagatagtggccaagctgttggctagaagaatgaagatggtgatcgaagaagctaaaatgagccaaaaatcatgccttgtgcttaaagtagactatgagaagacatatgattcaatatcatgggatttcttgttacacatgctgagaagaacatgctttagctccaaatggatcaaatggattgacgggtcctccaagtccttcaagtggatccttgcccttgctcttggtcatgtcctcatcaaaagaggactcaggaaaggggatccattagcgccacttctctttaatgtggttatcgaagctctaaatgggttgttgaggaaagctttggagaaaaacttgttcacaggttttccagtgggctcaaacaatgtaagaataagcatacttcaatacgcggacgacacaattttctttggtgaggaaaaaatggagaatgtcaaggctatcaaagctatcctaaggactttcgaactcgtatcaggtctcaaaattaactttgcaaaaagcagttttggagcaataggagtgcctgatcagtggaagcaactagcagccaattacttaaattgtagtttgttggccattcctttcgtgtacttgggcatacctagtcgggaaaacccgaggcgatgtcagttgtgggatcctgtcattaataaggtccctaatagagtggtggacaagatagtgagcttacaacaaagattcctttggggtggcagacctgagcataacaagattgcttggattaagtgggagacccatcaaggacaactatgggctagggtattggagtcaaaatatggtgggacgggctctaatggaacgatgtggaaggttggatgtggtgataggatcaagttctgggaggatagatgggacacaggatgggagtggaatttcatatggaggaggccactgtttgacaatgagattgccacaattgttagtttcctaagagatgttgaaggcaagataatacaacaacatagaagtgatgtgtgggttgctaacaagaacaaatttacaaaggcggcaagtgcagatcaatga

SEQ ID NO: 4005 - DNA, 1038 bp, Glycine max
  Peptide Sequence Number=SeqID_120783
atgaggaaatccaacagtcgttcgcagaagcaggggaggatctgttggcgaatgtccttttgcagccttcccagcagatttccaaatgtgttagacaccttgacatcatctaaagagatcattgaccttttgaagactgtggattccctttttcattccaaacaagcagggtcaggcaaaccaatgctgaataacttgtacagatatgttcctattatttgtgaacagttgcaggactgggaggatggcttatgtgagactgatgctgacggctcttttttgcacgagaattggaacaaagatttgcgactttttgctgatggggaggatggtggacaacagctccttcagttatttatactgcgtgctgaagctgaattacaagctatatctggtgataatcttgtacccagccttcaatgcttagattcattgaaggcaaaattggggtgtttatttgatggaaacactgttataaagtcatcatcaacttgtcctgattcagtgccacatcaacaatctcgtgatgagatattcaaacctagaagagctggcaatcatgcatttgcagatgttaaatacaaaggtgactggatgagacgtcccatttccaatgatgaaattgcatggcttgcaaaaatgctcattcggttgtctgattggttgaatgagagtcttggactaaatcaggcagagagcagtcaagtaagctctgcagtttcttacgtggaggtatcggctgatgttgcccatatatgtggaccttccgaagccctgaagttcttcttatgtaccattggttcttggtttctcttcctgggtgctgcttctctgggttgcatgcgaaaatatggtctgagggtgaacttaaggatactggcctccaagaaggttgtgatgtgttgtggtaaccaacaaaaaattgctagtccaccccattttgctcactgggagtgcagtaatggaaatagtttattgcagccgctctgtactagttatctcgttcgacaaggtctaaactcagctcagctaatgtaa

SEQ ID NO: 4006 - DNA, 402 bp, Glycine max
  Peptide Sequence Number=SeqID_120784
atggtggctcaaaaatgctccatattcatgttttatatccatacttatgcaacatggcaatggattttatcgtggtctttgatagctgggaggcttccaggacgaacagataatgaaattaagaattattggaattctcatttgtgcaaaaaagtgaatcagaaagtggagaaaccagaaagttccacgagacacgaaattattggccagaatgatcagaatgctggggataaccgtgcaatgtcagagaacgaggttgaaattaatgaaagtggtaacttagatgttagtttggacgtgaacgaatttttcaacttctctgaggaatcctttgggtttgattggctgaacaagtacttagaacttgaccagattcctgagagcacagaaagatctgaatga

SEQ ID NO: 4007 - DNA, 594 bp, Glycine max
  Peptide Sequence Number=SeqID_120785
atgaatgaattgaggagtgtatcatttgtggcatgcaggctttacactggaatccatgcaaaaccaaagcccaaattcaagagcggagctatatccgaatcaacaactgctctgaatgttgatcagaccaacacctctgtgattagtggtgacatcaaaaccacaccggcgagtgctgcattgccagtgccagtgcttgcaaccaccacaacaagaggaaataatcaggaacaggcagcggctgttaatggttcttctgctgctacagtcatatctgctgcttctgcaccaccaaagaaggaaggtggacaagcaaaagctcaggcggacaagaagaagatagatgccagaaagaaaattttacattttgatagagaaagaggggagggagtggggatgtggtctcctgggttcaacatttgctttataaaacgagtgagatttcaggaactatgccaaacaattttggaagtcttttgggaaagaactttgaaaatggtgacatcaacggcgcctccaacggagagtgacgaagacaccatcaggggatgtaggaaagggagggaaagtacagaaaagtggaatgagaactaa

SEQ ID NO: 4008 - DNA, 633 bp, Glycine max
  Peptide Sequence Number=SeqID_120786
atgtcttgccttacaattaacactgaacggctattttacaaccaatacttccctctagtgctgattctattgcagtttttctttggtttggttgcatcctttgatctgatcagcaaatttgagaattcagtttgggaagggccattcctctttagtgcaaaacagatcgcaggtgcctttgtgctgatggccactaatgaaaatcttccaccaaatgtaattaagcaacttgccaaggagttgaaaaatcttgatgaatctcctcccgagggcattaaagttgtggtaaatgatgatgatttttcgacaatatttgctgacattgaaggcccagctggaactccttatgagaatggagttttccgaatgaagctgttgctgtcccatgatttcccgcattctccacctaaaggttttttcttgactaagattttccatccaaacattgcaaacaatggagagatttgtgtcaacacacttaaaaaggattggaatcctagccttgggttacggcatgttcttattgttgttaggtgtctattgattgaaccatttcctgaatcagctctaaatgaacaggctggcaaaatgctgcttgaaaattatgaggagtatgctagacatgctaggtaa

SEQ ID NO: 4009 - DNA, 591 bp, Glycine max
  Peptide Sequence Number=SeqID_120787
atggaaaatgcctaccttccagaaaatgaagtaggcatatggcagtggttatttggcaaaactataactagcattgtacttcgcaattctggaccaagtgatggatttgttggaattgctgcaccttattttgcaagaattcttccgattgatttggcaatgttcaatggagagattttgtgtcagccagatgcttttctttgctctgtcaatgatgtgaaggttagcaacatagttgatcaaaggggacggaatgctgttgctagtgctgagggattcttgaggcaaaagctatctggccaagggcttgcattcatattagctgggggatctgttgtacagaaaaatcttgagatcggtgaagttctagctgttgatgtttcttccattgttgctgtgacaagtgcagtcaatatccaaataaaatataatggtcctgcaagaaggacaatgtttggggaaacacaatatccctcccccataccttcgcatagcgaagagtctctgggcaatggggtacgaagtttttttataggaaacacaatggatccaacccttccttggactccgagcattctaggagctttgtag

SEQ ID NO: 4010 - DNA, 276 bp, Glycine max
  Peptide Sequence Number=SeqID_120788
atgagccagacattattctggggcttcctgcctctctttttcctccctcccttgccttgtgcaaatggtcaagaacttaatgtgcctgagcatgatgttgagcagctactggtgtcgcttattttggataacagaattcaaggacacattgatcaagtcaaccggctcttagaacgctctgataggtcaaaaggaatgaaaaagtatactgccgtagacaaatggaacacacaacttaaatctctttaccaaactatcagcaacagagttggttaa

SEQ ID NO: 4011 - DNA, 273 bp, Glycine max
  Peptide Sequence Number=SeqID_120789
atggtggaattgcaaaagtttagcctgttattggctctcctctccatgcttcttgatgaagtggctatcagtcaattgagaaaatggattacagaagaagtcctttgtcaaccaaaagttgaggtctcagtttgtgagcgtgaaacagaccatgaagaaaagatgtcagagaagacgaccaagatagaaccatgcggtaccaatcaagacaaaggtgtaaacggtgtagaaataaacaagggttctgaaacagtagaggtggctcaagcctga

SEQ ID NO: 4012 - DNA, 2100 bp, Glycine max
  Peptide Sequence Number=SeqID_120790
atggatgtgttatgtagatccccagaccaggaatcagtagggtctggcacaaagaggtccagtgtatcatctgggggtaggcctcagaatcagaaggagttcttctataaatttgttgaaagtgacagcttgactgcaaaacttgtagattggtttgaatctgtaacagaaaatagtgaattgaaacagcaggcatttgatgttccatttgagttgattgaacttcaaaaatttgattatgcattggaaggaatttcatttcagcagctaacacgcatgcccaatgctgttcatgcttctacatctgatgctgtagaagcaacagcttatcttgctattgaagattttctacatgcaagtataaaaggcttgtgggaggcattttggagtcaagatgagcccatgcctttttctgtcgcttgtctgtataatgccaatatgaagttttatcaggctgaaaaggcaattgcaaatggaaggcttggaggtctttgtggcactggtatattgctgaataatcctagacatcctcatggaaaatgggatcatgtccttgaattggcactgctaagacctgatattggaggccatgctgttggcagtgaccgccagccttctccatcagttcttggagaggctctattttgtgctcttcgaatgctattggcaaggagtttaagtagactgagtttctttccagatccaagcacagtgtttgttcttcttgttgattctcaatatgggggagttgtaaaggttgaaggagatgtaaataagctcaattttgatgtgaataatgtttatgaatgtgctgcagaatgggtaaaagatcattctagaatttctgtttctccaattgataggatctggaacaaacttggaaatgcaaactggggagatattggtgctcttcaggtactatttgcaaccttccactgtattatgcaatatgctggaatgcccaaacactctgttgaggatttagctgctgaccatagttcacgcctccaaacaagaagagttgagaggcagttaggagatacaggtgtaaatggaaatggcctattgcgataccagcaatgtagtgtttcccctgaaattgttgaagttcaggatgattctgtcaaagttgattccaaagagtcaatgataacagaaggaaccatattatggctggaggattcagattggcaaaagggttatcagataaaagaggtaatcaacactagtgagttgacatacttcattgcatcccatgttgaagagccaggaaaaaatctgttcctatatgtaggctctcatccatcccagctggaaccagcatgggaagatatgaatttatggtatcaagttcagaggcagaccaaagtattgacaataatgaagcaaaaaggtctatcaagcaaatatctgcctcgattgagtgcctctggtaggatcatacacccaggtcattgtcgccggcccagctctggtggaaattgtgaccacccttggtgtgggacccctattcttgtgaccagcccagttggtgaaacagtagctgaaatggtacgcacagggcaatttggttcagatgaagctatcagatgttgccatgattgcttatcagcgctttcaactgttgcttctgctggaattcggcatggagacatcaggccagagaatgtgatctgtgtaaagtctggtgtgaggcacccttattttgttctaattggatggggccatgccattcttgaagatagggatcgccctgccatgaatcttcatttctcatctacttatgcacttcaggaaggaaagctatgctctgcttcagatgcggaaagcctagtttatatgctttattattcatgtggtggagttttccctgatttagattcagtagagggagcactacagtggagagagacatcttggtcaaggagattaattcagcagaagcttggtgatatctccactgtgctgaaagcttttgctgattatgttgacagtctctgtgggacaccatatcccattgactatgacatatggctgagaaggttgaggcgaagtattcatgaagatgatcatggaaaggaaatcgatgtaacaggctag

SEQ ID NO: 4013 - DNA, 270 bp, Glycine max
  Peptide Sequence Number=SeqID_120791
atgagtttcatcaaaacgacggaagaagaaagaaaaagaaacaaaacgacacgccgtacggagctcggagaagaagagcaagagcatgaggatggaggaagcgagcgtgatgacaccgccggagagcgtgcggctgtagaaatcctcgttgattttagggtacgcgtcgaggttgcggagcttgctcattatgctatccatgacgatgatgatgatgcttcaattcaatttcccccaaattattgtgtggatccaaaactgaagatctaa

SEQ ID NO: 4014 - DNA, 1275 bp, Glycine max
  Peptide Sequence Number=SeqID_120792
atggtgaaagtgcagtttgatgttacgtttcctgcgcttccatgttccatactcagtcttgatgcaatggacatcagcggagagcagcatctagatgttaagcacgatataatcaagaagagattagactctcacggcaatgtgatagaaacaaggcaagaaggaattggtgctcccaagcttactgagagcatgcctgcattgccgtttgaattgcggcagcacaaagccccatgcacctccacagcagaagtgatgaagggcatgcttttggaaacagagattgaaaagcccttgcaaaggcacggaggcaggcttgagcacaatgagacttattgtggttcctgttatggtgctgaagagtcagatgatgattgttgtaattcctgtgaggatgttcgtgaagcataccgtaagaaaggttgggcactttcaaatcctgatttaattgaccagggttgtagctgggttaaccttgctttagatgggctgttcacctctattggagatgggtctgttcaccttgttggaactgggttcaccaagtctgcatgttggctttgttgcaggcttgcaacaatgacttcattagagcagagttcatcactttgttgcagctgggttgatgagagtcgttgcaggcttgcatcttcatttgcaatgttcatttgcaaaagagaaggattcttacaaagaatcaaggatgaagaaggtgaaggatgcaatgtgtatggtttcttggaagtaaataaggttgcagggaactttcattttgctcctgggaaaagctttcagcaatctggtgtacatgtacatgacctactggcttttcaaaaggattcttttaatttaagtcaccacatcaacagattagctttcggagagtatttccctggtgttgttaatcctcttgacaacgtgcattggacacaagaaacaccaagtggtatgtatcagtattttattaaggttgtgcctacagtatacactgacgtgagtgggcatactatccagtcaaaccagttctctgtgacagaacacttcaggactggagacgtgggtcgtctgcagtcccttcccggggttttctttttctatgacctctctccaattaaggttacttttacagaagaaaatgtctcattcttacattttcttactaatgtttgtgccatagttggaggtattttcaccgtttctggaatactagattcattcatctatcacggtcaaagggctatcaagaagaagatggagcttggtaaatttaactga

SEQ ID NO: 4015 - DNA, 952 bp, Glycine max
  Peptide Sequence Number=SeqID_120793
atgggatgttgcaagggaagcttgagcaatatggtgaaggggactgtgaggcagtcaaagatgcttctgtcaacaatttttccagatgaagccgttgggagtaagagctataacattgacaagggattggaagatgaggtgagagggggagagtgtctcgtgaggggaactggatggaagaacaaggattttgaaacaggggtagatctcttgaaagtggatgaagacatgtgtaaagtccacaatgcaagaataaagaagggggtaggcaaaaaatcttttttgagaaacactgagttggtggttacttttgggttatgggtcaatgaaggaacaaaggactttggtttagatggattgctttcaaaggaagcctttcaagatggcctaaatcctcaagagatgaaaaaggatagcttagacctaggagatgaagagtgccaacaatgtttgggtacatactatgtaggatacaacaaaggaagtgtggaatctgggaacaaaaaagctttgggggatggatacatatatcttgaaggattgtggaaagaaattggaagcaatgtggtagtgataaatgtttattctccatgtgacaacttcaaaaagaggagactcaaggaagatttacttgttggggatggaagtggattggatccaatcatgaaagatttcaatcaatttattgacaatatggaattagtggacattcctttagctgggagaagtttcacttggtataggcataatggaagtgtgaagagtaggcttgatagagctttgttgtctttagagtggttttctacatgggtcgggggcaccttatctgtctcagataggaaaaccttggatgattgtcccgttattttgaaaaatgttgtaagggattggagtccaaaacctgtccagattgtagaagcaaccttcatgatgatgaatcaagatgattcaa

SEQ ID NO: 4016 - DNA, 305 bp, Glycine max
  Peptide Sequence Number=SeqID_120794
gccttcttaacaggctttctgaatctaatgttaagtcaattactggggaattgtccttgatctttcagggattcaaaaagtattatttgatctttggatatgtcaaattcttcctccttgatcttgtgttaaaaataattaaaaataatattcaatttaaagacgatgcttatatcagcaccgtctttgaaagtagacattctaaaacggtgcttacctcaacaacgtctttgaaagtaggcattctaagacgttgcttaaataagcaacatcttagaatgcctatttttaaagacgttgctgag

SEQ ID NO: 4017 - DNA, 1115 bp, Glycine max
  Peptide Sequence Number=SeqID_120795
ccacccaccaccaccaccgctcccccttctccccgcccccccacgccctttcgctccaaaacaacaaccccctccccaattcccccccaatctaccacaccgctagggttttcacaagccccgccagatacaccttccccgtctccgacaaaggcacccacatcgtgcgcctccacttccaccccttcaccaccccaaatctcgatctgggtctcgcccaatttcacgtcttgctcaacgctcacgtcgctctcagcaacttcactcgcttgctaagcgacgccacaaaccctagcatcgtcgagtatctcatctgggtcgacgcggagaagctcgaaatcgtgtttgttccgaacaaagactccagattggcgttcgtcaacgccattgaggtgatttccgcgcccaaagaccttgtccccgacaccgcacagtatttgagttcatcgaaattagagaaatttgagggtttgaacaaacaggctcttgaagttgtttacagggtcactgttgggggtgttaaagttaccccttttaatgattccttgtggagaacttgggttcctgatgatgggtttttcagaccaagtgttgggtcggaaaagctttactttggtgggagaatcaattaccatgttggaggggctagtcgtgaggttgggcctgataatgtgtataatagtgctaggttgattaggagtaagaatgattctgttcctaacgttaatatgacttgggtgtttccggttgttggagggtataagtacttggttcggttgcatttctgtgatattgctagcatttcggttggtttgctttacttcaatgtttatgtcaatggaaatttggcttatgaagatttggatctctcatacgttacgaattcgctggcttcgccgttctatgcggactttgtggttgatggaggagatggggccttgagtgttggtgtaggtccttcgaagagcagcatgccgcatgtcatcgatgggatattgaatgcggttgaggttatgaagttgaacaattctcgcagtagtcttgatggagaggaggttgattgggtcgagggaatctgtgtcttggtcaaggttgcctgtgaatttgtcggatga

SEQ ID NO: 4018 - DNA, 877 bp, Glycine max
  Peptide Sequence Number=SeqID_120796
aagaccaagaagaagctgcaggaagctgcacagttaggaagcgttgatggcatcatcgaccctccatccccggtcagacgccacgtgaagtggaagatgacctgcacgaagaagacatgggagatgacgactaaggccgcaaaggaaatcgctgagaagattgattcgtttgaggagcaggccacacagggatcgttcgtcccccatggacgtcaggatgttctggccgctgctattggacgtcctgagcaccctggacgtgtccgtgctactggagccgatatcagggaccagttagaggagtccatcacagagaaagtgacgaggcaggcacctcctgagcctctggttggtcctggtccctccggtcctcgggtgagcacaaaggggagttgtgttgatccctcaggaaacgatcctgagacgagtgactctgacaggtgcgacttgtacatagaagcagatcctgcccgcctggttgccttggggagagtttataagggatccactcttgttcataacactcctttgttgtctggccaagtaaaggtgagtgtggacgaggttaaagatgcagatgcttcagttcctgtacccactgcagaggtttccttagtggggcaggcacttcacaccttccttgcttggccgacacatctgatcaattctttatcataccagatagttgtgtctccgccaaaaccacctccgaaacccggtccggaggtcgatgatccgctttatctgatgacattgaccatcccagagcttttcttgagaccttatcaggttagatgggatgcccccgtgttcggggtcgttaatccagatttccccctgtacataaagcacgaagacctctccgaaatcgcacacg

SEQ ID NO: 4019 - DNA, 2571 bp, Glycine max
  Peptide Sequence Number=SeqID_120797
atgccttactatggagtcattgaagatatttgggagcttgattactatgaatttaaagtgcatgttttcaagttgcttacaacgatgatccattcatcatggcagtgcaagctagacaggtgttttatgtccaagatccatgactcaagatggtcagtggttctacaagggagaacaacttgtatcgatgacctgattgatggttcaacacttgatgtcaacgagatgtcggctttctgtgaacaaatgcctttcataaatggggaagatcaggaggatgatgtacatgcaaatcgtaatgatcatgatgaaggtttatgggagaatattcgtatactcatggcaacacccaaaaggtcccctccacatccttcagaggctatgtctaggaagactagacaatcgtccaggctgagaaggttgattgtccgaagtttggatcagccacagccaatgattaacggaaattttgacatccttgaaggtgacaatgctaaaaagaaggtgatgtcaacggtcgctactagatggaggaaatttaagtcctccttaacgacaaaatatgtttatgttgacaatgacgatcaacagaaagatgatccttttgttaagtatgttattgatgcagcaacatgggcagaatttgctaaaagccaccaaacccctaactggcagtggaagatggcccacacaaagcgatatgggcagatgacctctacaacagcccaagaaatatcagacaacattgtgagtaattacctctatgtttcacaggaagctttgttccacatggtcatcatgacattgaacatggctattggtcggccaaagcatccaggtcgtgtacgtgtggcggggaaaggtgtaacaatcagccagtattttggacaagcatctcgtgactcaaacagctcttctacatcaatcagtcaacaacaattggctcaaatcatcgagttgaagcaagcaataaaattagagttatcccaaatttcatcacaacactcacctccacttgaggcacctgatatacaagtgttagctgcacgtgtgagcaccaaggggagctatgctaaagcagacacaattccatcaggtaaagagccttctgatgttcacgcggatactatgggcttatacgtagttggtgaccagtgtactgaactagtggcattgggaaaagtgtatgatagtgcatccaccatacacaatgtcccttatgcagatgatgtggttagggtgagtgtcggtgacgctcaagtcccttttccgacatcagagattcaatttgtgaagcaggccattggcacattcgtagggtggccgacacatcttgtgaaacctgtatctaatgaggattcaccaaagcgtctatcgaaaagggttacatctgttggaatggacaatgcagtggctgtagttgatccattaggaaaattggttaagaacatgtttgatgtttaccaaaagccaattgatttgccatttgatggggcgaaatttgggatacctaatctcaaagatggctttttcatcacacacgcagatgacaatattgttgtttggttatgttctttgcgtaaaaagcctgatgttaacatcaaggctgcagttaacaggcagatcaagctgtacctcggtggattgaaccaaagttgtcaagattgttatgcagtgaaatcatctttgaaagctgaagatggaattctgtatccccttgacacatgcaaatctcatttccataatgagactactgttgtggtctgcagatttgtatgtgaatcccaatttgatgttttcttggccttcattccaatgtttcacatctacggacttctgttctttggattaggattgttgtgtgtttgtgttacaacaatttcgatgcagaaatatgacttaccagcagtgccaccaatgatccttgcactagtaaaacatgcaaggaaagctaggtgtgacttgtccagcctaagaagggtggggttaggtgctgcacctttgagcaaggaagtggcacaagagtttagaaggatgtttccatggattgaactgaggcaaggttatggcctaacagaaagtagtggtggagcaacattttttgcctcagataaagatactaatgctcatacagattcatgtgggaagctaattccaactatttgtgcaaaagttgtagatattgaaacggggaagcctttgcctcctcaaaaagagggtgaattatggttcaaaagtcctaccattatgaaaggatatctaggaaatttggaggcaacaagtgcaacaattgattcagaaggttggttgaggactggtgatcttggttacatagatgagaatggatttgtttatatagtcgaacgtataaaggagctaatcaagtacaatggttatcaggtgactgctgcagaactggaatctgtggtgctaagtcacctccttatagttgatgcagcagttaccgtggttgaagatgaagaaactggacagataccaatggcatatgtggtgagagcaactggttctgaactctcagaaaaccaagtcattcaatttgttgcaggctag

SEQ ID NO: 4020 - DNA, 1029 bp, Glycine max
  Peptide Sequence Number=SeqID_120798
cgggtgattgatctgcagccgtttcatgccagcgtcgccggggaaactttcgcgccgctgactatggcgcaggcgctggcggcgctgctgccggtttatcagcgccactgcgcgcactgggccacgggcgtggccgacatgccggacgataccccgcccgctgctgccgccgtaatcagtcagcaggctttctggcaggcgatgcagcgtttcctgcagcccggtgatattatccttgccgatcagggcacggcggcgtttggcgctgccgcgctacgtttaccgcatgatgcgcagctgctggtacaacctttatggggttctattggctatactttacccgccacctttggtgcccagacggcgcagcccgaccgccgcgtcattctgatcatcggcgatggatcggcgcagctgaccattcaggaactgggatcgatgcagcgcgacggcttaagcccgatcatttttctgctgaataatgagggatacactgtcgaacgcgcgatccatggagcggaacagcgctacaacgacatcgcgcagtggaactggaccgcgctgccgcaggcgatgagcctgaattgtgcggctcagagctggcgcatcagtgaaacggcgcagctcgacgccgtgatggcgctgctcagccaggcgcgttgcctgtcactgattgaagtggtgatggagaaacaggatttgccgccgctgctgcgcaccgtcacggcggcgctgcaccagcgcaatagccacaaacggagcagcagaagaatgacaaaatacgccctggtcggcgatgtgggcggcactaacgctcgtctcgccttgtgtgaggtggagaccggcgccatctcccaggccaaaacattctcaacatcagactacgacaaccttgaagcagttatccgtcactatctggatgagcaaaaacaggacattaccgacggctgcatcgccatcgcctgtccaatcaccggcgactgggtggagatgaccaaccatgactgggccttctcaacgcgtcaatga

SEQ ID NO: 4021 - DNA, 651 bp, Glycine max
  Peptide Sequence Number=SeqID_120799
atggcgattccgatgctgacggcgcaggacgtcctgcagttcggcggcaaatcgccggtgcaggataaaccgattgccatctacggtgctggcaccgggctcggcgtcagccatctggtgcacgttgataagcgctgggtcagcctgccgggtgagggcggtcacgttgacttcgcgccaaacagcgaagaagaagatgcgattctcgaagtactgcgcgccgaactgggtcacgtttctgccgagcgcgtgctgtcgggttccggactggttaacctgtatccggcgattgtgaaatccgatcagcgcgagccggaaaacctcaagcctaaagatgtcaccgagcgggcactgcaggatagctgtattgactgccgccgcgcgctgacgctgttctgcgtcatcatgggacggtttggcggcaacctggcgctgaacctcggcacctttggcggcgtctatattgctggtggcatcgtgccgcgcttcctcgagttctttaaagcgtccggcttccgcgcggcgttcgaagataaaggccgcttccgcgattacctcgttgatatcccggtctacatgattactcacgaccagccgggcctgcttggcgccggtgcccatctgcgccaggcgctggggcgcgtgctgtaa

SEQ ID NO: 4022 - DNA, 1239 bp, Glycine max
  Peptide Sequence Number=SeqID_120800
atggcggtcggtttgtcgcaaatcatctcgacgcagctggaagtctcgcgtgccgagcagctgcgtgagatggccaataaagcggaactgcgcgcgctgcaaagcaaaatcaacccgcacttcctgtttaacgcgctgaatgccatctcctcatcaattcgcctgaatccggacacggcgcgccagttggtgattaacctgtcgcgctacctgcccctgtcgcggcaaaggcgtggtcacgctaagcgtgaaagatctgggcgatcgcgtccgcgtggcggtgcgcgataccggtgccggcatcagcgaagaggtggtcagccgggtggcgcgcaacgaaatgccgggcaacaaaattggcctgctgaatgtgcatcaccgggtgaaactgctgtccggccacggcttaaccatcacccgtcatcagcccggtacggaaatcgcctttaccctcagcaaaagtggtcagcggctgtccggcccgctcaccccgttagcggaaacctcagcgtgaaagccattattgtcgaagacgaattcctggcgcagcaggagctaagctggatgatccagcagcatagccagatcagcatcgaagcctgctttgatgatgggctggaagtgctgaagtatctgcagactcatcgggtggacgtgatttttctcgatatcaacatcccgtcgctggacggcatgttgctggcgcagaacatcaaccagtttatccataagccgctgattgtgtttatcaccgcgtggaaagagcacgcggtcgaggccttcgaactgcaggcgtttgactacatcctcaagccgtatcacgagtcgcgcatcatcaccatgctgaacaagctggaggccagcgcacaacagcagcaggcgcagcagcacaatccagcagccagcgcaccgcaaacggtgaatttagtcaaagatgagcgcattatcgtgaccgatatcaacgatatctattacgtagaagcgcatgagaagctgacgtttgtctacacgcggcgcgaagcctatgtgatgtcgatggcgataagcgagttttgcagccgtttgcctgagtcgatgttctttcgctgccaccgttcctactgcgttaatctgagcaagattggcgagatcgaaccgtggtttaacaacacctatctggtgaagctgcgcgatatggatgcgcaggtgccggtgagtcgcagcaaggtgaaggcgtttcgccagctgatgcatctttga

SEQ ID NO: 4023 - DNA, 2496 bp, Glycine max
  Peptide Sequence Number=SeqID_120801
gcgcgcagcgatgcgcagctggcgggcatcgtgctgatttcaggcaaacgcgacaacttcgtcgccggtgcggacatcagcatgatcgccagttgtgaaacggcgcagcaggctgaagcgctggcgcggcagggacaggaagtgatggcggagatcgccgcgctgccgttcccggtggtcgccgccattcacggagcctgtcttggcggcgggctggagctggcgctggcctgcgatgcgcgcatctgctcgctggatgagaaaacccgtctcggcctgccggaggtgcagctcggcctgctgcccggttccggcggcacccagcggttgccgcgtctgataggtgtgcagcaggcgctgccgctgatcctcagcggcaaacagttgcgcgctaagcaggcgctaaagcttggcctggtggatgatgccgtaccgcaggcgattctgctggcaaccgccgtggcacgtgtacataaaggaaagcacgccgcacgcagcctgtcgcgccgcgatcgcctgctgcaggggccgctggcgcgtccgctgctgtttacgctggccaaacgccagaccgatggtaaaacccacggtaactatccggccaccgaccgcattttgcaggtggtgcgcatcgggctggagcagggcagcgccgccggtcacgccgcggaagcgcgtgcgtttggcgagctggcgatgaccgcgcagtcggccgcactgcgcagcctgttttttgcttccaccgccctgaagaaagagccgatggcggatgcgccgccgcgcccgctgcagcagattggcgtgctgggcggcgggctgatgggcggcgggattgccagcgtcaccgcgctgaaagccggtctgccggtgcgaatccgcgatatcaaccttaacggcgttaaccacgcgctgcagtacagctgggatttgctgagcaaaaaggtaaaacgtcgccagctcaagccggcggaacgccagcagcagatggcgcgcatcagcggcggcaccgattatcagggcttccgccagcgcgatctggtgatcgaagcggtgtttgaggatctggcgctgaagcagcaaatggtggccgagattgaagaacactgtcagccgcacactatctttgcgtctaacacctcctcgctgccgattgcgcagatcgccgccggcgcgcagcgcccggagaatgttatcggcctgcacttcttcagtccggtagacaagatgccgctggtcgaggtgattccgcatagcggcacttcagcacagacgctggccaccacggtggatctggcgcgtcgtcagggcaaaaccgccgtggtggtggctgaccgtcccggcttttatgttaaccgcattctcgcgccctatataaatgaagccatgcgctgtctgctggagggcgagcccattgaacacattgatagcgcactggtgaaatttggtttcccggtcggcccgctgcagctgctggatgaagtcggtattgatgtcggcagcaaaatcagcccgattctcgaacaggcctacggttcacgcttcagcgcgccgcaggcggtgagcgctatcctggccgacgatcgcaaagggcgcaaaaaccagaaaggcttttatgattatcagcgcacgcgctggccgcgcaaacgtcaggccgatgccagtctgtaccgcctgctgcagttaaaaccccaggcgaaacagagcgagcagcagatcgccacgcgctgtgtgatgctgatgcttaacgaggcggtacgttgtctcgacgaagcggtgatccgcagcgcccgcgacggcgacatcgcggcagtgtttggcatcgggtttccgccgtttctcggcgggccgttccgctatattgaccagcgtggtgcgggcgagatcgtcaatacattacgtacattaatgcagcaatacggcgagcgttttacgccctgtgacgccgttcattcgcagaatgaagcgtctggtgctgtggtacccggcgatatcgacaaacaacagcggtgctttatgcaagtttttatcatgcgtcacggcgacgcagctctggaagcagcgagtgatgcggttcgtcctctcaccctgtgtggctgcgacgaatcacgtcagatggcgagctggctgaatggtcagacgccgggaatcgataaggtgctggtcagcccttatctgcgcgccgggcaaacgctcgccacggtacgtgaagcgctgaaactgccggaagggcaggaagtgctgccagaactgacgccaggcggcgatccgggcatggtcgcctgtcatttacaggcgctggcggtgcagggtgcgcacgcagtgctggtgatttcgcatctgccgctggtcggttatctggtatctgaactctgcccgcaggaagcgccaccgatgttcgccacctccgccattgcctgcgtggagttcgatgccgacgcctgcgaaggcaagctggcgtggcaggtgagtccggccaaattagccaaagccatgtaa

SEQ ID NO: 4024 - DNA, 1048 bp, Glycine max
  Peptide Sequence Number=SeqID_120802
atgaaccataagaacctgtttgcaaagtcagctgtggcagctgcagtggcgctcgtctcttctcacgtctacgccgcaggctttcaacttaacgaattctcagcaatcggcctgggccgcgcctattccggtgaaggcgccatgggtgataccgccgcctctgccagccgtaacccagccactatggccctgatggaccgcccttctttctccatcggtgccgtctatatcgacccggaagtggatatcagcggtaacagcccgaccggcaacagcctcaacgccagcaatattgcgccaaaccagtggatcccgaacatccattatgtgcatccgattaacgatcagtggtggattggcgcctcggccacctcgaactacggtctggccaccgaatttaataatggctacaccgcgggcggcttcggtggcaaaaccgatctgatgaccggcaacttcaacctcagcaccgcttatcggttaaatgataacttcagcttcggcgtcggctttgacgcggtgtacgccaaagcgaaaattgagcgctacgccggtgaagccggtgcccgcgccggtctgccggccgatacccaggtcgcgcacctgaaaggtgacgaatggggctacggctggaacgccggtatcctgtatgaagtggataaaaacaaccgcttcggcttcacctatcgttccaaagtgaagatcgacttcgacggcgactataagagcaatatcccgcgcgcctttaacggcacgccgcaggcgattgcgctgggtctgccgtatggcaccagcggcgccaccattccgggttcgctgacgctaaacctgccggaaatgtgggaagtgtccggctggcataaagtggcgccacagtgggcggtgcactacagcctcgcctataccagctggagccagttccaggagctgaaagccaccggcagcaacggccagacgctgttctataaagatgaaggctaccgtgatgcatatcgcatcgcgttaggtaccacttacaactacgacgataactggacgttccgtaccg

SEQ ID NO: 4025 - DNA, 900 bp, Glycine max
  Peptide Sequence Number=SeqID_120803
atggtgcgcgaactgcagcaaacgctgctgaccgacgtgcccggcgacgcggcggcccgcgcgcatcacagcagccgctgggtgctgctgccgggcgtgatcgtcctggtgctggtgtcggtgggcgtctatctgaaaaccggtggcctcgcccagctggcgggctggcagagcgtgcagcaggagtacccggcgctgcgcgcgcgggtgatggatcccaacgcgcagccgctgaccatggaagagctggcccgtctgcagctcggcctgcgcacctcgctacaaaacgatccgcaaaacctcaatgactgggcgatgctgggccgcctcggcatggtgctgaacaacgccaccgatgccagccaggcctttgagcacgctttgcagctggcgccggacaaccttgaactgcaacaggattatgccgaagtgctgacgcgctccagcgatccgcaggataaccgccaggccaatatgctgctgaaagacctgctgaagcgcgaccacagcaacgtgcgcaccctcagtttgctggcgttcaatgcctttgagcagcagcagtatggtgaagcgattggcgcatggcaggtgatgctgaagctgctgccggccggcgatcgacgcattaccatgatcgagcgcagcattgaacaagcgaaaaccgacgcgggacagcaaaatagccagctggcattgacggtgagcttaacgccagaggcagaaaaaatgttaccgccgggcggagtgttgtatatttctgtgtctgacggtgtttcaccggtgcctgtggctgtaaagcgtttaccgctcagccacttcccgctatcgcttacgctggatgacagcaacgccatgatgccggatcgcctactttcggcgcagcatcaggtgcagatcagg

SEQ ID NO: 4026 - DNA, 1044 bp, Glycine max
  Peptide Sequence Number=SeqID_120804
atggtgctgggccatcttggcgtggcggtgacggtagtaggcattgccttcagcacccaatacagcgttgagcgtgacgtgcgcatgaaggctggcgacagcgtggatatccacaactatcactttattttccgcgacgtgcacaatctgcagggccccaactacagcggcggcgtggcgattatcgatgtcacacgcaacggtaagccagaagtggtgctgcatgcagagaagcgcttctataccgcagcgcgcaccatgatgacggaagcggcgatcagcggcggcttcacgcgcgatctctacgcggcgctgggcgaagagctggatgacggttcctgggcggtgcgtatttattacaaaccctttgtgcgctggatctggttcggtggcgtgtttatggcgctgacgcgcaacgccagcggtgacgatcctacgcgcctcgaatcggcgctgatcggtaaaccggtgccggtgtttaaactcgaagcgctggatcagccgggcaaaatctataaccagcaggtgctgaccgatggcaaaccgctgctgctgaacgtctgggccacctggtgcccgacctgccgcgccgaacatcaatatctcaacacactggcggagcagggcatccgcgtggttggcctcaactacaaagacgaccgcagcaaagccgtcacctggcttaacacgctcggcaatccgtatgcgctgagcctgtatgacggcgacggcatgctcggtctggatctcggcgtctacggcgcgccggagaccttcctgattgatggccacggcattatccgctaccgccacgccggcgacatgaacgaccggggaggccggcgtatgaaacagctgcttatgttgctcgcgggtctgctgctgagcaccagcctgtgggccgcgatcgatacttatcagttcgattcggtccagcaggaggagcagtatcgcgagctcaccgcatcgctgcgctgcccgaagtgccagaacaacagtattgccgactccaacgcgatgattgccgccgacatgcggctgaaa

SEQ ID NO: 4027 - DNA, 445 bp, Glycine max
  Peptide Sequence Number=SeqID_120805
atgaagccatcgccatcaaataacacgcatgacaatgacgtggacagtgaagaaaaagaacagggcacggatattgaagtggacgaagacgccctgccctcgcgggctgcggcgatccatgaagagattcgacaggatggggaaaaggagctggaacgcgacggcatggcgctgctgtggtcagcgattgccgccggcttatcaatgggcgcctcgctgatggcgaaaggcatttttcaggtacacctcgctggcgtgcccggtgcctatcttctggagaatcttggctacacctttggttttgtcatcgtgattatggcgcgccagcagctgtttaccgagaataccgtcaccgccgtactgccggtgatgcataaacccaccggcggcaattttatgctgctactgcggctgtggagcgtggtgctgatcggcaatttaattg

SEQ ID NO: 4028 - DNA, 1200 bp, Glycine max
  Peptide Sequence Number=SeqID_120806
atgtcaatgtggaaatggttacaccagtgggcaaagcctgagcggctttaccagctatgcggtcgcttgattccctggttcgcaatcctgggcgtcggtgcgctgctgctcggctggatttggggattcggctttgcgccggcggattatcagcagggcaacagcttccgcatcatgtacattcacgtgccggcggcgatgtggtcgatgggcgtctatgcctcgatggccatcgccgccttcatcggcctggtgtggcagatgaaaatggccgatctggcggctgcggcgatggcgccgattggtgcggtgtttacctttatcgcactggtgaccggctcggcgtggggcaagccgatgtggggcacctggtggatttgggatgcgcgactgacttctgaactggtgctgctgttcctctatatgggcgtgattgcgctctatcactctttcgacgatcgccgcaccgccggacgcgcggccggcatcctgattctggtcggcgtggttaacctgccgattattcacttctccgtgcagtggtggaacacgctgcatcagggctcgtcgggcattctgcaacaggcgatcgatcccagcatgcgcacgccgctgcgctggtcgattctcggctatctgctggtggaggacgcaaagcatgacgcctgccttctcatcgtggagcgagtttttcgccatgggcggctatgccttttacgtctggctggccgtgtgttttacgctgattccgctgatcggtctggtgctgcacaccgtgttgttccgtcgccgcctgctggcagagattcgccagcgagagtccgtgtgaatatccgtcgtcgtaaccgcctgtatgtggtggtggcggtgctggtgggcttaggccttgccacgtcgctggtgatgtacgcgctgcgttccaacatcgacctgttctacaccccgagtgaaattctgtacggcaaaggtgaggatcaccagaagccggaggccggacagcgcctgcgcgtcggcggcatggtgatgcccggtagcgtcaaacgcgatccgaaaacgctggcggtgtcgttcaaactgtatgatgccaacggcgtggtcagcgtcagctacgaaggcattttgccggatctgttccgcgaagggcagggcgtggtggcgcagggcgtgctggaagacggcaacctggtcaacgccaaagag

SEQ ID NO: 4029 - DNA, 996 bp, Glycine max
  Peptide Sequence Number=SeqID_120807
atgaatctcccttctatgctcgaagtgattaatctcgcctgcgttcgcgatgagcgaaccctgttccacggactgagttttcaggtgcaggcgggcgatgtggtgcaaatcgaagggcctaacggcgcaggcaaaacttcactgttgcgactgctggctgggttaagccggccagagcagggcgaagtacgctggcaacagcagtctattcgccggcagcgcgaaatatggcagcaaaacctgttgtatctcggccatcatccgggcgtgaaatcggtgctgtcgccgcgggagaatctgcacttctggcacggcgatcgcagtgaagacacgctgtatgacgcgctggaacaggtcaatctgctgggttatgaagaggtgccggtggctcagctttctgccgggcagcagcggcgcgtggcgctggcgcgactgtggctcagcccggctccggtgtggattctggatgagccgctgaccgccatcgacaaacacggcgtggaaaaattaatggcgcgctttgccgatcatgccgataacggtggcgtgcgtgagttaaagattgcctttcgcagcggcgcggaagtggttaatccgctgtgccgcgctgctggcatcgctgctggcgctggagcggctgtttcgcgacgactttctcgatggatcgctggagcagctgctgttgctgccgacgccgctgccgatcaccgtgctgggcaaagtgattgcgcactggctgattaccgggctgccgctgattttactctcgccgctggcggcgctgctgctgtcgctggattttgctggctggcgggcaatggcgctgacgctgctaatcggcacgccaaccctgagttttctcgcgcggcgattgatgcggccggtcaggggttaccgatcggcggttatctggcgattctcggcgccatgctggcggtcagcgccacgctgtcgccgtttgcgaccgccgccgcgctgcgcatcagtctgcattaa

SEQ ID NO: 4030 - DNA, 627 bp, Glycine max
  Peptide Sequence Number=SeqID_120808
atggccgcggtgggcggctggcaatatctgcaccggcccgatccactgcaggctcagctcgtggcatcgctggctcctgtgcccgccacactcacgtcacagcagcgggatgtgctgcggcagcggacgtccttaccaccagctttgcttgccgacacgcagcagcagttatctcgtctggaacaattcgcgcccgactggaatattgcgtatggccagcagctggtggagcaggcgcaggtgctgtggccggaacaggcgggttcgttatcagctcggtggcagcatcagcttgaggccagcacgttgccagcgcaaaaccttgcggcctggcatcagggaatgatgaagctggcacagttaagcgagcggctgaatggactggatgagcaaaaaggtaaatacatcacggtgagtgagctgaagtcctcggtatttggcatgatgacccgttttcagcaggctgagcccattgaggaacaattgcggcaaatccactcgctaccagccagtgccccgcagcggcagcagcttatccgtcagctcgaacagcacctgcgatcgcagatttacaccttgtggcagatgaaaaacagcattgaggtagcagagggagaggagcaataa

SEQ ID NO: 4031 - DNA, 525 bp, Glycine max
  Peptide Sequence Number=SeqID_120809
atgcaattactcacccctcgtttgtccctcagccggttacagccggaagactggcagattttcaaagcggtacatgaagatgccgcgaccatgacctgggtgagcgagatccccgatgaaaacgatatccgccagcgctttaacgagcggctggcaccgtggcaacccagcagttttcacatgctgtgcctggtggcgcgcctgcgcgacagcggtgaagcgattggcctgtttggctgcagcgccgagtggcatccgtatcgtcaggccgaagtgggttacatgctgcgccacgcctgtaccggtcagggctacggcagcgaagcgttgcaggcgttgtgcacgttcctgctgcaggccgacttccataaacttaaagcgctggtgattgagggcaactggccgtcgcggcgcattctggaaaagaacggtttcgcgctggaaggcacgctgcgcgataactaccgcctcaacggccagtgggtaaacgattgggtgtttgggcgcttgaacgaagcaggctaa

SEQ ID NO: 4032 - DNA, 228 bp, Glycine max
  Peptide Sequence Number=SeqID_120810
atgaggctgtggtttaagctactttccttgatatctgtcttatgcctaactccatctacttgttcagtaacttctgttgcatacacctttgtatatagtcactgcatgtcattgccacttaaggacaagttaattaggcaagctttggaaagtgttgtttttcaccttctcgctaagccaatctgctggcttagcgagcgtccgctaagcgcagcactcctgggctaa

SEQ ID NO: 4033 - DNA, 318 bp, Glycine max
  Peptide Sequence Number=SeqID_120811
atggaaggtaattgcgattaccttataactgaagagggtcttctggagggcgttaagcattttgctgtctggccactatcgcaggcggcagattcatgtttcgggactggacattggccaactgaatacccaaaaccacagggatggattgaatatgaggtagaggatctagattcagccacaaagatcttaaaagagaaaggatataacctgttggtggctaatcgcgtagagccatggggacaaaccgtcacccgcttacttagccctgagggattgcttacagggcttactataactccctggcttcgtggctaa

SEQ ID NO: 4034 - DNA, 571 bp, Glycine max
  Peptide Sequence Number=SeqID_120812
atggcgaccatcaaggatgtagcattgcgggcaggggtctctactgcgacggtttctcgcgtcatgaatcagactgcgtgggtggagccggttacccgcgagcgcgttgaaaaagcgatgcgcgagcttaactaccgacgtaacgccgccgctatcgcgttggcaaagcgcagcggcaatatgcttggcctactgaccggtaatcttgcagaccctttctttgctcacctggctcgtggtgtggagagcgttgcccgcaagtggcagtatcgcctgatggtgtgcagcggagggcatgatgaggcaatggaaaaagccggtctcgactttcttgtgaatcagggttgcgaggcgattgtcgttcacgccagccgtctgtcagaaaaagaactcctgcgctacagcgcccattttccggcgatggtaatagtaaatcgctatatcgccgggatggcgaaccgttgcatctggctggaaaacagcgccgccgcgcgtgaagccacccaccatctgcttgcacaggggcaccgttgcattgcctgtgttacctccgatcttcctatcatcgacc

SEQ ID NO: 4035 - DNA, 1140 bp, Glycine max
  Peptide Sequence Number=SeqID_120813
atgacgaaccgtaatgtgaataacacgcttatggagttggcaatgtcgatttcaaacagaagtgctctacctagagctgcggtgcctggactaatggccttgtttggtggggttttgggcccaccccagaagaagctcttaaggaaaactttagaagatggaagtgttaataaaggagggaacaaagttattaacacatggattgattcaatgagagcctcttctcccactcgatctgccaaatccacacaaaacaaccaaaaccaagacccaacaagtccttggactctttaccacccttcggcactgagcatgtttgatcatattgtatgtgagtccaaagggaagcagattgtgacttttcttgactatgatggaactctctccccaattgttgcagatccagataaagcatacatgagtaaaaagatgagggccacattgaaggacttagcaaggcatttccccaccgccatagtgagtggaaggtgcctagacaaggtgtataactttgtaagattggcagaactgtactatgctgggagccatggaatggacatcaagggaccaacaaataagcgaagtactaagaaaggaaacgaacaagtgctcttccaacccgctagtgaattcttacccatgatcaatgaggtgtacaacatcttggtggaaaaaacaaagtctgtccctggggctaaggtagaaaataacaagttttgcttgtccgtgcactttcgctgtgttgacgaaaagaactgggcatcattgggtgaacaagtgagtttggtgctcaacgagtacccaaaacttaagctaactcaagggagaaaagtgcttgagattcgaccagccataaaatgggacaagggcaaggctcttgaattcttgctagagtcactaggatatgctaattctgataatgtatttccaatctttattggtgatgatcgaactgacgaagatgcttttaaggttttgcggaggaggggccaagggattgggattcttgtttctaaaattacaaaagaaaccgatgcttcctacactttgcaagatccaacagaggttgggcagtttttgaggcatatggtagagtggaaaagaacgagttcccaataccagaagttagattctagatga

SEQ ID NO: 4036 - DNA, 4047 bp, Glycine max
  Peptide Sequence Number=SeqID_120814
atgggatcagaaattggaatcaaagtaaggaaagttgttgtcatttcaatcagaggtggttacagatcagcttgcaaccatccattccttgtgggttttttttgcttcttgcttttgttgtacagatcttttccttttctgttttctgttttggtctctgcatctcctgttttggtctgcactgctattctgcttgggacccttctcagttttgggcagccaaatgtgcctgaagttgagatagaagagaaagttactcatgacatttcatccttccaagccgggttttctgagggtgacactgtttttgctgacagagatgagagctattttgtgaagggctattcagaaaataggagtgatgtggaagagaggggcattgaggaggaaacaagtttggttagtgagagggataatagggccgaagaagatcaaggcttgctttctgacttgcctccagatgatgaaaagttgccggattttcagcacaagaagcaagaaaaagaggaagtggagagggaaagggaattccatagttttgagttgggaaagaatagggaagttcatgaagaaaaccttaggtctgaagctgtttcaagtgatgatgaagctattgagaaacaatatgtcatggttcgaaaggtggatgatgatattcttgaatttgaaaatgagaaaactcccggagatcatgtggacttttctgccagctcatcttggaaacaggtggaaaacgacggtgacgaggatgactcagtggagtcaggttctgatggggctgagagctcttcaccagatgcttccatggctgacatcattccaatgcttgatgaactccatccactactagacctagatgctccacagccggctcatgtgtcctgtgatggttctgatgctgcatctgagaaaagtgatgatgacagtgttgaatcagacgatgatactgaaaaccatgttgatgcggacgatgatggtattgacgagcccgatgatgaagaggaagaagaagtggcgggtggcaaagaagaggatgaaagtaaatctgctattaagtggacagaggatgaccaaaagaatctcatggatctgggaaatttagagctggaaaggaataaaagattggagaatcttattgctaggagaagagcaaggagattgatggatgagaagaatctaatagacttagattgtgttgatattccctgtaatgttgcacctattgctacgaccaggcataacccatttgattttcctgatgactcctttgctgccatgggattaccacccattcctggatctgctccgtctattctacagcctaggagaaacccttttgatattccctatgactcaaatgaagaaaaacctgatcttaaggcggacagttttcaacaagagttcacagtgtttcatcaaaaagaggcctttttccggcggcatgaaagtttcagtgtgggatcatcagtattggggttatccaagcaagagaggtatgattggaaacctgtctttatatctgaaaggatggcttccgagggaacaagctatccttcattccagaggcaatcaagtgaagtaagtgattcaaagttgagttctgttccagatactgaatctgtgagttcaattgatcaggatgacgggaagttcagtgagcaagacttgtctcaagaaactgaattaatatctaacattgaccatgcttctgatgctgttgaacatggaagccaatcctctggagaaaatgattctgtggagataatccaagttgaggagagcaatgctcatcatgatgaagtggaaatagtgctgggtggggtggaagatccttctgagatggtattctttcctaaaacacgagaggttgaaattcatgaacaattcaatgcgggggaaacacatttgagaagagaaccaagtgatgaggaaagtgttggcagcagcagatcaagccattcttcactatcagaagtaattgacagcatacctgatgaaaacatggaaaaagaggaaaatttgcagcaaggagatggtcatctctctgaatctggaatttcaacacaagcttcagtggaggaatcagacttccagcaagttagtggtgaggtggaagaaaatcaccatgtggaccctgtttatgatcttagtccacaagcttctgaaacactccaatcgattccttctgtatcttctcatgattctgctatggagttgtccgagagggcatatcctgcttcagtagaaatgactgctaatgtggcagatgaagagtctgaagtgcatgatcacagacaggaaggttatacttctggtcatgataaaaatcaagcaacctcttccgaactacatgtggaagccaaaaatgaactgaggtctgagaaatctgaagatgttaataatattactgcaaatgagttatctgcagttgccccaaattttgttgatcataatggatctacaatggctgagcctcaagttgtccctgtttctgtggattcaaatttgtctttcgatattggatcaataaaggatgtgactaatttaggcttagttcatggacaggatctagctgaccacatacgtgctgattctgaaattcttcatcaagacaatgtagattctccagattcagattatcaaatggcttctgaaaagtcacatctatcagataatgaatctgtggaggaatctgcactgcccaatgcagaatcaagatttgataatgcaaatatgtctacgccagtccaagatgcagatgaaatgtttgattctgcagcttctgatgcccaccatatttcttctaatggttcatctatgcctgcaccacgggattttcagctttcacctacagcagggccagcaccagtggttcatcctaatttaccttctgaagaaactgaacatatagagaagttttcatcaaataatgatgccatatttcagattcagcaaggtaaagtcaacatccaccaagatttggataagaatatggttgctttcacttcggacagtcaacatgaaattgatgtgaagtctccctctaacttggagaataatctgtcaagctctgataaatcagttgttgcacaatcttctagtgatcatgatgaaattcagagttctaatgctatccaggttgaatctgcacatggttttggcacttccaatgatgaagttggagaattgcatgatgcagctgacaaatttcctccaagcatttattctgtgacctctgaaaaatttgagactcctgaatttgtgtcacccactggtgaagcagatttggaagttgataggcacagggaagttgaaaatgaagaccaaaatgaagtgttagaaactggacttccttcagaagagagcatgtctcaggttactgaagaaaatagcaatgaatttgatgatatgaaggagattgacgaagaattcttgtcagaattggacactgttggagactttagtgtcaatgatgctggtgtatcacttcatactgacgttgaacatgagaaaactagagatgctcaacttagttcactccctaaggatgtaaagacagaagaggttgagcaggacatcccagttcttgaagcaagatcacttgaagatattaacttggcttttaagcaacttcaagaaggagtggatgttgaagaagtcatccttccaagtacaattaaggatcaggatgtcagtgaagaatctagagatcatctggaagttaattcagaccttcaagttgttgaagccagatctctagaagatattaacattgctttaaaccaagtctctgaaggtaataaaggggagttgccaaattctttggattcaaaagacacttcagtcaaagtagaagagaatgaagttggctcagccaaggtgaatgaattctttgatgtagcaaccagttctgaggaaatgagcagaaccacagtggataaatcggaagatgtacctaatagcagctcgggtaacgaggaaaaatcccacagtaggaaatctagttccagttccagctccagctcgagctcaagtgattctgattga

SEQ ID NO: 4037 - DNA, 423 bp, Glycine max
  Peptide Sequence Number=SeqID_120815
atggtgaaaccatttctagaacccaagacttacaaaaaggtgatatttgtttaccctgacaacccaaggagtcacatggtgatggaggaacaccttgacatggacaaactggaatcctattttggtgggaaaaatacagttggattcaactaccaagcttatgctcagaaaatgaaagaaggtgacagaagcatgtctgatgtttttgattcatgtcgttcatcattgcccggttttttaagctccgaatttcatgaatcagtgcagtcagaaaccaatgattctgaggatgaagcatctagtgatggagtagttttttcaaacttagaggaagatgatgatagcacacatgggaagatgccttgctcccaatatgaatccagtggggttgatgaattaatcgaaaaagacatgaagagctga

SEQ ID NO: 4038 - DNA, 132 bp, Glycine max
  Peptide Sequence Number=SeqID_120816
atgacgatccatgttcagtcaaaactcaaaaccggtggccttggagatgctttttcaagcaaccaccatggggacaccgaacatgggtcattgaagcatattattcatattcctgatgatgagacattctag

SEQ ID NO: 4039 - DNA, 582 bp, Glycine max
  Peptide Sequence Number=SeqID_120817
atggaggagactcaagtgctgcacgaactccacaagctatcacagatagaatcagaggaaaccctaaaccaaatgctatgcaccctttggtccactcgtaaaacgggtcttcccctctccgacaagtcccatttccaatccctcctccacctcccttccccctcccatctcgaccccgttttagcgtgcctccgttccctcgtcagaaaatgcgcgcaccagaacctcgcccgcgacgaccttctcagactgtttccccgcgatcttccgattcagttgcaaacgaatttggtatcagcgttgcagagaaacagagatcggtggaaggaggacgtgagtcacgtgattccgcagctgaagggaacgataaactttgctccttcgctgctttggccgcgccaagaacaagattttgatgcggtggcggtgccggcggttgttcctgatgttggcccttcgggggtgaattcgtgcttccagtgtgatgccgttggtgcttctgataacttgattttgaatttgctgaagaggaatgctagcgatactctcggacactctctatctaacacaatcatagagtga

SEQ ID NO: 4040 - DNA, 699 bp, Glycine max
  Peptide Sequence Number=SeqID_120818
atgatccatcttgtctctttgcatatccctaagagacctcccccattaagagacacactgtcccattggtgtatttctcaccggaagagagctaaagaaatagttgaaacttgggataaattgttcaatgcttcccagaaagagcagcgtatctcttttctatacttggctaatgacatcttgcaaaatagtaggcgaaagggcagtgagtttgtcaatgaattctggaaagttctcccagcagctctcaggcatgtttatgaaagtggtgatgaaaatggaaggaaagcagtgaccagactaatttctcctgcaatcacaatgtttccatttccgttgacatcaatttatctagcgattcatgttgacatatgggaagagaggaaggtttttggttcacgaggtcaaggtcttaaggatgacgtaatgggcaagaatccccttccatctgcaagcaatggaaagagttcaaattctatcaagacagtgaagagggatgcccactcagtgagaataaaactggctgttgggtgtttgccagagaaaatactaacagcatttcagcctgttcttgatgaacatcttaatgagaaagatgctttaaacaactgcagtgctgctgtgcgcgaagtgggtaaagttgtggaagatgttgaaaatacattggctcatggtaagaggattgctagagggacttga

SEQ ID NO: 4041 - DNA, 387 bp, Glycine max
  Peptide Sequence Number=SeqID_120819
atgaagcccctacttatagtaaattcaaagccccaatttggggtgacttatctctgcactgacaattcaaatctaattgcactgttgttgagtttcatccatttgggtcatagccagggcatcagtactatcaaattcagtccagatggtcattgggttgtttctggtggatttgatagtgttctgaaggtttgggatctaacaggtggaaagctcttgcatgactttaagttccacaaaggacacattggagtggtattaggggtatgctcaatagcttttcatcttgatggacagactctatttgttggacttgaggatagcataaagcgtgtggagccatatagtggtggcttggaaactgagaaaaaagaaagcacagagtag

SEQ ID NO: 4042 - DNA, 338 bp, Glycine max
  Peptide Sequence Number=SeqID_120820
atggataccttgcgagtgttggattatgaatatggattttctcatgagtgtattgtcataattgccatagaacagatacagattgtgttggtatattgtatttacctgatttttagggcatttgaagactttcatggccaattctacatgctgactcttctgtacttcaagctttgcagaaaccagttggaatctactttggtgaatgacttacaggagcaggaaaaaaagcttaaacaatatatggagcaacttgaaaatggggaggctgcaagggcttcattttgctttctcagcttaaacatgcacttcaggaacaagtacagttgtttctacaa

SEQ ID NO: 4043 - DNA, 407 bp, Glycine max
  Peptide Sequence Number=SeqID_120821
aaatatgcaaaagctatactgcaaagcttgaagtacagaagagtcagcatgtagaattggccatgaaagtcttcaaatgccctaaaaatcagagctttctgatttttttcaaggcttccacaaccggtggtgagacgattccagcaaccagaactccaacttcagtcacctctgtaccgatgaatcaagatgtttcttctacgtcacttcctatgacgaatttctcaaaacaaatcaccaaaaagctcaacgataaaataattttgatgtggaaacagcaaattcagcccacgatcactatgcttggattcaacaattttgtcactagtcctcaaatccctccgcgatatctttttgacgctgatcacgatctagatcacctcaatcctcaattctcgctatggtag

SEQ ID NO: 4044 - DNA, 288 bp, Glycine max
  Peptide Sequence Number=SeqID_120822
atggcaacaacggagatagaggaagatgagtggatatatgagagcattatgtctgaagaaattaatatgaatgaagacaaggaggaggaacctactgtggttgaaactattgattgttttgttgattattctgatgccttcaatacttctcatgtgtttcttacccgtgaggacatattgcaatgggctcgtactgttgcatatgatattggttttgtggctatgatgatgaggtctgatacatcaactggaaagagaggaagaacatcatttattttaatttgttga

SEQ ID NO: 4045 - DNA, 336 bp, Glycine max
  Peptide Sequence Number=SeqID_120823
atggctgggggaattccttatggatacgggtcaaatagcctgccacctccacctccacctcctttgcctccacacgtgacaataggtttatcaatgcctggccctcaaccagcgcagcagcaacagcagtctccaccgggattttacaggccacctggcatagggttttatgggcaaagccacctatcaacaccaccaccagtacctaggcacatgttcctctgggaaattgctgtgaaagctgaggattttccagcaggctgtgtaataatatggtgttattcccctcttgatgaattttcagagcttcaccttgctcacaatctgggaggttga

SEQ ID NO: 4046 - DNA, 501 bp, Glycine max
  Peptide Sequence Number=SeqID_120824
atgaaaaagatcatgccaagtataatagatgagagggagtccacattcatagagggtagacatctgttacaaagtgcattgatagcaaatgaggtggtggatgaggcaaaaagaagaaagaagtcatgcattgtcttcaaagtggattacgagaaggcatacgactcggctgggattctgtcccaaatgaataaagtggatagaggggtgcttgaaatccgcatctattttagtattgtgagagaggcatgtagcaaaaacttatttaggggattcaaagtgggctcaaacagtgttgacataagcatactccaatacgcggatgatacaatattttttggagaggcatcaatggagaatgtgaaggcacttaaagaaattctgaggtcttttgcacttgcatcaggcctgaaaattaattttgcaaaaagtagttttggtgcaatcgatatgtcggatgttagacaagtggcctcaaatatcttaagaagggggggttga

SEQ ID NO: 4047 - DNA, 1020 bp, Glycine max
  Peptide Sequence Number=SeqID_120825
atgtggggggacacaacagtctcttgggaggtgcagccaataattaattctgcagggggattgctttgtatgtggactgaaaacacattcacattacaaaggaaagtagtggggaatggtttcatttgcttgacaggcctatggattaaggaggcactgcaggttcatattgttaatatatactcaccatgtgacatgcaaagtaagagagtactatgggaaactatcaaacacctaaaaacagccaatcagggaggactatggtgcattatgggggattttaacaacattagagatccgatggaaaggatgaaagtatgccaaagagggatgaaggaaagcaatatccaagagtttaatgaatggatagatgatatggaggtggaggaagcgccatggattggaagaaaatttacatggtttagacccaatggcatcgcaagaagcaagttagatagatttctagtctctccaaagtggcttacaaaatggccaggcagcatccaacacccattggatagaaatttttttggccattgtctggttttgcttaggtcaaaggttgtagattggggaccaaagccattccgggtccaggattgctggcttctaaacaaatctttcaagtcaatagtgaaggaatgttggttgtcccaacagcagagtgggtggggtggattcgtgttgaaagaaaaaataaagaaattgaaggaaaggttgaagacatggaatagagatcggtttggggatactttaaagaaatacaagaagattgagggagaactaaaccagttagaagtgaacttggctgatagaccactctctcctcagcagatgataatcagaaaacaacttcaagaagatctatggatagctgcacaatcacatgaatctctactaagacagaaggcaagggccacatgggtcaaagaaggcgattgtaactcaagatttttccatttgttggtcaacacaacacatagaaataacaatctgaatggagtctggatcgagggctag

SEQ ID NO: 4048 - DNA, 183 bp, Glycine max
  Peptide Sequence Number=SeqID_120826
atggcgagtccgatgacatgcagagatacccaagtggttatctgggcaagcaagcccgttgacatgcagagactaacatcgtcttcttcacctttgtcatccagagacggcgagtccgatgacatgcggagatacccaagtggttatccgtacaaaccaacttctgttaatctcgacccgtga

SEQ ID NO: 4049 - DNA, 267 bp, Glycine max
  Peptide Sequence Number=SeqID_120827
atgtctcctccacctctagtctttacacaaaaaaatctctcaaactctctagaacttggacctttctctctccaaaactctctagacatgcagaagcttcaagaaaaggccaaactccactctaaaatctggtttcaggcttatataggtggctttgttcgtgctcgtgcgcttagcgcaattctgaaccgcttagcgtgcattagtgaatttcggcttagcacatgcttttcttcctcagcggatggactaaagcggtgcgcttag

SEQ ID NO: 4050 - DNA, 830 bp, Glycine max
  Peptide Sequence Number=SeqID_120828
atggataggttcgccgatgatggaaagttaggtcagggatttacattggctgatgatctagtagaagtagatataggtaatggtgatagaccaagacctacttttattagtgctaagttagattctgagtgtaagcaacagttaaccgatttgttaaaggaatataaagattgctttgattgggattatactgagatgcctggtttagaccgatcgattgttgaacatcggttacctatcaagtccggatttcggccacatcaacaaccagatcgccgatgtaatcctagtattcttcatgatattaaggccaaaataactaaatttatcgaagctaaattaattcggcagtgtcggtatgccgagtggatttccaatgttgttcaagtctacaagaaaaatgggaagctttgggtttgcattgatttcaggaatcttaataaagctacaccgatggatggctacccaatgccagttgccgatctactggttgatgctgcggccgggcatcagatcataagctttatggatggcaatgcagggtataatcaaatattcatggctgaagaagacattccgaagactgcatttaggtgtcctggtcatgttgggttgtttgaatggatggtcatgacctttggtttgaaaaatgctggtgctacttatcagagggctttgaattttatctttcatgggttcattggcaagctggtggaaatttatattgatgatgtggtggttaaatctggagatttcacaaagcatcttgccgatttacaaaaagtgttggaatgcacaaggaagcattgtttaaagatgaatccgaataa

SEQ ID NO: 4051 - DNA, 147 bp, Glycine max
  Peptide Sequence Number=SeqID_120829
atgaagctgtcactatcacgaaccaccccacgatctggcatattgggtacaatcgcagataaatacgaggcttcttctcccttgaagaacaatgaattagggttgagaggctctctcctccaggggccagggggtctggttttatag

SEQ ID NO: 4052 - DNA, 693 bp, Glycine max
  Peptide Sequence Number=SeqID_120830
atgcctggtttggaccgatcaattgttgaacatcggttgcctataaagtctggatttcagccacatcaacagccagctcaccgatgtaatcctaatattcttcctaatattaaggtcgaaataaccaaacttattgaagctaaatttattcggcagtgtcggtatgccgagtggatttccaatgttgttccggtttacaagaaaaatgggaagcttcgggtgtgtattgatttcagaaatcttaataaagctacaccgatggatggctacccaatgccagttgccgatctactagttgatgctgcggctgggcattggatcatcagctttatggatggcaatgcaggatacaatcagatattcatggctgaagaggatattccaaagactgcatttagatgtcctggtcatgttgggttgtttgaatggatagtcatgacctttggcttgaaaaatgctggtgctacttttcagagggctatgaattttatatttcatgagttcatcggcaagctggtggagatttatattgatgatgtggtggttaagtctggagacttcacaaagcatcttgtcaatatgcgaaagaggggaattgaaattagtcggagatccattgatgctatcaacaaaatagttgctcctaccaacaagactgagctccagtccttgatcggcaagtccattacttaa

SEQ ID NO: 4053 - DNA, 384 bp, Glycine max
  Peptide Sequence Number=SeqID_120831
atggattttctattaactgcctttgatgagcaaaacactcttaataagagggtagagctcaaattaataaagctagctgctgcactgcctgttgctactaacattgagcaggtaaagaacataactactagaggaggcaaagccaccagagatcccccatacccaaaagagaaacaaagaacatcagcaccagtgcaaccagcagtgatagaagaagaaagcccagttgaagcagaagatctgctacaaccaccaagaactggagaaatgaggaaagatttttacgacaccaactatttgctatttcccagaagaaacagaggactgcagtcggatgagcagtttggtacctacatatgcaaagtacatcagagatattcttaa

SEQ ID NO: 4054 - DNA, 664 bp, Glycine max
  Peptide Sequence Number=SeqID_120832
gctacgatttctagaggaaggacgtggttgttcccacgccgtcgaaccggactccgactccgaaacagatagctatgaccttacgagggaatgctatcacatcgacggggcggtagaaactactgacgagacacgggatgctgccgcaggtggtcgagccaccgcagcacgagaagaccccaggacgcctgtgaacgacggacagctcgacccccctcctcaggaagacagaaccgcgcagctcgcgcagctgcgggagctcaaaatgaagcttgacgaagaccgcgagcgcctcgtcctgctcgagcaaatcctcgagcaagacctgccttacccgccgggcggaagtgtccgcagacgcgctcgggaggtgcatcgacagatcgtcggcgacgcagagccagaacaacctgtcagccgtttccctcgagcaagccagaatgtagtggcagcgacgatgctgctacgtaacatgccagagccgtcgaattcccaagcccgacgcattcgagatgaagtacagacattgctccaggtggcggcggttcaacaagccgaaagttcggcgtctcgacgacgaggagctgccacagagaagcacgacgaacagcctctaaacgaagaggaggtgtcagtccatcaacaacctcaccctcgaggttga

SEQ ID NO: 4055 - DNA, 252 bp, Glycine max
  Peptide Sequence Number=SeqID_120833
atgagtgcaactccggccggataccccgatctggttcaagtgcgcaccccagttggtagtaaggatgtgcggggagtcaatggcgtaagaccgaggtgtcaggctttttatgcaaaaagtgagtcaaaccagtccactaagatcagccttgcatactccttggtgtcactttatttctggtttatgacggatgatgttgtttatcacggctactgtgctaactatcatcatccggctgcggacgatgaatag

SEQ ID NO: 4056 - DNA, 1215 bp, Glycine max
  Peptide Sequence Number=SeqID_120834
atgcccttaaatgcgcgtcaagtcgagactgcaaaacccagagacaaagcctacaaactcactgatggcggagggctctatcttatggtcaacactaacggttcaaagtactggcgcatgaagtatcgatttggcgggaaagagaaaaagctctctttcggaacctacccgaccatctcacttgcggaagcccgaactaaacgagatgaagcaagaaaggtactagcaaatgacaaggatccaggagaggtaaaaaaagccgcacagctcgccaaaaagctatcagttaccaacacatttgaagcaatagctctcgaatggtacaacgcaaaagtatctggctggtcaaagagttatgcagattacgtcaaccgaggttttaaaaataatgtctttccctttctaggctctcagccagtgaatgaaattaaaccactggagctattatctgtattgcaacgaatggaaaagcgaggagctccagagctcgcaagcaaagtacgccagcgttgcagtgaggttttccgctacgcgattgttacaggtcgtgccgaatacaaccctgcggctgatcttggtagcgctttgcaaggccatgataaacagcactatcccttccttaccgctactgagcttcctgattttttacaaaagttatcaagttactctggaagtctaattactcttctcgcaacccgtttgctcatgctgacaggcttgagaacagtagaattacgtctggctgaatggagtgaaattgactttgataatcgtatctgggaaatccccaaaactagaatgaaaatgaaacgtcctcatgtaatcccgttatcaactcaatccttgagcgctcttcgtcaattggaagaactgacaggaacctacccgcttatttttgcaggacgaaacgatgttaacaaagcgatgagtgaagctagcatcaatatggttataaaaagggttggctacgacaagagagctactgggcatggtttccggcacaccatgagtaccattttgcatgagcaggggtttaacactgcctggattgaaatgcagcttgcacatgtggataaaaactcgattcgtggaacgtacaatcatgcgcaatatctggatggaagacgagaaatgatgcagtggtacgctgattatcttgataggttggaaggtacaaataccatcggtaaatcatgccgtggtagttttatttaa

SEQ ID NO: 4057 - DNA, 291 bp, Glycine max
  Peptide Sequence Number=SeqID_120835
atggagcaacatcaaataaaagaactatcttctccaaattctaccaacattgatcttgacaagagaatgtcaaaaaatagaagatctttgcaagatataatgtccatgagatgggataatgtgttcacaattcatgcaacaaccaatgagattgatggttcggttgaattttcaattatgttgcatgtgagagatgccaaaagaaagttacaaaagaggaaaatcaatacacttgcagagaatgcagacagtcatccaagtacccaacaaggtttaatgttttgtatataa

SEQ ID NO: 4058 - DNA, 402 bp, Glycine max
  Peptide Sequence Number=SeqID_120836
atgggggagacacatgaaattccccatcacaatctagctgacttcgagccttggctcggatatgccactaaagggcaagcagttggtggtatacccctacaaaacccttcggagggccctcatttctgcccacaaccgcaacccttgcattttgcggtgggaagagcccctcttgctatggctgaaaatggaaagttggatcggatagaggaaaggctaaaggtcgttgaaggaagcgaagattatgcctttgctaacctagaagagttgttcttggtacccaatgtcgtcacccctcccaagttcaaggtgtcggactttgacaagtacaaggagactacttgccccaagaaccatctaaaagatgtattgtcagaagatgggggcataagcaaaagatga

SEQ ID NO: 4059 - DNA, 231 bp, Glycine max
  Peptide Sequence Number=SeqID_120837
atgaggtggaatacgtcgaccgttagggctgtcactaccctagggctaccacaacaatccgcaggattgggtgcaattctaggtcgatggaacagcgtccgcgaaaagagtcctgatccaactccaagtcagggcgggcgcccaggtcaactgggtgggcgcccagtgcctagccccgttcggcctccgcttccttcccgtggcttctcgagtcttctagatgtaagataa

SEQ ID NO: 4060 - DNA, 711 bp, Glycine max
  Peptide Sequence Number=SeqID_120838
atggaagaaaacgtgaaattgaaggagtctccgttcaccggacaacaaggaaagccatctgaactaatcacttatttgtacattggccacttcttagcaagatggggtgccagaatgtggaaattctctgttggtttatacatgatcaatatttggtcagaatcattgctgtatgcagcaatatatggtgcagttgaatctgcctccattgcagtgtttggctccataattggaagatgggttgataagttgtcttgtgtgaaggtgagccccaaagtcactgatgaaattccaattacttgcctcagctttggaactttgatgacagctaccttaaaatgggaaggaatacctgcatatgttattggaatagcaagaggaataagtgttgtgattggaatagctgcaacagctgtatatcctgtgctacagtctcatatatcgaccattagaactggactttggtctatatggtctcaggatcttgtttctgaatccgatcgtttgattgttggaggcgttcaaagttcgcttcagtctttgatgggtttattggcctatgtaatgggaatcataatatctgatccacgggacttctggaagttgacttcaatatcttctagcagtcacattagctgcattcctctactgtatccacgcataccatgtacgaaagcacctctgccacttagaccaagtattgtggggtaa

SEQ ID NO: 4061 - DNA, 1506 bp, Glycine max
  Peptide Sequence Number=SeqID_120839
atggaagaaaccttcatattgaggagagagcctcttcttgcccaacatcaagaaaccccatcttctttaatcaatcatttgtatattggtcacttcttagctagatggggtgccaggatgtgggaattctctgttggtttatatatgatcaacatttggccagactcattgctgtatgcagcaatatatggtgctgtagaatctgcctccattgcactgtttggttccataattggaagatgggttgacaagttgtgttatgtgaaggttttgcagttgtggttggtgacacagaatctctcttttgttgttgctggggccactgtagttgctttactactcaactcatctttgaagttgacaaatttctcagctttcatattgatggtgttgacaatcaatatctgtggtggcattggtgtactttcaactcttgctggtacaatattgattgaaagagagtggttgttagttatatctgaaggtcaacccccagaatttcttacaaagatgaattcagtaacgagacgcattgatctaacctgcaagcttcttgctcctgttgttactgggttcataataagctttgtatcactgaaagcatctgctataactttagcactatggaatactgtgtctgtttgggtggagtattggcttttcacatctgtatataaagggattccagctttgggtcaaagtagccagaggagaatggcaagacttttagaaagtgatcaagaaaggagcaatccaacattggagggagatagattgcttcctgttactgatggtagctcagaattggtagatagaaaatgcagtaaaaaactttatgagaagatttcagagattccttatattgctgcatggagagtatatttacagcaagaagttgtccttcctggactagctctggctttgctattttttactgtactcagctttggaactttgatgacagccaccttagaatgggaagggatacctgcatacgttattggattagcaagaggaataagcgctctgattggaatagctgcaacaattgtatatcctctgctacagtctcatatatcaagtattagaactggactgtggtctatatggtctcaggatcttgttcctgaatctgatcgtttgattgttggaggtgttcagaactcacttcagtcattgatggacttattggcctatgttatgggaatcatattatctgatccaggggacttctggaagttgactttgttatcatttctagcagtcacattagctgcattcctctactgcatccatgttttaaatctaaagaaacagacttctctgttggtaactaatgtctttaacatatttgcacttaatggaataagatcattgtcattgccatcatctcaattacttcagttgcttccttttttaagcgaatctcatctcaagtgcgacataattgacatagtggctcttggatctattatgaacaatgctacaatcaaatgcttcctttga

SEQ ID NO: 4062 - DNA, 318 bp, Glycine max
  Peptide Sequence Number=SeqID_120840
atgtgccttgctatcaagtttccactactgtttgaagccatcaaagtctctgtaaaaccaactgtcaccaccttctttcttcaatcacaatgcgagtacacgattggttcttcgttagttattcttctaaccaagaactctcactcaaccaccacacctcacgaaaaaatggtgcagaagaagactcaatacacaaaacttgcaagaaaacagaaagaatctcacaggaagaagacacacttcattgaaaacaatcaagactctctaactaacattcctcacaggtgtaggatctcacaactcttgataccatgttaa

SEQ ID NO: 4063 - DNA, 501 bp, Glycine max
  Peptide Sequence Number=SeqID_120841
atggtcaatgcaatgagggcttgcaaggagataatctcatatcaacaagtggtagaaaaaatattgagaactttgcaccacgggaaagaaccatggaagggaaacaagtcaaacaccgccacaaagaaccaggaacaagtgatagttgaaggtagtgaatcctccaaaggaaaaacaacatgccaaacttctcagaaatcaaactacaacaacaacaaggagtggaagctcgacaaaagaaaggtgaaatgctacaactgtcaaaaacttggtcattatgcaaaagaattttggcaaggagaaggtgccaagaacaaactcaataatcatgcaaatttggctcaagatgaaggctcagattctgaacttgtattgcttatggctaccattagcagtgaatcatcaagcgacttctcatggtacttagattctggttgctccactcatatgacaaggaagagggattggttcatcaatctaaataaatcatccaagagctga

SEQ ID NO: 4064 - DNA, 1041 bp, Glycine max
  Peptide Sequence Number=SeqID_120842
atgcagagaaaagtggcaatgaaagtgaaaatcatacttgaagagaatgtgaagcggatgatgtccaacataaatattgaaagctgctgtaagatagcagatttaggttgttcttcaggacccaatgcactgataactatgtcaaatatcttgaacatcatgtataatgctagcctgagcttaaacaagcgtgtgccacgtgtattccaaatttacctcaatgatctattcggaaatgatttcaattccatcatcaaattaattccagacttctaccaaagtatacatcaagaaaaaagaggcaattttggaacatgctttattcatgcaacaccggggagcttttatgggaggctttttcctgataattacatccacttctttcattcttcttacagtctccattggctatctcaggcaccaaaaacttcgagcaacatagctataccactcaacaagggaaatgtttatataacaagtacaagctcttctttagtctatgaagcatacttcaagcaatttgaaaaggatttcaaactttttctaaagtcacgctcggaggaactaagatcgggtggtattatggtacttactttcattggcagagataaaactcgaaaaattaataatcctgcagaggtaattggtatggtactcaacggtatggtccaagagggtctggttgaagaggaaaaattggacttctttgatttacctatatatggtcctacagcagaagaagttggacaagtgattgaaagagaaggatcttttacccttcaaacattaaaaactatcaaaataggttgggatgcaaaccttgaagaggaagttgatgatggtattcttgatagcaaaataagaggggagtttatagctaagtctatcagagctgttttggaacctatcttgtcagctgagtttagcgaagatatcatggatgagttgttctcaagatacgcaactctggttgcccaactcattgaggtggagacgttggagtatactaatgtagtagtcaccttgaccaaacattcttga

SEQ ID NO: 4065 - DNA, 183 bp, Glycine max
  Peptide Sequence Number=SeqID_120843
atggaggatggtgagacattgaaactcatttgtattctatcttgggtgttggagagcttcgatctaggagcgtgggaacagttaatggttacaaaggtgaacacgagaatggagacacacatggaagccatggagaaggagatagacgagaatcgcgaagagatggaggcacgaccattatga

SEQ ID NO: 4066 - DNA, 207 bp, Glycine max
  Peptide Sequence Number=SeqID_120844
atggagcacataactacaagtgatgagaggttcaaatccttggaatccactatgtcaaacattgtcactcttatgtctcaaagaactcttgacacacttccttcccaaactaaagttaatcctcagaatgaggagataaatgttgttagcaccaggagtggaaagtctgtggtagaattgaagaagaaagagtcactcgaacactag

SEQ ID NO: 4067 - DNA, 390 bp, Glycine max
  Peptide Sequence Number=SeqID_120845
atgaaagtcattgtggctaagcctcacccaagtgtagggaagaaaaacccttccaagaataaggtcattccaaaagatcctggatggagtaagaaaaagggagatgacatcatcattcaagctcttgggtatggagtggatgattatactagagtattagtgaaaaaaaccatgttcaaggttgatcgattttttccctttttcatccgtgaggcttatgatgttaaacaagcgctatttgggaggcaaccgatgacttgtatccatatattatgtttttcacataatttcctttcatttgttaagtcaaattgtctctcaattcgaggaccatggtcatttgaccatgacccatgcatttatcgtcagaatcgagtatggttgtggtaa

SEQ ID NO: 4068 - DNA, 384 bp, Glycine max
  Peptide Sequence Number=SeqID_120846
atggagaaagcaaatttggtattaggatctggatctattcttgggcgtcttttatcttttccttctgctgcactaaatatgcaaaacaataggatgtttcctccatctctaagccctctgcaggaagaaagactaagaaatctacgacaacggcttgaagttccctttgatggttctaaagcagagcaccaagacgcacttaaacaattgtggaaattggcttacccggacagggagcttccttcacttaaatcagacctttggaaggaaatgggatggcaaggttctgacccttcaacagattttagtttcttgtgtacttttggaactaatgggttacaatcccttggcatgttcttatggaatgcagaagttgcttcatag

SEQ ID NO: 4069 - DNA, 222 bp, Glycine max
  Peptide Sequence Number=SeqID_120847
atggtcatggtattggtaggtatgccatcatcactgcaaaggaggaatgagaatttcagtctcactgaggaattgcaaagatggcattcagaaaggaatggaggtccaccgcagcagatttaccagcactgcaaagcaggaaaatgtcaatctcaatttcacagtggaattgaagaaaagacaaagggtgcaattgttgatatacttgaaagggacaaatag

SEQ ID NO: 4070 - DNA, 786 bp, Glycine max
  Peptide Sequence Number=SeqID_120848
atggacgatactctctacccattgagcacaggtctcaatttggcatgtcgaaagaacatagaagggtatatgttgaaacatctgctgatggaagaaagtgaagtaccaaagctttgcgtggatttgtacagggagtatgggacaactatggcaggactaaaggcctttggttatgagtttgacaatgatgaatttcatgcctacgtgcatggaagattaccatacgagaaactgaagccagatccagtgttaaggagccttctgctttccatgcctcagcgtaaaatagtattcactaatgcagatcaagcacatgcacaccaagttctcaacagattggggttgaacgattgttttgatggcatcatatgctttgaaacgcttaatccgcctaattacacaaatgtacctactgatactcacttgctaacatggagtaagtcgtttaacaaagactgtaaccaagtagagagcggatgtttcaactccaagacacaaatcctatgcaaaccctctgtggaagccattgaagctgccattcagattgctaatgtagatccaaggaaaacgttgttttttgatgacagtgcaagaaacattgcaagtgggaaagctgctggacttaacacagttattgtgggacgctcagatttggtgcctggtgctgactatgcactgaatagcattcataatatcaaagaagcattgcccaaaatatgggaggttgagggagagctacagcaaatgatccaatccccagcagttgaaaccatggtccttgcatag

SEQ ID NO: 4071 - DNA, 741 bp, Glycine max
  Peptide Sequence Number=SeqID_120849
atggcgtcttcattatctgctcaattggttcaatgtcagaattcacttccacctcttcaggctaactttagccaagatgtgtctaaggttcaaaggtcacatgtggtatgttgcggtaccaaatcaccgattggttatggtaaaacattggcatcaagatcacataatgccctgaggttttctgtcacgcaacaatctgtagcaaggtcaattcgatataggagaatgacatgtgtcaatgctgcagatagtgttgtagagcttcaagccaagatcaagctgaacagtctttgtacagatgagaaaggatatggttacaaaggaagctccttccatcgtataatcaaagatttcatgattcagggtggagactttacagaaggaaatgtgagctctgttatagttgtttgtatgcctgcatatatggaactggtggaattagtatctatggtcctagttttaaagatgagagttttgccttttcaacactttcttgctgtgaagcatgtcggtcctggaattctgagcatggcgaatgctggtcctaataataatggtagtcaatttttcattttcactgtaaagactctatggctagacaattggcacgttgtatttggacatatcattgatggaatggatgttgtgaagacacttgaatcccaggagacgagtaggtcagatgtccctcggaaaccttgcagaattgttaattgcggagaactgcctatagagggttga

SEQ ID NO: 4072 - DNA, 318 bp, Glycine max
  Peptide Sequence Number=SeqID_120850
atgtggaacaatacggtggcgactctcatgatcgcgaaaccacaaagacaatgtctgaacattgccattgataaggtaggagagcaagaacctcgcccgtggcacaaaactcgaggtaaggagcaagcagaggaggaggcaataggagccgacagtgaagtggaagttcgagtggcgggtggcgaaaagaaaaaacccactttgcaagacagtgttttggcctctttttatgctactttatcccgaaacagcaaatgggtcgcatcgctttcagcctcggaatttgatgacgacgatgatgatggagcatggtggtga

SEQ ID NO: 4073 - DNA, 237 bp, Glycine max
  Peptide Sequence Number=SeqID_120851
atggatagcttcgaagttgactctggttgttcagggatgttgattaaccttgaattggacacgtcaacgttgacagcaacaaccgaagcagctggtgcctctactcaactctcgtggggtccaatactttctccaatttctttctttttactttactataccaagaaaagagaaaaccttacaagctttattgttggtaattctaatattttactccaagcgattattctattttaa

SEQ ID NO: 4074 - DNA, 2292 bp, Glycine max
  Peptide Sequence Number=SeqID_120852
atgggcaacggcacttctcgtgttgttggctgtttgatgccatttaatggcaaaagtggggttgatttggagtttctagagccattagatgaagggttaggccattccttttgttatgtgaggccatctatttttgaatctccagccattaccccatcaaactctgagaggtttactgttgattctagtacccttgattctgagacgttgagtggctcatttaggcatgagagcattgaagagaggcctggtaagaatgttgcagaaaccacgttcaaaacgatatcaggggcttcggttagtgccaatgtttccactgccaggactggtaaccagaacgcgttacttgctagcgatgttctggagcctgcagcatcgtttgagggaacctcgtcgttcgctgcaatccctttgcagcctgttccccggggttctggacctttgaacggtttcatgtcgggacctttggagagattttcttctggtccgttggataagggcggtggtttcatgtctgggccgatagagaagggtgttatgtcgggtcctcttgatgccactgataagtccaacttttcagcgccacttgctcgtggtcgtcgaaggccgcacctgcagcgcctcatgagaagtgtaagtggtcctatgagaaacactttttctcggactttttcaaggcactccatgggtggcagttgggtgcagcggttattccttcatccggtgtctcaactagcttggaattccaaagaggcaaagtttcgacaggaggtttctagaaactgtgctgaggttggatcgtccgaattggagtataaacatacacaaaatttgcagtgggcacatggtaaggctggtgaagatagggttcatgttgtgctttctgaagaacaagggtggctgtttattgggatatatgatggttttagtggaccagatgcacctgattttctgatgagtcatctttataagtttatagacaaggaattagaagggttgctctgggattatgaggataatcctgttgatccacttaaacctgaagtccttaaaaatggaaatgatgtagttgctctagaatgtgatagggaggaaatgtcagatgctcataccatttcaaatgaagaaagttcttgctgtttagaaaattcttgtaccgtaatggtcaaggatcaatcatctaatagtgagatagtggaggtaaatgctgaagttaaggtaaatattgaacagagaaattgtggaagtcccagtattgtacatactgatcctgaatctgttccaattggacaattgagtggtcaaggcagaagaagtgtgcgactttatgagctacttcagatggaatcttggaatgaacagttgttagaacaaggcagggattctgtggttcccagggaaatagcacaagagaggcaaatgagattctgctcacctgatggtaaagaggatagatctagacatccagacgaaggtcccactacttcagggcaaaatggaggtgctgggtttaattcaaccaaccaggtgccgatagctcctttttccatttcaggacaaaggcagaattcaagaaagtcatttattggtacaaaaatcagaaaaatgtacaggaagcagaagtccttgcgtaagaaactttttccttggagttatgattggcatagggaggaaactttttttgaccagaaattagtggaatcctcaggacccattagaatatgcaagtctggagtagatcataatgcagttttaagagcaatggctcgggctcttgaaagaacagaggaggaatacctgaaaatggtggagaataatatggacaaaaatccagagcttgccttgatgggatcatgtgttttagtgatgctgatgaaggatcaagatgtttatgttatgaaccttggagatagtcgtgcaattttggctcaagaacggccaaatgatcgtcattctaatccgtgtctcatcaaagatgatatgaggcataggaatcggtctagagagttgttagtgggcatggagctggatagaatttcggaagagtccccagtgcacaatataaacaagcatgttaacatgataaacaaaaacagagagatatccgtgtgcagattgaaaatgagggctgttcagctttccacagaccacagcacaagtattgaagaggaagtttctagaataagagcagaacaccctgatgataatcaggccatatttaatgatagagtgaaaggacaattaaaagtgaccagagcatttggtgctggattcctgaagagggtcagttga

SEQ ID NO: 4075 - DNA, 157 bp, Glycine max
  Peptide Sequence Number=SeqID_120853
atgtccaatgtgagaataaatgtgaaaaggaaaagagtaattagggctagaatgaagattaccaatgacgacctcagtgtgggcacgacagcaagtgcacggcggcatctgggatggcggtgcaatgatgtgggtgagaggacgcgcgctcgcgtgg

SEQ ID NO: 4076 - DNA, 636 bp, Glycine max
  Peptide Sequence Number=SeqID_120854
atgggaggtgcatgtggctatggaaatctctacacagatggttatggcacaaaaacagctgccctgagcactgttttgtttaatgatggaaaatcatgcggtggttgctataggatagtttgtgacgcaagccaagtgccccaatggtgcctcaggggcacttccatcgatattactgccacaaatttctgccccccaaacctcgcacttcctaatgacaatggcggttggtgtaatccccctagaccacactttgacatgtctcaacctgcctttcagacaatagccaagtacaaagctggaattgtaccaatcttgtacatgaaagttgggtgcaaaagaagtggaggcatcagatttaccatcaatggaagggactatttcgaattggtgcttataagcaacgtaggtggagctggagagatttcccgagtttgggttaaagggtccagaatgaataattgggaatccatgacgaggaattggggtgctaactggcaaagcttaagatatgtgaatggtcagagtttgtctttcagagttcaactccgcaatgggaagactcgcacggcaaataatgtagcaccgtccaattggagatttggccagtctttctccagcaatgttcagttctga

SEQ ID NO: 4077 - DNA, 735 bp, Glycine max
  Peptide Sequence Number=SeqID_120855
atgcaattcaagtatgggattcctggggcaatgatttcaacaattttggcatactggattccgaatattggtcaactaatatttattacatgtggttggtgccctgaaacatggaaaggtttctctgttttagcattcaaagatctttggcctgttgccaagctttccatttcatctggtgccatgttatgtcttgagttctggtacagcacaatattgattcttttgactggtaacatgaaaaacgccgaggttcaaattgatgctctatctatatgtattaacatcaatggatgggaaatgatgatagcatttggtttcatggctgcagcaagagaaaaagtagcttatctctttacttccaacgaagacgtggctactgctgtgggggatttgtcacctctgttagctgtttctttgttactaaatagtattcaacctgtactctcaggagtggctgttggagcaggctggcagagcactgtagcatatgtgaacataggatgttattacctcataggtatcccggttggaatagtgcttggtaacattattcatttgcaagtcaagggtatttggattggaatgttgtttgggacactaattcaaactatagtcctaactataatcacctacaaaactaattgggatgagcaggtaattatagcccgtagtcgtattaataagtggtctaaagtggaatctgatcatgaaacaactacatcagataattag

SEQ ID NO: 4078 - DNA, 750 bp, Glycine max
  Peptide Sequence Number=SeqID_120856
atggcaagtgcgttgtcaacactttgtggacaagcatacggtgcaaaagaatatgacatgatgggagtgtatcttcaaagatcatggatagttttattcttaactgcaatttgtcttcttcccctgttgatcttcgcaatcccaattttgactctcttagaccaggatgagaccatagcacaagtggcaggaaccatttccctttggtcaattcctgtcttgttctcttttattgtctcattcactacccagacattcctacaatctcaaagcaagaacatcatcattgcattcttggcggctttttcgatagtcattcatgtgtttctctcctggctcttgacaatgaagttcaagcttgggattgctggtgcaatgacttcaacaagtttggcactatggattcctaatattggtcaactaatatttataacatgtggttggtgctatgatacatcgaaatggaaaggtttctcatttttggcattcaaagatctttggcctgttgtcaagctttccctttcatctctaccaactaatgggttaattcttgagctctggtatagcacaatattgattcttttaacgggaaacatggaagatgcagaagtccaaattgatgctctatctatatgcctcaacataaatggatgggaattgatgatatcacttggtttcatggctgctgcaaggaggactgatctaaacaagcacctacgcctttcaagcatagtactcgaggggctatga

SEQ ID NO: 4079 - DNA, 177 bp, Glycine max
  Peptide Sequence Number=SeqID_120857
atgacctccccctctatgccctgcgataatgattcctctggcattacggcctttaccacaacgatgttgtccatagatcaaatgatttcgtggattggattttacttgactgtctacggctccattgcgtgtgcttggggtgttcatgttcatgggggaggaggtgacccgaaatag

SEQ ID NO: 4080 - DNA, 780 bp, Glycine max
  Peptide Sequence Number=SeqID_120858
atggataggttcgccgatgatggaaaattaggccagggattcacatcggccgatgatctagtagaggtagatataggtggtggtgataagcctagacctacttttattagtgctaagttagattctgagtgtaagcaacaattaaccgatttgttaaaggaatatagagattgctttgcttgggattatactgagatgcctggattggaccgatcaattgttgaacatcggttacctattaaatctagatttcggccacatcaacagccagctcaccgatgtaatcctaatattcttcctgacatcaaggccgaactaactaaacttatcgaggctaaatttattcggcagtgtcggtatgccgaatggatttccaatgttgttccagtctacaagaacaatgggaagcttcgggtttgcattgatttcagaaatcttaataaagctacaccgatggatggctacccaatgctagttgccgatctgctggttgacgctgcggctaggcatcggatcatcagcttcatggatggcaatgcagggtacaatcaaatattcatggctgaagaggatattccaaagactgcatttagatgtcctggtcatgttggactgtttgaatgggtagtcatgacctttggcttgaagaatgctggcgctacttatcaaagggctatgaattttatctttcacgagttcatcggcaagctggtggaaatttatattgatgatgtggtggttaagtctagagacttcacaaagcatctcgccgatttgtga

SEQ ID NO: 4081 - DNA, 904 bp, Glycine max
  Peptide Sequence Number=SeqID_120859
ccattctgtttcgcctccaaaaccaattcccaactgggtggaagaggttgatcttccaaccgaggatcaaaacgataccataaacgatcttagagataagtgtgcgattcttctagaatccttctctaaaaaccaatcaagagaccgctttacatggcaagatatcgcacaacgcctcgttttggaggggaagggaacgaccgctgaagtgggtgccaccagggaagacttccaacacgctgaggcaccttttattactcaaggatggataaacttggttgaaacaggcattgttggtctggctgctggtctagcgatccctcctagccgccgcctagagtgcagcctgcctgttgaagatcagatctttatcattaatgcaacctccattttgctcattcatggagttgtatttagtacctctaagaaatatgattatccaccgttagtcagtaatgtgggttggcttggattacttagtgttgcgcgcctaggagggcagcgcgctttgggatgcggaggagcgaagcagctcgaacgaatgaatgtgagaggagcgaaaaaagcccagctccctaacctaatgcggcaccgggttcggaccgcagggaaccgtagcatgggaggatctggctcgaatacccctggttctggaaggcacatgagtccgaacgctatgttgaatgtgcgaccgacactacactacgtaggtacctgtgcaggcgaggcgtcgggatcgggagggcatagcacaattcttcttggaggagggttggtttgcccggcgaaaggtgccatgccatggagtgaggaatatcccgagtctcatgtaagacaactaaatgcacctcgaggtgctgccgaggaactgggggaccttctcgagcacaggataggcaattga

SEQ ID NO: 4082 - DNA, 597 bp, Glycine max
  Peptide Sequence Number=SeqID_120860
atggatcacacaataccacacatggccctcttgatttattgccccattagaatcctgaggcataagaaaagccatgaacatagtggattagctgcaggctttgatcccatgggtacaataaaaatgactccaaaaagacattttgatggacatgccggaaaaccaaaaaatattgatgcacaatccgtaagtttccgtgacacaccggaaatcaaatggaagcatcgttgcataattaaaaaatctaagccgaggcgcttccgaaacgtttccgtaacgttttccgtgaagaatttcgcaaaggtttcaaccgttcttcgacgttcttcattcgttcttcatcgttcttcgatcttcaacgggctgccgtcccttgggacggacgtgtggggtgctaataccttccccgtgcgtaaatacaactcccgaacctttcacttaaaagttcgtagatcacgtcttttccggtttttccgacgttttcctcaaataaacgttggtggcgactccgcgcgtattcctttcgtggaacacgcatcccgcgagtcacgcgtcgccctcccgccgaagggtaggttgcgacagctatatatttaa

SEQ ID NO: 4083 - DNA, 1680 bp, Glycine max
  Peptide Sequence Number=SeqID_120861
atgacgaaatcaaataggagatttagaacctacaactctgattcaggaaagataacaatccactacgacacatttgtgagcttcgactcaaaagatatcgacaaagagaaaaacatgactatgccaaggattagggaaaggagcaaagtgatggatgatcgatcagaggaagatatccaatcagcactactggatccagataaccccaaatatagggctgcacttaaactgcagaaagtatacaaaagctttcgtacaagaagaaagctagcagattgtgcaattcttattgaacaaagctggtggaagctcttagattttgctgaactcaagcacagctctatatctttcttcaacattgagaaacatgaaactgccatttcccgttggtctagagctacaaccagagctgccaaggttggcaatggtttatcaaaagatgacaaagctcaaaaacttgctttgcagcactggcttgaagcaattgatccacgccatcggtatggacataatctacacttttattatgctaaatggctcaagtgtcagagcagagaacccttcttctattggctagatataggagaaggaaaggaggtaaatcttgagaagtgccctcgatctaaacttcaacatcagtgtattaaatatctgggcccgatggaaagattgccatatgaagttgttgtgaaggatggaaggttcttctacaggcaatcaggaaagctacttcacactactggtgaaggtgcacataccaagtggatttttgtccttagcacatccaagatcttgtatgttggcaagaagaagaaaggttcatttcagcattctagcttcttggctgggggagccacatcttgtgctgggagactagttgttgaatatgggatgttgaaggcagtttggcctcacagtggacattatcgtcctacagaagagaatttcaaggaatttatttcattccttctggagaatgacgtgcagctttcttatgtcaagatgacttcagttgatgaggaatatcactcatcggaagaggacttcactgagaacatgagtggcttggaggctgaagagaaggccaatttgatggaaaccaagaggacttctgcaccagtgggacataagacgaggcaattccagatttttggaagagatctaaccagtcttgaaataccaaaaaggggtcatgtgcttgaaggaccagagaacgagaaaggaggtgctgggctgagtagtaagagtttccaaatggattctccaacaggtgatcaagaaacagaacaagcttttgcatcagagctagataacacaatcacaaagcaaaacttctttgacgatgacagtcacgtaggaactattccaaaaaagtcaacacttaaaaggattgcctcacataaagaaatgaaatcataccaactggggaaaaagttgtcttgcaaatggacaacgggagttggacctcgtattggctgcgtgagggactacccttgcaagcttcagttcagagccttggaacaagttagcctgtctccaagaagtggttgccactctacatctcctagagtttcaactccagtctcaaaaatatcacctaaaagtctgcttcgaggacttgagcacaataccccgttggttagagggatatcagtgataccagttattcatacgtcatga

SEQ ID NO: 4084 - DNA, 1218 bp, Glycine max
  Peptide Sequence Number=SeqID_120862
atggcaagatttgatcatttctggaatctggatgaattcatcgtgtcgactctgacaactgacagattaaagagaaacatcgtggaggaaacaatggcagcaaggtattggtgtcacatgtgctctcaaatggtcaatcccatcatggatatggaaatcagatgcccgttttgccaaagtggatttgttgaagaaatgggtaacacccccagtagcagcagcattcccaatacatcagaatctgattttgaatctgatcgggctctctccctttgggcgcccatcttgctaggcatgatgggcaatccacgtcatcctagaagactcagacaaatagccaatgataatggtaatcgtgattatgttgatggtgtagcagatcatggtagagaaactgaatatgatcaagagtttgagtccatccttcggaggaggagaaactcagctaccattctacaattgctccaaggtataagaactggactggcatctgaatcatatgagaatactgatggccatgaccatgacagggaaagagaaagagaaagagaaagagagcacatgatcttgatcaatcctttaaatcagactattattgttcaaggttcctatgagtcaaaccgggatcaaagtgataatcatagctccgttgggtccctgggtgattatttcacagggccgggtttcgatatattgttgcaacatttggctgagaatgatcctaataggtatggaactccacctgctcagaaggaggccattgaagcgctgcctaccgtcataatcaatgagaattcgcagtgttctgtgtgtctggatgattttgaagttggttctgaagccaaagagatgccttgtaaacataggtttcatagtgggtgtatccttccctggctggagcttcatagttcttgtccagtttgcaggcttcagttgccattggatgagtctaagcaagactctgatctgtcaagggatagcagaagccaaagggaggatgaaagtattgaacatgacaatgatgaagaaagagatggcgaagggagaaatgcaagtggggctgactttgtcaaggtctgtaatccagaagtagagaagcgtgatgggagagcaagtcacgtggtcaaggagttattaggaaagactggggagtggggcttgggagagggtgcaaagagattcctgttattccagtttggagaattagcagagatataa

SEQ ID NO: 4085 - DNA, 759 bp, Glycine max
  Peptide Sequence Number=SeqID_120863
atggccatgagtgtgggcgtggcattgccatccaccaccaccagtctcagtttccttcgctaccgctctcgctctccaattcaaaataaaatccgttttccccgtcaaattgtttctaaattaaacagtgcagaggtccaggttcaaacctgtcttcaggccttgtattgtagcgtgtgggattggaggggttactctattcgctatcaacattctggaaatattggccctgcactagttttagtccacggttttggagctaacagtgaccactggaggaataatatttcagttcttgcacaatcccaccgggtgtactccatcgatcttattggatatggatattcagataaaccaaatcctcgtcaaatcggagaccattccttttacacttttgagacctgggccactcaactaaatgagttttgtcttgatgtcatcaaggacgaagcattctttatatgcaattctattggaggagttgttggtcttcaagcggctgtgttagcaccacacatttgccagggtattatccttctcaatatatctctgcgtatgcttcatataaagaagcagccttggtatggaaaacctttcatcagatcgctccagagattgcttagggatactgatgttggcaaattcttctttaaaactatagccacaaaagaatctgtgaggaacattctttgccagtatgctggacaaccaaagaaaaaggaaatgccagacgatgagactgttaatgaattagaataa

SEQ ID NO: 4086 - DNA, 834 bp, Glycine max
  Peptide Sequence Number=SeqID_120864
atggcatttcctgtacgtatcagaaatgcggttcaaggagctaataaggacaagcctgcagacctcacactcacaagaataagaagtcagaagggagaagagaagagaaagaattctccaataacggtttggataggaatgtctccacccaagcacgatccagcgaatctttggtgccagctcagcattcatttctcaacgaaatcaccaagtgaaaaagatgcggaaaattgtattctccatagctacaagtatagtttctcggggttctcagcaatgctaaatccaacccaagcagctacactggctaatatgcgagaagtggtgtcggtttacaggagcgagtcatcacaatcacacacaacaagaagctgggacatcatggaccttaacttggacagtagtgaagtaacgccattgcagctgatttatggtgaagacatcattgttggggtattagacacagcatatactctggacacaaccttggacagtattctttccggtggatcaacgaaagtagcggatccttttaacatgggtgctggccacataaacccttcgaaagcagttgatccaggactaatctacgacatcaaatctactgattacgttagtttcctctgtaatatgggattcacccaagagcagataaataaaatcactgatcatccctctccagaacctgttcacgcaagctgcaaacacttggtaaccaaaaccaatgccattctaaactacccatcaatcacactctcaaacctccactctacagtaacaatcaaaaggactgttcgtaatgtgggtcgaaacaaaaatttcatattttgttag

SEQ ID NO: 4087 - DNA, 648 bp, Glycine max
  Peptide Sequence Number=SeqID_120865
atggagcgttgcaaagcccaaacggcattaccagaaactcgtaatggccatgatggggctattactaggacgaataatgccattctggagcatggtattgacttgagactcgatttcctgcttctggaagtgaggatatcggttcgggaattgattgatgacatcgaggatggtgggttgagtgtttgggaaattgtttgggaaattttcaggtggggaacaaacacgaatgtgaaagaattcacttacacctcatacttgggagcattcaactgtgttgccattgccgacaagcacgtgaatggtcttgacgaggtgtccttgcacaaagttatgtgtgctgcctccgtcaaccaaaatcgtgacatggtggaggttaatccggccgggttgtctatattagggttatctgttgggtcttcatcagccaggagaagcagaaatcgcgaggggcagcgatggcctctcgtgaatttctcatcacaatggaagcaaagccctcgctcccggcggcttgctatctcttccggtgtcaaacgtctgatgggtaagggtggtggtttgggcgaggagggaagtaatggaggactgggtgtgggagtgactaccgagaggggagtaggtgagtgttgtggagggctagggtaa

SEQ ID NO: 4088 - DNA, 783 bp, Glycine max
  Peptide Sequence Number=SeqID_120866
atgaaggaagacattcagaggtacataaccaactgcatcacttgccagcagattaaggcagatcatcgtcacccaccggggcttctctgcccacttccggaatccatctgggacctttaccttcacatctcatcgcattcagtgtcgcgcagctattcatggaactttccggtaaactccatggagctgttcaagatgagtggaaccaagctcggaatgagctcagcttaccacccacaatccgatggccaaacagaggccatgaacaggattgtcgaacagtatcttcgagccttcgtacaccagaacccagctacatgggggcgctttctagtttgggcagaatggtcttataatacttcagtccattctgccacagggaagacaccgtacgaagttacttatgacaagcaacccccaagtttaccacagtatatcacaggaagttcgaatattcaagtcgtggacgaatggttgaccaatcgagaaacattgaatgcaagtctaataaaaaagttgaccaaggctcaacaaaagatgaaagagatagcggataagcaacgccgagattgggctgggctaccacctgaagatacttcatgggaaaaatgggaaattcttaagagggactacaaccttgaggacaaggttgttttggaagtaggcggaactgctatgaactctgaactagcaccagaaacacagtcaactaaagaagaagaagtaggggcaaaaaggagaattatcagaccaaaatatttggaagattacatagcaaaatga

SEQ ID NO: 4089 - DNA, 690 bp, Glycine max
  Peptide Sequence Number=SeqID_120867
atggaagaccagaaagagaagatttcaggttccaagtatttagaaactaacattgacgtgcagccagagccgtctgtggacaaacatgagccggaaaccgatgacggtggcgccaccgaagtccaacggcagtggaagaggaaagagatgctaactttcggcccattagggctaagaggaattgctctatctatgtctttgttttccctcatttttatggctaggaacaagtatggttatgggtatgaatttgacaagttcgaagaatacagatacttggtggctgtggcaactctatctactttgtacactgcagttcaagtgttccgacaagttcatgaaatttccactatgaaaagcctgatgcagccaagaactgaagggttgattgattttgttggggatcaggttctggcatatctcttgatatcatcaacgtcttcagcgattccattaacagatcaaatgaggaaagttacaataaatgtatttacggacttttcagctgcatccattgcattttccttatttgccttttgcagtctagcactttcagctgttgtatcaggatacaaactctctacccaaacttatactcctattgctatggactctgaactagcaccagaaacaggggcaaagaggagaattatcagaccaaaatatttgaaagattacataacaaaatga

SEQ ID NO: 4090 - DNA, 567 bp, Glycine max
  Peptide Sequence Number=SeqID_120868
atggaccgaatcaaagaagcaattgccaagcttgcttcgagccatttactcctcaccgagaaacttgatgaattgatcaatcgagtcacaaaccttgagaacacggccaacccttccccttcaccatcatcttcctcagctatacccataccacagattcaatcaaccaccccacatagactgaaacttgatgtccctagatttgacaggtctgatccttcagggtggtattcaaaattacccagttctttgaataccacgcaacctctgaggctgagaggctcaccgtcgcgtccttttacatggacggaccgtccttgcgtggcaatagaagcgcgttttgctcagtctccatatgaggatccaacaggactcctcttcaaactaactcagaaaggcatagtgaaggaatacctggcgcagttcgaagccctcgcgaatcgtatcatggggttatcgccggcctcgctcctgagctgcttcatttcaggacttgaaccggatgtccgccatgcagttcaggcccttcagccgctaacactggttcacgccgctggcctggcttga

SEQ ID NO: 4091 - DNA, 457 bp, Glycine max
  Peptide Sequence Number=SeqID_120869
atgcgcctggctatcctgttatttgtaggtctttttagctttaacctcacagcccatgccgatgatgaagacggccccagcccggaagagattaagaccctgttcttcggcaaagatcatcgtaaagccattaccgacgtcagtgcggcgccgtgggatgccattggtcagttagagacggaaagcggcaatctgtgcagtgccacgttgatttcggcccatctggcgctgacggccggacactgcttactgacgcccccaggcaaattcgacaagccggtcgcgctgcgctttatggcgggagccaaaggctggcgttacgaaattcatgatattgacgcgcgcgtggagccttcgctggcgcggcgtctgcaggcggatggtgaaggctggatcgtgccgccagacgcggcaccttacgattacggcctggtgattctgcacaatccgccgtccg

SEQ ID NO: 4092 - DNA, 707 bp, Glycine max
  Peptide Sequence Number=SeqID_120870
atgatatccagtgaagctgcaaagcaaacagatttctcatctgagaggacagaaacaaaacctgaatatccatctactcagggcttctcagcagcattagcctcaatcaaacctgaaatacaaagcaattctgctcctggttctgttcattttaactccacttatgctcctaagtctattagggaacaaaagagatcagaagatggttacaattggaggaagtatggagagaaacaagtgaaaggaagcgaaaatccgcgtagttattacaagtgcacgcacccgagttgtccaacaaagaagaaagttgagaggtctttggagggacatatcactgaaatagtatacaagggaagccacaatcatcccaagccacttggtagaaaaaatggttctcaatcaattcatcaaacttcttcgtcctgcactaactcagggatttctgatcaatctgtgggagaggaagatcttgagcaaacatcacagactagttattctggagggggtgatgatgaccttggaaatgaggccaaaagatggaagggggagaatgaaaatgatggccattcctattcttctgctgggagtagaactgttaaggaacctagagttgtagttcaaaccacaagtgaaattgacatacttgatgatggatataggtggaggaaatatggacagaaagtagttaaaggaaatccaaacccaag

SEQ ID NO: 4093 - DNA, 1443 bp, Glycine max
  Peptide Sequence Number=SeqID_120871
atgtccaataggtatcaggatgattggctcaagacatcagcaaactctttgcagcactgggagaaggctcctctagagccctatgctctacagaaacctattacgtatcatgttgtatgtcccgacattgatccccttacttctgctgctgctgatttttttcaacaactaggaacagtgtatgagacatgcaagctaggtactcattcacctcaaggcttggggaatcagatagagatagagtctgcaaagttgtcatcttgtggttttgttttacttgattgcccccaatcaatgaagattgagagcagcaatgcatctcttgttggttcagtaatctatgtggtgtgcccatttcctgatcccactgcaattttgcaaactgtaattgagtcttctgttgccattggatcggttgtccaacagtcggatagagagaggagatctagcttgcatagtcaggttgtgaaggcattaagtggcttggccactgtcgatgaagcttcagcgtctaatatccttgtgctttctgggtttagtattccaaaattggtcttgcagatagttacagtggatgccattttcagagtcacaagcccatctgttagtgagcttgtcattttaaaagagacttcctttactgtatacagcaaggctcgtcgcatttcacgtggaatctctagtgattttgctcaatctgcattttctagtagatctcattctggtttgacacaaatgccttctcccatctctgggatgtggaaagactgtgttggtcctcgaatggcaggacattctcttccaagagagggtgacattgatgctagcttgaggcctggtacttgggataattcttggcaaccaacaaggactggggggttaagctgtgatccaagtagaactggggataattttcttcatgatgaaattcgttacatgtttgaacccctttttattctcgcagaaccaggttctcttgaaaatggtatttcagttattggtagtcccacttcagaatcttccaaggcattggcagatgacagtagtggtaactatgtacagagtacaagtacagcaggaagtgtggagtctgcttcaagcactgatgcatctgggtccgatccaaagactcctccaagcctacattgttgctatggatggactgaggactggcgttggctcgtgtgcatctggacagactcaaggggagaattgctggactgcaatattttcccctttggtggaataagcagcaggcaggatacaaagggtctgcagtgcctatttgttcaaattcttcaacaaggttgtctgatacttcaatcttgtgatcctggccttgcaaagcctcgagattttgtgatagcacgcattggaggtttttatgagctcgagtaccttggtaagtctgtctctgcctcttgtgagatatattatatgtaa

SEQ ID NO: 4094 - DNA, 1197 bp, Glycine max
  Peptide Sequence Number=SeqID_120872
atggtgtatatttcagctcatgccaagcttgaaagacgagacttttccaatgaggaaggtaaggaagcagaactgcttgccatggaaggtagtgatgatggtatgctggctgagcactctttggacttggtgcgtgatccttttgatggatctaggataggctctgatatcaagaagaaatctgagcctaactcaaccctaaaagctagcttaaagagtgaggtggtgattctcttgggtctcccattgtggactgctgattgcttatcatctccggtattgtccttgctattgctaacaatacccaccactagaaaaacaactttgtccttaaggttgaacaataaaaacaagctaaaacaggggattgggtttgtgacccgtgccgtggagcaatcaacgaaggtgttaaagacgggtggcggagatgatggtggaggcggtggcttcggaggtggtggtggatgtggcgacggtatcggagagaacccaaatccaatgcggaagaatctggtgagcgttggcggcgtccccgagcaggatgatgtcattgtcgtaggggatcttgcgaacgagatcaatggtgtcaatcgtaaacgaaactatttgaggttcgagatggtgaaaagcaacggaagacaacgtggttctgttacgctgatcaatggcgatgatgtcgacacggtggtgctaccacaccctgacggggaagtaggtggtaccggaatcgattccgagtcgggatgggtgtggggatttggtgccgggatgcggggcatggaagcagagttagtatggggagcatattgggcatgggtgcatttggtggaggtggccagtttggattgccccattcctgaggataaggctggggaggaaccgttcgacggaggagctggcggcgacggcggcgacggttgctaccactgtggtgaaggtgaggtaggagaagaggatgccggagtgagagcatcaagacaatgccggatggagtcaagctttccattcaagtcgcttaggacatggaaaaatgcgctggtcaatggtggactgacagatatgatgttctggcatggtggggtagaggagaaggaggcaggtcgaaccaattgttatgaactaggactaagctattttatgctaaactacagtaatgattaccttctgttacgacctatgctaggtgtgctgaaatag

SEQ ID NO: 4095 - DNA, 1203 bp, Glycine max
  Peptide Sequence Number=SeqID_120873
atgtcaagtgcgctgtcaacactatgtggacaagcatacggtgcaaaagaatatgctatgatgggagtgtatcttcaaagatcatggatagttatgtccttaactacactcttccttcttccggtgttcatcttcacacgacccattttgatgctcttaggccaagatgagattatagcagaagtggcaggaaccatttctctttggtcaattccaatcatatttgcttttattgcctcgttcacttgccaaaatttcctgcaatctcaaagcaggaacaccatcattgcactcttggcggctttctcaatagttattcatgtgtttctctcttggctattgacaattcaattcaagctcgagattcctggtgcaatgacttcaacaagtttggcattctggattcctaatattggtcaactaatatttattacatgtggttggtgctctgatacatggaagggtttctcatttttagcattcaaagatctctggcctgttgtcaagctttccctttcatctggtgtcatgttatgtcttgagctctggtacaacacaatattggttctcttaacgggcaacatggaaaatgctgaggtccaaattgatgctctatctatatgcctcaacatcaatggatgggaaatgatgatatcacttggtttcatggctgctgcaagtgttcgagtggcaaacgagcttggaaaaggaagctccaaggctgcaaagttctctatagttgtgacagtgcttacatccttggccattggattcgttctcttcttatttttcttatttttaagggaaaaacttgcttacatatttaccacaaataaagacgtggcccaggctgttggtgacttgtcacctttgttggcaatctctattctactaaacagtgtccaacctgtactctcgggagttgctattggagcagggtggcaaagcattgtagcatatgtgaatattgggtgttattacatcataggtgttcctgtaggagttctacttggtaatgttctgaatttgcaagtcaagggtatttggattggaatgttgtttggaacatttattctaactgtagtgctaattgtaatcacctacaaaactgattgggacaagcaggttattatagctcgtaatcgtattaacaagtggtctaaggtagaatctgatcatgaaataattacatcagataattag

SEQ ID NO: 4096 - DNA, 399 bp, Glycine max
  Peptide Sequence Number=SeqID_120874
atggaaagccaagatccacaaaactctcctcccttccttttcactcccatgtcaatgatgcaaaacccaaatttggaacctcaaggcttgcatgatgacatagactgggttagccttttctctggccagagcaacttccttgcggatgccaatgcgatgatggaatgcgcttcttcttcttcttcttcttcgtcctcctcgtgtgctttgatggctgaaaagagtgataaagagacaatgaaagggggtagattgaggaagacaacacgacccaggtttgcgtttcagacgagaagtgaagatgatattttggatgatggttatcgttggaggaagtatggacagaaagctgtgaagaacaacatgcatcccagtatcttcaagggattaaaagattaa

SEQ ID NO: 4097 - DNA, 417 bp, Glycine max
  Peptide Sequence Number=SeqID_120875
atggtcaccgcctacgactaccccgccgtggtgcacctcgagaccgccggcgtcgacatctgtctcgtcggcgactctgcggcgatggtggtccacggccaccacaccacgctccccatcacgctcgaggagatgctcgtccactgtcgtgccggggcgcgtggagccaagacgccgcttctcgttggggacttggcttttgggatctacgagtccagctccaatcagcttggtgggagaactttactggctatagtggtcctaaccgaatcaaatagtattgcctttggtggtggatactgtggccttacttcccaggccattagtgtttttggagggtttagaccacaaggaaagaatgttgccagtgctgtcaaggtgtgccttcatgcgtctatatggggtttgagtgattaa

SEQ ID NO: 4098 - DNA, 420 bp, Glycine max
  Peptide Sequence Number=SeqID_120876
atgaagacgttttatggatgcaacctaaatatgtttgaattgtataatgggaaaccagacataaaattgcacatcagacgagcgatctcgatttatcaagggtttgcgcttggaggttgcatttcccaagcgcagtttaaagcgtcgtcagcaactataatggcttctttttctgcactgactacacccttgggtgttgggattggaatgggtatctcttcggggtataacccttacagcacccaaggtatcttggattccttgtcgtcggggattttggtttatatggctttggtagatttgatagctgcggattttcttagcaagaggatgagttgtaactttgggctgcagatactgtcttactgcatgcttttccttggggctggattgatgtcttcgctcgcaatttgggcatga

SEQ ID NO: 4099 - DNA, 246 bp, Glycine max
  Peptide Sequence Number=SeqID_120877
atgacaaatctggagaatgtttggaacgaagatcctaatggaattctaatcatgcaacttctacaacaagtatgtgttcataaatgtgaaagccttacaagtgtgtttcccgcatcagtagccaaagatcttgtgaaacttgaagatctagttgtggaagactgtgagggattgatggcaattgttgcagaggataatgcagatccaacaggagcaaatctagagcttacgttcccacatcattga

SEQ ID NO: 4100 - DNA, 518 bp, Glycine max
  Peptide Sequence Number=SeqID_120878
cagcttcagaacgagagaaatattcatcagaaaaagaggagatagatgcatataaagagcaaaagaagtgggaaaatagagtgcttactggtgaagtattaagagctttcctcattcttagtttgatgatgattcgttttctagtctcatttctgtgcacattgaagggtgtaaaaaactatacaagattttcccgagtcacatggaaaggatggtttgaaagtctggaaagcttgaaggtttttgaatgttggtcagtggaagtgatttttaaaatcaaagattctcagcaaatagatgcatctgctgggatagacacaaatttgtggttgattcttgtagacaacctcccaaaactgaagcaagtgtggagcacagatccaaaaggaattcttaacttcaaaaatctgcctagtatagtggtttcttgttgtcataaaccaagggatgtctttccagcttctgtggccaaagacgttcaaaagcttgaatgcatgtcggtacagttttgccagtga

SEQ ID NO: 4101 - DNA, 660 bp, Glycine max
  Peptide Sequence Number=SeqID_120879
atgctagagacggagcaagcaagaccattagccccatcaatagagcgccaaagcagcgatgaggataacaccactccacaccctcaaacacaaggccacaaaaaactcatcaaacgttgtgcttgcccattaatctctttacttctcatagcaatagtgatcatagttttaatcttcacagtatttcgtgtcaaggaccccgtgatcacaatgaacagcatcaagatcacaaagctccaacttgtcaacaccatgtcacaacaacccggggccaacatgtccttagtcgctgacgtgtcggtgaagaaccctaacgttgcatcctttaggtatagcaacaccaccacgagtttgtactaccatggtgtcattgtgggggaggctagaggaccacctgggagggccaaggccagaagaacattgaggatgaatgtcacaattgatgtcatcaccgctcgcgtcatttctagcccggattttgtgacggatttaggttccgggttgttgactatgagcagcttctctagagttcctgggcaggtcaagatcttgaacttgattaagagacatgttgttgtgaaaatgaattgcaccaccacttttaatatttccacacaggcgattaaggagcaaagttgtaagcggaaggttaaactttag

SEQ ID NO: 4102 - DNA, 441 bp, Glycine max
  Peptide Sequence Number=SeqID_120880
atgactgacataaaatcaaccaaataccaattggtatcttctagagatctgacattaaatgcttatgaagaggattgtgaatttgcagacccagcaggctcatttaaagggcttcagcgattcaaaaggaactgcactaattttggatcccttctggagaagtcaaacatgaagctgatgaagtgggaagattttgaagacaaaggaattggacattggcgattcaactgtatcttgtcctttccttggaggcccattctttctgcaactggatacacagaatactattttgatgcacgatcgggaaaagtatgcaggcatgtggagcactggaatgttcccaaaaaggcattgttcaagcaaattctaaggcctagtcgtggatttggcttaaaagattatgtgaataggtggttgaaagcagtgcagatgaagctttaa

SEQ ID NO: 4103 - DNA, 1461 bp, Glycine max
  Peptide Sequence Number=SeqID_120881
atgaaatctttcaatattctgagtcctgaagataagggaatgacaaaacagaatgttaatacaaagttaaaaagatggagatgtgcttactattttatcttcataccgggtgctcttgctcttctcctttctgttgctgctgtgtccaagttcctctccttcaaatcatttctaggtactgaatctttatactcaaatctgaatcctgaggtcccaaataggaatcaaaatgaggtgctgatgaaaaccgttgaaatggtaattcataaaattgaagaggaactggacaaactgagggaaacaaaacaggatccatcgtcaaccccatctgtattccagcaaggttcatttctttccgatatattaggacttcttgagtcagcagcgacgtctcatcaacacagtgaagggagtaatcggcaaactgataatttcaccattcatcctctggtgagaaaaaagaagcaatctgatgagcctgctgattactttctgcgtgaagagattcgcaagtatgtcaggataaagcctaacagattaggaaaacaaaacttcatggggacaaatgcaagcttcaccagcataggacacgcatgctttgccatgaaggaagagctagaagaatacatggactatgatgttggtgagatctgcaatgatgactggaagctagctcaaaagcttatggttcatggttgtgatcctttaccaaggagaaggtgcttttcaagagcccctaagctatacaaccagccatttcccatcaatgaatccttgtggaaacttcctgatgatagaaatgtcagatggagccaataccggtgcaagaacttcttgtgtcttgccagcaacaccactcgtaagggattcttcaagtgtgcagactgcttcaatctcaccaaccatgagatgccaagatggataagcctggaggctgattcaaaccagacagcggatttccttatatctgatgttcttggaattaagccaaaagagatcagaataggattggacttcagtgttggaactggaacttttgctgctaggatgagggaattcaatgtgactatagtttcagccactatcaattttggagcaccctttaatgaaatgatagctcttagaggacttgttcctctctacttgactataaaccaaaggcttccattttttgacaacaccctggatttgattcacacaacaaggtttctagatgggtggattgaccttgtgctccttgagtttatattgtatgattgggatagagttctgagaccaggggggttgctttggatagacagcttcttctgcttgaaggaagatttgtatgcttacttgcaggccttcaaaatgctgagatataagaagcacaaatgggtagttgttccaaaggttgataaggatgatcaagaaatgttcttctctgctgttttagagaagcctcctagacaattcaggtga

SEQ ID NO: 4104 - DNA, 900 bp, Glycine max
  Peptide Sequence Number=SeqID_120882
atgcctttttggggccatttagcccctaaaacacttcacttggtgggtcggatatctactcagagggtgatcatcctcattgacggaggaagcactcataactttgtgcaacaacgtatggtgcgaaccctgggcttgaatgctcagcccactcacctcttacgagtaacggtgggtaacaacaacgaagttgaatgccaccatctctgtgtcgaagtcacggttcacgttcagggccagagcttcactgttggccttcatgtccttcccttgcgtgggaaacaggagattgagactcaagttcgggctatgcttcagaatggaatcattcacccaagcacgagtcatttttcgtcacctgtgctcctggttaagaaatgcgataggtcttggaggttttgcatttactatcaagctttgaactcaattacggtcaaggaccgttttcctattcccactatagatgagcttctggatgagttaggaggtgcttcttggttcttgaagctagaccttctacaagggtatccccatattttgatgaaggacgatgacgtaagcaaaaccagtcattatgaatttcaggtcatgccgtttgggctatgtaacgccccctccacctttcaggtgacaatgaatagcatctttgctcctcatttgcgtaaattcatcattgtcttctttgatgacattcttgtttataacaaatcctttccggagcacctcacacacctggaaacaacctttcaggctcagaaggcgtttgacaccttaaaagatgttgtttgtaaggtttcggtgttatggctgtcagacttttcagaaccttttgttgtcgaaaaggacgtctctggggtaggaatgggcactatcttgtctcaacgaggaattaaagcgtga

SEQ ID NO: 4105 - DNA, 263 bp, Glycine max
  Peptide Sequence Number=SeqID_120883
atgaaaagattaagctgtggctttttcttcgggggcgtcattcatcagttgttgagactgctcagacagcagtatctggattaagagttgttgcttctgggctttggttggctcctggggattcagaagaggttgcagctgctctctctcaggctttaaggaattgtatagaaagagctttgcttgggctttattacatgagatttggagatgtattttcaaagtttcatcaatttcaaagagaagaaattttcagattataa

SEQ ID NO: 4106 - DNA, 318 bp, Glycine max
  Peptide Sequence Number=SeqID_120884
atggagtggggtgcatttgtggttgtatggtactctagccaagggttacctgtatctttgttgcttggactaggaagtatgcatcagatatcttggtttcagtttcttcctcatgaacctgacctgaaccctctacctgacaaaagtgttaaagtggaccaaaaggatgctgcaatgttactggtgctttcatcacatctgcaacttcagaaggaggggtttctcagcacatggaccaattcctttgttggaccttgggatccatcccagggattgcataatccaggtagagattgtgttgacttagtggttttgtga

SEQ ID NO: 4107 - DNA, 572 bp, Glycine max
  Peptide Sequence Number=SeqID_120885
acgctttacgcccaatcattccggataacgcttgcatcctctgtcttaccgcggctgctggcacagagttagccgatgcttattccccggataccgtcattgcttcttctccgggaaaagaagtcatgacccgtaggccttctaccttcacgcggcattgctccgagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggatcgaactctccatgagattcctagttgcattacttatagcttccttgttcgtagacaaagctgattcggaattctcttccattccaaggcataacttgtatccaggcgcttcatattcgactggagttcgctcccagaaatatagcccccccacccctcgtgctcgaactgataacttccaccacgtcaaggtgacactctaccgctga

SEQ ID NO: 4108 - DNA, 240 bp, Glycine max
  Peptide Sequence Number=SeqID_120886
atggaagagaattccgaatcagctttgtctacgaacaaggaagctataagtaatgcaactaggaatctcatggagagttcgatcctggctcaggatgaacgctggcggcatgccttacacatgcaagtcggacgggaagtggtgtttccagtggcggacggctggaaacggctgctaataccccgtaggctgaggagcaaaaggaggaatccgcccgaggaggggctcgcgtctgattag

SEQ ID NO: 4109 - DNA, 1164 bp, Glycine max
  Peptide Sequence Number=SeqID_120887
atgttaaaaggcgggcacaggtttatagacacagtgatactggtgatcaaagagaggactcaaagtggtagttcgataaggagttgttggcgtgacagtttcataactcatagggcattttgtgatgctctagcacatgacagtgcaagacacccttcaagcctgaaccctttgggaactcatcatttgtatggcacaaaccacatgagcctaggccttagtgctcagcttcagaaccaccaagcagctactaacagcatattgagccttggaagtgcaccaaagtttgagcacttaatctcaccaaatctgcaccactcaccatcatcatttggagtgcaatcaccaccaccaccaccccagtcatcatcattcttcatgactgatccaaaccaagcatttcaagacctccaatctcagaaccaaggacacttattctcaaacaagcaacttcatggtctcatgcaactccctgatcttcaaggaaccaccaatatcaattccactacttctgcttcatcagtgtctggttcagctaacaacaccaatctcttcaacctaagcttcttccctaacaccaacgccagtggaagcataatcaatgatcaattcagcaacatgactggagttactaataataaccaaggaacagcaacactctacagtactaatagccctgtgaatagtaaccaagttggtttgtcttcactctttggaaactcatcagtgcaacaagataacatgtcccctcacatgtcagccactgcattgcttcagaaagctgcacaaatgggttcaaccacaaccaccaatgagttaggtatgagatcaagcatggaggatgatgagcacagcaaccatctacgtgggttgatgaactcttttgtcaatggaaacaaccttggtcagtttcacaacgtggtggaggagcctaagaagatgccacaaaacaacaaccttggtttgtgctttggagggtctgataagttgaccttggactttttgggtgttgggggaatggtgaggaacatgaacaatggtggagggttttcacaaagagagcaacaacaacaacaacactccatgggaattactatgagccccttggatcctaaattggaatcagcgaaagcaaaccaacactatggaacctcaacactctaa

SEQ ID NO: 4110 - DNA, 690 bp, Glycine max
  Peptide Sequence Number=SeqID_120888
atgtctaatcatacttgggatttagttgacttacctaagggaagtaaaccaattagatgcaaatggatttttagaaagaaattaagaactgatggaaccattgataaatttaaggctagattagtagttgttggttacacacaaaagaaagaaattgactattttgatacatattctcctgttactaaaatttccacaattcgttctcttgttgctttggctgctattcatggacttatagtgcatcaaatggatgtaaagacagcttttcttaatggtgacttgagagaggaaatttatgtggaacaacctgagggctatgtgattcaaggtcaagagaacaaagtgtgtaagttgagaaaatcattatatggccttaaacaggctcccaaacaatggtatgaaaaatttgaccaaactttgtcacattatattaaaaagatacttaaaaaaaaaattaactattatgatgaattacctgtgagaactccctatgatcctagcatacatcttaagaaaaacaatggttctagtgtttcacaaactgaatatgctaaaatcatagggagtgttatgtttctcatgaattgtactagacctgacatagcatatgctgtgagtagactaagcagatatactcacaatccagaaggattttgtgatgcaaattgggttactgataatgatgaa

SEQ ID NO: 4111 - DNA, 848 bp, Glycine max
  Peptide Sequence Number=SeqID_120889
ctcaacttctgggatttgagaaattcatcccaccctttgcaaacactagtggttcagacatacttaaaggtgtgaactatgcatcaggtggagctggaatacgcgttgaaaccagctcgcatttggtatacatcaaagagcctagttctttcatggaaattgcagacaaatgcagccgctgtggctgcaattacagtcacggagatctcaaaagccttgtcattggggctgaaattgtgggtgctactatcagctttggattacagttagcaaatcacagagtcatagtttctcaaattgctagcagacttggaagttcggacttggctctacaataccttgaaaaatgcttgtattatgtgaacataggcagcaatgattacatgaacaattacttccttccccagctctacccagcaagccgcatttatagccttgagcagtatgcacaagctctgattgaagagttatctctgaatttactggctttacatgacctaggagcgagaaagtatgtgttggctaggttgggacgtataggatgcactccatctgtgatgcattctcatgggacaaatggatcttgtgttgaagagcaaaatgctgctacatctgattataataacaagcttaaagctctagtggatcaattcaatgacaggttctctgctaattccaaattcatccttatacccaatgaatcaaacgccattgacattgcacatgggtttttggtttcggatgctgcttgctgcccatcagggtgtaatcctgatcaaaagccgtgcaataataggagtgactatttgttttgggatgaagttcatcccaccgaggcatggaaccta

SEQ ID NO: 4112 - DNA, 330 bp, Glycine max
  Peptide Sequence Number=SeqID_120890
atggcaagtccgatgacatgcgaagatatccaagtggttatccatacaaaagacggcgagtccgatgacatgcggagatacccaagtggttatccctacaaaacgattttgttaatcctaaccgagaagtcaggggcaagcgagcccgttgacacgcagagactagcatcgtcttctgcacctttgtcatccagagacggcgagtccgatgacatgcggagatacccaagtggttatccgtacaaacgatttctgttaatcctgacccgagaagtcaggtggcaggcggagatacccaagtggttatccgtacaaaacgatttcagttaa

SEQ ID NO: 4113 - DNA, 237 bp, Glycine max
  Peptide Sequence Number=SeqID_120891
atggctgtgaaaggtggtctgccgatggtcatgaagaaaggcgcagggattgccgatcgactcatggcggagttcatcgagtcaacctcggcgaattctcaagttccgcgtgagcacctcttggccgtgacatccgggcgcatcgctgttgtcaggaccaaagtgctcgagttaccacctttgtcgattgtaaggtcaaatcagctggcacgccttaacgttgaaatcgggtattag

SEQ ID NO: 4114 - DNA, 633 bp, Glycine max
  Peptide Sequence Number=SeqID_120892
atgtcgatctctgacctcgatcaagagaacgtcatccccgtgacggaagccaacctcaaggatgagcaaaagcaagctattgcccaagccatggaagagttcaagcagcaatgcctgaggtctttcagcataaacaggagcggcgaagtggtccagaaagatgcactgccggcaccacggcaggtcacctttgacgccaatcctggcaagcttcaagatatggttgacaatgccatcaatcgagcgttgattaaccaagctggtgtactgtctaatacggttttcaacgccgtggcaagaactttcaaggaaggacaaatcccgccagattatgtggggccctcccatcatcagccaacggcaccagaggtcacggctccatcggctgccttgacgaatgcaagtgcacagtctgccatccctccaagtacattggggactactggtgcactatctatgccgatggcaaccaacccacaaatttcagttgggcagcataaactgacaacagatatgttggcatcggcaatgtcagggttaactcttcctcccaactggtgggcttatggtatgcctccagagttgacgccgggaacatcacagataactgacatgaggggcaaactcctatga

SEQ ID NO: 4115 - DNA, 321 bp, Glycine max
  Peptide Sequence Number=SeqID_120893
atgcagaaaaatgcttgtgtgtggttggctgtggaaagtctagtgcagaatgagttctggatgtttgctagtagatcccaacggtcaaaatgtaggcttatgcactatagacttccacttgtgctgtgtgaatgttgtattactttgatgttggggaagcttgggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 4116 - DNA, 873 bp, Glycine max
  Peptide Sequence Number=SeqID_120894
atggtgcaatccaaccagttctgtgggaaggcacacgaagatgctagtgctcatttacaacacttcctggagatttgcaacacattcaccatagcaggagtttccaaagacgctatactacttcgcctcttcccattctcactgttaggaagagcgaagcagtggttctacgctacaaaggagaagaatactacgtgggcactctgctcaacaaacttcctggcaaagttctttcccatgggcaagaccaatgctctccgtgggaagattacaagttttcagcagcaaaatgatgaatctgttccagaagcatgggagcgctttcaagactacatcctagaatgtccccatcatggaatggagagttggctattgatgcagacattctatcatgggctcagcaacagtgcccgagagaccatggatgctgcagctggaggagcattcttatcacttactataccacaagccacagctcttgtggagaagatggcgtccaatcaaagctggaatgaagagaggactcagacacgcaagagaggtggaggtatgcatcagctgaaagaggtagatatgctgtctacaaagctagacctgctcatgaagaagctggatgatagagctggagacaagaaagaagttatgcacatctacgactctcacatgacttgtgaggagtgtggagacactggacactcaggcaaccactgccctaagatacttgaggatgtgaactacatcaacaacaacaacaacaactactacaaccgtgtggcagaacctcctaagtgtttgggcccaccgacacctgccattgtcctaaggacctctgacggtgatgccgggagtcctcccactttagaagtccgatga

SEQ ID NO: 4117 - DNA, 297 bp, Glycine max
  Peptide Sequence Number=SeqID_120895
atggcaaggaccaggcgtatgcaaaggcagggacaaagggacaagagagcggggacacaagagacatttcacataccctctgttgtctggatccaatttaaagtgcagcgctggcgtgccgcctcagtgaatgtggtattttcatatcagttctctctattttatgagtcgctaatcactgtaaatttcccgatcgagacagcggcatcaaagaataaggtcctctcatactcttacatgagtcgagagtggatcaagtttgacttcccctcggagtttgttgacagcaaactttga

SEQ ID NO: 4118 - DNA, 273 bp, Glycine max
  Peptide Sequence Number=SeqID_120896
atgatccatggagggtgccacaaacacaatgcacaaccgctaagaaaggaaagcttccacaaggtgatactgtaccatcactcttcaagtacacttcaagcaaaacatggaggagttttacaactcccagactccaccaagggaaggacctggatccatgagcacaaacacactgagcaggatattgccaacaccgcacttcgaactgctaggcaatcaaagaacataggtgacaccgtatcaagaagtgcagacgtcaaggtccacacctaa

SEQ ID NO: 4119 - DNA, 418 bp, Glycine max
  Peptide Sequence Number=SeqID_120897
aggttgcggacgagcaagagcagctcaaggcgaagccataggaagaagaatcacggccagaggtgaaccagagaggtctggccacgttgccggtgatccctgcaaactccggcgaggtggagctcgcgacggagatgacaatgtgacctcaccggacgtcaaggcggagctccggatggactggcttggccggagacgcggtggaacggccggaggagctcgccgaagcgcgacggagctcgccgtggacgaaggcgggcgcaatgtggcgctctggaggggcggggtcgccgtcgacgtacggccgctaggtggccggacacacggcggcggatcactcaatggttttggctgggatttggtcctctggacagagctacacgagctctacaactttggttacaagatcaaagtctaa

SEQ ID NO: 4120 - DNA, 903 bp, Glycine max
  Peptide Sequence Number=SeqID_120898
atggtgacatccttcaagtgtggcggttttgcaattggcatctctactagccacaccacctttgatggcctcagcttcaaaacctttctagacaacattgcttcaatagcctctaaaaagcccttggttgtcatgccctgccatgacaggcacctcctagccgcccgatccccaccatgtgtcaccttcccacaccctgagatgctcaagctaagtgacctcccaacatgccccgactccaacatctttgaggcctccaccgaacaacttgacttcaaggtcttcaaactaacatcaaacgacatcacaaaattgaaggaagaggctaagaattcttcaactagtggtggcacaagtactacatgtgtcactggctttaacgttatcactgcccatatatggagatgcaaggcactatcttgcgaagatgataaccctaataggtcatcaactatactatatgctgtggatatacgttcaagattgaaccctccattgcctaaatcatacgcgggtaacgcaatgttaaccgcttatgccacgacaaagtgtaaggaattagaagaattaccttttatgaaactagttgaaatggtgcgtgagggagcaactaggatgacaaatgagtatgcaaggtctatcatagattggggagagacaaacaaagggtgtcccaatagggaggttttggtttcttcatggtggagattggggtttgaggaagtggagtatccgtgggggaagccaaagtattgttgtccagtggtgtatcataggaaggatattattttgttgtttcctcccattgatggaggtggaggggtgagtattattgtggctcttcctcctaaggaaatggaaaaattctatgggctcttcaacaagttcttgactttagattga

SEQ ID NO: 4121 - DNA, 417 bp, Glycine max
  Peptide Sequence Number=SeqID_120899
atggtgacaatggagagtgacgacagtctaaagacatgggtatcagataagttgatgtctctactgggatattctcagcccacagttgtccagttcatgattggactatccaagcaagctacttctccagctcatttggtgggcaaactagtggagtttgggatctcgtcaatggacactcatgcatttgcggaagaaatttactcaagagttcctcgtagatcatctgctgcaatgttggcgaggaagcagaagacttactcaattttgaaggctgataacgatagtgacgatgactatgtagataaatcttcagtaactactgcatcatctagaaggtctgacaaccataaaaaacgtttcaggaagaaaactgaagttcaagatgatcaagattatgaggcaatgtgctcataa

SEQ ID NO: 4122 - DNA, 303 bp, Glycine max
  Peptide Sequence Number=SeqID_120900
atgactgctaatcttcctcacgagttgattgagcttcttgaaaagattgtgctacaaaatttttcttttagtggaaacttcaatatgcaaaatttgttgatccttaatgcaatcaaggcaaatccttctagagttatggattacaaaaataggttggaaaactttgataggtctacagtagggctgttaatgtcctactgtataacctctatactattgattgtgctgtggagtttgctttctaggtcgaagaagatgttgtttggcgccaagtggctaaagcactacttaacaaaggcttag

SEQ ID NO: 4123 - DNA, 192 bp, Glycine max
  Peptide Sequence Number=SeqID_120901
atgatgattgatgtaggtgttcattcagttatttctttgattcttgctttcattttggaccgtgctgctcatcatcacaggaataatttggagacgtattttaatgaagttagatcattggaagcagttagattcaaggcgctttgcatccagtgggcacagtattatctaaaatttagaaatcaaacatag

SEQ ID NO: 4124 - DNA, 163 bp, Glycine max
  Peptide Sequence Number=SeqID_120902
tggtagttgatgattctggtgatggtggtgataatgataataacgatttcattggtgttggtgttgacaattacaatgtcaaaagtgatggtggtgttgaggatagtaatgatgctagtggtagtagggagaagtataataggaagaagtataattgtcaaat

SEQ ID NO: 4125 - DNA, 261 bp, Glycine max
  Peptide Sequence Number=SeqID_120903
atggccataacttttgcagccagccaaaggccggctgagtgtatgactagaggcaatccatctgacttacaaccctttgatcctgagatagataggacatttcatagattagttaggcatcatattgtaccttttgagcatcctgagcattctattattggtgagtctgagcattctgtggttgataattttgaacatcctgattttgagcattatagttttgaacattctgattttaaacattctgagaacatggcataa

SEQ ID NO: 4126 - DNA, 252 bp, Glycine max
  Peptide Sequence Number=SeqID_120904
atgggcgcgggtgatggtggtggttttgggggtggtggggtggaggtaagggtgaccaaacgatctagaacgaaattgagtttgaggttgaggtcaacattggcttgggtgagtttgtgtactacctcctcaaggcattcgagggaagtttggcgcgtggtatgctctgacatggtgtcgccatcgacaggccaggtcgaaccaaaattgtttggactatattatctactaacactacaagctaatgggtaa

SEQ ID NO: 4127 - DNA, 366 bp, Glycine max
  Peptide Sequence Number=SeqID_120905
atggtttctgtcatcctgacccgtgaagtcaggtgggggtaccgtatggttatccacacctttcgtcaaccaggggcaaacgagcccgttgacgcgcagagactaacgtcgtcttctgcaccatttttcatccagggacagcgagttaggtggcaggcggagataccttatggtcgtccgcacctttcatcaaccgaggtgaacgagttcgacggtatcaggatgatgttggtttttactctcgtcatccagagacattcaagctcgacgtcgcacgagattcttctctgctgggcgaggacgatcaagtttgatagcgtggggaaacgtcatggttatcccactttatcgctttcaagacgctaa

SEQ ID NO: 4128 - DNA, 219 bp, Glycine max
  Peptide Sequence Number=SeqID_120906
atgcaatttcataaaggtctggacattgctgttgattatggttctgatgtaagagcagccgcagccggaaccattattttctcaggacagaagggaggttatgggaattgcgtaattgtttcccatggaaatggcttggcaactttatacggccatttatccgaattgatcgcaaaagtaaacgataagaaatttatacttgaaaaagagactgtgtaa

SEQ ID NO: 4129 - DNA, 399 bp, Glycine max
  Peptide Sequence Number=SeqID_120907
atgtcttcacaaggtgacaatgccttcttttacatttccaagacgacaatgtcttcacaagccgacaatgccttcttttactttttgaagacaacaatgtcttcacaaggaaacaatgcctccttcttttacatttcgaagacgacaatgtcttcaaaaggcaacaatgccttcatctacatttcgaagatgacaatgtcttcaaaaggcgacaatgccttcttttacattttgaagacgacaatgtcttcaaaaggcgatgatgccttcatctacatttcgaagaaggcaatgtattcgcaaggcgacaatgccatcatttacttttcaaagacgacaatgtcttcaaaaggcgacaatgtcttcttttacatttcgaagatgacaatgtcttcataa

SEQ ID NO: 4130 - DNA, 438 bp, Glycine max
  Peptide Sequence Number=SeqID_120908
atggctagatgcaagaggattcaagaagatgttaaggagatggaagattatttcctaaaagctacagatgatgtccttactgagacggaccaagcacataggaaagttgaggttcctattaatgtgaatctagtggcaagcaaagagagtgagaaggaggtacaaacacctcctcaggatactacatgctttaagtgtgagcaagtgatgcaatcctactctccaagggcattggatagaagactacaagaagattgggtcagagatgtaagagaaggccctagggttctcatgagccttagggaaaacgtgtggagtcgccaccaatgtttatttgagaaaaacgctagaaaaaccaaaaagacgatggtctacgattttaaaaatgaggtcgacaatggtgtcgcccttgctcctatgtatcatcgtgtgcgatga

SEQ ID NO: 4131 - DNA, 384 bp, Glycine max
  Peptide Sequence Number=SeqID_120909
atgagtatcaaaggtggtgccggtggagctggtggaggagatagtatctcaacctccggagaagcaagtgggtttactactggaggttgcgactcagctagtgcaggctctgtccttgttggtataggactgggaggaacaacctcaggggctcttcctaaaggaaactgggcttcaagccaggccaccttgtccagaaattgttccatggatattattagcctattctgcctcctgaataagctctgcaacataggaattatgggtggtgcttgttgggcatctggttccatggttgctatcgaaggaggtgggttggatgatgaagggatgtcttcagctcttgctctctttcttgaggccatctataagaaaagaatgtga

SEQ ID NO: 4132 - DNA, 473 bp, Glycine max
  Peptide Sequence Number=SeqID_120910
ggaactcaatttcaaaggaaccagtcttctgcaagctatcaatgggagtcattctggcaaccagagtattacgataaagcagaaggagttcttaatctggatgatctgctaatgcaattcaaagatacaatagagtcaatgcaacaggcctttagaagaactgcaactcagattagtaagttggtggatgacatggctaaccctgcggtcagacaacaggaagagcgtgcagagattgaaacgcaccaagaaagcatttttaaagttacctcaatccatcatcagatgaccactgaagagaaaacgtctgaagtctccagtactccagaatattcatgcccagccattgctagctatgttggaggaacagagaaaggtagattggaactcagtgtggaggatcaaaaagtctcttttgacctctttgaggccatgaaacactcagatatgggtgatgcttgttctgatacaca

SEQ ID NO: 4133 - DNA, 652 bp, Glycine max
  Peptide Sequence Number=SeqID_120911
atggctgaggctactcaattatggaaagatgtcatgcctcgccatatggaggagactatggagcattccggacacatgctaaaatttggcaaagtggctttttctagccaacgattagaacttttcgatgtatggggcattgatttcatggggccattccctatgtccgggaattgcgaatatatcttagtagctatggactacgtgtccaaatgggtagaagccctaccttgtcgatcagctaattcaaaacatgccaagagaatgttccatgaagtaatctttcgtcgctttggtataccccggatagttataagcgatggaggttcccacttcatcgacaaaatcttccgaaagtacctagccgatcatggagttcgacacaacgtcgcaacaccataccatcctcagactagcgagtttaaggctcattgggcactcaagaaatggaacatggatctccacctcactagcgagaatcgtctgatgcaactatctgagcttgaagaatggagagagatagcctaccacaattcaaggatctataaagagagaacaaaacgatggcatgataagagaatcaagcacaaggagtttaagcctggagataaggttctactattcaattcaagagttaagctctttgggcatg

SEQ ID NO: 4134 - DNA, 171 bp, Glycine max
  Peptide Sequence Number=SeqID_120912
acccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 4135 - DNA, 675 bp, Glycine max
  Peptide Sequence Number=SeqID_120913
atgacgttatcgattgttggacgctgtgcgaaaaccggccagctgggcattgcggtcagctcgtcgagtattgcggtcggcgcacgctgtccgtggctgcgcgccggcgtcggcgcggtctccacacagaacatcacgctgccggcgctgggcccgcgcatccttgatcggctgagtcagggcgagacggcgcatcaggcgctgcagagcggtcttgccagcgatgacttttttgattatcgccagcttacggtgctggcggtcgacggcagcagtgcctgctttagcggaacgcacacgctgggggtgaatcacgcgctgtgcggcagcgactgcgtggcggccggtaatttgctggcgaatcccgaggtgattgcggcgatggtcagcgcgtttacgcagcagccgggcgaactggccgcacggttaatcgcagccatgcaggccgggatggccgccggaggtgaagccgggccggttcattcggcggcgctggcagtggtgggcgaaccgtcgtggccgctggttgatctgcgcgttgactggacggagggcgatcccatcgcagaacttcatcagctgtggctggcctatcagccgcagatgcaggattacctgacgcgcgcgctcaatcccacgctggcaccccgttacggcgtgccgggcgatgaataa

SEQ ID NO: 4136 - DNA, 1063 bp, Glycine max
  Peptide Sequence Number=SeqID_120914
cgcacatcgcggtgggaggtacgacagcgacgaagatcgggtggcccccgagccaccgggcccacgagtgttcagcagggcaatccgcagcacgcccctgcccagtccgttccgacccccgaccagcatcgcgaagtacaatggggatgatcgggccatcatcagacaattaccgctcttcctctccgacactgcccgccgatggctcgaggaactcccagcaaatcaaatcaacgactgggtcgatttggagaaactcttcgagagtatgctcgacgcttctcgaagcagcgcaccgagctgccgcacatccccgaccatgacgtcatcttggctttcgtctctgaccgtcgatgagctgatggacgtagtggcaaactacgcggcaggggaggaggcagtcggcgccttcttcaactacgagggagggaagggcaagcggcttgtcgatgaagatggaacccctagtcgagggctcaagaagaacaagaagaagcagaaagtgcggcagcacaagcgggagaacttcgacgacgatctcatcgctgccgtggatcggaaaaagcctcgaggccccccggatggaggcattttcgacaagatgttcgaggagccgtgcccttaccataagggaggcgccaaccacaagctcaaggactgtcgtatgctgagaaagcattttgacggtcaggggtccaaaaaagatacgcgtgatgactccaagaaagagaaggctggcagcaaggaggacaacaaagatgacgatggcttcccggccgtccacgactgctacatgatctatggcgggccctcgactcagttgaccacgaggcagcgcaaaagggagcgtcgcgaagtctttgcagcaagaatggcggtgccccagtaccttaactggtcaagcactcctatcacttttgaccgagaagaccaccccgacaaggtagtcgccccaggcgtctacccgctcgtcgtcgaccccatcatcgtcaacacccggctttcgaaagtgctgatggatggtggcagcagcctcaacatcatctacctcgagaccctcgac

SEQ ID NO: 4137 - DNA, 444 bp, Glycine max
  Peptide Sequence Number=SeqID_120915
atggacaaggaagaagccttaatggattctgactttggcccaatttcaaatggtgagttcttgactccctttgaagatgagattcatcctactacagaagaggacataggcgagaccaatctaggagaaactccgaacattcagattggagatgaagataacattaatgagcatggaatttttatagccacttcgtttactccatgctcatatgcaacatcttcccaatcttttggtctctccaacatcaccacatttgagatctccaaccccctcttcctttctatttataaaatctttaaaagggtggttgtcgatgacaagcttagtgtcctaaaacaagcacaaggtattggagcatataaagataattgtagaaatattccttcgggtattcgtgtcactaacctttctaggattggagcaagaagatccgaggaatga

SEQ ID NO: 4138 - DNA, 213 bp, Glycine max
  Peptide Sequence Number=SeqID_120916
atgatccgcaagcgcacggatatcgctgagcatttcacctgggagggaagcttacggaatctagacaccacaaaggatattcgacccgcacctatgaaccctaccctttctgctaacaagatgtgggatgcaaaggtaactcggaaatgtcacgttcctcgctactaccacggtccagctagtcaggggatatctatgagtaccctagcctaa

SEQ ID NO: 4139 - DNA, 282 bp, Glycine max
  Peptide Sequence Number=SeqID_120917
atgcctaacattaaaagcagtgagactgatctgaaactgaaactgaaacgtgcacgtagtcgccacaggtgtggttgttgttctcagcaagtgtgttacatcttcggcgggcgcaatggagcaagagaatcgcaatatcaaaggaactgcagtaacaacggcggtgctgaaggagttaatgacgtgggtatagatagagagagggggatggtgatggtgaagggcacgatggatgtggcagctttggcaaagaagttgtcggagaagttaagaggaagatag

SEQ ID NO: 4140 - DNA, 843 bp, Glycine max
  Peptide Sequence Number=SeqID_120918
atggcgcaacggggggttgtgctagacactttgcaccgaaccattaaaatcccattgcccaatgagagttcttacttgctaatccaactagttactcccaaacggacaattgggcaagttcatgccgctaatgtgtctgaagttaaaaatatcccggtagttcgagatttcccggatgtatttcctgaagacttaccaggtctgcctccggaccgggatgtacaattcagtatagaattgaaaccgggaacggccccaatatctcgaagggcctacagaatggcaccgaaagagctggccgaattaaaaacccaattacaagaactgttgcagaagggttttattcagcccagttcttctccatggggttgcccagccttgtttgtgaagaagaaagatcagacattaaggctgtgcgtcgactatcgtcctctaaatgaggtgacgattaagaacaagtacccattgccccgcattgacttattgtttgaccagctagctggggccaaagtgttctcaaaaattgatttgagatcagggtaccatcaaattaaaattaggccggaagatgtgcccaagactgcttttacaacccgttacgggttgtatgaatacttggtaatgtcttttgggttgactaacgcaccggcccattttatgtacttgatgaactctgtcttcatgccagaactagacaaatttgtggtcgtctttatcgatgacatcttgatttactccaaaactaagaaggaacatgctgaacacttgagaatcgtgctgacccgtctcagggagcaccagctttatgccaagttcagcaaatgtgagttctggctggacaag

SEQ ID NO: 4141 - DNA, 744 bp, Glycine max
  Peptide Sequence Number=SeqID_120919
atggaatctaaatactttgactccaatggggaggtctcactaaagcaaaaatcaaaatccatttcagcagagccaacaatctctactagtgaatatgattgctttgattgcaacatttgcatggaatcagcacatgaccctgtggtcactctctgtggccacctttactgctggccatgcatatacaagtggcttgatgtccaaagctcctctgttgaaccgtaccagcagcagacatgcccagtttgtaaatcagagatctctcacacttcagtagtccccctctatggctgcggaacatcgaactcggaatccaatgccaagaaacttcagatgagcctgggaatacctcacaggcaacctccttgcagcttgaatgctatgttaacttctcctcgctcgcggatttcgcatcctagtcagcaactgcatccaagttatttccagacacaatcaagaccatttcattatcagcagttttatggaagttatggtaccaatggattaccttatcttggaggtgcttctatgactagtttctttaatactgtgattgatatgtttggggagatggtcttgacaaggatttttgggatctcagatgcaaatttgtttgcaaaccctcttaatggaagtggaagttctaggatgagaaggcaggaaatgcagattgacaaccaaatttcctataagccagatggagcggtttgtaagaggctgggtgaagaagaattcttagagtaa

SEQ ID NO: 4142 - DNA, 432 bp, Glycine max
  Peptide Sequence Number=SeqID_120920
atggtcgttagcgagactgatggaggaacatctgggtatggtaattatttacccactattcttttagtctgtcattcacctgagtggttgatggacactgaggctaatgttcatgccggcgacactggagccttactgatggggaacggctcttatgcgcgtgttcttggtgttggtatagtcattgtgaagtttagtttaggaaagacggtgctgatgaagaacgtgcagcatgtcctctccatcaaaaagaatctagttagcggctcacagctttacagagatggctacaaaatagtctttgaggccaataaagttatactttcaaagtttggaacttttattggtaaagtcggatttatggcattcacggttttgtcacgcaagttatggttgtcttatgcggttagcaaatctgaatttaattcctaa

SEQ ID NO: 4143 - DNA, 240 bp, Glycine max
  Peptide Sequence Number=SeqID_120921
atggtggttcactccatggcaagcgacctcctcccgatggagatccgttcctacatcaccaatggcatccataacatgttcttgcacttctcctcggacataaccctaatcatcaacgagttcgatgacctcgtcaacaaccaaagctccttgagacttgtgaaaaagcttggacttgtgaaactctctaatatgttttgtacaaaatatgatcaaacacaaaactccttgatatcttga

SEQ ID NO: 4144 - DNA, 438 bp, Glycine max
  Peptide Sequence Number=SeqID_120922
atgttttttgacgggtccttgaacatcaacggtgccggcgctgggatactgttcgtatcacccaacaaggacaaactgcgttacgtccttcggatcctttttccggcgtcaaacaacgtcgccgaatacgaagcatgcttgcatggcataagactagccgtcgagctgggagtcaagcgcctctatgtttatggcaactccgctttggtcatcaaccagctcaacaaggagtgggacgcaacccacgagaagatggatctctactgcaaagaaattcgcaaatgggaaaccaacttctacggcatagagtacatccacgtggtccgggataagaaccaagcagcagatgcgttgtcgaagttaggctcatctcgggcccagatcccgcggggtattttcgtccaggacatccacgagccgagcgtaggctcctccctg

SEQ ID NO: 4145 - DNA, 243 bp, Glycine max
  Peptide Sequence Number=SeqID_120923
atgttgtggcaccgccagtacccgaggaccgttccggcgaccgaggtatccaaggtataccaaggttgcgcgccgcgcccttcgtcgttctcctcaaccatcaccaatacagcgcatggcggctcgattcccggcccggatagtgttcaggcttcgcgggtccggaacgatttattcttccagctaagtgtggggcatgcgttcaacatgaccaagagggccgtcaaacgatcggtcccttaa

SEQ ID NO: 4146 - DNA, 177 bp, Glycine max
  Peptide Sequence Number=SeqID_120924
atgaatttcgtgggtattgggattttgggagatatgatgggtagttctactagaaaactggtagagatgatggggagagttaacctagggttaaatgtgagaatggtagcgatgaaagcttgggaagagcaaatgagaaaaatgagtgacaaatgtgaaagcatgagccatttctag

SEQ ID NO: 4147 - DNA, 882 bp, Glycine max
  Peptide Sequence Number=SeqID_120925
atgtacatgcacatgaacccccaagatggctcctcatcggccaagaaggagaagaaggacttggccctcaaagcttctcacaagggcaaggccaagaagattgaagttgagtcatcaacttcaagtgatgatgatgcatctattgccctcatggtgagaagaaccacaaagatgttgaaaaagctcaacaagaatggagtcaactttgactccaagaagaagaagttcttcacaagtagcaagagaaagcccatctccgagatggatttctacaattgtggtgagcttggccatcttgctcatcaatgtccaaagcccaagaaggacaaatacaagaagaagaaaaaagagcaagatgattcaagtgatgatgagaagaatgaaaagaagccatacaagaagaaaggtggcaagaagaaagagcattacaagaagaagaatggcaaggcttacattgttggtgattggctcacctacattgagagctcaagtggtgactcttccggcaatgagattgatgatgagaaggttgccgccattgccatcgatgctccatcaccatcatcttcaccaccatctacatcctctacacacctatgcctcatggctaagggtgactggaaggtacaaagtgaggatgagagtagtgaaagtgatagtgaatatgaatcaccctcttatgacgaacttgtaaaattgctaaacaaatatacaaaagtcataagaaagactagaagtgaaaatgagaagcttgaacttgaaaatgaaacacttctagcaaagcttaagtctagtgatgagcttagagaccaaaatgagatcatgaccactaagctcaaggagctcaaactctctttaaaagagctcaaagaaaaaccatga

SEQ ID NO: 4148 - DNA, 447 bp, Glycine max
  Peptide Sequence Number=SeqID_120926
atcagggagaataacattaccttgagcggtggatctgcgatagaggaatccatcattggcaaggttgatggatttcagcatcggaacactgtgtggcaccaccctgaacatggtgccaatgagttcgatctgagcctgcatttgggtcaagtcgacggtggtcttgagatcgatcagggggaagttggtgaagacgatgccttttccgatggcggtgggagggtggtgccattggggagcacaacattggaggcggagaccaacaactcgtcatggtcgaacccaacaaagacctcccacgacttgagctcaacgaggccgttgttgagcatcgtcatcgtcgactcgaaccggatacatgtcttcttctatttggattactggtttgctaaaaatagccaaaatttctattgtgcagaatcgtttccaatagttgcattgtgctaa

SEQ ID NO: 4149 - DNA, 237 bp, Glycine max
  Peptide Sequence Number=SeqID_120927
atggggaggagcttgccgcccagcttgccccaggcttccttaggaagtttccggatgcacccccaaattactaagttcacccccctttcgtactttacggaaaattttcaaaaattttacggaagcattacggaagccccagaagccatttttcaacaaaacgggggaggaggttgccgcctagctcgcctaggcaagcttagctcacccaggcgagtttggttgcttccaccataa

SEQ ID NO: 4150 - DNA, 690 bp, Glycine max
  Peptide Sequence Number=SeqID_120928
gaatccttccaaaagataaagacggagtgcgtgaagggcgagattgcccggagcgccacggaggaggccaagaagaaggccctcgaggaccttgaggtggagcgggctcgatctcgcagtctctctgctgacgtcaaccgtctgaagagagcgttgttggagaaagatggagccattgcacaggcgagcaaggtgatcgaggacctgcgcatcaccaacaccgacctggcgcgctcctacaaagggatcgagagggccaacaccgaccttgttggcgagaacaccgctctagaggagaagattcacgggcttaaggatgaactgctagacgtccaagtcgaggcccgttccaccaaggctcagctcgagggggaggttgctttgaacggtcggctgcggactgcgataagcgatctctcagcctcttgggagctcgaccccatggacgagttgagggaggcggctcgaggcgacgcactggtcgatcagctgtgctacctaggtggtgtcccatggcttcgtcaccgacatctccaagaccgaggggagaacgaggagaggcttcacaccttgatcgacgacgcggagactcctggggaaaggctggcgaagttattcgagccggaagtacttcctcccgagactagctcgggcgcggatgacggtggtgagggtcgagacgtagactga

SEQ ID NO: 4151 - DNA, 732 bp, Glycine max
  Peptide Sequence Number=SeqID_120929
atgacctctcttcctagtgttgtgtctcatcttttgcaggactatggagatgtctttccagaagaaacacgggcgggactacctccaattcgtgggattgagcatcaaattgatctcattccaggggctgcactacctaatcgaccaccataccgaaccaatccagaagaaacaaaggagatacaaaggcaagtgcaagaacttcttgataaaggttttgttcgtgaaagtttaagtccttgtgttgttcctgtaattttagtacctaagaaagatggttcttggagaatgtgtgttgattgtagagctataaataacatcactgtttgctattgccatcctatcccacgtttagatgacatgcttgatgaattaagtggttccaccatattcactaaaattgatttgagaagtggataccatcagataagaatgaaaacaggggatgaatggaaaactgcatttaaaacaaaatttgggctgtatgaatgcaagtcttttgaggaacatgtgaatcatattcggcaagtcttagaagagcttagaaaggagaaattatttgctaatcttgagaagtgcagtttttgcacagaccatgttgtgtttcttggctttgttgtttcaggaaaaggcatagaagtggatgaaagtaaggtgaaagccatcaaggatttgcctactccaacgtatttgaatgtgatgctagcggaattggcatacgaggagttttaa

SEQ ID NO: 4152 - DNA, 263 bp, Glycine max
  Peptide Sequence Number=SeqID_120930
ttaaaactccctgagtatgggacggacgctaccggtgcgtcggtgctagcgtcggtgctcaggcagcgtccggtgcctaaccctaagcaccaaacttttccaacggctaaggacctcaccggacgcactcacagagcatccggtgcagcgtccgatgcctacttaggcaccctaacttcgttgaaacgcgatcgttccaaaacgaagttggttcctctcgatctaaggactatctctgagctacctagtgctaggtttaccaa

SEQ ID NO: 4153 - DNA, 417 bp, Glycine max
  Peptide Sequence Number=SeqID_120931
atggagctgaccctggaccagaagaagcagcgcacctgcattattgcgattacaatccacgagtccttcgagacccatgggctcgtcatgcacaaccacaagagccaacagaagagacatggccggagagccaagatcaccagtggacaaacccaccttttcatacgggcaggacgatactccgacgcctcctacgccttcacgaatgactactatcaagaggccggtgctttcttcactcgtaccgacaacaccctcctcgacatccagaacacgcaagcagaacatagaagactcctggaagagcaacaaaaatggaaccaggaccatgccgctgcggtacaagagctgagacaagatacaacaacaatgaacgataacatcacaaccataatgcggttctggaacatcgggtaa

SEQ ID NO: 4154 - DNA, 468 bp, Glycine max
  Peptide Sequence Number=SeqID_120932
gagcgcttggtgacgagaccctggtggggatcgaggcagttgtccctaccagtggaggagaccctgcttggggtggttgggtgtacgagtcccgaggtgtcacgcctttccacggtgccagcagggcagctttcgcagttctgagggacctcatggagaggttccacaggagctggcccacgccttcgctggggtgtttccccgggtccgaggtgaatgctctagagaggagtgcggatgaggaccagcacagtgacagtgcagctatgagtgccatgtacgcgttgatgaagacctatggaggcctggagcgttgtttgggtcgcttgtccgggtctcttctcaccgtccaggatgagaagcgtcagttgcagcgtgagtttgactctgaggttgagaggctacaggcagagttggctcgtgtgaccagagagagagaccaggcagtccagaagaacagcgagctga

SEQ ID NO: 4155 - DNA, 131 bp, Glycine max
  Peptide Sequence Number=SeqID_120933
atggcaatcaacctagaacttaacttatactgggatgtttggataggctgtgatgattcccatggtaaaaggtcagttgctaaagggattgcagactcatggatcgatttagaattttggttttccataag

SEQ ID NO: 4156 - DNA, 612 bp, Glycine max
  Peptide Sequence Number=SeqID_120934
atgtctagaggttctttctttcgcatccgtactgatgaagctagagtgatcctagacagaatcctagaagctgagatggataatacccttcatgatgaaacctacgaagccgaagtagacactctgccaaattcttcatctactttagctatcccaagttctgagccacaagaggaagaaattccaccaccggacttcatgctggatatagaatccgatctttttgccgattttggaaacatttcaaactaccattctattgacaaaccccaaaacggccagtttagcatttatttgccaagtgaatatcaattgagagagcttatctcagtcatgagtagccaatggttggaggaatcagagctttcctctgatgtgatccgtttggacacaccctctataactatacgctgtgcttataattctgatcgatttaatgctctctataatcctgttgtggggatcaacatcatgtctgaatcttttgcacttaaactatttaaaaatcttgtcttaacccccacaacaaaggtcataaaggaatcttcgggacgattagtccccagtcttggaattattaatgtcctacctcttacggtagaaggctccatg

SEQ ID NO: 4157 - DNA, 258 bp, Glycine max
  Peptide Sequence Number=SeqID_120935
atgggaaggggcaaatctgacttatctctttgccgcatccgtgaaatccgagggtgttcaggtggatatggtaactgttcgcacggtaatcaagggattgcgcagatcggcagatggagcaatggtgatcagtctggagggaagttgccgataaaggaggttgccgatgagaaacaatcggatatgaccaagatcagaaggggtggtgtattcgtgccgttgaccaatgatggtgtgccaatgactatggacgggtaa

SEQ ID NO: 4158 - DNA, 527 bp, Glycine max
  Peptide Sequence Number=SeqID_120936
gtctgctgatgactatggcaaggggattgccgatgatgcgaaggaggagtccggaagctgccagttgtcatgtggaggagtttcggagttcgtcgacttaagctcagcgtattctcgagttccgcgtgaatacctcttggccgtgacatccgggcgcatcgctgttgtcgggaccaaagtattcgagttatcacctttgccgatacttttgcatcaacacatcttttggcacgcccggtgggacaagttcaagatcaagatcaacatgtcgactaccgagttcgacttggagaacgtcatccccgtgacagaagccaatctcaaagatgagcagaagcaagctattgcaaaagccatggaggactacaagcagcaatgtttgaaatccttcagcataaacaggagcagcgaggtgatccagaaggaggcactaccgacgcctcggcaggttacttttgacaccaatcctggtaaactccaagacatggttgacagtgctattaaccgtgccttgatcaatcaagctg

SEQ ID NO: 4159 - DNA, 249 bp, Glycine max
  Peptide Sequence Number=SeqID_120937
ttttcttgttactcttggtggttgccaccacctagacagcttgaagcagcggaggaggattggcacgagttggtgattgttcgtggccatctcccggtgattgtgaggggtttgtgcctaccccagcggagagccgaaaggttcttgtggtgtcctagtgaggacgaggttcgtgctacacatcttagccaccgaaccaccaagtgttggtcgacacaacggggacgtagcgtgccggtaagcacgtga

SEQ ID NO: 4160 - DNA, 348 bp, Glycine max
  Peptide Sequence Number=SeqID_120938
atggcatatgagatggacgaagatcaaaatgaagaagaatgtggtgtgaatgaatcacatgttgattgttcggatgcgttcaatatttctcaagtgtttgacaatcgagacgatgttttgcagtgggctcgatccgttgttcatgcaaacggatttgtggcgatcattataaggtttgacacaaacactaatagtagaggaaggactttgtttgtgttaattggttgtgaaaggagtggcaagtataggtgtaggaagaaaaaatttgttagaagagatactaggactaggaaatgtgggtgtcccttcaagcttcatggtaaaccagtggttggaggacaaggttga

SEQ ID NO: 4161 - DNA, 825 bp, Glycine max
  Peptide Sequence Number=SeqID_120939
atgcaagcgacgtcgttctgggtagccaagtttccatttggcgtaagggcgcagcagcacccaaccgtgaagagagactccatggccgagtgcaccgtccccaagtgggcccaaaaaaccgtcagcttgccccctctccggcgcggctgtcatcttgtcacttccaagatagtgaaggaaattgagcaagacctctccggcttcaagtgtggcctagctcatctcttcttgcagcacaccagtgcttctcttaccatcaatgagaattatgactcagatgttcgcgaggataccgaaaccttcctcaatcggatagttcccgaggggtcatctgcgccatggaagcatactctagaggggccagatgacatgccagctcatattaaatcatcgatgtttggttgtacactcacgataccgattacaaatggcaagcttaacatggggacatggcaggcacattcaaggagttcaatcaatgcttccattgtcgatagtgttccaaaagtagttgtctccagcaatgttgttaaatggcagcaccatggcggaatggtgtggtggatttttccagaccgccataggcaatttgtgaagggaggcctgctatgctggtgccataggccgcaatggtgtgtttatatggtggaattttggccttccgctatattctgccatctgtcattgataacactggtctccaagtatatttgctacatgatgcctgaacttaaccgtgcacaactaacaagacatgcattcgttctcgtaagaacagatgaaaaaatgattttcacaggagttgagtgtgttgagtgtgtgtga

SEQ ID NO: 4162 - DNA, 138 bp, Glycine max
  Peptide Sequence Number=SeqID_120940
atgaagctatttcaatgggtgcatcgaaaagttcggcaaaatagtatagatcctttcaaggatttcacacttgatcaagttgatccgcaagagtatatggatcaacttgatccgcaagaagcttacggatcaagttga

SEQ ID NO: 4163 - DNA, 729 bp, Glycine max
  Peptide Sequence Number=SeqID_120941
atgtctaccacaaattccatcactaaacaacacaaattcatcacaatattaacttgttcaaacaaaacaaaattgaaggttgaattagttcttcattggaagacactaaagaatatgagaagcaagttgtcagtgttagaatcggtgtggggttcaagttgggatgctttggtttggggtgaggctaatggggatgctgacgtgaatttgtctcttcttattgtcactgctgcacagggtttggcttggattttgggagggggggttctgaacatctatgttctagtgttgttgcaaatgttgttgtcacaccagccagctcttgcatttttgtgtttggttgcaattaggggtgttacaagtataagggtttgcaggaactctgatcttcaagagccattgcttgtcaatgaggaaccggggtctctcaatgttaatccttatagagatactggactttttagtttggccactctttcttggctgaatccacttctttccattggtgcaaagaaactgctcaagcttaaggacattccacttgttgcaccaagagatagagccaagactagttataaggttttgaattctaattgggagagattgaaggctgaaaatgagaatccctctaagcagccttcgttgacttatttcaagaatagaagaaatgataaattgattatgaggaaaaagctacacaaaactaagtattttcattgtctaaggtaa

SEQ ID NO: 4164 - DNA, 408 bp, Glycine max
  Peptide Sequence Number=SeqID_120942
atgcacgtccgcaatggcgtcaaagcaaagctccaaagaccaacgcatgttgaagaagaagaggacgatgcaagaagaagcacagcgggccaagaagaggtgaagaagcacgaacacgtgagagaagaagcgaggaggcgctgggtgcacgattgggtgagagaagaagaaaagaaattgggctcgaaaatcctaaaatgtcttttgagacacctacaccaaaacccaacactacaatggactaaaacatttttaaccaaaaaacgaccatcatttaccttcgttggcattgcacctagaggccaagggaagtggcgtcgcgcgactgttgcgtgggattgtcgactcagggaagggggtcacaatttggagaaagtgcaagaagcatgtgatgagtgcaaaaagtaa

SEQ ID NO: 4165 - DNA, 291 bp, Glycine max
  Peptide Sequence Number=SeqID_120943
atgtctaacagtcgggcaaatcctattcaaggattatttaaacttaactgtgatggttcctatgtatatgcaacgaatattacatcttgtggagttgtcctttgcaacagcggcaggaaatttattccagctttttctagaagacttggccattgctctatcttggaagtgaaacatggtttgataattgagtctgattgccttaaagctgttcaactattggatgatgttgaccattctggaagccagttttgtgaccttcttgatgagatcattgtgctgaagctttag

SEQ ID NO: 4166 - DNA, 213 bp, Glycine max
  Peptide Sequence Number=SeqID_120944
atgactcaacggtttgctgctttggcttccatagcccaaaaccctgttttagaagttcttcctacctatgactttatactttcccttcctttccaagtggtgaacaaatggtttgctcttcaagcaatgtctgacattcctgataatgttgagaatgtgcgaaaactgttaagcaacccaacatttgataagcacaatttagtgctatgttaa

SEQ ID NO: 4167 - DNA, 195 bp, Glycine max
  Peptide Sequence Number=SeqID_120945
gaaagcagagggaaaaaaagattcaagactttggagaaaaaattgattttgctttggtgggcatgcgctggtgaagtgcagcgtgatgtggttggcgagcggcagagacttaacgatcttggttctagtggcgtcgtcgaggccgaggcagtggagcgcaatgacctcgtggcaagtggtgtcgaagacgcatag

SEQ ID NO: 4168 - DNA, 420 bp, Glycine max
  Peptide Sequence Number=SeqID_120946
atggatgcaagctctgcattgggccttgcactacaagaggagaggtttggattctattatgatgcattttacggggagttgggtctcaatgacgatcactttaagcagattgaggctggagcattgaaggctgttgcggttgagattatcaatgatttgcctgccgacaaaactattacagtatacagatgtggccccttggttgatttgtgtcgtggaccccatatacctaatacatcctttgtcaaagcaattgcgtgcttaaaggcttcatcagcatattggaggggggacaaagatcgggaaagtttacaaagagtttatggcatatcttatcctgatcagaaaagtctaaagcatttatcaatgttcgagctcgctcctctgcactatgctacatgcttactgtggcatttttga

SEQ ID NO: 4169 - DNA, 1035 bp, Glycine max
  Peptide Sequence Number=SeqID_120947
atgtcgtggaccatcaatacagaactagtaagcccccatatcaccatcaatagcaagtcgctgtcacacctggcattggacccttatgcattgttgaattgtcctctaaccaccatgccaccagagcatcactctgccacactgaaatgccttgcactgtcaaccaattaccgttacagcatcactacttgctgccagaatgctgggtgttgtcaagatgtcaaccctttcagcagtataatggcatttgctttaaatgttgctcaggacgatgcacatattttctgcagggagtctcagataaaggatgaagtgaggaacagcttgaatttcatcaattatgtctataagatatttggtttcacatatgagctgaagctttcaacgaggccagaaaaatacctaggagatattgcaacttgggacaaagctgaaagtgctcttaaagaagctttagatgattttggcaagccttggcagttgaatgaaggggatggtgcattctatggaccaaagatagacatcagtgtatctgatgcattgggtaggaaattccagtgtgcaactttgcagcttgacttccagcttcctgatcgttttaagttggaattctcagctgaggatgaagccaaaattgagagacctgtaatgatacacagagccattctaggatctgttgaacgcatgtttgccatacttttagagcactacaagggtaaatggcctttctggctcagtcctcgtcaagcaattgtatgccctgtgtctgaaaagtcacaagcttatgcattacaggtgcgagatcagatccaccaagcagggtattacgttgatgctgatacaactgataggaagattcaaaagaaggtgcgagaagcacaattagcacaatacaactacatcttggttgttggagaggaggaagctaatacaggacaggtgagtgtacgagttagagacttggcagaacataaggttatgagtattgagaagctacttgaacatttcagagacaaagctgcagctttcgaatga

SEQ ID NO: 4170 - DNA, 1523 bp, Glycine max
  Peptide Sequence Number=SeqID_120948
gacgaaatgtaattctttctgaatccggaaaccttaaagtgattaatgatggcgttacaattgctcgatccattgagctttcggatgcaattgagaatgcaggtgccatcctaattcaagaggttgcaagcaaaatgaatgagttggctggtgatggtactagcactgcaattattttggctcgggccatgattgagtctggactactagcagttgcttttggggctaatcctatttctttgaagaaggggatggaaaagactgtaaaggagttggtcaagttcttgaaggagagaagtgttcctgttgaaggaagggagcatattagagctgtagcatcgatttctgctggaaatgacgagtatgttggtaacttgattgctgaagctatggagaagattggttcagatggggtgatctctattgagtcttcctcatcatctgaaacctctgtgataattgaagaagggatgaagttcgataagggttacatgtctcctcactttattacaaaccaggagaagtccattgtagagtttgactgggttaaagttttggtaactgatcaaaagatttcaaatgtcaaagaaatagttcctttgctggaaaaggctatgcagttgagtgttccactcttaattattgcagaggatatcacaaggcaagtgttggagaccttagtggtgaacaaaatgcaaggattactaagagttgctgttgtaaaatgtccaggatttggaggtgcaaagaaagctttgttacaagatattgcccttatgactggagctgattttctttctggagacttgggtctcacacttgatggtgccacatcggaccagcttggcactgcactgaaagtgacaataaccagtaatgcgacaactatcattgctgatcctagtatgaaggctgaaattcaggctagaatttcacagataaagaaggatcttagtgaaacagataatgcaaacctgtcaagaaagctctcagagagaattgcaaaactctctggtggtatagctgttataaaggtaggtgcacatactgaagtagaacttgaagataggaaacttagaattgatgatgcaaagaatgcaacatttgctgccataagcgagggaattgttcctggagggggtgccacatatgtccacctattggacttgataccaacaataatgaactccatggaagatctagaggagcaaattggtgctgatattgtagcaaaggcactccttgaacctgcaaaatcaattgcaactaatgcgggagttgatggagacattgttgtccagaagattagaacacatgattggagaattggatataatgcaatgacaggcacatatgaagatcttttgaatgctggagtagcggatcctagtcgtgttgcaaggtgtgctcttcaaagtgcagtttctgttgctggtgcagttctaactactcaagctatattggtggataaaataaagaaaaccaagccacctgtacccttggtccctggcataactccctag

SEQ ID NO: 4171 - DNA, 420 bp, Glycine max
  Peptide Sequence Number=SeqID_120949
atgagttcctcggataagcttgatgaggctctgcttcgcctctctaaccataaaaccctccttggtgaatccatgaataccctcactcagaagattgacgaccttctgactcgggtcacccccatgttttcgtctccttctagctcatacacaccacccccaccacctgtacctacacaaagccataaaatgaagcttgaggttccacgctttgatggcacaaaatctcttggttggattttcaaaatcaaccaattttttgaataccacagaacaccagagaatgaacgacttaccattgcgtcattttacatggaagggcgcgcgctttcatggtttcaatggacgacggtcaacggccagttcacgtcgtggatcgtgttcctccaagctctccagacacgattcgccccatcctaa

SEQ ID NO: 4172 - DNA, 303 bp, Glycine max
  Peptide Sequence Number=SeqID_120950
atggatgtagaagaagtatatggtggagagagtagcgatgggagaatgagtaggcaaaggattgaccagaaagtgatgaaggcaatgacctttcaacacagcggtgttgcaaccactggagtcaccgtcgaagtgaacaaaggaactgccattgaaatgaaaggagggacttctgtcggaatgaatggaggcatcgctgtcaatgtgatcagtggatccgctgttggagtgaacggaggaactgttgtcgtcgtcggagtagctgaggaatcgctgacaccgtcggaatcagcaccggaatag

(The sequence listing continues in the following parts.)

What is claimed is:

1. A recombinant DNA construct comprising an exogenous promoter that is functional in a plant cell and that is operably linked to a polynucleotide, wherein said polynucleotide encodes an RNA molecule capable of binding to an RNA encoding a polypeptide having at least 90% identity to SEQ ID NO: 147,670, and wherein said RNA molecule suppresses the expression of said polypeptide.

2. A transgenic plant or seed comprising a transgene having a promoter that is functional in a plant cell and operably linked to a polynucleotide, wherein said polynucleotide is transcribed into an RNA molecule capable of binding to an RNA encoding a polypeptide that is at least 90% identical to SEQ ID NO: 147,670, and wherein said RNA molecule suppresses the expression of said polypeptide.

3. The plant or seed of claim 2 further comprising DNA expressing a protein that provides tolerance from exposure to an herbicide comprising an agent applied at levels that are lethal to a wild type of said plant.

4. The plant or seed of claim 3, wherein the agent of said herbicide is a glyphosate, dicamba, or glufosinate compound.

5. A transgenic seed comprising the recombinant DNA construct of claim 1.

6. The transgenic seed of claim 5, wherein said transgenic seed is from corn, soybean, cotton, canola, alfalfa, wheat, rice, sugarcane, or sugar beet.

7. A transgenic pollen grain comprising a haploid derivative of a plant cell nucleus having a chromosome comprising the recombinant DNA construct of claim 1.

8. A method for manufacturing non-natural, transgenic seed comprising a stably-integrated, recombinant DNA construct of claim 1, said method comprising:
    (a) screening a population of plants for said recombinant DNA;
    (b) selecting from said population one or more plants that comprise said recombinant DNA, and
    (c) collecting seed from selected plant from step b.

9. The method of claim 8 wherein said method for manufacturing said transgenic seed further comprises:
    (a) verifying that said recombinant DNA is stably integrated in said selected plants, and
    (b) analyzing a tissue of said selected plant to determine the expression or suppression of a polypeptide having at least 90% identity to SEQ ID NO: 147,670.

10. The method of claim 9 wherein said seed is corn, soybean, cotton, canola, alfalfa, wheat, rice, sugarcane, or sugar beet seed.

11. A recombinant DNA construct comprising an exogenous promoter that is functional in a plant cell and operably linked to a polynucleotide encoding a microRNA, wherein said microRNA is capable of binding to a polynucleotide encoding a polypeptide having at least 90% identity to SEQ ID NO: 147,670, and wherein said microRNA suppresses the expression of said polypeptide.

12. A transgenic plant or seed comprising the recombinant DNA construct of claim 11.

13. The transgenic plant or seed of claim 12, wherein said transgenic plant or seed is from corn, soybean, cotton, canola, alfalfa, wheat, rice, sugarcane, or sugar beet.

14. The transgenic plant or seed of claim 12, further comprising DNA expressing a protein that provides tolerance from exposure to an herbicide comprising an agent applied at levels that are lethal to a wild type of said plant.

15. The transgenic plant or seed of claim 2, wherein said recombinant DNA construct encodes a double-stranded RNA, an antisense RNA, or a microRNA.

16. The transgenic plant or seed of claim 12, wherein said microRNA has at least 95% identity to a sequence, or complement thereof, of a fragment of at least 20, 21, or 22 consecutive nucleotides of SEQ ID NO: 30,892.

17. The transgenic plant or seed of claim 12, wherein said microRNA suppresses the expression of an endogenous polypeptide comprising a sequence set forth in SEQ ID NO: 147,670.

18. The transgenic plant or seed of claim 2, wherein said RNA molecule suppresses the expression of an endogenous polypeptide comprising a sequence set forth in SEQ ID NO: 147,670.

19. The transgenic seed of claim 5, wherein said transgenic seed is a soybean seed.

20. The transgenic plant or seed of claim 12, wherein said transgenic plant or seed is soybean.

21. A transgenic soybean plant or seed, wherein said transgene reduces the expression or activity of a polypeptide having at least 90% identity to SEQ ID NO: 147,670.

22. The transgenic soybean plant or seed of claim 21, wherein said transgenic plant or seed comprises an insertion mutation in an endogenous locus encoding said polypeptide having at least 90% identity to SEQ ID NO: 147,670.

23. The soybean plant or seed of claim 22, wherein said insertion mutation is created by a transposable element or T-DNA.

* * * * *